United States Patent 7,750,207 (ZEA MAYS RIBULOSE BISPHOSPHATE CARBOXYLASE ACTIVASE PROMOTER) - sequence listing, part 8

SEQ ID NO: 10224 - DNA, 5356 bp, Zea mays
  misc_feature (4684)..(4684): n is a, c, g, or t
gtgtcttaaaacagcgctcgaaaaattaaaatactacatcattttatatgtttaggggaaccaaattgagctccaacaattaagccttaaatcgtatttttttagaaagtaaactatattattataaaaaatgttattgaacactaatctgatgtgtatattttagtcatggtgtgtcttatgtttttttacaaaaaatgtaaaatgtaataatgttggagttgttttttataagcatgtatttaaagatagatctctatatctgcctatttcattgggtacctcgaggccggccgggaaaccgctcgcggcacgccccgccatcagacgctcgcctttccctcgccgcatcacggtgtctgttcctcccatcccatctcactgcctcataacactcccgtatcccacgccatacgcccaagaggccaagaccgagccgcctggatctgattgggttggctctcgtcgcgggggcgaaggggaaggggaggaagaaccaggaggcgtgcgttctcgtccaagatgctgcagctgctgatggcgctggccttctcggcggccccgctgacgctgtacgtgccgccggtgcgcagcctcagcctcttcgtggaggccatggaggccgtctgccgcgactgcgggccctactcccacggcgccgtcgcccgcttccgcctcggcttctcccgcgtcctcgccggcctagcgcgcgccctccgctaggcaggccggcaccccatcgccggcgccggttcctcctgcctacaggagtatatacagtatactacacggacacgcacgttcggtgaccttgtgctctccctggtttctatgtcctttttgtattactagcgaggaagtggtttctagcgcagcacagcaatctacatgcaggagcaggactagcggcggtcagtttcgagatctttcctgcttcgtttctccctttttgtgctctctctttcttttctgttttttttttgaggattgggtgtagcatgtagagtgaggaaaggttaataaatctgtccaaaaagggagattttgcaagagatgctgagtaaatctagtgtgcttgcttgcctggggttatgggatgtgagggacgactccccctccccctaggaatttccatgtgatttgtgaatattcccttgtctgtaacttggcaatgattcttcagtttaagttgaggatttgcggtttaaattcatcgtcttcctttccgatccaatgcttccctccaagtcacgatcgacaagttgggatgggaacggaactcctgttcccctctgtttgtttgggccaggcacccaacctccgtgcttgaaagttcttctgtgcggtttctatgacaccaaaccgacaaagcaaaagatttggttacattaaatggcacagagcgaccgacgcgacgcgacgcgacgtccttgcgaagctcgatcgctcctcgcgaaaacacaggcagcaagcatagtcgaggaagaagacgacgcgcggggcgggcgggggcagcgaatgatttggttacattacagctccagttctatagtagcaatgcgagtgatgctgtgatggcgacctttcgccgacgatgactacagtagcataattcttaaagtgctttccgtaaccatcgcttagcggtgcgtccagcgtgcctagcggctagcgccgttggcttggcaccagaagagatcagttggtcagacggcgaccgtttcccggtccccacgcaatggtaggctggcagtggtgagcgtatccagaaaatggtgtcagggagatcacagtctttgtcagaggaatagaccgtacgattatactattcctcttgttgtgttggacatggacctggacctggacgcacacatcaccaaaatcgttttcttgctgcgttcgcatggaacggaagcacccacacaccggcgtgtaccgcgtgcgacctccctcgacctcgagctctcgttcgatggacccgttgacttgcagtggcggtggcggaagggcgaaatgggttccttccgagtggcatccgcgtgaacctataaaacgcgctccgtcccccggatcagattcagatctagggtgtagtgtagtacggtacatctgtcgcgcggtcctgtgctgacaagtacacgtcgcaccgacgccaagtttccgacaactcgctccgcttcagtcaagaagatcgaaacgtcaaaaagggattaagtactgatgaacaaatccagtggcacaatcacgcaccgatattatcgtcaaaattcacaatacaatatcttaccactatcatacaacgtcacgatttccctgtattagttttaatgaagtgccactgactactactgaatccagatcattccactcaggagaggacgtgcccaaactattgtgttgctttcccgcgagatcgtaaaatcactgtcaacagttaattcagatcaaccctatccacgcacgaagcttcatcgttcctctgcaacacgagcgcaccaagtcatgccatattccactatatcatccttccaagaaggacctggagtttccaactgggggtatatatcggtagattctagaagacccctcatccttcgatttccagggcctgcgatacggttgattgatgaattgatttgaagggggcagctggcggagctaggagaaggttacggcaccaatctgtcaggcaactttgatttcctcctgttgttcaggtttcacgatatgttccaggttcacgattcttattggcttccctaagctcgacttgtccgccaactttgcgatttcgagtgcccttgagcagacagggaagctcatcttgtcccatgaatccaaaattatgcctgaccccaggcatacattttcactatagaacgctgcaaactgaccagctgccaagccctggtcatcttcagccagatgcaccaccaaagcatccccattttcttcactacgctcttttaccaaagtgcaatcatgaaattcagggctatgtcgcacctgatgttcagaaattttatattagcacagaaacaaaagataagtttgcacaggaaaacactgcagatctcaacgtataaaactaaaatcttgaactagaaagcagcggctgcaatcctcacaaaatactgtagcgagctgcagcagcagccatgctagaagccagccgaacagcttccacatggattaggtataccgtataaggggatgctgaactggattaggtataagcatcccacgtctgatagagccagatgaactggacacccagtaatgcagggaattgctacacgataaagtagtggctgttctggcttctacggatcttgaagactttgtatgttgtttctgaaatatggtgtttgaattcatcgatacatggaaatagcctcccgtgaggcattgtctgattctacctctaattaagctcatgtttggttccatccagataatcattatctgctaaactttagatacctttgaaccaaccaagccagctaatagattagataaactttagctagagaccagaatccattatctcactatcttctcagccccagataatagcagctaatactgagggattgacccatatacccatggttttcacttttcactggtatcatcaaatcaaaagggtactcatgtcattttgtttctattagctaatttgttatctacgtaaccaaacatcctaccactagctaaactttagctagctaatacttccagctaaacttgatgagtggaaccaaacagggcctaagagggaaaccatggtctggttgtctgagaggaaattgatctctgacagctgtattgtgtgcaccaactttgccacaggagaggacttcagcttcggcctcaagaactgagctggttctcactctcgcagagacaaattgcgtgggatgagtggaccagagagttgggtatgaagaacccaagtcctgtttttgtttgaaaatatagcagcccccttcaacccatacgtattgaaagggattgagatggaaacttagttcactttccactccaatccatatgggttgggtttatccaaacataagtgggagatggggatagatgaggcatttgctggaagtggcaaggattgttggaaccggaccaccgacatatagcgtgtctgtagggtcgcccacatacacggtgcgcccacctaagccgtcgggtcacgacacacgcgctcgaacgcatagcagcgggctttaggtctgttgggccaacactcccccctcccccaaaagctagcccattagggattgcaccctcatctatgtcaaattccaataaaattgcataggagtgatttgctttcatagattgtaaaaattgctgatcgacttactggttggaaggcaagtcccatgaatttggcaggaagggatactatggtctattttgttttataggcaatcccaacatatttgctaattgccatcaatgagggatgttgtctagtggcttggaagaaagttatttgaccattgcaccttggtagtattggcattcacaatctacaagtaatggactgggctttgcaatcgagctggctttcgctacaaaattcctctggcaattgcaatacaacctcaagtctgagcaatcttcgctatctcagttgttactcaggttggcaatggctagaacactnatttggactgataattggctactcggatgctatttatcagattttgcccatgatttggtttcttgtgtgccaagacgtgtgtgtgaacaataagatggtcactggaatgggtctgctaaacaggcctgggttaaaagacatccctcataggttgtgttactgagttatatgtgtaaccacctgagtcgctttcagcgagatgcaatggctgcaggcatgtgtccaagatgctcagtggcatgtctaggacagccggcctttggggtgtttctcagcctgcacacgaaaagtttcttcttaatgcaatgctgcagggacggtcttcttaatgcagtatgtttaaatttgggatctttcgaagaggtgtctctttctgaagatgaggatcagctttcttgccggcctgaaggaaatggtgttttctcttctaaatacagttgcaaagcattcttctatggtgctatatagtctttaagccttggagtttccgaaaccttgggcgccatccaagtgcaaggtattattaggcttgcacttagaaacaactgctgcactgctaacagattaactaaaaagggtctccctcatccagagaactgagagaagtgtgttctatgtgatcaagaggaagagacagtgcaacatattctgactaattgttttattctccgc

SEQ ID NO: 10225 - DNA, 2024 bp, Zea mays
ttttttttttttttttggcacaatcacgcaccgatattatcgtcaaaattcacaatacaatatcttaccactatcatacaacgtcacgatttccctgtattagttttaatgaagtgccactgactactactgaatccagatcattccactcaggagaggacgtgcccaaactattgtgttgctttcccgcgagatcgtaaaatcactgtcaacagttaattcagatcaaccatatccacgcacgaagcttcatcgttcctctgcaacacgaagtcatgccatattccactatgtcatccttccaagaaggacctggagtttccaactgggggtatatatcggtagattctggaagacccctcatccttcgatttccagggcctgcgatacggttgattgatgaattgatttgaagggggcagctggcggagttaggagaaggctacggcaccaatctgtcaggcaactttgatttcctcctgttgttcaggtttcacgatatgttccaggttcacgattcttattggcttccctaagctcgacttgtccgccaactttgcgatttcgagtgcccttgagcagacagggaagctcatcttgtcccatgaatccaaaatgatgcctgaccccaggcatacattttcactatagaacgctgcaaactgaccagctgccaagccctggtcatcttcagccagatgcaccactaaagcatccccattttcttcactacgctcttttaccaaagtgcaatcatgaaattcagggctatgtcgcaccttgcatttgagttgctcattgtttccaggtccaaaattatcaaaccagtttagtgatccaacacgaaatgtgcgcctccgcttatccaatgaataataattccttgatacaaaaaccacattgttttgaacatctttctctacaacgtaccaaggtcctccaggaagccgtaatccttgccgctgaccaattgtataaaaccaaaacccacggtgtatccctaggtaatctccggactcagcttccagtatgattccttccttttctcctatatgtctttcaacaaactcactaaacttgacctttccaagaaagcatatcccttgtgagtctttcctaccttggttaggaagggccatttgagtagccagtctgcgaacctcatcctttgtaatacatcctagtgggaaaagaagccttctaagctgagattgagatagatgtgagaggaaataggtttgatccttgatcttgtcctttgataattgtagtacggatggcgcttcggtattttcagcggaaggatgtactacgtgtgcatagtgtcctgaagctatgtagtcaaatcctaaattttcaatggcttctaagaaagacccgaattttattctcgtgttgcacagaacatcgggatttggtgtacgaccacagcgatactcattgatcatatgtgataccacatggttccagtattcatcggataggtggaccacctccaatggcacatcaatcttgtcacaaacagcttgtgcatacttcaaatcctcgtcccatgggcactcggaccagaaattcctgaaatcttcctggaaccaaatcttcaggtagaacgcggtgcagcgatggccggcggcgtggaggaggcgaagcgccacgctgctatccaccccgccgctcaccagcaccgccacccgcaacggtgctatgcctgccgccgcgcaccgggtaaggtgcttgtccaacgcaacctcctcccccttcaccacggcgctgggcgcgccggcggcgggcgaggacgagagcgtgcagaacggccacggctgaaggcgtgagcggggcaggggtttatggtttagcagagagccacggcggagaagcggacggagggcggggagggtggagacgacgacgcgcaccatattggggggagcgcctcgccggccgcgtagcgcttctcgcgatactggattggggacagtcgagtcgttttttcgattaggatgttctaggtaatggtctcgtgc

SEQ ID NO: 10226 - DNA, 1934 bp, Zea mays
attgggtacctcgaggccggccggcggcgcacctcgcggccccgcccgctctcgcgtacataaacgacggagaaaaggacacaacccagcccgccctaaaaccctcccaccatcatgtcgctctccacactcagccacccggccgccgccgccgccgggagcggaaaatcccttttcccggctggcccggcggcgcagtccgtacatttccccaaggcacggctccctgtccccgccgccgtctccgccgctactgcggctgttcacgcggaggatagggtttcgtcgctgactcaagtctccggcgtgctggggtcgcagtggggcgacgagggaaagggcaagctcgtcgacgtgctcgccccccgcttcgacatagtcgcgcgttgccaggggggagcgaacgctggacataccatctacaactcagaaggcaagaagtttgctctgcatcttgttccatctggtattctccatgaagggacactgtgtgttgttggcaatggagcagtgatccatgttccagggttctttggagaaattgatggtcttgagtccaatggagtccgctgcgatggaaggatactggtatccgaccgggcacatctgctgtttgatctgcaccaggctgtggatggacttagggaagcagagcttgaaaattcatttatagggacaactaagagaggcattggtccttgttactccagcaaggtaactcgaaatggactgcgggtttgtgatttacgacacatggacacttttggggataagcttgacatcttattcaaagacgctgcttcgagatttcaaggctttcagtacagcaaaagcttgctcaaggaagaggttgagagatacaagaagtttgctgatcgcttggagcccttcattgctgataccgtgcatgtgctaaatgaatctatcaagcagaagaagaaaatcctggtcgaaggcggccaagcaactatgctggatattgattttggcacttatccatttgtgacttcttctagcccttcagctggcgggatatgcacaggcctagggattgctccaagggcaattggcgacctgattggagtggtcaaagcttacacatctagagtcggctctggccctttcccaactgaactatttggagaggaaggtgatcgccttaggaaagctggaatggaatttggcacaacaacaggtcgcccaaggcgttgcggctggcttgacattgttgcgcttaagcacagctgccaaatcaatgggttctcatcacttaatctgaccaaactggatgttctgtccgggttgtcagaaattaaggtgggtgtttcttatacccagactgatggacagaagctgcaatccttccctggggatcttgatacccttgagcaagtacaggtcaactatgaggttctgcctgggtggcaaagtgacatttcttctgttcgaagatacgatgaacttccccaagctgcccgcctctatgtggagaggatagaagaacttgttggtgttcccgtgcactacattggtgttggacctggcagagatgctctcatatacaagtaaaagcaactttatttggtccttggttgggcggaaacctggccgggactcgggagcatttgcattttcttggcgtggtagcttttgatacggtgaagtcactgactcgtggagtgatgttgctcaataatcagaaccttgttctaatacagccgctgagacatcagctaaggcgaataagggaaggatgagtcatttgcaccatgtttgaccaccaattgttaggtggtccatatattttgtactaattgtgagactttgtgctatggatctcaactgtataccttgctggtgcatggctttgggtttacatggttgaaaatgagattggtgtactaattgtctaaaaaaaaaaaaaaaaaaaaaaa

SEQ ID NO: 10227 - DNA, 1889 bp, Zea mays
ctctcgcgtacataaacgacggagaaaaggacacaacccagcccgccctaaaaccctcgcaccaccacgcccccctccgcgcacgcccgcccggccgccgccgccgccgggagcaggaaaatccctttttccggctggcccagcggcgcagtccgtacatttccccaaggcacggccccctgtccccgccgccgtctccgccgcgactgcggctgttcacgcggaggatagggtttcgtcgctgactcaagtctccggcgtgctggggtcgcagtggggcgacgagggaaagggcaagctcgtcgacgtgctcgccccccgcttcgacatagtcgcgcgttgccaggagggagcgaacgctggacggggagcgaacgctggacatactatctacaactcagaaggcaagaaatttgctctgcatcttgttccatctggtattctccatgaagggacactgtgtgttgttggcaatggagcagtgatccatgttccagggttctttggagaaattgatggtcttgagtccaatggagtccgctgcgatggaaggatactggtatccgaccgggcacatctgctgtttgatctgcaccaggctgtggatggacttagggaagcagagcttgaaaattcatttatagggacaactaagagaggcattggtccttgttactccagcaaggtaactcgaaatggactgcgggtttgtgatttacgacacatggacacttttggggataagcttgacatcttattcaaagacgctgcttcgagatttcaaggctttcagtacagcaaaagcttgctcaaggaagaggttgagagatacaagaagtttgctgatcgcttggagcccttcattgctgataccgtgcatgtgctaaatgaatctatcaagcagaagaagaaaatcctggtcgaaggcggccaagcaactatgctggatattgattttggcacttatccatttgtgacttcttctagcccttcagctggcgggatatgcacaggcctagggattgctccaagggcaattggcgacctgattggagtggtcaaagcttacacatctagagttggctctggccctttcccaactgaactatttggagaggaaggtgatcgccttaggaaagctggaatggaatttggcacaacaacaggtcgcccaaggcgttgcggctggcttgacattgttgcgcttaagcacagctgccaaatcaatgggttctcatcacttaatctgaccaaactggatgttctgtccgggttgtcagaaattaaggtgggtgtttcttatacccagactgatggacagaagctgcaatccttccctggggatcttgatacccttgagcaagtacaggtcaactatgaggttctgcctgggtggcaaagtgacatttcttctgttcgaagatacgatgaacttccccaagctgcccgcctctatgtggagaggatagaagaacttgttggtgttcccgtgcactacattggtgttggacctggcagagatgctctcatatacaagtaaaagcaactttatttggtccttggttgggtggaaaccaggccgggactcgggagcatttgctttttcttggcgtggtagcttttgatacggtgaagtcactgactcgtggagtgatgttgctcaataatcattaatcagaaccttgtcctaatacagccgctgagacatcagctaaggcgaataagggaaggatgagtcatttgcaccatgtttgaccaccaattgttaggtggtccatatattttgtactaattgcgagactttgtgctatggatctcaactgtataccttgctggtgcatggctttgggtttacatggttgaaaatgagattggtgtactaattgtct

SEQ ID NO: 10228 - DNA, 844 bp, Zea mays
  misc_feature (798)..(798): n is a, c, g, or t
acaacaaggtaaaacataacagaaggcccaaatgttgggtaaacgcacgcggccgcacgaggctgacatgcgtgcgagtcgacgggttcagaaacctgagatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccacacgagttctatcgggtaaagccaatgattagaggcatcgggggcgcaacgccctcgacctattctcaaactttaaataggtaggacggcgcggctgcttcggtgagccgtgccacggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgagcgaacttgcccaccatatatcatgaaacagtcgccgcccccaggcccgngcgcgaagcccggcgagcgccgtcgtgcagacttggtgtagtagca

SEQ ID NO: 10229 - DNA, 2982 bp, Zea mays
gtatttgggtatggatattgatttttcatatcccgttttaaaaatatccacggatatcaagtgctacccgtatccgtatccatgggtacaaactcgtacccaaaaccgtgcccaacgggttttttatccgcgggtacgcggataaatcacatccattgccatccctactcacggttcacaccatgaattcttattcttcagcaatctgttgttgcacgcttacttacatatgggcttccgaggcatcattcaaggccacatcccctgctgccttgtcgcaggttagcactgtcagcttcttcttttcaatggttccctcttatttatgcaaaaaaatgccaggctccacttgctgataccataccatgctttcgagggcttggatgtgaactctttaccatctttcaggttattcacgcgatttcccaagcctgctatggccgtgcatccgcactggaaacagccgcggagagctcttcaatcctggaaccagaaagtgcatcagcttgtagcacattagaatccctttgggatatggtgcctggatctcgcagcggacagtcgttcgtctcgtctttacagaagaaggatgattcaagcaaaagacaaggtggtgggaatttcagcatcatagatgctctgattgtgctactggttgctctgatagctggattgctattcacattctctgctggttccaatacctgcacaattcattggttactgttgtaccaccagtagatttttttttttttttttggagaacacacatcatcattgcacatatcggtttacatacaatccaatcgaatgttaatacaactcgtctcttatactgtctaggaacaatctgagctccctcgctttcctctcgtgttctggagactgactgctgctgccagcctcacaatccttcttaccattccttctactattatcgactttaactggtgatggagaagagaggtcgatcatggcagcttctactacttccctactctgcgcatcgcctctccgtgaagaatcagcttcgcctgccatcccagtcccatgcctgaacaatggtgactcttccacctgcacatttgttccaggttcatgcttgcaacaggagggttctttctcgaccaaattgcttatatcccaaagggctcttctttctgcctccatacacagtggtggtgcttctggagcagcctggggtttatgagcagcacaaggcgagggtgatgacagatcaattggctcaagacccagtgccgaatttgactccatcgatccaatctgcagactttggtgctgcagatgaatcccatccattgttactgtgtctgaatcactcaactttctggacctggcaatcttacaagatcgtataggtggtgatggagaagatagatcaacaaattcctggagcggtgcaaccatctgtatagctgctgtctgagggccattggccgtacatggaaagctaccactttcagattcaattccaagtagcaattcttggagctgcgcatccacgtcttttacggcagcttgaccagatttctttggcctagctctcctcttttgtttcttctgagcatccttgctttccaaaaattcagttattttttctgggcaagcacttctaacaagttcccctggaacaactgaaacttggagcccatctatgtttctccatgaaacctcataatattcacttccttgaacttttcgctgcttcacaatcgccagtacaggacacggtacaggaatctcattcagcgaaggtttcattcctagatctgaagacgtggagcggagatttgaaaatcttcgaagttctctctcagcaatctttggaaggatatattcatcagttttcacagggctccacgcaaagtattgctcgtatatctgatggagttgtgaacgaagaaatggccgctggctgcatgccctctgcacagcttctgaatctggtgaatgacattttggctccagatatgcatttattatgtcacgaaattgactaccagaatcttggttaatcccaacctcacaggtacttgcttttgggcacgttccaccaaccgtccctgcattggcgccactgccttttcctttacattttcttgcaggtttaactccatcggacaaaatttgaccaagaacggtgtcatcccctaaagacttaacaaggcggcatgctgcttctgggccaaagccatggactccattagaatagtcactaccaagaaggactgcaagtgatatcagtgagttcctgccgaaaccaagcttattctgaatgtcttccatttcatagcaaattacataaccaccctctcctatgaaaacatctctataaaatgtctttgcaccaaacaagaatgaatctgaatccgatgtaaaacagccatcacacaaggaagaaaaattaagcaatgcacactgtgcttcggcttcttccatgccatccaagcaagggatgccaagggccaacccgagatgcttggcttctttgatcatgcgtgagaactctgagctcttgttccgacgcaaagaagtcagaggttgtgagttggcctcctctcgagtagcctcagcagcatttaatcccagtcggcgcctataagtagccaatttgactgaaggaatcgccccatctgagacgaaaatgaggctgcagttgagggcgatgagggctcggatgcggtggaagaggttcttgaggtacaccttgtccctgaggaaggccggggagcggttggcgctgcagaactgcacgagccagcaggaaagatccacgcacaccttcttgttctggaggtgctggagcgggagcttcttcttgcaggagtcaaggatgtcccagaggttcttcacccccatcgccgccgctgcagctggaggttgcctgagccggggaagacgagaagcctctaacggaaaacagcactgtcggagggtcgcggattcccagacccggccggc

SEQ ID NO: 10230 - DNA, 2034 bp, Zea mays
cccgtctctcgccgctagctttccctttcccttgcgctcctccttcactcctcaccctccccgcaggccgcggctcggcaagcaagcaacaacccccgccactcccctccctcaccaccatggcgtcgggcggctgcgctctcgcgccgaggccatgacttggcgccgcccgtggccgtggctctccgtcttctccctctccccgcgacgacaacccctcctcctccctgggcggcggcggcggctctagctagctagctagatggcgtcggcgatggtggtgttcgggggcggcaaggaccggccgtcgcctggcggcggtggggcgccgcaggtggacgcgggcaagtacgtgcgctacacccccgagcaggtcgaggcgctcgagcgagtctacggcgagtgccccaagcccagcagttttaagaacatttagccagaggcttagcaggggtttcaatgatgctgtcaatgggtttccagatgatggttggtcactgatgagcagtgacggtgctgaggatgttactattgctatcaactcttctccaaacaaacttattggtcctcatgtcaactcctcccagctgtttaccgcaattggaggaggcatcctgtgtgctaaggcatcaatgctgcttcacctcgtgcccccccccccccgggtacggtttctgagggagcatcgctccgaatgggctgatcctggtgttgatgcttattccgctgctgctttgagggctagtccatatgcagttcctggtttgcgtgctagtgggtttacgggcagccaggttattctgccgcttgcacataccttagagcacgaggagttcttagaggttattaggcttgagggacacagcctctgccatgatgaagttgttctgtcacgagatatgtatcttctgcagctgtgcagtggcgtggatgaaaatgcagctggtgcatgtgccagcttgtctttgcacccatcgatgaatcttttgctgacgatgcaccactgctgccctcaggcttccgtgtcattccactagatgcaaagacggatgcaccgtcaggcacacgcacgcttgacctagcatctactctcgaggttggatctggtgggactactcgcgcttcaaccgatgcctccagcgcctgcaacacaagatcggtgctgaccatcgctttccagttctcatacgagaatcacctacgagaaagcgtcgcagcgatggccaggcaatatgtcaggactgtggtggcatcggtgcagagggtggccatggcaatagctccttcccgtcttggtggacagcttgagatgaagcaaactcctggttctcctgaggcgcacacgcttgcgaggtggatcggcaggagctacaggtttcacactggagcagaactgcttcgcacagacacccaatgcacggatgcttccttgaaagcactgtggcagcactcggactcgatcatgtgctgttccctgaaggctgctcccgtgttcaccttcgcgaaccaagccggcctcgacatgctcgagacgacgctgatcgctctccaggacatctccctcgagaagatccttgacgacgatggcaggaaggcgctctgcaccgagtaccctaagttgatgcagcagggtttcgcgtacctccccggcggtgtgtgcgtgtcgagcatggggcggccggtgtcgtacgagcaggccgtggcgtggaaggtcctgagcgacgacgacacgccgcactgcctcgccttcatgttcgtcaactggtccttcgtgtgagtgagaggaccgcccccctagcagagccagtcgcgcgcgcccgcctagcatttgcagctgttatttgttgaactctgtatccaagtactggtcgtttttgcctttgtcgaggcaaccctgtgaaacgcacctgccccccagtaacccagttcatcccgtggaacaaacaccttttgtagttgcttgcttggtatgttatgatggatcctggtctgctgcatctcctaaaaaaaaaaaaaaaaaaaaacgcccgcccg

SEQ ID NO: 10231 - DNA, 977 bp, Zea mays
cttgggaaagatgaaaaggactttgaaaagagagtcaaagagtgcttgaaattgccgggagggaagcggatgggggctggcgacgcgcaccggccgtatgcggaacggctcctgctggtccgccgatcggctcggggcgtggaccgttgtcgcccgcgccggcggccaaagcccgggggccctaggcgcccccggcagccgtcgtcggcgcggacggtatccgcgcgcctctggcgcgcccctcggggcgctgcgccgcaacggcctgcgagctccccatccgacccgtcttgaaacacggaccaaggagtctgacatgcgtgcgagtcgacgggttcagaaacctgagatgcgcaaggaagctgacgagcgggaggccctcacgggccgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccacacgagttctatcgggtaaagccaatgattagaggcatcgggggcgcaacgccctcgacctattctcaaactttaaataggtaggacggcgcggctgcttcggtgagccgtgccacggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaatggatgccgaaaaatggatgggcgct

SEQ ID NO: 10232 - DNA, 3192 bp, Zea mays
gaggccggccgggctctcccatccccgtctcgccgctagctttccctttccccccgctgctcctcccctccgtcctcctcctcacccgccccgcgcgccgcgcggctcggcaggcagccaagcaagcaacagctgcacaaccccccagcaccgccgccactcctctctctctctcgtctctctctctctctctctctctctctcgcaccaccaccatggcgtcgggcggctgcgctctcgccccgaggctatgactcggcgccgcccgtggccgtggctctccgtcttctccgtctccccgcgacgacgacaacccctcctcctccgactccgactcctccctgggcggcggtgctagccagatgtcgacggcgctggcggtggtcgggggcggcaaggaccggccgtcgcccggcggcggcggcggcgccgcaggtggacacgggcaagtacgtgcgctacacccccgagcaggtcgaggcgctcgagcgcgtctacagcgagtgccccaaacccagctcgctgcgcaggcagcagctcatcagggagtgccccatactcagcaacatcgagcccaagcagatcaaggtctggttccagaaccgcagatgccgcgagaagcagcggaaggaggcctcgcgcctgcagactgtgaaccggaagctgactgcgatgaacaagctgttgatggaggagaatgacaggctgcagaagcaggtctcccgactcgtgtacgagaatggatacatgcgacagcagctccacaatccttctgctgcgactacagacacgagctgcgagtctgtggtcacaagtggtcagcaccaccaacagcaaaacccagcagctccgcgtcctcagcgggacgcgaacaacccagctggtctactagctattgctgaggagaccttggcagagttcctgtcgaaagcaacaggaactgctgtcgattgggtgcatcgggtcgggatgaagcctggtccggattccattggaatcatcgctgtttcgcacaattgtagtggcgtagcagcccgagcttgcggcctagtgagccttgagcccacaaaggtcgcggagatcctcaaggatcgcccttcttggtaccgcgattgtcggtgtgtggatattctccatgttatccctacgggtaatggtggaactatcgagcttatctacatgcagacttacgcaccgacaactttggcggcaccgcgcgacttttggactctccgatacactagtggtcttgaggatggcagtcttgtgatctgtgagagatcactgacacaatcgactggaggcccatcaggacccaacactccaaattttgtaagagccgaagtgcttcctagtggctatctaattcgaccctgtgagggaggtggctccatgattcacattgtggatcatgttgatttagatgcttggagtgtgcctgaggtccttagaccactttatgaatccccaaagattcttgcacagaaaacaactattgctgcactgcgtcacattaggcaaattgcgcatgaatcgagtggggaaatgcccctatgagggggccgacagccagcagttttgagaacatttagccagaggcttagcaggggtttcaatgatgctgtcaatgggtttccagatgacggttggtcactgatgagcagtgacggtgctgaggatgttactattgctatcaactcttctccaaacaaacttattggtcctcatgtcaactcttcccagctgtttactgcgatcggaggtggcatcctgtgtgctaaggcatcaatgctgcttcagaatgtgccacctgccctactagtacgatttctgagggagcatcgctccgaatgggctgatcctggtgttgatgcttattctgccgctgctctgagggctagtccatatgcagttcctggcttgcgtgctagtgggtttatgggcagccaggttattctgccgcttgcacataccttagagcatgaagagttcttggaggttattaggcttgagggacacagcctctgccatgacgaagttgttctgtcacgagatatgtatcttctgcagttgtgcagcggtgtggatgaaaatgcagctggtgcatgtgcacagcttgtgtttgcacccatcgatgaatcttttgccgacgatgcgccactgctaccctcaggcttccgtgtcattccactggatgcaaagacggatccaccatcaggcacacgcacacttgaccttgcatctaccctcgaggttggatctggtgggacaacgcgtgcttcgagtgacgcctccagcacctgcaacacaagatcagtgctgaccattgctttccagttctcatatgaaaatcacctacgagagagcgtcgcagccatggccaggcaatacgtcaggaccgtggtggcatcggtgcagagggtagccatggcaatagctccttcgcgcattggtggacagcttgaaatgaagcaaactccaggatctcctgaggcacacacgctggcaaggtggatcggcaggagctacaggttccacactggagccgaactcctccgcacggacacccaatgcacggatgcttccttgaaagcgctgtggcaacactcggactcgatcatgtgctgttccctgaaggctgctcccgtgttcacctttgccaaccaagccggcctggacatgctggagacgacgctgattgctctccaggacatctcccttgagaagatccttgacgacgatggcaggaaggcgctctgcaccgagtaccctaagattatgcaacagggcttcgcgtacctccccggtggcgtgtgtgtgtcgagcatggggcggccggtgtcgtacgagcaggcggtggcgtggaaggtcctgagcgacgacgacaccccgcactgccttgccttcatgttcgtgaactggtccttcgtgtgagaacccggtccccctagtagtagagccaagttgcctagcgtttgcggctctgttgtttgaactctgtaccccatgtaccgtcgcttttgcctgtgtccaggcaacctatgaaacacacctttgtagttgttcatcacccccgtggaacaaacagctttgtactagttgttcgtcttcgcttgcttgctatcttatgatggatcctggtttgctcctgaaaaagaaaaagtgactggaccaaaaaaaactcgagggggg

SEQ ID NO: 10233 - DNA, 6547 bp, Zea mays
  misc_feature (4565)..(4565): n is a, c, g, or t
  misc_feature (6147)..(6147): n is a, c, g, or t
  misc_feature (6368)..(6368): n is a, c, g, or t
ttgggaccctcgaggccggccggggtcgcacaaattcgcgtccgcttcgtggtgcccgcccagccccaaccctcgtggtcggcgggccctccaggcccggccgggagaaaaacttcttgtccgccccggctccaggctgcaagtctgcaaccccccatccacccgcgaagtctcccaccaccgcgccgatccgggggcgggcggcgggggcggcctcttgctctctactccacccactcgcggcctcacccgtggatctacgcggtggccggcgggcgcgatggcggaggcggagcgggagcagcgcccgctgccggaggtagagcaatctgtcacgtccataccggaagatcatggagccacatgttggggctgtgggcttcggcttgtctttgcgagctactcacctatctacaagtgtggctggtgtggagccgtcacgcagagcaacaaccagactgcaaggaaacctgatagtatatggttttcccactggaggcgcctacgggacagactcttcgtggctgtgctcgtcctcttcatgctcttcgttatatgtggtggggtctgggcggtatatcctgttgttttctcagtcagcaagttctgtggcgtatttcactgcacggtagcagctgtgttggctgtatgcaccgtcacaagctattgcttggcctctttgaaatgtgcaggcgcaccaacagacataaggtggggcagctatcccgtggttgggaaaggggatcttgagaactataccttttgtacatactgtagcaaaccaaagccccccagagcacatcactgccggtcgtgtaaaatgtgcgtggtggacatggatcatcattgcccatttattggcaactgcgtgggagcatcaaaccatcaagtgtttgtggtttttctcatttctgtggttatcagttgctcttatgtcgctgggatgaccatatacgcgagctaccagatatggccctccattgaattcccagacctagcatcatcatctcgtcactcgatgagttcttggaaaacggtgctggagatgatcactacggttgcaggctccgccttcttcttgtcagccaggggtctagtcctggtgtatctggcgtttgctagctcgtcagtgaatgctggtatagctgtgtcgcgctcggtacccctgagctatatctacgaagggaacacgtacctcagccgtctgagctcagcaccgaatgccttgcagcatggagagaggggtttgcagaacatcgttcggtttttcgggtgcccgtatccagtctccagagctgtgttgcgactgcggtactccaacgctgccaagttgcaggatgattcagggtcgaaacttctttagagaggtatggatcaatagatcagtcaaaatcctctgttttttttatgttccttcttataaatcagtcatggtgtaacagacagtttcgtttacattacatgtcggtttcagtgctatactctcgattaagacgccgtttcgagtcgagacagttctgttctgttactcggaaattgtgatttgtgaacctcactcagttgaccaccggcagatttgtctgaataactgaagccgttttaggatgcagcactcatgacaacccgtgttcgatctggaggaaggattagttgttcatgaggacgccactcgcattgattaggtagagcaattttggcagatgctgaaatacggtgtggcctgcgcattcattgcctgcagacaataataaggtgctgatggtcttgcaacagactgcagcacctgaaattctgcatcaccatcactgccctttccaactcagcagagcttgaagatggcagcagcttcatccacagggggatcctccagaagaaatgatcatcatgattaaatctgacagtagtggcttcgagagtgatgctaggatgttggagagaaaaaaaatgtgtcccgccatacctctttgatgttaattcactgacatgtatatatacgatcggaaacgttgtaacgttcacttgatgtaaattattagtcgattaatcatgcacgtgtccgttccgtggtatggattgcatggcgaatggaagaaggagacgagatgatcgatcgatggatcggacagctgctgggcacgtattattaggtacgtgtccgtccggcacatggtttccttgcatcgcaagcgagactgattggccgtcattcatttgcccccgttgtcgcctccacccgtcctgatcctgacgcgacgaacacacatgacctgacagatcgacgacctgagagagcgatcgaggcaagagatccatccaccaggcaagaaaatccaggtgattcgttgaagtgtaggcgccctctgctgcccgtccgcgccgcgccgcggcgttcattcgccggcagtggcgtggcgcaaactgtatactgctcctacgccgacgaatcttggtatttagcgctcagattcgccgcgtcgctgctgctactacagtctacatccgtagcgaaagttgcacagcctgcacttgcactgtccagggcgagagccgacgacgagactctcatctgcagatagggagaggcccgcgcgcgcatctttacagctcaaagattcacgaacgccacatgcatgcatgccgacgccgtccccctctggctggccggccgatggatggatcggcttcattcagatccaacagaaatccgctttccgatcgggcgccgccgtgaattggcccgctcgatcgatcgtatcgtaccgctgccgctgccggcagctatttcccggcccctttcatgctagctcatgcagtgccgcctttgtgtgcctcttcgtcgtcctgctcctctctgctggctgctctgttggtgccgtgcacttgccgccagtcatgcgctgcagggctggagctgccgccagtaaaactaaattaactccttttacaggtagatccgtacgtagatagatgatgccaagacagaacatgcaacaggccgctgttgatggtactggtagccaccctggccaagcagcaagcgctgatgaagaaggccaaacaaacacacaaacaaaaccggagcaggacatatgtacacgtacgcgcttggatttgcatcgccattggccacccgcgcggccaatggccatcattcacctctctctctttccgctccggcggcggcgacaaatcgacaaggatatcctggcagcaaagcaggctttgtttactggaccaatcatcatcacatggcgaatgttgttgcgcgcggggtgtcgtcgtatatgtatgtatggccgtgacagcgacggccacccactgccactggggaggggaggggagtggtggtggtgggtggggagaggactgatgactgatgaggagccggtgcaggtggctaactggcacggcagtgtgcaaagtattcaccggacctctcacctcatggcggcaatggcagattacacagcgtacttccttccccatgtagaaaaaaaaggccctgtttcaacagtgggctcctttacttgcccttgccctcccctcatcactctgtctgtcactcatcatcatcatcatagaagagaagagaagagaagagtccatgtccgtccggcggcccatgcatttccctggaagtaggcgtggtccagaccttctataaattcagcgcctactaggagggtggtacctgccttgccttgcatccgcacagggctttcactgtcctgtcctgccggttggtcatcccatttccatccccatcggacgactctggggatgcgtagcagacgcttgtgtttcaggaaatggtacgtgaagagtttttttatttttatttttttgcagcaaacatatggccatgagaccatgacgaagaaagccaaggcaggaggaggcattcgagacggccttgtccgatagccaccggagcggggcggggcgggcggcacatggacagcgaggccaagctttgtttttttttaaaaaaaaaaccatcttggacaactggagcaagcgaacaaagccatctgtttttttaatcgcttttggaagaatggaaggagcatgtgtgccttcctgtcctgtcctgcctgcctgctgctcgtgcatgctcgatgtctaccgtctgctgcgcggtggccatcagtcatggcgatcgacgccgagctggctgattccatcgataataatgcgcggggatgccggccgggtttttaatccgggtcgcggcctgcccggaaccctaccctagctcgccaaaagcaagcgtatataggggctcagcagtcagcagcaacagctctcagggaggcaaaggcaggacaagcaagcagtagaggtgcaggtgcccgatgtgatcagtaggttaggtggatagatccatgcagagctggcatggcctagcccggccggtacggtactgcagttgcttcgtctctgtccggcctctagtacctcactacatagtagtacggagcaagcagcagtatccctttcgttttttacgaggataaaagaaagaacaaacagcaggctgctactccttgggcgagagatagagngagagagagagggtgcggatcggagtgccggccggcagggcaggcgcacggaaatggagggcctggcagcctccgtccgtccgccatgagcccatgcccatccagcatccatgggcaggcagcaccagcagagggtgtggtcagaagagaggaccgagagagagagagagtaccggcccgtgcctctgcagtctggcactctggctgctgccgctgccgctgccgcaccacccgccagcccggttgggtggttacttgccgcaactagcagctatttatatgccccagcctctgtgggccgtttgcactcactccaaagcaaagcaaatctctctctctctctccatctctccacacacagccccttcgctgccgaggtccctcgccggacggggggtgaaggacgaaggggaagaaaggtgcgcgggcatgctttccacaggctttcttgaactgtgaactcgtgggcgtggtggtggtggtgctggtgctgggtgtgtgggacggaatgattggctcctcccagtcccagtcccagtcccacccaccaattctcttccccccgaccggccgtgaattgaattgaatcgaatcgcatcgctgagcttccccccggctcgctcacgcgacctgttgatggttcaagaaagcccatggaaaccatgcagcctccctcctgtgcagctgtgctctggtggcggagaattccgccggttccgggtgagggaattcagcagaccagccaccccgatgcggattcgtgtgtggaggaggtgagttgtgtgtctcagatcgcttcccgtgttgttgtgggggttgaattctggtaggggacggtctcctggccttttgtttcggtgcgggtttcttgtgctagcttggatgtgaattttcgctgaagcagatgtcttgaggctttttctgtcttgcagagttgcagttgcagcgacgactccaactccaacgaggggatccacgcctggactgttctgttccaacgaggggatccaactccaactcagcggcaggcagctagctgtcctgttcgaaattcaaaacccggccagatccgtgcttgcgctgctcgccggggctgctttgtccactcaggccatcgatctccagttccatgtatgctccaattttgttcttgttttttttaaaacaaactcagttccagtacctgagcatgagtcacagcttggtttaggcgtgtggtggcgtttgctgggcagatcagttattactcctccactccacaccactgcaccggccggcaccgctggtaacgcacgcaggtaggcggccaaggccatgccaatgtcatgcagcgggattgatccatgcgtcgtccattggcgccctgccctcggctagctgcggctgtgctggaaagagatctggtggccgaggaggaggagaaggcgaggacgaggacgagggacagaaaagcagcaaaaggctcttgtggttggcatgcctacaaccaacgtcccaaccaggagcctgaaaaataatccccggcataaagccatgtgacaggcgacagcgatgccatctgatccgttccgttcggttcccnccagcaaaccgtggtgaaaatcacgcggcccccgctctgccatctacccctgcacgagtacgacggtacggcggctgctcctgcaccctgcactgcaggccttctgcaacgcgggaggcgggaggggatttcgcgcgattcccgagggtgaggcaagaatatatggggtatgtttgattttacttttggctttgctttttaccctctaaaaatcaaaagtnaaacctctaaaaatcaaaagtcaaatcaaatggctgcattcagaaatcatctttttctaaaagcacatttggacatgcttttagtggcttttaaatggaacatgtgaaaatatatatcgaaaaacttttaacgacttttagtagttttcaccgaacgatttttagctttttaacagctc

SEQ ID NO: 10234 - DNA, 1477 bp, Zea mays
ccccctcggagtcgacccacgcgtccgccctcgtggtcgttggaaacctattcgcagggaaaaaaaaagaaaaaaacattcgtgtcctccccggctccaggctgcaagtctgcaaccccccatccagccgcgaagtctcccaccaccgcgccgatccgggggcggggggcgggggcctcgtgctctgctctctactccacccactcgcggcctcacccgtggatctacgcggtggccggcgggcgcgatggcggaggcggagcgggagcagcgtccgcttccggaggtggagcaatctgtcacgtccataccggaagatcatgaagcaacatgttggggctgtgggcttcggcttgtatttgcgagctactcacctatctacaagtgtggctggtgtggagccgtcacgcagagcaacagtcagactgcaaggaaacctgatagtatatggttttcccactggaggcgcctacgggacagactctttgtggctgtgctcgtcctcttcatgctcttcgttatatgtggtggggtctgggcagtatatcctgttgttttctcagtaagcaagttctgtggcgtatttcactgcacggtagcagctgtgttggctgtgtgcaccgtcacaagctattgcttggcctctttgaaatgtgcaggcgcgccaacagacataaggtggggcagctatcccgtggttgggaaaggggatcttgagaactataccttttgtacatactgtaacaaaccaaagccccccagagcacatcactgccggtcgtgtaaaatgtgcgtggtggacatggatcatcattgcccatttattgggcaactgcgtgggagcatcaaaccatcaagtgtttgtggtttttctcatttctgtggttatcagttgctcttatgtcgctgggatgaccatatacgcgagctaccagatatggccctccattgaattcccagacctagcatcatcatctcgtcactcgatgagttcttggaaaacggtgctggagatgatcactacggttgcaggctccgccttcttcttgtcagccaggggtctagtcctggtgtatctggcgtttgctagctcgtcagtgaatgctggtatagctgtgttgctgtgccagcagctgagctatatctaccaaggaaacacgtacctcaaccgtctgagctcagcaccgaatgccttgcagcatggagagaggggtttgcagaacatcgttcggtttttcgggtgcccgtatccagtctccagagttgtgttgcgactgcggtactccaacgctgccaagttgcaggatgattcagggtcgaaacttctttagagaggtatggatcaatagagagtcaaatcctctgtttttttatttatgttccttcttataatcagtcatgatgtaacagataatttcgtttacattacatgtcggtttcagtgctatactctcgattaacaaaaaaaaaaaaaaaa

SEQ ID NO: 10235 - DNA, 3363 bp, Zea mays
atgagagaacccctcctaggctcctactctctccctagtccccgcgacggcacaagcccccccccccccgcccggcctgcctccagagcctgcagaccccgacgccgctcgcgttcgggaccgtaccgccctcccctgccgtatccgcccacacaccctccctccccgccgcttccgcccggtatcccccactcgcgcggccgtaggacacggccacgtgcgccgcctcaaactgggggctgtggctggggcgggaggagcggcggcgttagggtttccccatggacggtggcgaggatcggacgttcaaggcgaactttaccagcgagggggtgacgatgctgcaggaccgcgtcaaggagaagctcagtgagctcatgggcgactactccgacgacactcttgccgagtatgttgtagtattgctaaggaacgggaggcacaaggatgaggctgcaaaggagctacatgtttttttaggcgatgacaatgatgcatttgtatcctggttgtgggatcatctgtcctcaaatttgcacctttatgttcaacctaaagctgcctcttctaaggatgacactagaagcagtcacaatgctgccagaggattgcctgttcacagtgtgataagcagcacacaagttaatcatgaacctgaagctgaaacccagaagacagtgataactcataaaaaaaaagattggggtcatcgaaaaagagattggggaacaatcggtcgaggtcaatcagaaacagttcctcttagaagcgttgtcgacaatgtttctcttgcaaaggaaaaggatcttcatgagtcacatgcagatgaaaaggcttttcataaatcacattctgtaagacgaacccgctctcctgacatgcataaccacagaaagaggagcagagaggcagatgtgcggtctactaagagtgcaacacacccagttaatggtgcaccacgtcggcttcttcagtttgctgttcgtgatgctgtcagaactgtgcccccagttacttctggttcagaatcagcttccaagcgactttgttctgtagtggcacgagaccattacctagaacatcctaatcgaaaacatattaggttacagaaaacaaattcagatttgagaataccagttgccacagcagcactaagagctgcagctgaggctgctgaagatgttctcaaggatagcttttgtggaagtgtttttagtagattgggcagaatgcccacaataaattctactgaacaatcacctgatcgtagatcacaagatcttgaaggcaaagaatatgagaatatagataacatacaagctgaaaatcaagttgaattttatggaagaaatcaacatggtggcagtgacgtttacatgcgtgatcggagaacagaggaagccacaggttctctttctaatattgatgagtatggtcacaacagttctgttaggtataatggattgggttctctccgaagtgcattgcctgctagtggaggtaaagagtcattagtactggggtacgtaagaggagcttctgaagtacgaagcggaagattgatagctcaggggccacctgctggttcaggaccaagatcatctgaaaaggtcctaaatgtttctggtaacactaacacacagaagcttcgaactcatgtaactagggatgcccttgcatttgaccctcaagtgccaatggagaaggtttctggtgcaaggaagtcgataggtcagggggcacttactggttcaggaccaagaccatctgaaaggattctaaatgtttctggtaacactaacacacagaagcttccaactcatgtaactagggatgcccttgcatttgaccctcaagtgccaatggagaaggttgctgatgcaaggaaatcacatgtgaagattgcacatgctaacgatatgtccatgacaactgataagttcaaagatttgatacagtcaagttcaatgctggaggcacaaaaggctacatcagctgctggatcaaatactacaggtcaacccgaaggtggctctgattctaaaactgtctttgttagcaacgtacattttggtgcaacaaaagatgctctttctcgtcacttcaataagtttggagcgatcttgaagacccatattgtgaccgatggtgtcactggtcagtcaactggctcagcgtatattgagttcttgcacaaagaatcagcagagcaggcgttaaccctgaacggggcatcatttatgttacgcattttgaaggtcgttcggaaaaactccactgaagcaacccgatcgcctggcttgcttcgtgtttcgcggggatcaccatttgcttcaaggctcattagaactgcatacccaaggccaacgtttcctggtgcaatccgtggacgactgccactcaggggtgttgcccagagcttacagtggaagcgcagtgccacagattcctcaaatgctgtaaaaccaagtcaggctgcaccttcagctcctgggaatcagttggtcaccccgaccccacgaagcttcacctacacacgcacggagccaaaaccaaatgacggtgcgatggcttgactgctcagctgcagcatgccgcagctcctgatgaatctcgcagaaagagttcgtgatactgttacgtggttcattcagctgcttttggtaaatatttaagtagctgcagatgttagtttgtagcaggctggtttttgtggaccaaaacctttgagcgatattctgtgaggttttctgtgctgtttttcaccgtcagcacatattctgtgctggctggctgttcggagttcgtggatggagagtaaaatatatatataaaaagtggtagtaagggaaaacacggacgcgataaaaacgttgcaacatttgttattatttttcgatggattatttagcctccacagtttccttgtcaaggggggtgatctgtgattctgtgagattgatcataatatccaaactaccggatggtcttgctgtctcagttttgtaaatagaaaaaccttcacctgtggggtatggttgcctactgcacgtctgcacattagcaagtgatggtgcgtgtttcgactcaaatgtttttttgcatcctgtcttgtgtagaaaaagaaaactgaagacctgtctgttctgggtgtctgctgtatctattttctcagagagaagtgcattttatcttggtatcagcgggactcacgggtggctgaagtccaagtactgttcgcattcaccattgagccatgaaaatcatgtgattggagaatcagaagaggacagcagctctgtggtagcccctaatctatcaatgtcgccctgcgtacttcgtcaaataatacaataacagggg

SEQ ID NO: 10236 - DNA, 1093 bp, Zea mays
ctccgtcttggcgcacccggcacccccttatccggactccggaagactctaatccccgctccccaccacggtgccaccgttcccgtgcgtcgctgcaccaccaccgtagcctcctcctctcacccggacgcggccgagccagaatggttagcgagcaacaagctcctgcggcggaggtggtggtggagggcagcgaggcggcggcggaggtgcccgtggagagcgaggaggcggccgcgcccaaggcggaggagcaactggatgacgaggcgccggtcgtcgaggacgtcaaggaagacgaggacgaggatgaggacgacgacgacgacgacgacgctgacgatgatgacgccgatggaggcgccggcgcaaccgagggcaccaagcagagccggagcgagaagaagagccgcaaggccatgatgaagctcggaatgaaacccgtcaccggcgtcaccaggataaccatcaaaagagccaagaacatactgttcgtggtgtcgaagccggacgtcttcaagagcccgacgtcggagacgtacgtgatattcggcgaggccaagatagaggacctgagctcccagctgcaggcgcaggccgcgcagcagttcaggatgcaggacctcagcaaggtgatggccaagcaggacgcggccgccgccgcggcggcgccggccgacgaggaggaggaggtcgacgaggccgggatagagccccgcgacatcgacctcgtcatgacgcaggccagcgtcacccgcgccaaggccgtcaaggctctcaaggcgcacgacggcgacatcgtcagcgccatcatggagctcacggcctgatcatgatataccagtgcaatgccgtacggccgtttcttcctcgttattgcagtctgcttcgtccagcgtcgctgttcatttttgggatttgcataaaagacgagctttgaataagagatgtactgtttgttcaccgtatgaacgtttttgcatcatgtcagtttccggattattattattgccactccttaagttgttatgattaaaaaaaaaaaaaaagggcggcgctcgcgatagaacccacgcgtccgcccacgcgtccg

SEQ ID NO: 10237 - DNA, 3739 bp, Zea mays
ccttgcgggccccatggtccagcctttgatggaggtttttcaggctttcagctcccaatagcttcccttttccttttcgtcgctcactggctgtctcgctctcacacagaagcagcaggcggtgttgtacgtcatcggtcagtcaacgctggaccaacccaaacccaagagaaggggcaccagaaacacctcaacaaaatcgtgagcagccttggggtctccctgaagtctgaaccacactcaacaaaacccatggtagtttcagaacaaacaaacaaacatggaagccatgggcgagcacacccagcgctcaaaatcctagagagggggaggaacatctcttcttcttcttccttcccctcctactcgagccggtggaggtcagcggggattgaggaggaggaggggaagaggcgaggcaggaaatcaagcgggaatccaagaaccgtaaggatgaccgtggtggagaggaggtacggtccctgtaccagccatggttccttcctcctacggctgctgctgctgccgcccttcttcttcctctgcttcatcgatgtgccgccggccggcgccgccgccaccacacagtcgcctccactagacaacacgcaaaaggctatcatgaacgatgttgcgagtctggtgaactccggatccgccaacaccaggtggaacaccgcggagtcgaatccgtgcaactgggaaggaatcacctgcacaagtaacacttcttcctcggccgtgactcggatcgccttgtcaaactatggcctcgccaactcctccatctttgctcccctctgccgtcttggcactctgcggtaccttgacctttccagaaattttttagcagatttgtccgccccgttcttcgcctcttcttcttcttcttgctccatgaaggaagggctgcagtcacttaacctgagcaccaaccggctggctagcccgctcggtgagttggccggcttcccccagctacaagttcttgacctgtccttcaattcctttgccagcagaaatctgagtgcggaattgggttatttccccaagttaaggagcttcaacactagttccaatgacttgaatggtgatgttcctaccagtatggtcggctctttggaggagctggtattgtctagtaataatttgagtggtccaattcctctgcgtttgtttgaatatgaaaatcttactctgctagatctcagccagaataatctgaccggtgctattccagataacttcacgagtctctccaagcttgagactttgctcctttctggcaacaaattgattggggaaataccatcgagtctgtctaatgtgacaacactgtctaggtttgcagctaaccagaacggtttaactggacccatccatagctggattaccaagcatatagggatgttggatttgagttacaacaagctgaatgggacaatcccctcagacttcctctcgcatcaggggttgcagagtgttgatcttaccagcaacttgcttaacggagccattcctgccaccttgtctcaaagcctctaccgcttgaggcttggtgggaaccagcttggtgagaacatcccagggtcagtttgtgataccatgggcttgacttatcttgagttggatgacaaccaattgacaggagttataccttcagagcttagcaaatgcaagaacttgacactgttgaatctggcatcaaatcgtttgcatggtttagtgcccagtattaccggtgaacttgacaaactggtagttctgaagcttcaaaataacaccctcactggacaggttccaagtacattttctgaattaaagagcctaatcacattgaatctcagtaagaattcactcagtggagcgataccaagcggaattttcgagttgccaaagctttcgaacttgtatttgcagggtaaccagtttagcggttttattccgttctccatcagttcatcaaaggatctaatcgagctcaacctgggtgataatgctctgactggtaacatcccaaccatgccaaccactgtgaccacatctcttctgaatcttagtcataaccttcttgacgggtctattccttcaaacatcaactctttaggtgaactagagattcttgatctttctcacaatgccctgtctggtgctgtgccatcttcactatggagcctgcaaagcttgacactgctggacctttcctataataatctgtctgggtctattcctagattcggtccaagtcaaactgtagatattgtcggaaatcctggtcttgtaattgtaaatggtacaggaaacaataatgacactcctactactggtaagaaaaagaggcactatttggtcgtcatcatcttcaccattgccggtacacttgttggattatgtgtgcttgttcttattattgtgatgtcattatcaaagagagtgtatcgtgttgaagatgaaggattaccagctggagaatctgtaccacaaataatcagtggtcgcctcataactatgaacagcatccacacctctgcagttgacttcgtgaaggcaatagaagcagtctccaaccatcagaacatctttttgaagaccagattctgcacctactacaaggctgtaatgcctaatggctcaacatactctgtaaaaaaacttaattctagtgacaagattttccaaattgggagccaggagaagttttctcatgaaattgaggttctagggaaactgaccaattcgaatgtcatggttccattggcctacatcttgactgcagattgtgcctacctaatctatgagcatgcatacaatggcactgtatctgatttgctacatggtggaaaatcagaagttatagactggccgtcacgatatagcgttgctttgggggtggcccaagggctgacatttcttcatgggtgcactcagccggttttgcttcttgatctgtcaacaaggaccatccacttgaagtcaaaaaatgagcctcagattggagatatcgagctttacaagattattgacccttccaggagtacgggaagcttttcaaccattgctggaacagttggttatattccaccagaatatgcatacactatgaggctgacgatggctggcaacgtctatagctttggagtcattttgcttgagctgctgacaggaaaaaaatcggtcagtaatggcactgagttagccaagtgggctctcagtctttcaggcaggcctgatgaaagggagcagatccttgacaccagggtctcaggaacttcaattgctgttcatagccagatgctgtcggtcctgaacattgctctctcttgtgttgcattctctccggacgcacggccaaagatgcgcaacgtcttgaggatgctcttcaatgcaaagtgaatcagaagcagcctgcaatcatatcatagataaattttgggtgcagttccagcctcgcgtagtttatggatgtcagtgataagtatacaggctgcccttatatagttccataggagatagaaccctagcttatagtagatcattatatgttttatgaattgtgtaattaggtatctgctttgcagtgagtggctatatggtttataagctgtcaaaaaaaaaaaaacttataagcaaagttgggtattgttctcataggtagggctaggaaaaaaaagctcgagctcgatgagccggcttgcgctcgtgggggcttggctcgtagcggctcgacgcttagaatgag

SEQ ID NO: 10238 - DNA, 2064 bp, Zea mays
tgcatacggtgtttccaaagagttgggaattggtgattctgtcaccaagcttcactgtgatatgtctgatgcggtcaatatcctcacacatactgatgaaataaaactcaaagcaaaaaggattgccgcggtggaaaagaagaagcggcgtttaggaatcccacgcgtccgtatctaccaaggaagcaagtggaggccttcaacggtgtgcagattatgttggtatgccaacagctcccagtgaatctaacaaggagccaaggcctgaagagtgtgtaaatgaactgggcattaaacaaccagtacagcatgttgcttccgaggagcaggaaggagttcaagatgatgccaaggcagatgcaaatgttatgaatgtttcttttggtaagggaaaatcagaagattcttttggcacaattaatggtaccaacagtggagataaaatagaatctcctagtggtttagcagaaagaacattgactcagcctaccactaagggttgcagtaagcagcgtggccgtagttctaatggtagaggaaacaggactaaaaaaatagaagaggggaatgcgtctggactaattgctgtggctcccgagtcagaagatgatgatgatgatgccgcatttatagatggaaaccaagcagagggtggtgcactgtgggatatttttcgacgggaagatgtgagcaaactgcatgattatctaatgaagcatgctcatgagtttagacattgcaactttgagccagtgaagcaggttactcatcctatacatgatcagtgtttttatctaacaattgagcacaagagaaagctatgaagaatatggagtcgagccttggacatttgaacagaagctaggtgaggcagtatttatcccggcaggatgtccccaccaggttagaaatttgaagtcttgcataaaggttgcactagattttgtttctccggaaaatgtccgagagtgcatcaggttaacagaaggtttccgtctgctgccgaagtggcataaggtgaatgaagataaactcgaggttaagaagatagctcttcatgcattcaatcaagctattaaagatatcactgatgaatcatctaatagcaatgaaagcaaatggatccggagatagtgaggatcatgaaggccattgaatccatgcttgatgtcatggaagttagaacaacctgcattcgacatcttgctatcgagaacctgaatgaaaaccgtagtggcttatcggatgccgacaagataacaaaacctgattttagtgtattatgcatgatattagtaccttatataatacgtagcttggagaaaaggccattcaccgtttctcattgttgggaggttctaaagaatgaagccaaatggttacacttggagcagggctcacaaaatattgatgtgctggtgaacaaaggtgtagggttttctccaagatgtcggatttgacactgaagaagattgagtattggaagaggtccgattgaacatttggcactgacattcaccaacttgttcaaatagaggaaaaggatatggaaatggagaaagagcgcatgtatgcatgtgtaggtcagggagtggctcggatcagccttgagtcaatttccactgcgttttcttcggttatggatgagcacgaggagtaaaagaaacagaagaaggctgagtgtgattctcatatgcttattttcttgtcctgtgtaatggatgtgtgtatgtgaaccatatgcgaacttaaacgtctttgtttgtaccggtcaggccattctgagtgagggttccgtctcttctttttaggactccactgcgaggtgtcggtgtgtgagaaatggtgcaaacaagtttctgagaaatggtgcaaacgtgtgtatgaaactctacgaggcatactcttacctagtattgtgtctagtgaaaaatgggacacatccgatgctactgtaaactcacttgttgcactccctttttgagttggatttttctttccaactttttcgtataaaggcttgagtttatctaacactagatttcataaaaaaaaaaaaaaaaa

SEQ ID NO: 10239 - DNA, 2199 bp, Zea mays
tctggaattgaatgtatcatgctgtcaccgaaatgaaatcaaattgtgggttcatcttagttttattctttctagagatttttagggggttttgaatgcactaaaactaatagttagttggctaaaaattattagtggaattagctaactaacaactaactaactaactattaattaatttactaaaaatagttaatagttgaactattagctaggggtgtttggatgtctcaactaattttagtggctaactattagttttagtgcattcaaacagccccttagtttgtaacgacccttgtgctgctgggaccattaagacaacaacaataatgcctttttaatcccgagcaagttaataggctagttttcaaacctaaaaagaagccacaaatcaagtttcaggcttgtggatcgttgttttccatttgctccttttgaaagataaatctttggatattgttttattgcctcttcccatgtcaatttcgatcttccactttctctctttccattactattgcgccttaggatccccgaggggatctttgttggatatgtccaaatcatcccaattggtgttggataaatttttctttggttgcctgaatattcaacaaggatcggagatagtgtaaagaagccgcgataattttgtaatttttggactagtgtcaacaaaatcaatgatcaataatttacttgtatgtagcaaatggatccggagataatgaggatcatgaaggccattgaatccatgcttgatgtcatggaagttagcaccacccgcattcgacatcttgctatcgagaacctgaatgaaaaccgtagtggcttatcggatgccgacaagataacaaaacctgattttagtgtactatgcatgatattagtaccttatataatacgtagcttggagaaaaggccattcagcccgtgtctcattgttgggaggttctaaagaatgaagccaaatggttacacttggagcagggctcacaaaatattgatgtgctggtgaacaaaggtgtagggttttctccaagatgtcggatttgacactgaagaagattgagtattggaagaggtccgattgaacatttggcactgacattcaccaacttgttcaaatagaggaaaagaatatggaaatggagaaagagcgcatgtatgcatgtgtaggtcagggagtggctcggatcagccttgagtcaatttccactgcgttttcttcggttatggatgagcacgaggagtaaaagaaacagaagaaggctgagtgtgattctcatatgcttattttcttgtcctgtgtaatggatgtgtgtatgtgaaccatatgcgaacttaaacgtctttgtttgtaccggtcaggccattctgagtgagggttccgtctcttctttttaggactccactgcgaggtgtcggtgtgtgagaaatggtgcaaacgtgtgtatgaaactctacgaggcatactcttatctagtattgtgtctagtgaagaatgggacacatccgatgctactgtaaactcacttgttgcactcactttttgagttggatttttctttcaaacttttttgtatgctctcttgagtttatctaacactagatttcataagtgtgcaccattgtccataactagactcacttaggtaaagctatccattccatgtcctctttataatgtgacataaataaggattttatcactaatctaagggtgtgttcggttcaactttctgaaccagatcaaaacgggtacaacaacaaaatctacatatttctttagttcaatttagaatcacctcctactctagttttttttatatttctatcatccatgttaccaagctatgatgctcttaattacagaatctatagttgataattgttttaaccaaacatattctagctttaccagaactatctgctcgcaacaactttctcaatgttagaatcatattttcatgaatttataggtgaaccaaacatatcctaagcgtgcaacatctcaaatgatatttagaactagcaaattcttaatcttctcgaccatcctttaaaaagcgtcaaatgttgtccacaaataactttttttttcatgaactccatataagtccaaccatattgtattattgtgaactaatttatcttatttctacaaaatatatgttagtcacgataatcttatat

SEQ ID NO: 10240 - DNA, 1079 bp, Zea mays
  misc_feature (1071)..(1071): n is a, c, g, or t
cctcgaggccggccgggaggaagttataaatggggaacgcgcagcgcaggcgtcgtcgtcgtcctccgcggatcccgcgcgcctcctccgccgatagtccttgtggcgaacacgcgaaggcaaagcaacaccgcaaatctctccccctccctggattggattgattgagctgctcgcgtccacctccgctcgaattgccattcccccctctctcttggtttctcttggatcgaattgttagtttattagagtgaagttgtcgggggagggaggctaggcgttaggtgggcgcctgcgtgctacgcctcgggagaaggtcaaaagaaaccgccccaccaccaacccaggcgactccccctcaacccaacccaacccaacctgccattgctcttctttccctccccgtcgccagctggccagagccgccccgcccggagcccaaaggcgccgcctttcctgaaccccgtccgcggcagattgatcgattggttgttcggttccttggtcgggaatcagaggaggcagcaagagaagagatgtgcccgctgcgggtgatcctcatcttcctctccgccaccgttgccggcttcttcctcatcaggggcctcaacgctgagcccgaccagttcgacgccgacgccgacgactcgggatcccccagggcacccctgccccttcattccaaggttggatcggccgtgaaagcagggttctggacgatggtggacatggcgagcgggcggtacctctggcgcaccctcgctgcccaagcccagccttccaagtcggcgcggtgaaagtgaaagtgaaaccatctcgtcctgccgatgcagtggagactggtacagtcagtcatgttgttgtaatgctgttacgtattggtatatattcaagtaaatttgcaaaaacaaaaactattcttgtgctgagctgagccttgtgttgtgtgtaaagctggaagtggttgctgtcctgcaagtgtatactttggccatgagatttgggtccaagtttcgtcggtaacgaacattgtatgcattgcgcaaaaaaaaaaaaaaaaggcccctaggncctcgagc

SEQ ID NO: 10241 - DNA, 1003 bp, Zea mays
ggattgggaccctcgaggccggcctcgtcttcctccgcggatcccgcgcgcctcctccgccgatagtccttgtggcgaacacgcgaaggcaaagcaacaccgcaaatctctcccccctccctggaattgccattccacctccgctcgaattgccattccccctctctctcagtttctcttggattgaattgatagtttattagagtgaagttgtcgggggagggaggctaggcgttaggtgggcgcctgcgtgctacgcctcgggagaaggtcaaaagaaaccgccccaccaccaacccaggcgactcccccccaacccaacccaacccgccattgctcttctttccctccccgtcgccagctggccagagccgccccgcccggagcccaaaggcgccgcctttcctgaaccccgtccgcggcagattgatcgattggttgttcggttccttggtcgggaatcagaggaggcagcaagagaagagatgtgcccgctgcgggtgatcctcatcttcctctccgccaccgttgccggcttcttcctcatcaggggcctcaacgctgagcccgaccagttcgacgccgacgccgacgactcgggatcccccagggcacccctgccccttcattccaaggttggatcggccgtgaaagcagggttctggacgatggtggacatggcgagcgggcggtacctctggcgcaccctcgctgcccaagcccagccttccaagtcggcgcggtgaaagtgaaaccatctcgtcctgcccatgcagtggagactggtacagtcagtcatgttgttgtaatgctgttacgtattggtatatattcaagtaaatttgcaaaaacaaaaactattcttgtgctgagctgagccttgtgttgtgtgtaaagctggaagtggttgctgtcctgcaagtgtgtactttggccatgagatttgggtccaagtttcgtcgggaacgaacattgtttgcattgcaagaaccgttttcgttta

SEQ ID NO: 10242 - DNA, 875 bp, Zea mays
attcatgatggcaatggcacagagagaggtgagtccagcgttcatcctctttacgtctcccgcgtttcgttccctggctggtacggtacccgtcgtcgtgcgaacccaagacacccgcagagtgctcgaccaaatgcgacactaggttaggtgcttctactccacggcgatcacccagctcagctgctacccaactgtcgcaggccgacgcgccgagcgagggcgccgccgccgtctccggcgtcatggcggtgaagctcaaggacctggtcccggccgcgaccaacacggtgaacacgacgttcatcgtgctcgacaaggcggcgccgtcgacccgccgacagggcggcgccagggaggagacgtgcctggcgcttgtggcggacgagaccgcggcggcgcacttcctgctgtggggcgccgagtgcggcgcgttcgagccgggcgacatcgtgcggctcacggacggcatcttctcgtaccacagggggaacgccctggtgctgcgggcgggccgccgcgggcgcgccgagaaggtgggcgagttcgccatgctcttcgtggagacccccaacatgagcgagctccagtgggggcccgaccccagcgacggccggaggatggtgcaggaggccgtcgtctcgccttactcccagatcttcaagccgctgcggtgatcttcttactactgagaaacatgatactaggggtacgaacttacgatgaagaagaacgaaaaagaagggcttaaagctctgtctgtcttccaaagtgacaaggttacagcttacaacatgttcaaccatacaattatatcttccactgtgcaattatatgtttcattcacagtttgctgcacaaaaaaaaaaaaaaaa

SEQ ID NO: 10243 - DNA, 794 bp, Zea mays
acggatcggagctgtgtgcgtcactacttgcctgccactcgatcagcagtaggcccacagctcactcgcaaccactcaccaagctagcggaagcaaagcagagcagcggtcgccggccgggcacgataccagcgtcgcgagagagagagaggatggcgttcatgcggtaccgcgcgctgccgcggggggagctaacagcggaggagttccgggcgtggctggcgcagttcgacgcggacagcgacgggcggatcagcagggaggagctgcggcacgcgctgcggagcctcaacgtgcggttcgcgtggtggaaggcgaggggcggcgtgcgcgccgccgacgccgaccgcgacggcggcgtgcagctgggggaggacgaggtggcccgcctcttcgccttcgcgcagagccacctccgcgtcaagatcgcccagctcgggtactactagtactgctgatccgtcgtcggccgatcgatcggccaatatggaggcatggagcatatggcatcgatcgatgggtttgtcactactcgatcgtcacttgtttgtcacagctgggtgggttggatgtgttgttgctacttttttttctctcacgtccgggtggatgtgtgttgttacttattgttacgtactgctgtttggtcaaaacacattgaacgcaaacgcaaacgggaatagaaagcagcgagcgctaatggtaatccatcagttgcgtgtacaaaacaaaaaacactttcttaataggcgctgtacgtacgagtacagctgcttcttgtaaacaaccccaaa

SEQ ID NO: 10244 - DNA, 840 bp, Zea mays
aaagaacaaaggaaacgccggcaccagagcgctacaatataaccccaacacaacacaaacaaactaaccttatcggtctatctatccttctatccccattcccatcccgagacaggagaaggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggtgcgcctggctccacaccccaagtacaagcgccgggagcgcatcaagaagaagtaccaggcgcacgaccccgacaaccagttcaaggtcggcgacgtcgtcgagctccaaccctcccgtcccatctccaagaccaagcacttcctcgccatcccgctcccgccccgcgacactcgccgcaagtctcagctcctaccgccgctccagtccgacgacgaccaggagccgtcctcgcgagagtgattgattgtgattgattgctgcctgtctatggcttcgtcgtaagctcctctccatcagaggtgctgcttcccaattccaaatgcgaatccatgtgtgtttttgtcagactatttcctttttcttttcgatcaaaggctttagcccaatttcatccgaaatagctgttgcccttgttggaactgatccatggatatagctgcatattcccattcatcaatgcaaaaatgggagaaggaggtcttctccgttgcgctcctgaaatatttgagcagtctggagtggctagtttgttttcagaccttggactttctcct

SEQ ID NO: 10245 - DNA, 1667 bp, Zea mays
cctcgagcccggcgggcctcacattgggtacctcgaggccggccgggaaccttatcggtttatctatccttctatccccattcccatcccgagacaggagagggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggtgcgcctggctccacaccccaagtacaagcgccgggagcgcatcaagaagaagtaccaggcgcacgaccccgacaaccagttcaaggtcggcgacgtcgtcgagctccaaccctcccgtcccatctccaagaccaagcacttcctcgccatcccgctcccgccccgcgacactcgccgcaagtctcagctcctaccgccgctccagtccgacgacgaccaggagccgtcctcgcgagagtgattgattgtgattgattgctgcctgtctatggcttcgtcgtaagctcctctccatcagaggtgctgcttcccaattccaaatgcgaatccatgtgtgtttttgtcagactatttcctttttcttttcgatcaaaggctttagcccaatttcatccgaaatagctgttgcccttgttggaactgatccatggatatagctgcatattcccattctgaaaaaaaaaaaaaaaatgaaacgcttattttgtctaatatacttaatttatatttttcgagaaaaaaaaaaaaaaaaccgccccccgagctccggctttagggtaaacccaaataaataaatgacctgtatcttattaagggcatgttcatttcacccccaatccataaatgtgttcgttggtgagatgtgggccatccagccagtccaatatctagccacgagccatttgtttcgttgtgtagaagaactcatgtgggtacaaatccaagcaagcactcaacattaagggtctcttcgttttaatcagtaacattgatgtgtttttcatcgttgtatttgaaccgaagttctttatagccatgatttaccatgaacctttacccacaaatggcatgttatgtcaaaagagcccattctttgggcataagaagataagttttcacttatgtcaaactggccataagtgacttcatgttagtaagtaattaagcattaagtaatgtttcagtacttcttatgactgagttgagaaataagtttctctgttgtatgcttctgccattaagttaagatggtgatcatctaagcattgactctgataatgtcacttttgcttgagacttgataactttttcattaagataatggatcatggctatatattgaccaacattgtttatagccatgtgtctatgattgactattgcaggcgtcaagtcatattgtcttaagcatttatgattatgtttaagtgatttttaaagttgaagtgttattgttggaattgaataagtgccttaattgaatgtcagccttctataagcataagatatagcacatcgatatatttcgatcaacgtttatgtcaaggtgttgttcataaaaggtttttttgtatatttgttaagttcttcattttctacccaacagtgatggaagaagc

SEQ ID NO: 10246 - DNA, 680 bp, Zea mays
taggggccttttttttttttttttttacttcgaattcaaactagtattacgtcaatatagcccctttttccttaggggtccgtccttgccacgagcagagagaactttcaattcaaactatagtaagtgtacagaacaataggtgaaataccaaatgtcatttgagaatttatttcagtggtattacgatatgcagagttgagaattagcatagtgcccactgcccaggccccagagtaggaaagcaaaacatttatgagcttgactcgcttgggtttcctctttctccgctgcagcagtagaagtgaggcagcttcactcggccgcagcacctgcagcgaataatgaccggcacagacttcaaggctttgggtccattcctcaaacccttcttgtacttggagaccttcttcttagggacggccatgagctccatggctggtccggcagcggcgccgatgccggggatcacgagcgactgcgactcggtgagaggggcagggagaggaggctgtatgagggaaattccggaagggaggcggggtagcgacgacgcggccgcacgtcggagcaaacccgtcgccgccatggatcgccttcgtggctccgggttaggaccagccgagcaggtgcgggaagttctcagagtggcattggggatggtgctgatccggccggtc

SEQ ID NO: 10247 - DNA, 1322 bp, Zea mays
cattgggtacctcgtcggccgacgtacaacgctgctgctgacaccgagctacctacctcccccgtgccaccacctctaaaatcccccagcggcccaaccgaacccgcctagggattcctaccgagggaggccgcacgcagccatggatttcctgcaggagcaaagcgtcgagaccacagtggccgtcgccgtcgctgtcgccgccgtcgccgcaggcggcgccttcctcctccttcgatccaggaagcccaagggctgcttggatcctgagaacttcaggaagttcaaacttgttgaaaagaagcaaataagtcataatgttgccaggttcaagttcgctcttccaactccaacttctgtattgggccttccaatcggtcaacatatcagctgcagaggacaagacgctacaggtgaagaagtaatcaagccttatacccctactacattggattctgatcttggatattttgagcttgtcataaagatgtatccccaagggagaatgtcccatcatttccgcgagatgaaagttggtgattatttgtctgtgaagggacctaagggccgattcaagtaccacgttggccaagtgagggcatttggaatgctggctggtggatcaggcattactccaatgtttcaagttgccagagcaattcttgagaaccctaatgacaacaccaaggttcacttaatttatgctaatgtcacatatgaagacattcttctgaaggatgagctggacgacatggccaaaacctatcctggccgctttaagatctactatgtgttgaatcagcctcctgagaactggaacggtggtgttgggtttgtgtctaaggaaatgatccaatctcattgtccagcgcctgctgaggacattcagatcctgagatgtggtcctcctccgatgaacaaggccatggctgcacaccttgacgagctcaactacacaaaggagatgcagttccagttctaagcaatgttaagtttgcaaataataattagtgaccgacatggttcttcggtcacaggaatagtacctgactctgctcgttagctgatatcaggaggaattcaggatcacatgatgattagtagtgcgccagcattttttgcaatctctatttttgaggtcaaatgatatctacctccacataaatccacattggcagagacaacattttgttactatcattattgattttaaatgtggaccattggatgcgataaaaaaaaaaaaaaaaaaaaaaaaaaaaacgaaagcccgggtacccaaaaaaactcgagactagttctctctctctctctcctcgtgc

SEQ ID NO: 10248 - DNA, 493 bp, Zea mays
  misc_feature (145)..(145): n is a, c, g, or t
  misc_feature (473)..(473): n is a, c, g, or t
acctctaaaatcccccagcggcccaaccgaacccgcctagggattcctaccgagggaggccgcacgcagccatggatttcctgcaggggcaaagcgtcgagaccacagtggccgtcgccgtcgctgtcgccgccgtcgccgcagnccctttcctcctccttcgatccaggaagcccaagggctgcttggatcctgagaacttcaggaagttcaaacttgttgaaaagaagcaaataagtcataatgttcccaggttcaagttcgctcttccaactccaacttctgtattgggccttccaatcggtcaacatatcagctgcagaggacaagacgctacaggtgaagaagtaatcaagccttatacccctactacattggattctgatctgggatattttgagcttgtcataaagatgtatccccaagggagaatgtcccatcatttccgcgagatgaaagttggtgattatttntctgtgaagggacctaaggg

SEQ ID NO: 10249 - DNA, 723 bp, Zea mays
gtcttcttcttttgctccatttcaggctgagatcgggaggcaagcggcgtccgagcgccactgggaggtgtacaggttcctcctggatgacagcaaggagttccccttggcaagcagcctcgctaacaggaactgtgtcgtcgatagggcgaggaagacgctgatgggatgctacaactgagacttgggtgggtgtcgatctgtatctgtctgcaagaatccaacgaagcagtgcaagtgcaatgcaaggcttcccccatccacagatgcatttgcatgctatgctgcttcctggagttgtgcacgggggatggtttgaaaccagagttatgcacagcacagactggaatgaatgaacatcttgctgccatggatccattgcctacggaagaaggagcatgcttggtgtggaggtgcgatgcaatggcggttttttgttgttgttgataatgtaagaaacatgttccagccttttgcatcatatcaaggatgcatatggcttcatagcatattcaacctgacaaaagcagcaacaagtagcaatgaagcacatggttctcatgaacacataataagaaactaagaggcctcaatcctagcattgcatcgccatccatgtattgtaaaaaatgttcatcgccaccacttccaatgcgtgacaaatatctttggtaaaaagatccaagccatcaataataaaaaaacgaacacgtggcagaacgc

SEQ ID NO: 10250 - DNA, 2946 bp, Zea mays
ggccctgtttctgtttctattctcacgtcacgcgcaggctgcgggcaagcaatggcaggtgggccctgtcgcgctggccgatccagcgctgactcagcccccgcaccgcatacatgagagatgagaagccgccacccgccgctgcggctgcggcgcccgcgccaccacgagtgacccatcgtgctcggatcgtacggcctcaaccgcaaaatccagtatttaagcgccgcggaacactcgtcgagaggagaggacagagcagaggaccaccaccggaccgggctggagctggaggcgtggcggcgccggcgcgtccatcaggaggagaaggggcagggatggtgctgggcggcggcatggcggcagcggccgtaggcggggacgacgccgtcgtcatgcagctgggcgccgccgagggcgaggagaccgtcgtcaccgtcaactgccccgaccagacaggcctgggctgcgacctctgccgcaccatcctcgagttcggcctccgcatcacccgcgccgacgtgtccacggacggccactggtgcttcgtggtgttctgggtcgtgccccgctcctcgtccatcaaggtccggtgggcgagcctcaagaaccggctcatgtccatgtgcccttcctcctactccatccccttcttctaccgggacgtgagccagccagagccaggccccttgcagttctacctcctcaagctcatgtcgccggaccgcaaaggattgctgcatgatgtgacgcacatactatcggatctggagctcataatccacagggtgaaggtgtcgaccacaccggacggaagagttgtggacctcttctttatcactgatggcatggaactgctgcacagaaaggagaggcaagaggagacctgctcggcgctaactgcaaccctgggcccttccatcagctgcgaggtcgtaccagcagaagggttccagcaggggttctcttccctcccgccggagatcgccgaggaactgttcagggcggagctagctgacactgacagcgaggtgtgctcgagcccgctcagcgcggagctgaggaaggtccggacgacggccactgtcaacttcgacaactccctgagccccgcgcacacgctggttcagatcgtctgcgctgaccagaaggggctcatttacgatatcttgaggacgatgaaggactgcaacatccagatattttacggccggttcagatcagacaagaaagggtcagccagcaaaggttcatcaggttgccgtgaggtggatcttttcgtgaagcaagtagacgggaagaaggtgactgatcctgcgaaacaggacgcgctgcggtcacgcctgaggtccgagacgctccatccgctcagggtcatggtcgtcggccgtggacccgacacggagctcctcgtcgccaacccggtcgaggcctccgggaagggacggccgcgcgtgttctacgacgccactcttgctctgaaggcgcttgggatctgcatcttctctgtaagaactgcttcttttgtttgttccatttcaggcttagtatttcactccattgggtcttcttcttttgctccgtttcaggctgagatcgggaggcaagcggcgtccgagcgccactgggaggtgtacaggttcctcctggatgacagcaaggagttccccttggcaagcagcctcgctaacaggaactgtgtcgtcgatagggcgaggaagacgctgatgggatgctacaactgagacttgggtgggtgtcgatctgtatctgtctgcaagaatccaacgaagcagtgcaagtgcaatgcaaggcttcccccatccacagatgcatttgcatgctatgctgcttcctggagttgtgcacggggatggtttgaaaccagagttgtggacagcacagactggaatgaatgaacatcttgctgccatggatccattgtctacggaaaaaggagcatgcttggtgtggaggtgcgatgcaatggcgggagctttttttttttgataatggaagaaacatgttccagccttttgcatcatatcaaggatgcatatggcttcatagcatattcaacctgacaaaagcagcaacaagtagcaatgaagcacatggttctcatgaacaataataagaaactaagaggcctcaatcctagcattgcatcgccatccatgtattgtaaaaatgttcattgccaccacttccaatgcgtgacaaatatctttgatatcttggtgtaaaaaaaaaaaaaaatccgcgcccttgcagcagtctccagaatctaagccactaagaccccttgaaaataacatgcatataattgaaggtgccattaaatacaatatcattgtggcttagccagattaaccaaaacatggcagctacccctattacaatgattgagcttttgtttgttcagggatgctgacacagatacatggaggagccggcctgttgtatagcttattttagtggaacaactgctgcctcaccatcttgccttccccttgtcgttgttctcctcatgtaagcgcagtttgtaaggatgcatgtgttggagttggaaagtgatccgatggcggatgctactactgctccctatacagtgagtacagcttggttgttcaaagaagatactgatgcccggacaagcaccacccgctgcattattggtgagcgcgcacaggcacagcaccccgcctctgcactgcacatcccagtgtgtctgtcgtttttgttccatctcgcttgcattgcacatgggtggtgagtgagtgagtgaataaacgcactaggggccgggcaggggcgaagccaggatccgaagacagagagggtagacttagcctccaagcgaccaaatcagtaacgacacaatataaaaatgacaaggaaaccaaacacaatgtatatattgatatataatcttcattaaaaaac

SEQ ID NO: 10251 - DNA, 957 bp, Zea mays
gcgcttccctcccgccggagatcgccgaggaactgttcagggcggagctagctgacactgacagcgaggtgtgctcgagcccgctcagcgcggagctgaggaaggtccggacgacggccactgtcaacttcgacaactccctgagccccgcgcacacgctggttcagatcgtctgcgctgaccagaaggggctcatttacgatatcttgaggacgatgaaggactgcaacatccagatattttacggccggttcagatcagacaagaaagggtcagccagcaaaggttcatcaggttgccgtgaggtggatcttttcgtgaagcaagtagacgggaagaaggtgactgatcctgcgaaacaggacgcgctgcggtcacgcctgaggtccgagacgctccatccgctcagggtcatggtcgtcggccgtggacccgacacggagctcctcgtcgccaacccggtcgaggcctccgggaagggacggccgcgcgtgttctacgacgccactcttgctctgaaggcgcttgggatctgcatcttctctgctgagatcgggaggcaagcggcgtccgagcgccattgggaggtgtacaggttcctcctggatgacagcaaggagttccccttggcaagcagcctcgctaacaggaactgtgtcgtcgatagggcgaggaagacgctgatgggatgctacaactgagacttgggtgggtgtcgatctgtatctgtctgcaagaatccaacgaagcagtgcaagtgcaatgcaaggcttcccccatccacagatgcatttgcatgctatgctgcttcctggagttgtgcacggggatggtttgaaaccagagttgtggacagcacagactggaatgaatgaacatcttgctgccatggatccattgtctacggaaaaaggagcatgcttggtgtgggaggtgcgatgcaatggccgggtgcgt

SEQ ID NO: 10252 - DNA, 1171 bp, Zea mays
gaataacatgcttcatttctaggttcccttttccattttttctagcgccctctgcctccatccaccgacgcggcgcccgacgcccgacgccgcactcacctcgcctcgctgaatcgtccccgccagacgtcgggtgcccgacgctgcagcacggcagccgcacaaccgcagctcccaccgctgccgcgctcctccgcgcaacctcgatcgcgcacagaggcccattccgccgaggagtggcacgaggagagacgacaggtgcggggatggggtcagttttgctgccaacgctgcggctgaagagtgaggtcgacgccgccatccgcgacaccctcgataaggtcctcgttctccgatttggtcgcgccaccgacgccacttgcctccacctagatgacatcctggctaaatcttcttgggacatatccaagtttgctatggtagcattagttgacatggactctgaggagattcaagtttacattgactactttgacatcactttggttccagcaaccattttcttcttcaatgcccatcacatgaagatggattcagggacacctgaccacacaaaatggataggttcttttagcagcaaacaagactttatcgatgtagttgaggcaatattcagaggtgcgatgaaaggcaaactgatagtgtcttgcccccttcctcctgagaggataccaagattccagcttcttttcaaggatgtctgagaaaactgcagctcatcacgtgcacacaatcagctacctagcccaaggtaagtagaaaagctgaagcttctataagagaagcacaacagaggggacaatgcaggcgtgttcgtgcttcgaagaaacctaattgtgctggaaacagccattttcattctcaagactgtttgcgcaaatctctgcaataatctaatgttgtacttgtccatattgcatgtttaggtttgtatttaatcacgttcatcaaatatgacgggtatagatttcttgtttggtgttaataccttgctactagtttatattgagttttggcattttacacaaactggacctggtgtgtgtgtgtgtgtgggtgggggttggggggccacctctcatggcaaggctttcaagatgaaactttgtacacaaacttccgttggaagattggttgtgcaacaattttc

SEQ ID NO: 10253 - DNA, 1102 bp, Zea mays
cattgggtacctcgaggccggccggggtatgtcgcctagaggggggtgaacatttttttctagcgccctctgcctccatcccccgacgcggcgcccgacgccgcactcacctcgcctcgctgaatcgtccccgccagacgtcgggtgcccgacgctgcagcacggcagccgcacaaccgcagctcccaccgctgccgcgctcctccggtcaggcggtccttcctggcccggccgcccccgccgcctgccccgttgcatccgtgcccccagcgcaacctcgatcgcgcacagaggcccattccgccgaggagtggcacgaggagagacgacaggtgcggggatggggtcagttttgctgccaacgctgcggctgaagagtgaggtcgacgccgccatccgcgacaccctcgataaggtcctcgttctccgatttggtcgcgccaccgacgccacttgcctccacctagatgacatcctggctaaatcttcttgggacatatccaagtttgctatggtagcattagttgacatggactctgaggagattcaagtttacattgactactttgacatcactttggttccagcaaccattttcttcttcaatgcccatcacatgaagatggattcagggacacctgaccacacaaaatggataggttcttttagcagcaaacaggactttatcgatgtagttgaggcaatattcagaggtgcgatgaaaggcaaactgatagtgtcttgcccccttcctcctgagaggataccaagattccagcttcttttcaaggatgtctgagaaaactgcaactcatcacgtgcacacaatcagctacctagcccaaggtaactaggtaagtagaaaagctgaagcttctataagagaagcacaacagaggggacagtgcaaggcgtgttcgtgcttcgaagaaacctaattgtgctggaaacagccattttcattctcaagattgtttgcgcaaatctctgcactaatctaatgtttttcttgtccatattgcatgtttaagcttgtatttaatcacgttcatcaaatatgacgggtatagatttcttgtctggtgttaaaaaaaaaaaaaaa

SEQ ID NO: 10254 - DNA, 3739 bp, Zea mays
  misc_feature (2890)..(2890): n is a, c, g, or t
  misc_feature (2915)..(2915): n is a, c, g, or t
  misc_feature (3290)..(3290): n is a, c, g, or t
ggaattttgtgaactttaatatagaggcttaaaagaaatacttaactcgtgactgcaatatgagataggatgtggaatatctagagatatattcatactgatagcgaacaggtgtggcaagggttttgtgatttggtgatgcatcgtaactgatgatttgtatagttcctttagtcatttgactaaattttagtgactaaaattatgtttggttttattgattaaatctgactaaggaacattaagtactatacataaagaccgtcttacccctatttaatagggcatagggaagaagggagggcatatactgtcacttttaccccttgctgatgaaaggactaaattttagttggagtgatttagactctgtttgggagagcttcattttaagaattacaacttcgattttctagcttcaccatgaaacgccttcaacagattggtaaggcagagttcaagagtgtttggcttgcacatagactacaacatctgtaatataattaatttgtgcgaatttcctgaattacccttgatgattagtgggtgaagaaagagacatgaatcggtaggtcatgtaaccaatggtatgctggataatttttgtataagtttatgaggatgtatgaaaataatgtttttgaagcatcatgtgaggagcttcgaaaatttcatgaaactggcctctagtttcaatttttttaattagagtttgtggagctagacctatttggaaacatcaaagctgaaatagacctgaaatttaaaaggtctcccaaacatgacattagtttttatatttggttctttagtgactaaaagtgactttagcaccctaaaccaaacaggcctgaatcgtactccctctttcattttcccaacacctaaacaacgtaaagtttgattttaaataaataagaaatactgttatttatgatatatttaaaatattgtaagattaataatataatatttttatataagatataaatagtgctgttttttgtctagaaaaactagatgtgattttttttgacgtagagtactacaaaatcaggggcaattaaggacgttataacagccaagccgaactcttttgtgagctcaaaggccatgacccaacaaccaaacatcacctgcacaccacttgtcttgacacaccacacacaagaattgtatcaccgctgccagcatgccctcaccttcctccctccatcacttctcgccaaggctcccgctcgcctctacaaatggcaaggccacgcccttccacttccaccaattcactaccaacgacgtacaagccaccaccaaccagcaggagctcatcgggatgggcgacgcggctattgccgtcgtgcatgaggctgatgaggaggagcaggagcacatcttccggagccggttcccgcctgtggacctgccggacgacgtcactgtgccggagttcgtactggccggcgccgaggcctacgcggacaaggtggcgctcgtggaggccgcgccgggggggcggtcctacacctacggcgaggtggcccgggacgtggcgcggttcgccagggcgctgcggtccgtgggcgtccgcaagggccacgtagtggtggtcgcgctcccgaacctcgcggtgtaccccgtggtgagccttgggatcatgtccgcaggcgcggtcttctctggtgtgaacccgcgcgccatcgccgcggagatcaagaagcaggtggaagactcggatgccaagctcgtggtcaccaacgaggttgcctacgacaaggtgaaggacgcgggcgtgccggtgatcggcatcggggacgacatggagcgcctccccggtgcgatcagctgggacgagctcctcgccgccgcggaccgcacgggcgcgccggtggtggcgctggacccggtgcagcagtccgacctgtgcgcactcccctactcgtccggcacgacgggggtgtccaagggcgtgatgctgagccaccggaacctggtctccaacctctgctcgtctatgttcgcggtcggggaggagctggtcggtcaggtcgtcacgctggggctcatgcctttcttccacatctacggcatcaccggcatctgctgctccacgctgcggcacaagggcactgtggtggtgatggaccgcttcgacctgcgcaccttcctgggcgcgctggtgacgcaccgcgtgatgttcgcgccggtggtgccgcccgtgatgctggccatggtgaagagccccgtggccgacgatttcgacctctccggcctcgccctcaggtccatcatgacggctgccgcgcccctcgcgccggacctcctcgcggccttcgagaagaagttcccgggcgtgcaggtggaggaggcgtacgggctcacggagcacagctgcatcacgctgacgcacgccgcgtccggcgacgacgcgcggcaggggcccgtccaggtcgccaagaagaactcggtcgggttcatcctgcccaacctggaggtgaagttcgtcgaccccgacacgggccggtcgctgcccaagaacacgcccggggagatctgcgtccggagtcaggccgtgatgcagggctactacaggaagaaggaggagacggagcgcaccatcgatgccaaggggtggctccataccggcgacgtcggctacatcgacgacgacggcgacgtgttcatcgtcgaccggatcaaggagctcatcaagtacaagggcttccaggtcgctcctgccgagctggaggccattctcctgtcccacccgtcggtccaagatgcggccgtcttcgggtaagctatcgatcgagcatgaacgagtgcagttcacagcgacgcactagacagagagacttgaccgctgtgcttggtgctgcgtcatgccatgcancctgccggacgaggaggctggcgangtcccggtgtcgtgcgtggtgcggcggtgtggcgcgtcggagagcgaagcggacatcatggcgtacgtggcgggccgcgtggcgtcgtacaagaagctccggctgctgcagttcgtgtacgtcatccacaagtcggtgtcaggcaagatcctgcggcggcagctccgggacgagttcgttagcaggaccaaaacggcggcagcctagctctagcgagagctagacagtccaatatgccagttacatacttacattgcacacgtacatcaaacgaataaatgtcaagctattctaaattttaatactacgtactgcaatggtgatgctcaaaaaaaaaaaatttatgttttttttcatgtacaaacttagcccttnaatcggttttttaagtataaaaaaataaccaagagaccgtgtgatacaacctttagttccttgatcataatatagttaagagccattatgtataaagggtcgtgatcctttttaaagagatcgtaatattttgtactttttccagttaacttgctaagggcatgtataacctaaaaactctagatcggatttctaagtagaagagataattaagaaaatgtacgatacaacctagtgtctctacatcattaatgcagttaagacacaatatttatagaaatttgtgaagagatcagtaccccgtctctttatttttttcactaacgctctagagacttattaattaaaggggttacgttgtacgtgccctaagggcatatacaacttagagtcacttgttcggtttttcaagtaaaagaaactatatatgatacaattcggtgtcttta

SEQ ID NO: 10255 - DNA, 1560 bp, Zea mays
gatgacaccaacatatgaaaaaaaaatgttcagcagattttgatatttctgtccttactgaactagcagaaggaagtaagattaagacataacttggatatgagtaaagtttatcagaaaatgggtgttcagggagatgtctcagcctctctcttattttttccatcctcttgatgaaatggcaacgacctgtcctgcatagtccgggagatgaatgtaaagtttatcaactaataaacaatcaacaagaaaattataagtaatttggagtgttacatcgtttgtcatttaaccactctggaaggaatctgaagcagaattcagagtggaacaaccatgattaaaataattgaacttgtagtccactagggagaccaagataaattaattattcaatatactgagttactcacagcataagctagtctctataaatagcagagaatgatgaccccatgattcatagcattcacatcagggtaagagtataagactaacaacagcaccaagaagaagacccaagatgacaggccttggctcaccatgtggtgcgtgcaagttcctacgcaggaagtgtgtgaaggggtgtgtcttcgctccatatttctgtcatgagcacggggctgcgcactttgctgctatccataaggtctttggggctagcaatgcctcaaagctcctaatgcatctgccaataagtgaccgttgcgaggctgcagtcactatgtcatatgaggcgcaagccaggcttcaagatccaatatatggctgtgttgctcacatcttttctctgcaacaacaggtggtcaggctgcaagcagaactagagtctttcaaagctctagcaatacaaggatgtggagatgggtccttgacatcaaaccctcagaaagaaaactgtgaaagattagcaccttatattcaagacgggcagctcttttaccaaccaacaatggcaaacaattcttcagtaaagagtgagaggcagttatactttgcaaacgattgcttcacatcaacgtcaactcaacattctgaaggttatgagccagatatatgcatgcctgactactacaacaacagcaatccttcttggaccacgcaagggagtgggtatcatgatattgatgagcttcaatcagtagcctttgcatatctggacaatgcttgacaaaacgaggaatttgatagttattgtacaagtttgaatagttttggtaacaataccttacagatgtcaatcaagttttctagcatgggcattgagttactgaagaagctgtgtgttgatgtactcataactaaaacttcaaactgcacttttgtagtttagaaatcctagtttcttcatgatgattcctgcagaagaattaaattggaattgttcaataagaaacacatcatttggtgcagataaatagaagattgaaacgaaatagaccgtaacggtattgcatttcagtctgttatgtggagaccaaaaggttcttgagtgtataattgtaattttagtgcttgtactgaacatctgtttaactctgtaagcaagtatatttagcc

SEQ ID NO: 10256 - DNA, 1625 bp, Zea mays
ccggccggacaagagagaagtcggcccgcgcggccggcgcgcagaagctactcccgaagagtcgctctcctgcgtccacgcctcgcttgcggcgactagggcgactgccgccgccgcccttcgcccagctgcccaggtcttcgtcgggcgctttaccgctgaagagcgcccaccataccagattggccaccagaggattgctacatttgggaaggatgagcaaaggccctgttccattcgccaacattgggaagagagcaaaagatctcttgtacaaggactacaactttgatcaaaagttttttttgtcgacatgttctaactctggtttgaatctcacagccactggtgtgaagatcaatgaagacttcattggtgatatacggacacagcataaaagcagcagaaccactgttgatgtcataatcgatagtgattctaaagtgtcaaccacagtcactgttgatgaagcactaactggtttgaagacttcatttgccttcaaggttccagatcacaagtctgggaagcttgatctgcaatatgcccacaatcgtttttcaatgaattcgaccattggtttgacatcaacacctttggttgagctcgctgcaactgtcggcacaagtgaacttgccattggtgctgagttcgggtttgatagtacttcagctgctgttaccaaatacaactcaggggttggatacaacaagtctgatttctctgcttccttgctacttgctgataaaggggagactttgaaggcatcttacgttcatttattcaatccgaccaacggggctacagttgcagctgaggtaacacacaagctgaaaaccaaggagaactatttcacacttgggagctcccatgcacttgatccttcaacattgctaaagacgagattcagcaactcggggaaggtcggtctgctctgtcagcatgagtggaggccaaagtccctcgtgactctttcagctgagtatgatccaaaggtggtaagtgcgccttcaaggatcggcgtggccatatcgctcaagccttgagatatgggtcaagtcaccttctgtaaaacagtacaagcgttacgtactgatactcgtgtccaagaacataaacttttggagcgatgcctagaacaaccctctcccttttagccttgtttttggtaagatccttgggcaaagaagtgttgtcagggagttggacttgttttgtggaatgtttccattaagagccaaccccacaccgatgattgcaaacagaggtttgtattagtgcagaagtttcactctgcgatattttttccccatgttttcctagtcgacgcaaaatgattttggaggtgattgaacacctaacgtcttgagttgacggcagctttaacagctctgattataaaggggccacttgtacccagcaacagaagaatttgctcccaattcgtcgaattggctattctggtggaacattttttgtcaaactcgggggggggcccgggaccctcatgtattcagagcagtctagttttgcttcctcgataaagtatgttgtgttggatatttgtgatgtgaggtgaatgcgcccaggctggagatcagccgatggaggcttatcgagcaggg

SEQ ID NO: 10257 - DNA, 1482 bp, Zea mays
tgggaccctcatcggtgatcggtctcctatgttcacacctgtttgctctcttttcttcccccgttcacctcgcgtgcgccacccacctagggtgaccgccgccgcccttcgcccagccgcccgggttgcgctttgccggcgacgagcgcccaccgcacccccaccatattggtcactggaggattgctgccgttggtaaggatgagcaaaggcccagttccgtttgccaacatcgggaagagagcaaaagatcttctgtacaaggactacaactttgaccaaaagttttctttgtcgacgtctagcggctctggtttgaatctcacagccactggtgtaaagatcaacgaagacttcattggtgatatacggacacaacataaaagcagtagaactactattgatgtcaccgttgatagtgattctaaagtgtcaaccacagtcactgttgatgaagcactaactggtttgaagacttcattcgccttcaaggttcccgatcacaagtctgggaagcttgatctgcaatatgcgcacaatcgtttttcattgaactcgaccattggtttgacatcagcacctttggttgaactggctgcaactgtcggcacaagtgaacttagcattggtgctgaggttgggtttgacagtacttcagctgctgttactaagtacaactcaggaattggatacaacaagtccgatttctcagcttccttactactggctgataaaggggagactttgaaggcatcttacgttcatttgttcaatccgaccaatggagctacagttgcagccgaggtaacacacaagctgaagaccagagagaactatttcacagttgggagctcccatgcccttgatccttcaacattgctaaagatgagattcagcaactccgggaaggtcggtcttctctgtcagcatgagtggaggccgaaatctcttgtgactctttcagctgagtatgatctgaaggtggtaagtgcgccttcaagaatcggcatggccatatccctcaagccttgagctgggttaagtcaccttctataaaacagtacaagcataccgtctccaagaacacaagctttggagcgatacctagaacaaccctccattttagccttttttattttgtaagagtcttttgcaaaggagtattgtcacttgtcagggagttagacttgttttgtggaacgtttccattagagccaactccacacgaaggattgaaaatacagaggtttgcattagaacagaagctccactgcgatattttcccatgttttgctagtcgacgcaaaaaatgattttttggaggtgatttgaacacctaacatcttgagtcgatggtggttttaacagctctggaaatcaacaagggccatttgtacccagcaacagcagaattagttctggaaattggttattttgatgaaaaaaaaaaaaaaaaaagcggccctcgagcttgtcttggag

SEQ ID NO: 10258 - DNA, 5333 bp, Zea mays
  misc_feature (2952)..(2952): n is a, c, g, or t
  misc_feature (3726)..(3726): n is a, c, g, or t
ctttttttttgctggcagcttgatctgcaatatgcgcacaatcgtttttcattgaactcgaccattggtttgacatcagcacctttggttgaactggctgcaactgtcggcacaagtgaacttagcattggtgctgaggttgggtttgacagtacttcagctgctgttactaagtacaactcaggaattggatacaacaagtccgatttctcagcttccttactactgtaagctcctcaagtctatgctttttgcttagggatgcatgtaattttatacattgctcgtgattttgtgaacagttaaacctttggtctatcgtagcatgctattttcttcttccttctcacctatttttgggcaagtttaacaaacgaatgatgatctctcttttgtcagcgcactgaccactcttccacatctttgccttactactggctgataaaggggagactttgaaggcatcttacgttcatttgttcaatccgaccaatggagctacagttgcagctgaggtaacacacaagctgaagaccagagagaactatttcacagttgggagctcccatgcccttgatccttcaacattgctaaagatgagattcagcaactccgggaaggtcggtcttctctgtcagcatgagtggaggccgaaatctcttgttactctttcagctgagtatgatctgaaggtggtaagtgcgccttcaagaatcggcatggccatatccctcaagccttgagctgggttaagtcaccttctataaaacagtacaagcataccgtctcccaagaacacaagctttggagcgatacctagaacaaccctccattttagccttttttattttgtaagagtcttttgcaaaggagtattgtcacttgtcagggagttagacttgttttgtggaacgtttccattagagccaactccacacgaaggattgaaaatacagaggtttgcattagaacagaagctccactgcgatattttcccatgttttgctagtcgacgcaaaaaatgattttttggaggtgatttgaacacctaacatcttgagtcgatggtggttttaacagctctggaaatcaacaagggccatttgtacccagcaacagcagaattagttctggaaattggttattttgatgagttctgtttgtgagttgggttggttgaaacatagtccgaacagggggggcgggggcattgttttgctttaactttggtgaggtgtggtggacatgtgccgtcgaagccgccacctctccattctccagcagctagagtgaggcaactcatccagcacaaaagcagagtgcccattcagatcagataggccggaacgaaatgacaagcgtacagctcgagctccagcacctggaactcaaaaggggagatcgcagtctgcaccggttttagcatgcttgtgcacttgtgtggcaaacaacaacatcagcctcgacgcccttgagtggacggatagcctcctcttcctgagcgaagaggttccagcagcagtcgaaatggttcttagaaactctgttgcagtgagctcgagctgctcgcttttcggcgattgatggaccaggacgtccgggagctgatgggccaacggacataatgggccgccctcggcctggcagacgcgctcgcgctgcacggcttgccgacccatgaaactgtgtaggcgtcccggcacggcggcgccgtcgcacaggaccatcgagtgaccagttcagttcaacgctggctggcgaacgagacatgtccacaggcacttggatggcatggcatgacatggcagcacggaacacgtattgttttccaaggaggaggaggaggaggagcgcagcagtcaaacagtaagccgcgacgccgacgctgttcagccgctgaacgaggaccgggttggctgccactgtcagacctgcaggctgtagcagtagcacctcgggagcgcgggggggccggagccttcctccagtcctccccatcccgtcccgcccaccgcgcggactcggccagcgctacagatatacggggagccgtacgtaccccacccgacgacatcattgggacggtaatgagtgggcgtttgacgcaccttccggcgccgcacgtgcggtgcccgtgcccgcccggctggcggcggcgcgctttggcgcccagttttggcgggagggcttgggatttggcggggtctttttttgttgttgtttttgagttgagacttgagtggggccaaatctgcggcggaaaaggttcctcctctttccatttctctggttttcttttcaccatggctgctgcctttttctttttctttttctttttcttttgcaccggcaacaaacgtgcgcaccggtagattcgtagcgtagcgagtatgcttgctgtctgtgacaccaactggtgtaccgtccatctcattttttcacacctcgaaacaacaatgtaacaagagggtatgtatgtagctaggtacactttgcgtgtacacacgcgcaacgtaccatgcgcttgtccatgaatgtcatgtaccgctgctagtacgtagtacttgagatcgagcgggggtttggaggtaggcaggcaggcatcggatgccatgccatacacaaaagcttgctgctgctgctacaccacctggcacatttaccatcacaggcaggcatccatcctgactcgctgccaaggctcaaactcaagcccaaagtcgcatggatgccaagccaagccatgcggaaaggcggcttttttttttttttgtgcacgggctggactagtctgctcctaaaacgtggaaagaccgcagcttttgaaacacggcaacggacaaaacccagcaaaggctcgtcagagagtcctcagatagggccccggctggcccgctgcccagcatgggcagcgaaaaaaagagagagtgagagagaaaaattccccgtcangtcaacagcaccatcgatcagatcagccatcggcagcaatccatcagtccagcagatttgcatgcggctatgcaccacccgatcctcgggcttttcgttttgagtggattgtgtgagatttgagggattaaatcgtcccctaggatttgtttgagtactctaacattgatcttaatctacgtgggttgagttgaatttagatgcaaattaaactaaacttaacatatgtgtattgagatcaatattagagtaatacccaaactagtcgttaatgaacaagcttggggctggggatcctccaggggatgtgtatgggaaaatttcttctctgatgggatgtaaacgggaaaaaaattatcctccgacaggtaaacagggacatggatggagaagcatttccgaatctcccatctctgttccccgcgagacccactaaacttgaacgtggtgatattgttatgtaatagttaactataaaaataaataattatcttgttaagagataatttattatagtattattgcaggtgaccggattgttttcgcggccggctgggccggtgattatatttctcatccagccgccatcattatctgagagttcgtgcaatggttcctgttatgacaggtgattccttgcatgattcagtactgtgcgtagcgtcagtttcgactttcgagggtcttgaatcaaaaaaggcacaggaagaaatcatgcatgtgatatacaaaaagccacggcggtctttgtacgtgtttgtagatcgactggtngagacttgttgagactcgacaggccaagaaccatgcatccggtgatggatgggagtgaaatctccgaatctatgcccttcttttcataccaatggaatgcgcacgcagacaggcagtacacgtactcgttggtacccagtgggaatcatctccttgcatcactcggagaggacgcagggtgatgcccagcctgatgtgattatattccggcgggtactacgtacgagctgtgtaccaatatgctatgcactaccgcacccttggcgaactaagactctcgacgtagactttgtttgccgaaggcaaaacactcaaagtagaaaggcacttcgacaaaggaggttttatcgatggtcaagctctcgcaaaatgcatgctcgccaaaaggccgtcagcggccagtctctctcaacaacatcatcgagccaactatggatactctgtcagctgaagatcagcaggagttcgaggaacacaaggggcaccgatcaaggaagagcaggcgaaattcttggccaacatcaagatggacaagaatcataaggtcgtccagagggcaactgatttggcttcgctccgacctgatgcagcttcccccaaagtaagtgaaacaaacgaaacccaatctcttagatcttacatagatgaacaacgagaacaaatgcagcaaataatagggagtatgcaagatgattacaaaaggttggcacatgcatttgataaatctgttgtaatttcccacgcacgaggttgaaattaaggataatacacgtgattcatcggctgcaaattggtatggccaatcctagccacttcatgggatgctgatgaacacatctcttgaacaaccacagccttctacacagatagggggtaaatccatcaatctatgcacggtcggagcgtccgcgcatgagcacgaaccgttccgaccagcactgccagccccgtttttcgaacccaaccaccgaaatccacatcagggccatcgtatgccgtgcaaacactaacagacacacacagaccgtccgcctacacagtcggacagtccgcgtacgaccgaacagtctgcgcgttacgccagatagtccggtgcttggtatatataccaaacatggtgttaatttttatcacaaatctatatattcgtctcagccaagcttccccttactctctacgactcctcaacactgccccacatatgcgtgggggcgagcacttttcagcccctctcaggaggccagaaaaggatgaccagctatacgagccaccgaaggcaagcattaatgccccacaaaaacccaaactccggggcaagaaggcaacataataccaaacacctgcaccatcgatagactaaagggccggtggactaccaccaaccgtcattgacataataagggaagaaatagttggagcattcctagaaaaagctcaaagttagtatgacccctgaaggtcagtcatatcgaaaaacttatgacaaccgatttgattatcacacatacccctaaggaataaggatacccgaatttagaaaattgttgggtgaccagggtaagagcacacgcgagcacataagccaggttcctagcacaattagaaga

SEQ ID NO: 10259 - DNA, 2465 bp, Zea mays
  misc_feature (324)..(324): n is a, c, g, or t
  misc_feature (1356)..(1356): n is a, c, g, or t
  misc_feature (1431)..(1431): n is a, c, g, or t
catctgaaagtgattcctatttatttaataggacctcctgccatttttaggctaagctttgctcacctaaagaacacgtggaatttgaaatgtgagttttagacagatgaggattgctctattatttttattagctgcacttgtgcatccatagtatttttctgcttcatgttcgcttttgctttagttatggtgctcatattagcattggacatcctgcatttgtgttcttactggagtcctgttggttgcaggtgtcaaccacagtcactgttgatgaagcactaactggtttgaagacttcatttgccttcaaggttccanatcacaagtctgggaaggttagtgtttttggaagtaaaggaggaaacattagcttgcttgaatacagaaaatgagtggtgcaatatgtgcaggaagtcttaactgagctgtattttacttgcatgctgtgtttgtcaattacatcattggattatgatctaaatttcgtcccatcaatttccactggttttgtttttttaccacagtactttctttttgttttttgctgacagcttgatctgcaatatgcccacaatcgtttttcaatgaattcgaccattggtttgacatcaacacctttggttgagctcgctgcaactgtcggcacaagtgaacttgccattggtgctgagttcgggtttgatagtacttcagctgctgttaccaaatacaactcaggggttggatacaacaagtctgatttctctgcttccttgctactgtaagctccgcaagtttactcgcttttgctcaggcatgaccgtaaatttatgcattgcttgtgatattgtaagcagttaaacctctgctgactgtgttttcctctccttaccttttctttttgcaagtttaacaagtgaatggtatttttcttagcgacctctcttttgtctgtgcactgaccaatctttctacatttttgccaataaatagggctgataaaggggagactttgaaggcatcttacgttcatttattcaatccgaccaacggggctacagttgcagctgaggtaacacacaagctgaaaaccaaggagaactatttcacacttgggagctcccatgcacttgatccttcaacattgctaaagacgagattcagcaactcggggaaggtcggtctgctctgtcagcatgagtggaggccaaagtcactagaagatgcaaaacatagttaatcatatatggcgtatcactagaagttctttcctgccactgaatttactgtctgtagaagatgttccttgctgatttgtagtatcttaagatggaaatctagccatagggacaactatagaagattgttganttgatgattcttggacatacattactgttgagtcctggagaaggaatccaatcaaaactattttctaggaaaaangagctcaggtgcataaagcttaaactttacacaaatgtcactacctggttgcctgggattcgaaagggtgaatcaagcaatgaatatgactgatctagcacaaacgaatatccatcatcatttgctttcaaagtgggatccatagaaacatggtaaactgacacctttggtgtagaggctgcatcagagaatgacaattgtgcaagtgcagactcaaggggatttacactgattggcaggcctgttgtaaaacagagaataggtgggtttatgggatttgaatgcaagtcattgtgagtacgaactgtgtattcgtaaaaaaggaacatttaaaagagtgtagccttgtgttgttaatattatagcttcaatcaacaaatacttgatcatgaatgaataccactaattgtcgtacaatattttctattacacaactataaaatacaaacagaaacattatgcaaagtagcctcgcacgatcaacaaacaaactatccttgttagccttgaacaacacactgttttgagtgtggaaggcgaagcatcacgaaaaatgtcattgttccgcatgaaaacatttcaaatcgaattaattataatattgatggcagttccaatgagtccaaggcaaagatttagagtggactataattgtatccacaagatggtagttgttcaccatagtggtaggaccaaaaacatagaggatgacatgctatgttggcttgccaaacctatcacaaccctcatcctttaccagggtttgtgacctgctatgttgagctacaacaaaatatagtatccccccgcagtcaacagatgcctaaggcaccaagtgggttgtgaaggttaatgtgaggacctgattaaccattttgagcaaagctaggataaaagtgtaagaagggtgttagctatatgtaagcttgtcccatttggattacaactttggacaaattcttagcatggcatattaatttgaaaataacatgcatttaaaccaacatacatgaacttatagcagaaattgcatc

SEQ ID NO: 10260 - DNA, 1510 bp, Zea mays
ctgcaggggtcgcgtcgcgtctcgcgtgggggaaacgccgccgaaaaccactgggtgcccgctctcgctcggcacgtccttcgcgcgcccacgcccacgcgactggtcacaagcgctagccagagttcttcacgcgcctcgcgcctgcctgcagccgcaggggaatcgatcgtggcaagggcttgcagtcgcagctactggtagcagagcgatggcggccgcggcgagggtgtcggaggtgaaggccgagggcctcctgcggggcgcctgcacggcgctggccgcggcggccgcgctgctggtggggctcagcacgcagacggagacggtgctgctcgtcaggaagaaggccaccgtcaaggacgtccaggccctctgggtgctggccatggcggccgcggcagcggcgggctaccacctgctgcagctgctcaagtgcctctacctcggccgcgtcggcggcgcgcgcccctgccgccggagcagcagggctctggcctggacatgcctcctgctcgacaaggcgtgcgcgtacacgacgttcgcgacgacggtggcggcggcgcaggcgtgcgtggtcgcgctggacggcgcgcacgcgctgcagtggaccaagctctgcaacatctacacgcgcttctgcgagcaggtcgccggcagcctcgtgctcgggatgctggccgccgtcggcaccgccgtcctctcggccgcctccgcgcgcaacgtcttccgccactacgcgtcgttggagacctacgccgcgcactaggctcgcggcccaaggcggcgtcagctgggccgggtgcgccactcctctaaaacactgggccgtaacgaatttcaggcccagatgaagggtgacctgggctattaaagctggagctagtagagttctactctagagtgtactcctgcctacagtcctactgctctctccctccctctcgaagaggtgtgtacttttatttttcttttgcttctgttgcatttgatacattagtgaagacatgagtatgtacgttcgtcagtgtattttcttagatctttcctgtagactacattgcagctaaggaataaaaaaaccagcaattgctgcgcaacaaaaaaaaaaaaaaaaaaaaaaaaaaaaaaaaaaaaaaccaacgccgggggcgccgttgaggagtgcgacgtgatcagcgatgctggcggcaaggccatggctctcagggttcgcgggtgcggtcggttcggcgcttactgctcgcgggagccggcgaggtgcctattggactcggcggaagtggagttcagctacgatatcgacactggcctcgtgtccgtcgacttgccggtgccggagcaggagctatacctttggacgctggagattatgatctaggtcgtgatgctgtgcgccgacgccaacgcttgccctcgcggctgagccattatgagtcggacgacattgtcatttgctatgtgcacgagagatagatgtattgtggtggtgttgtataattggcatggg

SEQ ID NO: 10261 - DNA, 4508 bp, Zea mays
gcacgagaccattacctagaacatcctaatcaaaaaatcacacggccgtgaggagcaactctgttcctcatctcccgttcaccccgcgggcgcagggcgcgctctctcctcgtggcgatcgccgaccgtagcggccgctgcccgggttttcgtcggccgcttcgccatgtcttcgctggacccttcgccagcgacgagcacccaacagcagaagcaattggagagtttggtaaatctactgacgcagggaagcaggttctaccgcaaagcatataatgaattgttctcaggtgtaactactgagcaggatccggattcatcgactaatattcctgagtatatgctttttgggtggcatctcttcttaatgctccatttgagatcaccagaattgttcaaggacctggtgtcctgcatccatggattagttgctgtgttggccatacttttgattcacgtgccagctaaatttaggagcttcacgattgaaggctcttctcacttaatcaaacaaactgagaaaggcgtggatcttattgcttcattatgtcataactatcatacctctgaagaacgtttgaaagaaatgttgcacaagtctcacaatgcaatagaagacattttccatatgaaagcactaagtgcttcagagtgcaaaccagaaaatttggataagatagacacagatgacctgatgtatttcaaaggtctgattgatatggaatgtttccagtcaaatttggaaaaaatggagaaactatgtaattctaatagctgtaaaggggagcttgattttaaatcaattttgatcaataatgattatattccctatgatgagaactcgacgggggattccaccaatttaggacattcaaagtgtgcctttgaaacattggcatctcccacaaagacaataaagaacatgctgactgttcctagttctcctttgtcaccagccaccggtggttcagtcaagattgtgcaaatgacaccagtaacttctgccatgacgacagctaagtggcttcgtgaggtgatatcttcattgccagataagccttcatctaagcttcagcagtttctgtcatcatgcgatagggatttgacaaatgctgtcacagaaagggtcagcatagttttggaagcaatttttccaaccaaatcttctgccaatcggggtgtatcgttaggtctcaattgtgcaaatgcctttgacattccgtgggcagaagccagaaaagtggaggcttccaagttgtactatagggtattagaggcaatctgcagagcggagttacaaaacagcaatgtaaataatctaactccattgctgtcaaatgagcgtttccaccgatgtttgattgcatgttcagcggacttagtattggcgacacataagacagtcatcatgatgtttcctgctgttcttgagagtaccggtctaactgcatttgatttgagcaaaataattgagaactttgtgagacatgaagagaccctcccaagagaattgaaaaggcacctaaattccttagaagaacagcttttggaaagcatggcatgggagaaaggttcatcattgtataactcactgattgttgccaggccatctgttgcttcagaaataaaccgccttggtcttttggctgaaccaatgccatctcttgatgacttagtgtcaaggcagaatgttcgtatcgagggcttgcctgctacaccatctaaaaaacgtgctgctggtccagatgacaacgctgatcctcgatcaccaaagagatcgtgcaatgaatctaggaacacagtagtagagcgcaatttgcagacacctccacccaagcaaagccacatggtgtcaactagtttgaaagcaaaatgccatccactccagtccacatttgcaagtccaactgtctgtaatcctgttggtgggaatgaaaaatgtgctgacgtgacaattcatatattcttttccaagattctgaagttggctgctattagaataagaaacttgtgcgaaagggttcaatgtgtggaacagacagagcgtgtctataatgtcttcaagcagattcttgagcaacagacaacattattttttaatagacacatcgatcaacttatcctttgctgtctttatggtgttgcaaaggtttgtcaattagaactcacattcagggagatactcaacaattacaaaagagaagcacaatgcaagccagaagttttttcaagtatctatattgggagtacgaaccgtaatggggtattagtatcgcgccatgttggtatcattactttttacaatgaggtatttgttccagcagcgaagcctttcctggtgtcactaatatcatctggtactcatccagaagacaagaagaatgctagtggccaaattcctggatcacccaagccatctcctttcccaaatttaccagatatgtccccgaagaaagtttcagcatctcataatgtatatgtgtctcctttgcggcaaaccaagttggatctactgctgtcaccaagttccaggagtttttatgcatgcattggtgaaggcacccatgcttatcagagcccatctaaggatttggctgctataaatagccgcctaaattataatggcaggaaagtaaacagtcgattaaatttcgacatggtgagtgactcagtggtagccggcagtctgggccagataaatggtggttctacctcggatcctgcagctgcatttagccccctttcaaagaagagagagacagatacttgatcaattataaatggtggcctctctcgtatatagctcacagatccgtgctccgtagcagtctattcttctgaataagtgggttaactggagcgatttaactgtacatgtatgtgttagtgagaagcagcagtttttaggcagcaaactgtttcaagttagcttttgagctatcaccatttctctgctgattgaacatatccgctgtgtagagtgctaatgaatctttagttttcattgggctgacataacaaatctttatcctagttggctggttgttgggaggcattcatcagggttatatttggttgtcaaaaagtactgtacttaattcacatctttcacatttttcactagcaatagcagccccaaattgctttcctgactaggaacatattctttacaggtataagcatgccaactctaaactatatgaatccttttatattctcatttttaagtacttctctgtttctgctacttttgtactgtatatttccagcttctccatcagactgatgatcccatattcagtgtgctgcaagtgatttgacatatgtggcttatccttcaggtatgtctcatgttgtgacttcattgctgattgcttttgtaatggtactgttgagttcatttctggttacaatcagcctttactgctttatattgttctactaattttggcttgcacagccaggacgattggttttctgcatcaatcaatcttttttaggacaagatatttttgtatgctacacttcccaaattgcaattaatccagaagtctaccttgttttattctattagttctcagcaacagtgaatgaatatgaatcagtcatgctgatagatgttcatctggttattccaaacaatctgacatcgcatctctttctgcaagtgagatgaagaaaacctgaaatgctatcaccatttaaaacattggcttctggaagttcaggtgattagcaggagacgttctgacattgccattgacatgtacggtagtgatggcaggagacgttcttaaacagcagctgctccttcagcttgtaatgtctgattgtattgaccaagagcatccaccttgccttatggtactaactgaatgagctggtgacgctgactcatctgcataatggcagatgcttaaccatctttaggagctcatgtcatgattccagctgcaccgtgtgcaaatgtgaaggccctgcaagggctttccaggccgcaccaatcctgcttgcttcttgaagatacatatggtgccacctaaataaaagctgtttctggttatgtctgtccttgacatgtcaacagattagtgttgggttgcagtcatgtggtgtttaagtcttggagaaggcgagaagtcattgctgccagcattgtgatcgtcaggcacagaagtactcaaaagtgagagctacttgttgcgagcaaacggagggcgatataggttgatagccaatttcagttctctatatacaagcagcggattttgtttagagttagcttttgagatgcatcatttctttcacatctgattctgtgtgttgtaactcggagtcgcgtagaagttagaatgctaactgaccttaattttcaccgaataatttgctagcgtttttcagtatgaaatccttgtcttaaattaaaaaaaaaaaaaaaaatgggtatattttgtctttagatacttgtcatgtttttaatcatttattacatatttatagttttgact

SEQ ID NO: 10262 - DNA, 1030 bp, Zea mays
  misc_feature (991)..(991): n is a, c, g, or t
atttttcactagcaatagcagccccaaattgctttcctgactaggaacatattctttacaggtataagcatgccaactctaaactatatgaatccttttatattctcatttttaagtacttctctgtttctgctacttttgtactgtatatttccagcttctccatcagactgatgatcccatattcagtgtgctgcaagtgatttgacatatgtggcttatccttcagtgagatgaagaaaacctgaaatgctatcaccatttaaaacattggcttctggaagttcaggtgattagcaggagacgttctgacattgccattggcatgtacggtagtgatggcaggagacgttcttaaacagcagctgctccttcagcttgtaatgtctgattgtattgaccgagagcatccaccttgccttatggtactaactgaatgagctggtgacgctgactcatctgcataatggcagatgcttaaccatctttaggagctcatgtcatgattccagctgcaccgtgtgcaaatgtgaaggccctgcaagcgctttccaggccgcaccaatcctgcttgcttcttgaagatacatatggtgccacctaaataaaagccgtttctggttatgtctgtccttgacatgtcaacagattagtgttgggttgcaatcatgtggtgtttaagtcttggagaaggcgagaagtcattgctgccagcattgtgatcgtcaggcacagaagtactcaaaagtgagagcctacttgttgcgagcaaatggagggcgatataggttgataatcaatttcagttctctatatacaagcagcggattttgtttagagttagcttttgagatgcatcatttctttcacatctgattctgtgtgttgtaactcggagtcgcgtagaagttagaatgctaactgaccttaattttcaccgaataatttgctagcgtttttcagtatgaaaaaaaaaaaaaaaaaaaaaaanaaagtactctgcgttgttaccactgcttaagggcgaaaa

SEQ ID NO: 10263 - DNA, 1432 bp, Zea mays
ctggccgggaactagcacagcccgaacacactcgtgtgactcgtgtcctcatagctgagagccatttccaccgcccagcacgctggacccacctgccggcgtcccgaagagcggaacacctgaagccaacgccggccgtgctgcttccgctgccccatcgcaccaagccaccagtccgcagcacgaaagcttccccccctctcttctcctgctggttggctcatcaggcctgcccgaataatcctcctgcggattcccctcacggcaggccaaaacccgcacctttcccccgtcgacagattctcaaacccggcgaactccgggcagggctcacgtcgccgatcccgctcccggattctctttgccgccgcgaggagacggcgtccagtccaggccttcagcagctccgtctccgtgtgtatctgatcgggggattctttgcttgagaaactgctagcatgggcgcggtgcttggacggcatgacacgcacaagcggagttcccatggttcgaagctggaggtaaagatggtcgacgctatgcagcagagagcatcgcatggaacctcactgaaatcgttcgatagcattatcatgaagttccccaaaatagacgagagtttcagaaaatgcaagactatcttcgaacagtttgatgaagattcaaatggcgaaatagataaagaggaactgaaacattgttttcaaaagctggaaatctcattcacagaggaggagatatgtgatctctttgaagcttgcgatataaatgaagatatgggcatgaagttcaacgagttcattgtctttctgtgccttgtctatcttctcaatgaagcagctgtcttggaagcaaagataaagatgggactaggaaatcttgaggcaaccttcgagaccttggttgatgcgtttgtcttcttggataagaataaagatgggtatgtgagcaaggatgagatgatccaagcaataaacgagaccacgacaggagagcgctcttctgggcctatagccatgaaaagatttgaggaaatggactgggacaagaacggaatggtgacattcaaggagttcctgtttgccttcactcgctgggtaggaattgatgaaaatgaggatgaagatgacgatgaataaggactgtgaaggctggttattcttcaagggttagggccagatcagccttggagaagctggaaatggatggcggataaaagcagttgacgtttattggttgcttgttgatcgtaatattcatgccattgctaatagaatgtctcgacattatactcctagtagggtgacttgcatgtctgaacactggtatcaatgttacagttgctgtctactttcttccatgccattcagccattgttctactctgcgctagcccgcgccgatccatttcaaaaaaaagaaacttgcggcta

SEQ ID NO: 10264 - DNA, 1440 bp, Zea mays
atccactcgtgaaccgggacacacgtacgttgaacaaacacccaaggcctgacgagacgagatccggacctccgtcctcccaactagggcgcgcgcgcgacctcggcaccggcggcctcgatccatcgttctctcggatccccgccagtgcatgccctggaacggacggacggaatggcagcgtcgccggaccacctcttcggcctgcgcaacagcttctacgtcggcgcataccacgccgtcatcaccagcagccagtccctccccgcgcacgcgctctcccccgacgacctcgtcgagcgcgacgccctcatgtaccgctcctacatcgccatcggctcctaccagctggtgatcggcgagatcgggcccagcgcggccacgccgctccaggccgtcaagctgctcgccgtgtacctctccggcgacggcgggaacagggaatcggtggtctcgaggcttcgtgagctcctgtcagacgcggcggtcgggagcaatccgattctccgggtgatggccggcaccgtcttcatgcacgaacgcgattacgccgaggctctcaagcacaccaactccggtggcagcatggagctgcttgcgctgaatgttcagatataccttcaaatgaacaggacggaccacgcagagaagcagctcagggtgatgcagcagctggacgaagaccacacgctgacgcagctcgccaacgcatgggtcgaccttgtgctgggtggttccaagatccaagaagcgcgcctcatcttccaggacctgtccgagaagtacccgacgacctgcacgattcttaacgggaaagccctgtgctcgatgcacatgggcaacttcgaggacgcggaggggttgctgctcgagtcactgaacaaggacgccaaggatactgagactctcgccaacctcacggtgtgcagcctgaacctggggaaacccgcaacgcgctacctcaaccagctgaagctcgcacacccggaccacgcgctggtgaagcgaatgtcctccgctgcagagagcttcgacagagcctgccaagcaatggcgtgaacctcgtttgcgaaaattacgtttgctttccctaggatgagtcggaataacatcgtgatctactctgaagcaaaccagctagtgcttggctttctcatgggcagcttggactccaccgtcggcatgcttttccactggtctcggatagtacattcggcctcgctggtgcgctggaaaggcccaggtgtttcctttaccttttgggctatgctctctctctctctgacgccttgttgcgatgggagtgactgaggggaagcaatccttgaaatcctaaacaggagatagcatgaaacagtatttggttcaggtactgcaatgctgggggtcatatctcatatgcctgttccgatctgcatataataatagggtgtttggttc

SEQ ID NO: 10265 - DNA, 1740 bp, Zea mays
  misc_feature (1699)..(1740): n is a, c, g, or t
agaaaagcccaacgcgatcacacgagtgggactggggagtagtgaggcgagagcttctccccgcgccgccgccaaaaccctcaaaacccgagacgccggcggtgaagaggagagggcggaggcggagatggcgacgcggatgaaggacgtggcgcggaggtcgaccaagaagtacgtggaggaggcgctgtaccggcgtctgttccggaaggggtcgacgccgcaggcggttcgagaggaggtcgatggcttcctcgacagccggaagcgggcgttcaagtgggaggtgggcgtttgcgtccgccggatgcggcggaacgcgctctaccgcccttcgctcaagctttctgaagttatggcgagaagaggcatgaatcctactgttagtgatcaagcaattcgcctggatctcattgccaaatcgagaggtatcgctgctgccgagaagtactttttggacctcccagaaacatccaagactcatcttacatatggcgctcttctcaattcttactgcaaagagttgatgactgagaaggccgagtcccttatggagaaaatgaaggagctcaactttgctttcactgccatgtcctttaacagcttaatgacgatgtacaccaaagtcaaccaagctgagaaggtccccagtatcattcaggacatgaaggcagatgacgtattgccagatgtctttacttataatgtttggatgagggcgcttgcagctctcaaggacataccaggggttgagagggtgattgaagagatgaaacgggatggccgtgttgctcctgattggacaacatacagcaacctggcttccatatatgttgaggctggaatgtttgagaaggcagaggctgctcttaaggagcttgagaagcggaacaccagcaatgacatcgaagcctaccagttccttattacattgtatgggcgtacacagaatttagtggaagttcaccgtgtctggcgatcgctgaagcgggataaccctagaatggcaaacatgagctaccttaacatgattcaggttttggccaacttgaaggacctgtctgcagccgaagcctgttttaaggagtgggaagcccggcacatccatccacccaagaccaacacaaagggctcgggggcagataatacacctggtgcagatccaaaatctccaagtaacccgcctaataatcagtctggcaccaaggaaaccggggacgggacagcagaggacctccagccgaagcatccaaaatatgacatccgggtagcaaacgctatgatcaaggcgtacattaccgagggcatgcttgacaaagctgtcgccatgaagaagcgtgccaagatgcgcggcggaaggctgaacgccaagacatgggagatcttcatggagcattacctcaagacgggggatctcaagatggcccattggtgcgcggaccgcgcgatgaagaaggggcacagcagcggcaggatttgggtgccgccgcccgccgtgacggagaccctgatgagctacttcgaggagaacaaggacgtcgatggggccgagcggtacgtgggggctctgaagaaggtgcagaaggatctgggcgcaccggtgttcgagccgctggtgcggacgtacgccgccgccgggaagaagttccccgggatgcggcagcggctgaagatcgagaacgtggaggtcggggagggnnnnnnnnnnnnnnnnnnnnnnnnnnnnnnnnnnnnnnnnnn

SEQ ID NO: 10266 - DNA, 812 bp, Zea mays
tcgagtcagctacgtagcccccccccacagctgaaagcagccaaaacgcagaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggccacgggcccgctggtcgcagagggtgcaagggtggcgccctccgcgtccacctgggctgccgacaaggcgtcgccggcgaggccgagcggcggcatggccacgcagggcgacgaccagagctcgtcgggcggcagtggcagcagcggtgagcacggcaaggaggagggcgagaagcagggcaagagctgcctcaccaaggaggagtgccacaagaagaagatgatctgcggcaagggctgcacgctctcggcgcacagcaagtgcgccgccaagtgcaccaagtcctgtgtccccacctgctaggagccgaggccggagcttgccggcggcgagacctcgatcgatcgagtgcttcacttcacttctttgttatagttcttgtgtgttgccgttgcgttgcgttgcgtagacgaagggaataaggaagggtaattggattacctgttccagatctctgtgtaagcgtgttgtcgtgacaagtcatttgatccagagcgagcgatggatagatcgcgctcgcagttttaattgcaatgctagttcaataacaaaaaacttcgagggggttgtccgggaccccattcgccctataggggagccgtaattacatttactggccctttg

SEQ ID NO: 10267 - DNA, 807 bp, Zea mays
tcccacgcgtcccaactcacagctcaaaagcagccaaaacgctagctagctgcagcgatgatgtctcgctcctgctacctcgccgtgtcggtccttctcgcggtcgccgcgacagccagcggcgccatcgcgccggcgttgctgcacgaggtgcgcctcgaggaggagggcctgctggtcgcggagggcgcgagggtggcgtccacctgggcgggcaacaaggtctcgcgggcgcagccgatggaggcgtggccgagcggcggcgtggccacgcagggcgacgaccagagctcgtcgggcggcggcgagcacgccaaggaggaggggagcagcaaggagggcgagaagcagggcaggagctgcctcaccaaggaggagtgccacaagaagaaggtgctctgcggcaaggcctgcacgctctcggcgcacagcaagtgcgccgccaagtgcaccaagtcctgtgtccctacctgctaggacccgccgacgaggacgaggaagctagtttctgtgatgcaattgcctagatgattggaataaggacgggtacttcttgcatgcatgcatgcctctggtctagggtgccatttgtttttgtctgcataatggtttgtgtaaggtactgttgtttaacatgccacactaccagctgcctgcctaacaacagtacaaacacgaagatatttgccactccagggaaaatggaaactcaccgaaaccggttctaggcaacaccacatgatatcattttcactcaatgcagtgcatgacaaagggaggtactcagaagaaaaaagaaaaaaaaag

SEQ ID NO: 10268 - DNA, 833 bp, Zea mays
aacagctcaaagcagccaaaacgcagaagctgcactgcatatacagaagatacatcgagctaactagctgcagcgatgtctcgctcctgctgcgtcgccgtgtcggtgcttctcgctgtcgccgcgacagccagcgccaccgcgccggcatggctgcacgaggagcagcacctcgaggaggccatggccacgggcccgctggtcgcagagggtgcgagggtggcgccctccgcgtccacctgggctgccgacaaggcgtcgccggcgaggccgagcggcggcatggccacgcagggcgacgaccagagctcgtcgggcggcagtggcagcagcggtgagcacggcaaggaggagggcgagaagcagggcaagagctgcctcaccaaggaggagtgccacaagaagaagatgatctgcggcaagggctgcacgctctcggcgcacagcaagtgcgccgccaagtgcaccaagtcctgtgtccccacctgctaggagccgaggccggagcttgccggcggcgagacctcgatcgatcgagtgcttcacttcacttctttgttatagttcttgtgtgttgccgttgcgttgcgttgcgtagacgaagggaataaggaagggtaattggattacctgttccagatctctgtgtaagcgtgttgtcgtgacaagtcatttgatccagagcgagcgatggatagatcgcgctcgcagttttaattgcaatgctagttcaataaaaaaaaaaaaaaaaaaaaaaaggcgcccgccacattcaaaccgagatcgctgtttagcatgccagcataataatatcagtacaatcatattatatt

SEQ ID NO: 10269 - DNA, 1289 bp, Zea mays
cattgggtaccgcccgggcctccctcgttatttccgggctccctcctgtgtacaccactcccgccccgcctaccattttatccccgcctctcctggcctctgccgccccgtcgcacagaatcgcttggtgcaccctgcgagggcctcctcgaaaccctagcttgcccagcccctccgggccatgggcaagtacatgcgcaaggccaaggcttccagcgaggttgtcatcatggatgtcgccgccgctccgctcggagtccgcacccgagcgcgcgccctcgcgctgcagcgtctgcaggagcagcagacgcagtgggaggaaggtgctggcggcgagtacctggagctaaggaaccggaggctcgagaagctgccgccgccgccggcgaccacgaggaggtcgggcgggaggaaagcggcagccgaggccgccgcaactaaggaggctgaggcgtcgtacggggagaacatgctcgagttggaggccatggagaggattaccagggagacgacgccctgcagcttgattaacacccagatgactagcactcctgggtccacgagatccagccactcttgccaccgcagggtgaacgctcctccggtgcacgccgtcccaagttctagggagatgaatgagtacttcgctgccgaacagcgacggcaacagcaggatttcattgacaagtacaacttcgatcctgcaaacgactgccctctcccaggcaggtttgagtgggtgaagctagactgatggattcagagggacgagagagcagcaggcatggaatggaactcactccccgctccctccacaccaccccagcgttgtggcagaggcgcataccgtcgtgttagcttcgtttctgctgtaaaaaaaaacccttagtgttttatttagcatgtagccttaactggtcgtgtgttacagtacagaactgatgctgagttacaacaccctgatctgatccctcaactccaatgtaacccttaacagctcattctgtaaggaacctgtcaccctgttacctgttgctgaactaatgaagtagagctagataatgacgttttatcgtagttattattaataactcctcccctgtggtggcgcccctgaaaaaaaaaaataaggaactaccatctgaagatgacatgggcaacaaagaaagtttgtcacaatgcacttggtgactggaaaaataaaaaaacaggggggggccgctttaaaggatccaagcttacctccgcgtgcatgcaacgtaatagtttttttatagtgccacctaaat

SEQ ID NO: 10270 - DNA, 5113 bp, Zea mays
  misc_feature (2009)..(2009): n is a, c, g, or t
tgcagtattaaaactgacgtattatacacataacaatatttggtaaaccatcaaaaatctatattttaaaactgaagcattgtaaatactatagttgttttaaagtattttaaatttaagtctggatctcagttattaatattgtggtatttaaagtgtgatattatcatgactaaagtatattgtagtatttcaaaaactatgattttcaaactttgtttctaaacaggacccaaaaaaccagttaccccaactaaaatcagttttggttggttagtgattgtttatggaaaaaaggctattggatctaaacactcctattcatttttttcttcttctaaaagtgagttttcagaaatcaagtgtagaaacaagtttttaagaaatcggagtaaattcaaacggggtagatcctaaaaaaactaaaattcgtcgttcctctctcacccacacgcccctcgcaccgggcgccctctcccttacctaagccaccctttaaatggcaacaccaacacccgtcccgacctcttctctcctaattattcccgggcttcctcctgtgtacaccgctcccgccccgcctaccatttaacccccgcttcccctggcctctgccgccccgccgcacagaatcgcttggtgcacccggcgactcggcgagggcctccctgaaaccctagcttgcccagccccgccgggccatgggcaaatacatgcgcaaggtaaaggtttccagcgaggttgccatcatggatgtcgctgctgctccgctcggggtccgcacccgcgcgcgcgccctcgcgctgcagcgccttgagaagcagcaggtgcagcgggaggagggctgcggcggcgagtacctggagctaaggagccggaggctcgagaagttgccgccgcaggtggcgtccgtgaggaggtgcggcgggaggaaggtggcggccgcggcccccgccgctatggaggaggcggaagcatcgtacggggagaacatgctcgagtcggaggccatggggaggtgagttcttggattgaaatttctgttgcgttcttgggttgcttgcacgggttttgggtttagtggattccgattgtgtggtaccaagattttttttttgggacagaaagttggaattttagcgctatgcgtttctatttgaatgctttcgtttttttcctttttcgcgcagtgtgttcgacttcaaattgggagtcatgcgaatccccccagcacgcttgtacagctcctatgctttcttgcggatttttctacgccaggaacccctttgctaattcttgccgtgctctccttgcgcttaattttttcggcggtgtatcttccattctcttttgaaatcaaaagtcaccccatattttaatgccaaaaccattgtcgctgccgtgtgtccgagaaattagtctctaattcttgcaataatcggttgacgccgtccaaactccaacatcaccccataaaagccccaatcccacctctggcttggctttgattctctgaagcaccgagtaagttgtgctcaatcttgtaccagagcggcagagcccaattaatccgctagcttagtggagtctcttgcagtggccagccatggcgtcctcctttttccatagtggaacggaaaagtggcctcctttccccttgttctttccccttccccatggacgcacacgcccttgtttcttttgcttgcgaggagacgagtagccggggacccctcaaatcttttaccaatcaatcaaaagcccttacttttcgcaagaaatttctctgttccaccctcgaaaaagcgccctctgctctcaccctccctcacagcctcatttctcgcttgggtctctcaccactggcctgtcacctctttgggaggaaatggcatgtcctggcaaggtctcttcctgggccatggcccgaaattggcatcgccattaaatgtttgaggtgaaagggtggtcggagtcctccccgtcttagcatactagagttttttttnatatccttgctgaagctagggcatggaagaacatttcaagattaggaaactgcggcatagctttgctcagtatcacgagcttgtttgcaatttttgtaggtcctacttatctttcacaagtggtcctcttccatgcttaaacaggtcagagtccatgtttagccctgctacgattagccccatctatctgtagactgaacgctggctacacccccccccccctctctctctctctctccattgtgggtgcacttgctcgcatggagagagatgaacgaaagcggttgctgtgccatttcttttgtcgtttttggttcaccatcggggccaagccgtggcgtgctgtttgcggctctagccatggccttgatgctagcaccgcctaaaggagggaccataatacggaacagttgtaaagctgagtctctaatccctttgggcccttcatgtatggcagcctaacagtaactggagggtggaagcgtgcactgctatgatctgaacagtgcgtgtgtttgtgtaaatcatgctgcatcagtggccacctacgagcatagcgaagccaggtgcatgttttgctagggccactgtttggtgcccggcctgcctcatgcagcttcggttcggttctggggattcgcctgcctttggtgtcgtctcaggcgagaatgaaggctgggcgagtgagccttacctactcatggtcatgggactgcgagttggagttctatagtcctaaccattttgttgtttcctctggctggatgcttggttgtccgctagcctttttatggcacctgaagctagacatcgagaggaatggtagattcgtaggaccacaaacgatgatgttgtgcatacttactaatggttatgcattacgttttctgacatttcttttgtttgcttgttgagtattcgtccggtgtaacattggaattagagaaattgacctcgctttgtttggaattggcttcaggtttttcatgtatgtatactgaccttgttgcttgcaggaataccagggagacgacgccctgcagcttgattaactctgagatgatcagcactcccggatccacaacaagatccagccactcttcccaccgcagggtgaaagctcctcctgtgcacgccatcccaagttcaacggagatgaacgagtacttcgctgctgaacagcgacgccaacaacaggctttcattgacaagtacgatttgcataatctgttttgtcgattcttgattcattataaattattttgctgatgcattcggcttctcttaacgatgccttgcactaaccacaaacatgtatgatgcatggcttaatcttcaggtacaactttgatcctgtaaatgactgccctctcccaggcaggtttgaatgggtgaagctagactgatagattcagaggacatgagagcagcagcatggaactcacctccgctccctccaccgccgcagcgtcgtggcagaggcgcataccgtcgtgttagctttgtttctgttgtaaaaacttagcgttagcttgtagccttaattgtcgcgtgtcacagtacagaactgatgctgagttacagcaccctgatatgatctggtccctcaactccaatgtaacccttaacagctcattctgtaaggaacctatcatcctgttaccagttgccgaattaatgaagtagagctagataatgatgttctgtcacagttattaatacttatactctgtgatgttgcacctgaagctgatgtaatttttgtgtgtgattcatgcactcctcttggtacctgcaaagctggctgccatggtttgacctttggagccttgtgctgtgcccttcctgcagtggcatcttctctctcagggctcaggatgctgctgcatgtgtcattattgctggatgctggccacgctgtgcatttgctatgctgaattgctcctggattctcagttgctgcaatggccatgagagtttgggttgtatcctgcttggagtcctacatctggtgattggtgcatgctcgcaaacttttgtgcttgtgggctcatctccacttgtttagtgggtgatcttttcactgtgtgtgcaagctgacagtgcctttggctgctgtgatgaccgattattcgggcgtgtcgcactgcctggcacatcctcttggcttcttgttttcttaccagtgctggactggtggtgactggtcatggtaactgataaagaacgccctttccacagtatattcattcttgtggtgcctacccctggtccaggggggagggcctttccttcttttcacttgccttcgtgaagtctgtcctgcgctgctgctggagtgcaaaccagcaggtgcttccctgcttgcttctttgcaaatccaaataagctgccctggtatttacttctgaaatctgaagctactgctcagctagcactgtactggtttaacagaattaggcacagatctgattcctttgttcttgacaagaccatgcccatgcatttcgtactattaaacaagtgagcccatcatggtacctccctgacaaaagtacaaattctgatgagtacaatccatgtcatgtcattatcttatctgaaacagtttcgttttgaaatgttgtagtaccaaataatccctcgctctcaagaaaaaaaacaattcaaccgatttaaactttaaccaaatttatataaaatgttaatattatttattatgaatcaaatttgaactagttccactggcgcggttctataattacacctttttttagacatatatgatactgttcgctctattaatgacaaaaccctgcagctcctgcgaagctaagaactattatgaatataggctgtaaacggataattatttatattcaagactgaatcacctcatgaccgagtgtgttcaatgttgacggagcaaacatacacgcaaagacatatggaaaggacatcacgtccaaaaacaagaatggcaccccatcaaaacaatcttgtaggcagatgaaggagtaagtttgtaggcttctcacacaagcacgagagtcaagagctccgtctcctaacacacgaaagacagtaataaagatatcgacacc

SEQ ID NO: 10271 - DNA, 2178 bp, Zea mays
  misc_feature (7)..(7): n is a, c, g, or t
cccgggntcgccccgcgtccgccccgcgtccgcctttctcgcagtccaacgaaaccctcggaggcacggttcggttcgccgacatgctgtctggcgtgaagctggttccgcgagaccagatccagtctgatcagaagcgtaggggtgaccagggctccgattccgactcctccgacggcaagaagccgtggaagcacagtaaaagaaggcggggcaagaaagagaagaagagacgaagcagccggcggcagcggaggcggagcaagaggtactcgtcggaagattcttcggggtcagacaccgacgattcaatcggagaggaagaggaggatgatgtcagtcggagcaagcgtcgcgggaaggacaggaggcggcgacgcaacttttctgacgacgatgattccgaatccggtgaatctgaccggggaagagcctctcgcagggggaagcagagacgtgatgacgatgatgaggaagaagagactgaaggtgatgggcttagggcaagtgaggtggtcaggagggagatggggcttgaatggatgctcaagccagcaagcagcagccaaactgagggcaccggtgttcgtaaggttgataatgtcgagaaggatgaatctgcacatgaagagattatgagaccgaacccaaaggaacttaacccataccttaaagataatggaattggatacccagaagaatcaaccccatcaaatgctggcagtcagttgcttgcatcctctgttgtgggtgatggaggtgccagctggagacttaaagctttgaagcgtgcaaaggagcaagctgctcgcgaaggaagaaaacttgaggaggtatgcaattattctcagtaaccaattcatttttttatttctcattaaattttgtgactattcaatttctataggttgttgaagagagatggagctcattaggcgacttagctgtttcagtatcagcatcaagagctgcccattcacatgctcatttgcatgccattagaggcagaaaatctggtaatgctgacaactcagaagaacgtgttaaaagaaatccagagggtcagctggatggtagcagtggcagacgtgaatatctacgggatgtttcttctcagcaccatgccatgagaaaaccatgacctgattctgtcccatggaaaaagagaagacagaatatatcttctgaagatcaggcacttatctcatcagcggtagcaagcttaaataagttttctgatgatggaagctttatggaaaagattagcaatgttgagagcaagaacacaaatgtttccactgctagtgctagtgctgatgagcagagggacaatgggcagaaaacccctaaggagagttcaaacaaagtacaattagtgagcactcagaaactaaatgcaaaccagatggctgcaaagattctgcagctccgaatgaaaggcaagcatcaagaagctgaacaactttcggtgagcctttcaattttttttcttgtggcaacgctgtcacttttttgactgaatctatgaatcattagatatcaatttattttataatgcaataatgggaatatgcagagtacccttaacagatatgtgtttgatttaacatcgtagatatgctagttttgtgtttccaccatcatctgagtcctaaacttgcatatattctgaaaaactgcacgtaactaaggttcaaaatatggattgcattggtcatactgggtctttattttcctaacagattgcaccatatatttgaactaagcatatatttgcccacatctcatgatttaggaaactgggataaatgttttgttatctataaaaatagggagaggttgagattttttatttgcctggcactatggctgagctgctcgttgtactttatcagagagaaatggaagctttgctggagaatcaggatactgcccatgagaagcctggtcatggaaaagaaagaagctcaatcaggtaactatgtccagccatggtaaagaatgatctctgaaaacaaagtaaagtatgcacttgtcattttgtgggggaagtattgtaggaataaatgatttcctggagtactatggaaaagaagttctggtttcattgttattttagcacttctatcctaatactctatctgcctgttgaagagttctttttgcatctgcaggtcg

SEQ ID NO: 10272 - DNA, 1279 bp, Zea mays
tcttcccctgaccgccgccgtcaccgccgatcacacctctagtcagcttccactggagcacgccaccccgaattttctcccggagtcgttgccctcctctcctacccccgtacactaaagctggttcgcagatccatccggacttgatcggttccttcttttatttcttgcccatagagcccaaacattattggatggactctgtcacttgctgcgacggcggcaaggaattggaataggacgaggtggggatcacgggctgcgacggcggcaagaaattggaaaaggacggcgtggggatcagggtattcgtcttgggaaaggggatggggggtctctgctcgaaggtctcagctgtagacaagtcaccgagcgacaccgcgcttggccggaaccaggtcgccgatcatgagccaggggcgtcgttggagttggagaagccaccggtgtcccgagagtcagctgcgccggcaaagcggctggacgagcagctgcagtctttctcgttccttgagagcgtcgtccctggggttgcttttcatgccggggctaacacgggcggcgaagcggggtccaggacctcgccgcagctgaccaggtcgctgtcccagagggctggtgtgggcaaggcaaaagccggcgctgccaaggtttcagaagtgagctcaattttaggtagagctagcactgctgggcttgaaaaggcagtggaggttctagatacacttggcagtagcatgacaagtttaaattccagcagtggttttgtgtcaagttctgcagcaaagggaaacaaaatatccatgctggcttttgaggtggcaaatactatagttaaaggctctaatctgatgcgttctctatcggaacctagcataaagcatctgaaggaggtggtgcttcattcagaaggtgttgaaaaccttatatcccaagattttgatgaactgctcaagatggcatctgctgaccaaagggaagagttagaagtattcacaagagaggttgttcgctttggaaaccgttgcaaggatcctcaatggcataacttggaccgctactttgaaaaactggcatctgaacgaaccccacaaagttatctgaaagaaaaggcagaatcagtgatgcagaaactggtcacctgcgttcaaaatacagttgaattatatcatgaattgcatgctttggatagatttgagcatgattgtcgtcttaaacagaaagaacaggatggcttgagttcaagaggagacaacctggatatactgaagcaggaatt

SEQ ID NO: 10273 - DNA, 1441 bp, Zea mays
  misc_feature (445)..(445): n is a, c, g, or t
ggtgaactgctctagtgtcgtgtgtttcgtagatgtacgggcaacaacttggaaccctcgcctggaatgatcaaacaagcaccatcagaaaaccacatggctcggcaaccttggagcaataatggccatagaaattccccttcaaattcattagatggaggagttcctggacccatgcctctggtccctttccaggaggaacttgcagttggttgtgaagagattcgtagaattgctgctgataatactcttgtgctagaggatattctgggccttaggcaagaattagctgtcattgaagacgagatccatatacttgccaaacaaaccattcccagacttcgtgttgataatgaaatggaatacagggatattatccagggaggcatgaagttagaggaacagatgcatgctcttaaacttttcaaggaaagaagtgttgggntcctaagttctgaaaaagatgggagttgggaagctttgtgcaaagagctatctgtgaaggttcagtcattgtacagggagctggagcagatccaatccgagaacaagcagatacctgctataagagaagggttgcatgatatacaagaggagatttcgagggccaggatggcatacgagcatgagaaacgtgcaaaagttgagcttcttgaggagagtcaggccatagagagtgattttatcaacataaaaatggaagcacagagattgcggacagagctggagaagaggaggtctggtgtgttcaagcatcatgcatttggctcatactataaaagatagagcatggcattgcatcctccaactgattaggtgggcgtcacaaagcgtagctaagggtttggtgtctattagagaaattaatcgaactcaggagtcaagaccaaatgcgtttgtctttcggatgagcagctgacagttatttgcgaacacgttgctattattatatctcattattaagtaggagtacaaattggacgattgaaagaagaatattatcaatttggtctttattgtactcctacttattttttctctcgaaaagtactcctacttatttttaatggttgttttatgtcttattatccacttctatattgtcctttgttttccttaagataaatcaactgcgagacactcttatggatgtcttcattttttttaaaaaaaagtaggagtacaagccaagtctacttgctgaggggcatcagcatcagattcatattagctgatatggtgcgttacagttttgctgagtgctgacagtaacatcactgtttatcccctaacgggcttcgttgatgatcaattcttatttcgtatcaacaaacacttatatagcatatgccaggcttccactacacaagcatccgctattaacaaatggtgtttggctaatcaagcctgagatggacctgagactgcaggcatcaagcaa

SEQ ID NO: 10274 - DNA, 1419 bp, Zea mays
agagcaaagagacaacatgcttgagacttgagagaggaaagtgaccggggtgccgctccggccaggtcaaggtggtgaaggaagtgggtgcgaaggaagttggggctcgcgttcggaaagcttttcagcctctcttcgccaagaaggagattccgatttttggcgcccacacgcatgttgtacaatggcttgttcgttctgtatcttattcttgcggtttcggaatgtaatccagctctgattcaagatttattaggctggagagattatttctcgctttgagaagacaaagtttttgttgaaatgctaaaaacttttccagtgcaccaaagacttgggcaccatcagaaaaccacatggctcggcaaccttggagcaataatggtcatagaaattccccttcaaattcattagatggaggagttcctggacccatgcctctgctccctttccaggacgaacttgcagttggttgttaagagatttgtagaattgctgctaataatactcttgtgctagaggatattttgggccttaggcaagaattagctgtcattgaagacgagatccatatacttgccaaacaaaccattcctagacttcgtgttgataatgaaatggaatacagggatattatccagggaggcatgaagttagaggaacatatgcatgctcttaaacttatcaaggaagaagtgttggtcctaagttctgaaaagatggagttggaagctttgtgcaaagagctatttgtgaaggttcagtcattgtacagggagctggagcagatccaatccgagaacaagcagatacctgctataagagaagggttgcatgatatacaagaggagatttcgagggccaggatggcatacgagcatgagaaacgtgcaaaagttgagcttcttgaggagagtcaggccatagagagtgattttatcaacataaaaatagaagcacagagattacggacagagctggagaagcggaggtctggtgtgttcaagcatcatgcatttggctcatactataaaaagatagagcatggcattgcatcctccaactggtaggtgggtgtcacaaagcgtagctaagggtttggtgtctatcagagaaattagtcgaactcaggagtcaagaccaaatgcgtttgtctttcggatgagcagctgatagttatttgcgaacacattgctattactatatctcattattaagtaggagtataaattggacgattgaaagaagaatattatcaatttggtctttattgtactcctacttatttttttctctcgagaagtactcctacttatttttaatggatgttttatgtcttattatccgaaaaaaaaaaaaaaaaaagcttatcgataccgtcgactgtttaaacacaataaagttggaactggagggggg

SEQ ID NO: 10275 - DNA, 1503 bp, Zea mays
accccactctgctgctgttgttatgataacaactcgcacccccactctcagcaccgcagcctcactcctgctcacccaccggcaccgcatcctcgccgcccggaccctctctgtctctgtctccgccgcggcgggctcctcctccatccccgtcaagatgactgcgcggtcggcgctggacgaggtcaccgacacgggcgccttcgaccggtcgccgtccaccttccggagctccgtttccagggacgggcggttccccgccgtggcggggcggtaccacctctacgtctcgtacgcgtgcccctgggcgtcccggtgcctcgccttcctcaagctcaagggcctcgaccacgccatcggcgtcacggccgtgaagcctatcttcgagcggaccaaggagagcgacgagcatctgggctgggtgttccccgccgccgccgacgaggagcccggcgccgagcccgaccctctcaacggcgcccggagcgtgagggagctatacgagatcgccagctccaactacgccgggaagccaaccgtccccgtgctgtgggacaagcagctgaagacggtggtgaacaacgagagctccgagatcatccggatgctcaacgccgagttcaacggcatcgccaggaaccccgggctggacctctacccggcccacctccgggcctccatcgacgaggccaacgagctggtctacgacgccatcaacaacggcgtctacaagtgcggcttcgccaagaagcaggggccgtacgacgaggccgtgacgagattgtacgaggctctggacagatgcgaggagattcttggcaagcggcgctatatttgtggcgaccagctgactgaggcggacattcgcctgttcgtgactctcattcggttcgatgaggtctacgccgttcacttcaagtgcaacaagaagctgctgagggagtacccaaacctgttcaactacaccaaggacatataccagatccccggcatcagcagcaccgtcaacatggaacacatcaggaagcactactacggaagccatccgtccataaacccatacgggattatccccgctggacccaacatcgactacaatgccccacatgacagggagaggttcagcgcctgactgcgcgtgggaccttgttgcttcctttctctctctctctctctctctcttttctgcaggagccgtgtgcagtgttgttgtgcttcatgagggtcttgtgcttggccgtgtcagaggctgcaagaatccctactgtactttttttcttcttctgagcagttgaagatggaagacaaggttttatttcgcacagataaataaaaggtacaaagggtcgtcgattttatacgaaggcctcgtttggcacaaaaaaaaaaaaaaaagtgttttctttctttccttccttatgacatcccttcaaaccaagttgaacaagatggtgcacagtcgccatatacgcaatataatgctatcgacacactaaatgcttc

SEQ ID NO: 10276 - DNA, 1177 bp, Zea mays
cctcgaggccggccgggaatcgtctcgcacgtaccgtacggtctcaggcgcgtcccccccgccgcccccctcgccgctccacagacgacggcggaggcggcgagatgacggtcttccacttcctcaactgcgccttcctcacctttggcccccacgtcgtctactactccgctaccccactgtcagagtatgatacgatcggcacttctgtaaaagcagctgctgtttaccttggaactgcacttgtaaagcttgtttgcttggcaacattgctcaaagtacctgagaatgatagctttgatccctgtcaggagttattgaaagttgttattggattcatagatgcagttggactgtattttgccttgacacagttgacccacagaaacatatctcagaatcataagttccaggctgttggtcttggttgggcttttgctgcttcagttctgcaccgactggcacctctctggattggagcaagagggcttgaatttacatgggagtacatattacaaggccttgaagcaaatgctaatcttgtgatgaccctctcccttgctgcattgggatccttgatgtggcttaggaagaacaagcctaggactttggttccgatagtttatgcatgtgctctgctcttagcaacaatgccatctattaccggctacttgaggaggtcattggagtggcagacaccaaaggtggttggctttgagctcatctcctctcttgttatggctttgatcagctggcagctgttctcggcttgtcagagaccgacgtgacgagacatccatatcactgccaattttacgtgcagtttgaagctgctgaggatgcttcctgatacgtcggaagaattacgatgattctctgaactctggaccacaactcttcttggcgttcggtcacagaacattttacatagaacatctgttgtgacttagagaactgtcgagcagaaacccatgcctcaaatgagttaattctgtaacagatgctcaggtaggcctttgatctgaaacatttgtttattgttattacggtgtgcatttcagacagatgctatctttggtcgcataatctagcgtaaagatcagataattcaggtatcccacagaacgcgtgaataaaaagaagtttggttgcaaaaaaaaaaaaaaaaatgtgaaca

SEQ ID NO: 10277 - DNA, 1105 bp, Zea mays
ggccgcttcgagccggccgggccggcattacacacctgcatctcggaatcatcgcgcagcatcaggcgattcgacctcgccgttgcccaggcgccggagacgacgacgccgacgagatgacggtgttccacttcctcaactgcgcggtcctcaccttcggcccccacgtcgtctactactccgccacccccctgtcagagtatgacacgattggcaccagtgtaaaagcagctgttgtttatcttggagcagcacttgtaaagcttgtttgtttagcaacgttcctcaaagtacctgatgcgaatgatagctttgatccctaccaggaattaatgaaaattctaattgggtttatagatgttgctggcctttattttgctttgacacagttgacccacagaaacatctcccagaaccataagttccaggctgttggtcttggctgggcttttgctgattcagttctgcacaggcttgcacctctctggattggggcacgagggcttgaatttacttgggagtacatattccaaggacttgaagcaaatgccaatcttgtgatgaccctctcccttgctgcattaggatccttgatgtggctgaggaagaacaaacctaggactttaattccaataatttatgcatgtgctctgcttctggcaacaatgccatctatcaccagttacttgcggagatcattggagtggcagactcccaaggtggttggcttcgagctcttctcctccttggttatggctttcatcagctggcagctgttctcggcttgtcagaggccgatgtaatcaacgaaacaaagcactgcgggatttgccggagatttggcgctcccaagatgtctcttgttgtacttcggcaaaattagaatgctgcttagagccttggcgctacgataacatattattttgagggtcagttgcagaacgttttactttatttgtcggctatagtgcagaaacacatgatctaatgagcgcaactgtaacaggtgctcttgtaggaatcgagctaaaacgtagcacctttatacccttgtgggtatgggatattcctccccaaaaaaaaaaaaaaaaaaaggggcccctaa

SEQ ID NO: 10278 - DNA, 1175 bp, Zea mays
gaaaaagcctagttcgcgttacgcgcccccccgggggccgccccggcgtcacgcccacaccccgtcacccccgcccccaatcgtctcgctcgcaagtcgcatcgcacgtacggtctcaggcgcatcggcctcgccgctgcacaacgccggagacgagacgacggcggctgcgggatgacggtcttccacttcctcaactgcgccttcctcaccttcgggcctcacgtcgtctactactccgccacgcccctgtcagagtatgatacaatcggcacttctataaaagcagctgctgtttatcttggaactgcgcttgtaaagcttgtttgcttggcaacattgctcaaagtacctgagaatgatagctttgacccctatcaggagttaatgaaagtttttattggattcatagatgtagctggactgtattttgctttgacccagctgacccacagaaacatctctcagaatcataagttccaggctgttggtcttggttgggcttttgctgattcagttttgcaccgactggcacctctctggattggggcaagagggcttgaatttacatgggagtacatatttcaaggacttgaagcgaatgctaatcttgtgatgaccctctcccttgctgcattggggtccttgatgtggcttaggaagaacaagcctaggactttggttccaataatttatgcatgtgctctgctcttggcaacaatgccatctatcaccagctacttgaggaggtcattggagtggcagacaccaaaggtggttggcttcgagctcttctcctcccttgttatggctttcatcagctggcagctgttctcggcttgtcagagaccgatgtaacaagacatccataccactgccaattttacgtgcaatttgaagctcctgcagatgctcctgagtacgtcagaagaattaggaagatcctttgaactttgagctacaactcttcttcttggcgttcggttacagaacattttacttagaacatctgttgtaacttgtgagctgtagagcagaaacacatgcctgaaatgagttattctataacagatgctcatgtaggcgtttgatctgaaacatttgtttattattattgcggtgtgcatttcagatgctctctttaaagtcgcaaaaaaaaaaaaaaaaaagcggcc

SEQ ID NO: 10279 - DNA, 2007 bp, Zea mays
gtctcgctcgcaagtcgcatcgcacgtacggtctcaggcgcatcggcctcgccgctgcacaacgccggagacgagacgacggcggctgcgggatgacggtcttccacttcctcaactgcgccttcctcaccttcggccctcacgtcgtctactactccgccacgcccctgtaccccctccccctttcactgcttcccctctctctctctctgtctccgtgagatccgtatgctaaacacgcgggatctgtgtttgctacttgatctggtcgctctgttgcgtgatctgcaccggagagtccgaacgccttgacccgccttgtgggatggggttgtagttcagtgcaactgcagtgggtttcgctcactcaagttggcaggcaaacttacgttgcacagttcgttgggattcggagcttagtttgagtagattaaggttttccatcggaatctagctagcagagctgcaatttggggtggtgttttacgagctgtacctgccatgtaagctcacttcaatcgtacgtttttttttgttgtgggttcggagggtattgctggatccgtattgtcagtcaagactatagagtaaccacatgataattatgaaattgttaagtgcattctggagtggaagagattacattgaaagtacattcatgtaaataacaggccgaaaattgaattacattaaatggtcgctagtgtagtattctttctgtagctttcaggttgtggtgacgtgcctttagttttcagttacacaaagggctgaatatctcatttctcatctaaggcaattatcgcatccagttcaactaaaccctacttttctttgactgtcgtctacccataacccatggaacatgtagactagttcatgggttcttggcattgtatacctagctgaccaagttttatctgaacatacaataaaaaaagtgttctgcatttaaaggttccttggactgaacatttttatccaaccaactgtttcaggtcagagtatgatacaatcggcacttctataaaagcagctgctgtttatcttggaactgcgcttgtaaagcttgtttgcttggcaacattgctcaaagtacctgagaatgatagctttgacccctatcaggagttaatgaaagtttttattggattcatagatgtagctggactgtattttgctttgacacagctgactcacagaaacatctctcagaatcataagttccaggctgttggtcttggttgggcttttgctgattcagttttgcaccgactggcacctctctggattggggcaagagggcttgaatttacatgggagtacatatttcaaggacttgaagcgaatgctaatcttgtgatgaccctctcccttgctgcattggggtccttgatgtggcttaggaagaacaagcctaggactttggttccaataatttatgcatgtgctctgctcttggcaacaatgccatctatcaccagctacttgaggaggtcattggagtggcagacaccaaaggtggttggcttcgagctcttctcctcccttgttatggctttcatcagctggcagctgttctcggcttgtcagagaccgatgtaacaagacatccataccactgccaattttacgtgcaatttgaagctcctgcagatgctcctgagtacgtcagaagaattaggaagatcctttgaactttgagctacaactcttcttcttggcgttcggttacagaacattttacttagaacatctgttgtaacttgtgagctgtagagcagaaacacatgcctgaaatgagttattctataacagatgctcatgtaggcgtttgatctgaaacatttgtttattattattgcggtgtgcatttcagatgctctctttaaagtcgcatcatctagcgtatagatcatgtcccagagcccgttttttttaattgccctttttggccaaaaatattcaaaaaaaaaaaaaaaaaactagagggggggcccggtaccc

SEQ ID NO: 10280 - DNA, 2613 bp, Zea mays
ttgggtacctcggggccccccggggcggcccgccctcacccccttccacaatcgtctcgctcgcaagtcgcatcgcacgtacggtctggtctcaggcgcatcggcctcgccgctgcacaacgccggagacgatacgacggcggctgcgggatgacggtcttccacttcctcaactgcgccttcctcaccttcgggcctcacgtcgtctactactccgccacgcccctgtcagagtatgatacaatcggcacttctataaaagcagctgctgtttatcttggaactgcgcttgtaaagcttgtttgcttggcaacattgctcaaagtacctgagaatgatagctttgacccctatcaggagttaatgaaagtttttattggattcatagatgtagctggactgtattttgctttgacccagctgacccacagaaatatctctcagaatcataagttccaggctgttggtcttggttgggcttttgctgattcagttttgcaccgactggcacctctctggattggggcaagagggcttgaatttacatgggagtacatatttcaaggacttgaagcgaatgctaatcttgtgatgaccctctcccttgctgcattggggtccttgatgtggcttaggaagaacaagcctaggacttcggttccaataatttatgcatgtgctctgctcttggcaacaatgccatctatcaccagctacttgaggaggtcattggagtggcagacaccaaaggtggttggcttcgagctcttctcctcccttgttatggctttcatcagctggcagctggtctcggcttgtcagagaccgatgtaacaagacatccataccactgccaattttacgtgcaatttgaagctcctgcagatgctcctgagtacgtcagaagaattaggaagatcctttgaactttgagctacaactcttcttcttggcgttcggttacagaacattttacttagaacatctgttgtaacttgtgagctgtagagcagaaacacatgcctgaaatgagttattctataacagatgctcatgtaggcgtttgatctgaaacatttgtttattattattgcggtgtgcatttcagatgctctctttaaagtcgcatcatctagcgtatagatcatgtcccagagaccgttttttttttaaattgaccttttttgtcaaaaatattcatatataccctttgcatccttggatcataggtctcggtccgtatcctttgcgtggtgacggacatgacgttgacgtggcatattttggtgttaaccatgtaggcattgccaggcttagcgttgacctttagaattgtcgtgttgtagcgtgtaaaagttgcttgtagcctgtgtaaacgcatgtataatatatattaatgcatcatgagagcatgtccaagagactatttttgacattgtatttgactttatttacctcttaataaagattaaactctataaatagcatctcactctaactctaatagataagttagtttggttagtgagaaagttaatttaaaaagctagatagcttaacaaattggatggccagtgcgttgaagagttattttgctattaagtagctaaaatttagtttggcgggttatttaactagtttgtttgagatgctctgagatgtctctaagaagtaagtgtaaaaaaataaaaataaactcatgttggtttgtatttatgctagcaaattgtctgtacatctacggtttctatttttgcttagatatttaatatagaacatatttatgcttaaatatagaatataaaatataaagatatatatgttctgctagctaggtggaggtgaatatgagtttaaagtaataatcatggttcgaatccctatttataaatattattagcatttttcaatttaaatgtgagggcacgatgatggtagaaacactgggaccacgaaaattgatgatttaatttagtagagataatacaatctacataaataagtcatgtcttaaaaatttattgaataagatatagttattaatatactaggagtttcatggtgcgttgtccccttcctacatgctttgaacattggtctcttagaaagagagacctcacctctaacttccatgtctcccgttggtttgtattgtaaaaaacccatatattatatatataaatcacagtgatacatgaacaactaactagtagctaggatttagacacacatacacttcatgatatctatatatatgttaaacatgtcttttacttgaaaaactgtactagagtagtacattctctaatggaaccatggtgttgtaacatataaaagttgcttatcggtaaaggttgcacgtttctcgacccacaagatccgcctataatggttgtaagacaatagtctatatgtgtgtaatcaggtaaactgtgcttagtagatcgtgtatatgttaatataaaatactgttttacattgtttatgtagtaaaattctaagcactagatgagatagaaaatgattctttgaagtcgcccttataactgtttttaaaaaaacatgcacccattattgtagcatgagaagactaatcttaaactggggatcctt

SEQ ID NO: 10281 - DNA, 1439 bp, Zea mays
atacccaacaacaaacaacaggccaacacagcgggacaccaacctgtggtcgcgacgccacccggccgtataaatccacgccgccccgtcgccgccggatcctgccagtgccagcacaccacgggtttcccctgtcggagagaggacgccttttggtgctgtccctgtacttctcctttcgaaaggatctctctgcgcgccggggcggcgatggcggcggcgccggcgcccctgccggcgcccgtcgcagactggtgggagcgcgtcaacggctcgccggcgtggcaggacgggatcttctgggccctcgccgtcctctacggtgccatcgctaccgcctcattcatccaagttgccaggatacagtgcagagtccctgaatatggatggacaacccaaaaggtcttccagttcctgaatttcgtggtcaatggggccaggtgctctatctttgctttccgtcgccaagtgcaacaagtgaaccctccgatctttcagcatgttattcttgatcttcctggccttgcattcttcactacctatgcactgttagcgcttttctgggccgagatactttaccaagcacgtggaataatgactgatcgacttagatcaggtttctacatcattaattgtgttgtttatgcattgcagggttttctgtggttgtggctgtggtggaatccaaatcattctatgctagtcacttctaagttattcattgcaggtctttcttttttcactgccttgggttttctgatctatggaggaaggcttttcatcatgctgaaatattttcctattgagtcaaaagggaggcaacaaaagctgagagaagtcggcagagttgccaccatatgtttctgttgtttctcggcgcgatgcataatgatgtgcttcaatgcatttgacgaggaagctgacctcgatgttcttgaccatccagttctgaatttgttctattacctgcttgtggagattctcccttcatctcttgtcctgtacattctaaggaggattcctgcaaagctacggctatcccagtatcaccccgtcagcagcagctagagacgaggcattaccatctgctgagccaaaaatggtgactgctgtcaagctatgaaaaatcaactgcaacgccctctatataatatttgtattggtagcctctctgcaaaatatatatagggataagacttgcctcggttatttcttttctagaccctactcacatggaagccatccaatatttttccgtagctcacctattgctaaccctgttagttcaatctgctaattttatgatttttagtgtttgagcataatgaaggaaagcaccattgtaaaactgaactacatgaaaagttgaacatagattttttttcctggagatgagtttaacagcgagttaccctttggaatcgttgaacaaaaaaaaa

SEQ ID NO: 10282 - DNA, 1217 bp, Zea mays
ctagctagcatgtacgccgttccccaacctctggcgtagtcttgttcatcttcgatctcctccatctcccttcatcctctctctcgctgtttgaggagaactgcctgcccctgctccctcttccgctcctccccgcgccccgctcgccatccccagacttcatttcaggccgggatggacgactacgcccgggagatgatggagctcaagacgctcgtcacccgcaccctcgagaagaagggcgtcctcgccaagattagggctgagctaagagcaagcgtgtttgaagccattgaagaggaggatcgggtggagaatgatgatggagggaaccctgctttgcttggtagctgtaatgaccgagctaagcaactgcatgcttcaccttcaggtaggttactaactgcacttgtatgcgaatacttggagtgggcgcaactaagtcacacaatgaaagtttacttgccagagtgtaacctgcccaaggacttctggaagaatgaactgaaagacttctctaacaaaagtggagctgaagggagcaggagtgctgaaagtggtccaatgcttttagatgttctcgaaggttatctgaaatatgagaatttgtctcaaacaaggatgggcggcaggaggatgatgagttcagaatctgatccatcactaaatgttgaacatcggagcatgaggagggcaccattatcgtcagctgggaacctgcctcctatggggaggccaatctcttcgtcgcagcaggcatcagatcgcagagggggatcttcagcttccaacacaaggaaagatgagtacaactggagatacgataccaccgatgatatatctgaagaggtgctacgggcatcgactgctctagaaagtgttcagctagaccgcaaatctcggaatctgccaacatcttggaggcattcaggggatggcgccgagtaacaacaaggctttggagctggttgcttgacttgaccctgtatcatgtaatttgtatgccaatcatttgcagtgatacgatgcttggattgctgctatcttagagaagtggtaaactggttatgcgtgtttgtcttgtaacgaacaaaacaactttagtgttagtttcatgttgcaattttcaaagctctcatgttggaactgcgtggactagtttcatcgtcataaagctcattttattcccgtagaacattatttaatcatcactcgct

SEQ ID NO: 10283 - DNA, 1210 bp, Zea mays
cattgggtacctcgaggccggccggggtacctcgtgcccgaccccggtgtccatcttcgaattcgagctcctccatcttccttcaccctcctctctctcgctgtttgaggagaactacctgctcctgctccctcttccgctcctccgcgctcccgctcgccatccccaggcttcatttcggacggggatggacgactacgcccgggagatgatggagctgaagacgctcgtcacccgcaccctcgagaagaagggcgttctcgccaagattagggctgagctaagagcaagcgtgtttgaagccattgaagaggaggatcgggtgatggagaatgatgatggcggtaatcctgctttgcttggtagctgtaatgaccgggctaagcaactgcatgcttcaccttcaggtaggttactaactgcacttgtttgcgaatacttggagtgggcgcaattaagtcacacaatgaaagtttacttgccagagtgtaacctgcccaaggacttctggaagaatgaactgaaagacttctctaacaaaagtggagctgaagggagcaggagtgctgaaagtggtccactgcttttagatgttctcgaaggttatctgaaatatgagaatttgtctcaagcaaggatgggcggcaggaggatgatgagttcagaatctgatccatcactaaatgctgaacatcggagcatgaggagggcaccatcagcatcagttgggaatctgcctcctatggggagacctatctcttcttcgcagcaggcatcagatcgcagaggggggtcttcagtttccaacacaaggaaagatgagtacaactggagatacgataccaccgatgatatatctgaagaggtgctgcgggcatcgactgccctagaaagtgttcagctagaccgcaaatctcggaatctgccgacatcttggaggcattcaggggatggcgccgagtaacaagaaggctttggagctggttgcttgacttgaccgaccctgtatcatgtaatttgtatgccactcatttgtggtgcttggattgctgctatcttagaaaaagaagtggtaaactggttatgtatggttgtcttgtaacgaacaaaacaaatcaaagagttaggtgccgtttgttttacaaaaaaaaaaaaaaaacgcgaacggggacccgcccctcccaacgttaaaccatgtttgtttaagtct

SEQ ID NO: 10284 - DNA, 1440 bp, Zea mays
acaagacagcagggggaagaagaggaaagttggtagactattgtctgatccgcaccgttggctgcgtcacattctctacgcctcgtgctccttcccttctaccgttcggctgcgtacccgcgtctccccagatccgctgccccgccctctcgacgcggcaattcctcgaacgccccgcgcgagccacgccctcgccgcccatgggctcgctcccggcgccggcctcggcggaattcgccccgcggccgcaggggcgcgccacggtggtggcgtcggacctggcgccgctcttctccgcgcagcgccggcacctggaccacttcttcgaccgcctcgacatggcgcaggcggcggcgttcgcgcaggcgctgctcgacgcgccgggcgccgtcttcttcacgggcgtcggcaagtcgggcatcgtggcgcgcaagaccgcgcagacgctggcgtcgctgggcctcgcgcgggccggcttcctcgcccccgtcgacgcgctccacggcgacatcggcgcgctcttccccggggacgtcctcgtgctcctctccaagtccggggcctccgacgagctgctcgcgctcgcgccctgcgcgcgcgccaagggcgcctacctcgtctcgctcacctccgcggcctcgggggatgactgcccgctcgccgcggcctgcgacctcaacgtccacctgccgctgcagggggaggtgtgcccctttggcctcgcgcccgtcacctccaccgccatccagatggtgtttggggacaccgtcatcgccgccatcatggaggcaaggcgactctccagggaccagtacgcttccaaccatcccgctggcaagatcggcaagaccctcatcttcaaggttaaggatgttatgaagaaacagaatgagcttcctctgtgcaaggagggagatatgataatggaccaactcaccgagctcaccagtaaaggttgtggttgtctgcttgtggttgatgaagagcatcatttgattgggaccttcactgatggtgatctccggcggacactgaaggcaagcgggccagctatcttcagtctcacagttggagagatgtgcaacaggaacccaaggacaatcactgcggaggcaatggcagttgaagccatggagaagatggaggcaccaccttcacccgtgcagttcttgcctgttgtcaacgagaacaacgtcgtgtgtggaatcatcacattgcatggattggtctctgccggattgtagacttgtgtggcaccattacctgttagctagctgttaccgctggagtatttatgtggagcctgaactcttcagtgtacccttatgtacagtatagtggtcgctaagaggaacatggtacactgcttataatgcttgtgtttttgtacttaattttaaatgccgattgccttggtttcttttaaaaaaaaaaaaaaaa

SEQ ID NO: 10285 - DNA, 1461 bp, Zea mays
cttccatttccccgttttccccgtgacagttgctgtgacagttgctgcgtcgcactcgcaagcctcgcctcgtgctccagtccttccatttccccgttttggctgcgtgcatgcccgcgtgttcccagaccgcaaggaatcaaatccgcccgccgcccgacatctcgcctcgccgcggcatttcctcaaacgccccgctcacagcgcccatgggctcccttccggtgccggcctcaacggaatgcaccccgcaggggcgcgccacggtgtcggcgtcggacctggcgccgctcttctccgcgcagcgccggcacctggaccacttcttcgaccgcctcgacatgtcgcaggcggcggcgttcgcgcaggtgctgctcgacgcgccgggcgccgtcttcttcacgggcgtcggcaagtcgggcatcgtggcgcgcaagaccgcgcagacgctggcgtcgctgggcttcgcgcgcgccggcttcctcgcccccgtcgacgcgctccacggcgacatcggcgcgctcttccccggggacgtgctcgtgctcctctccaagtccggcgcctccgacgagctgctcgcgctcgtgccctgcgcgcgcgccaagggcgcctacctcgtctcggtcacctccgcggcctcgggggccgactgcccgctcgccgcggcctgcgacctcaacgtccacctcccgctgcagggggaggtgtgccccttcggcctcgcgcccgtcacctccaccgccatccagatggtgttcggggacaccgttatcgccgccatcatggaggcaaggcgactctccagggaccagtacgcctccaaccatcctgctggcaagatcggcaagaccctcattttcaaggttaaggatgtcatgaagaaacagaatgaacttcccctgtgcaaggagggagatatgataatggaccaactcaccgagctcaccagtaaaggttgtggttgtctgcttgtggttgatgaagagcatcatttgattgggaccttcactgatggtgatctccgccggacactgaaggcaagcgggccagctatctttagtctcacagttggagagatgtgcaacaggaatccaagaacaatcactgcagacgcaatggctgttgaagccatggagaagatggagtcaccaccttcacctgtgcagttcttgcctgttgtgaacgacaacaacgtcgtgtgtggaatcatcacactgcatggattggtctctgccggcctgtaaacttctgtggcaccatcaccttctgctggactgtaagctgacgtgccagcttacccagttcatacaacaagtggttctgtcgactcctcttcagtgtacgcttatgtatagtggtggataagaggaatatggtacactgctgttggttgtttatcaatgctatcgttttgtactttaatctaaaatgcccatttccttggttactcgagcccgg

SEQ ID NO: 10286 - DNA, 1308 bp, Zea mays
tttggggtaccctccggcgcctgcccgtccggcagcctgctagctgagaggatcggatcgcatggaacttgccgggacatggaggaaggtgatgccttacatggccatggtgtttcttcagttcggcttcgccggaatgttcctcatctccgtcgcgtccctgcggcagggaatgagccactatgtccttgttgtctaccggaacgtagtggcagccattgtcatggctccattcgcgctatggtttgagaggaaaacaaggcctaaaatgagcctaccggtgttcatcaagatccttgctttgggattactcgaacccgtgcttgaccaaaacttcatctacatgggagtgaatagcacatcagcaagcttctcctctgcgttaaccaacatattgccagctctaacttttgtaaatgccatcatactcaggatggagaggatagtgattaaggagcgacgaagccaggctaagattgcaggcacagccataacagtctgtggtgccttgcttatgatacttttcaagggccccatcatcaacttcccatggagcaagcacgccagccacgccgtatctgacagcggcgtccacaacagcggacactggctcatgggcacgttcatgatcctgttaagctgcttctgctggtctgccttcttcatactccagtcatatacgttgaggagttacccatctgagctctctttaaccactctgatatgcgcaatgggcgccacggagagtggcgcggtcgccctagtcatggagcgtgacaccaaggcttggtccatcgggtttgacatgagactcttcacggccatatactcgggaataatgtgctctggagtagcttactacgtgcaagggatagtgattaaggacaggggcccagtgttcgtgactgcgtttagcccgctctgcatgattttagtgactgtgctaggctccttcattctttctgaggtcgtcactttaggaaggctcattggtgcgacagtcattgttgttggactctatgcgctcatctggggcaagaacaaggaccatgtgaagtcgcaaaacagttttgacaagcacgacacatttgagctgccgttctctacttctgccgttaacaatacaaccggtcccgtcctggcaacatctatttaaggctcgtgtccatgtgacttcctgtatcccgcacccatcgatttaaggctagctagcggcctagcatgtaatcgccaaatttccattaaaaaagaattctaggatttgcataacacagtttttctctgaaaaaaaaaaaaaaaaaagcggcc

SEQ ID NO: 10287 - DNA, 3261 bp, Zea mays
  misc_feature (205)..(205): n is a, c, g, or t
  misc_feature (256)..(256): n is a, c, g, or t
ccgatcagtccacgactcgactctagttgctacccggttgacaatcactcatcgtcaacccgaaccacaagatacaagtcaaccttgtgttcactggttgaggagcaggccccactcatcggtgaaaccaggacgcacggctgtctgttggagccgagcgacgggaaaagatgcaataggccgagttatagcaggggggagggtngggccgaggagtggggccgccagagtaccggtttgtcctttttcctttttnggttttcctattcttttctaatttcagttttattttgtatttttaattccaaattcaattttcaatctcaattctaatcgatatacaatgataaaaaattctagcatggaattcaaaaacaaaaacttttttagctaatgcttgctaatgcattattcacttaagaaaataaaattcaaacaaacatctctcttttagaaaaaaactatctagactcttaattagacttttgaagtttacaccattagtttattagctaggtcaatctagttaaaatcagctaataggtagctagttaatttcaccaagaattttttagctaataccaattagctctagtatattcaaacatgtccaaattatttgtatggaatatgtatgtgttaaattttataaaaataagcagtcaaaacatatatttaattaattttcatgttttatcttaatatgtatccctccgatctaaattataatttatttgacttttttttgacacgtctgatcgactcgttctattcatttttttggaaaaaagaaaaatacaaagttatatttaatgtaaattatatgttaaataatatcacaataaaatttaataataattataaattttctgaataagacgaactgatttaatttgaggtaaaaaatcaaacgaataaattgaaaagtattagtttcaccgcatatagctactgagctcccgatctggtccaaaccccaccaagctcctaccgtcctacggtccagccacttgaagccaaatccctccaggctccagctcatcactcccacgatcccactctccccgctcacctcaaggagtcaaggtgcaaagctaagcttagctcattgctcaagcttccgtctctttctctctgcgagactgcacactgccaccacgcgcaatggcggcattccaccatttgttgccggccttgctccttctactcctgctcccttccacccctgaggcgacgtcctcggcgctgcttggcatcagctacggtcgcgttggcaacaacctccctgcagctacatcagtgccgcagattgtggcttccctgggcgtcggccgcgtccgactctacgatgctgacagcaccaccattcgcgccttcgccaacacgggcgtcgagctcgtcgtcggcgtccctgacgagtgcctcgccactgtctccaccccgacgggcgccgcctcctgggtccgctccaacatttcccctgcgctcccggccacaaagatcgccttcctcacagtcggcaacgaggtgctcaccggcgtcaacagctcctcgctgtccaggtacctccttccggcgatgcggtgcctccacgacgcgcttgcgcaggccggcctggacaagcaggtcgccgtgaccacggcgcacaacctcggcgtgctggccacgtcgtacccgccgtcgtcggcgtacttccgcaaggacctcctcccgatgctctgccccattctcgacttccacgcgcgcgcgggctcgccgttccttgttaatgcgtacccctacttcgcctacgccgaggaacccaccggcgtggagctcgagtacgcgctgctggaacccggccatgccggtgtcgccgacccggggaccgggctgcactacaccaacatgctcgcagcgcaggtggatgcggtgtaccacgccatcgccgcagccaacagcgcggcggcgcgggccgcgcaggtgcgcgtgtctgagaccgggtggccgtcggcgggggacgccaacgagaccggcgccacgccgcagaacgcggcgaggtacaacggcaacgtgatgcggctcgtggcccaggggaagggcacgccgctgcggccggcggcgccgctgcgcgtctacatgttcgcgctcttcaacgagaacatgaagcccgggccaacgtcggagcgcaactacgggctcttcaagcccgacggaacgccggcgtacgagctttcctaccgcctcccgctggacaacaccacctcctcctcttccgccggtggcagcattaccggcggtggtgggtacaatggccacggctacgggtcgtcggacaacggcggatactacagcatctcggccgccgccaaggtgacaccggtaagctctgctctcttgctagctgctgctaatgatggttgacatccctgctgatatatcttttctttggcaaatttagtgcaatgttgtagactgagcaatgccggatgctttagttagcactataaaggaacatgggcacaaaagcattgtcaatcagataaattaataacaaccgttcgggaaaagaaacaattgaaaaaaatgcatgaatgttaagcatatgcttggtaacattgaagcagagaatgaattttagctttccaagtcatccggttttggttctgcgttccagtgttgggctggcacaaaaccagaaatgtgagtaggtagccatgaacacatggtagaaaggtggaatcgcaactgacgagctgaacttacttcctttgccgtcagtagcatttacctgcatttctgcaatcatgaaagtggagaacaaccctccactggcccatctgcccattgttcttccgattggaactttgcgcccccttttgctcgtctgctgaggtgttactcctttgtttgtgcttgcaagggttggtggacatggccacaggtagctgtggcaccatgtgtggctgtactggccatggcattgtgaccattagcagagatcaagtggtgcctgcctggacttggtggatggaagcctctggcttctgatggagtcagaagcagcgtatggtgtgggtcagtgaactgctgttctagagaaacgcattgctcgtggtgatccacttcctctctctctatgttgtttcccttttctccacgttgttgtaactgaggtgtccttgtaatcagtggtgaacaaatggactagacaattgtcattaatgattagacagccatattttttgtacaaaaaaaaaaaaaaaaaaggcccctagggcc

SEQ ID NO: 10288 - DNA, 1642 bp, Zea mays
acgatcccactctccccgctcacctcaaggagtcaaggtgcaaagctaagcttagctcattgctcaagcttccgtctctttctctctgcgagactgcacactgccaccacgcgcaatggcggcattccaccatttgttgccggccttgctccttctactcctgctcccttccacccctgaggcgacgtcctcggcgctgcttggcatcagctacggtcgcgttggcaacaacctccctgcagctacatcagtgccgcagattgtggcttccctgggcgtcggccgcgtccgactctacgatgctgacagcaccaccattcgcgccttcgccaacacgggcgtcgagctcgtcgtcggcgtccctgacgagtgcctcgccactgtctccaccccgacgggcgccgcctcctgggtccgctccaacatttcccctgcgctcccggccacaaagatcgccttcctcacagtcggcaacgaggtgctcaccggcgtcaacagctcctcgctgtccaggtacctccttccggcgatgcggtgcctccacgacgcgcttgcgcaggccggcctggacaagcaggtcgccgtgaccacggcgcacaacctcggcgtgctggccacgtcgtacccgccgtcgtcggcgtacttccgcaaggacctcctcccgatgctctgccccattctcgacttccacgcgcgcgcgggctcgccgttccttgttaatgcgtacccctacttcgcctacgccgaggaacccaccggcgtggagctcgagtacgcgctgctggaacccggccatgccggtgtcgccgacccggggaccgggctgcactacaccaacatgctcgcagcgcaggtggatgcggtgtaccacgccatcgccgcagccaacagcgcggcggcgcgggccgtggaggtgcgcgtgtctgagaccgggtggccgtcggcgggggacgccaacgagaccggcgccacgccgcagaacgcggcgaggtacaacggcaacgtgatgcggctcgtggcccaggggaagggcacgccgctgcggccggcggcgccgctgcgcgtctacatgttcgcgctcttcaacgagaacatgaagcccgggccaacgtcggagcgcaactacgggctcttcaagcccgacggaacgccggcgtacgagctttcctaccgcctcccgctggacaacaccacctcctcctcttccgccggtggcagcattaccggcggtggtgggtacaatggccacggctacgggtcgtcggacaacggcggatactacagcatctcggccgccgccaaggtgacaccgggttggtggacatggccacaggtagctgtggcaccatgtgtggctgtactggccatggcattgtgaccattagcagagatcaagtggtacctgcctggacttggtggatggaagcctctggcttctgatggagtcagaagcagcgtatggtgtgggtcagtgaactgctgttctagagaaacgcattgctcgtggtgatccacttcctctctctctatgttgtttcccttttctccacgttgttgtaactgaggtgtccttgtaatcagtggtgaacaaatggactagacaattgtcataaaaaaaaaaaaaaaacatattttttgttct

SEQ ID NO: 10289 - DNA, 1091 bp, Zea mays
  misc_feature (1017)..(1017): n is a, c, g, or t
  misc_feature (1029)..(1029): n is a, c, g, or t
  misc_feature (1040)..(1040): n is a, c, g, or t
  misc_feature (1078)..(1078): n is a, c, g, or t
  misc_feature (1081)..(1081): n is a, c, g, or t
gaagagggcaagatcagatggcagcattcttaataaaagcaaactatcaatgtccagtaatggcccaaatggagttttaaactcagcacttactggttcaaaaaatgaagggcgacatccaaactggagttctgattcagtgcatgggatgtcttcagcctctgacaattccatgtcaaagtcaaggtatactccgacagtgtctcacattaagcatataagctgtgaactagactattacaatggttctggtgattcaaatttcctggatcttgactggctttcagcttcagacaatgaaaggtcaaaagccataagcactcctgatgtgaatatttcaactgatgatggtgttcatgatgtaatctatgggataacggatgatcaagctgctgagatccaggctcagggattatctaaggattttgtgcagtgggttaatcaaggagagacattttggtactgatattccaagatgggcgtaccatgtaaattcaagccacataatggttgcacttgcaaaaaggggggaaaataagggagaagtctacatgatggcagtccagacctcatttcaaagcatattaactcttaaagaccattgcaaggagggaccatcaatgtgcatgagattgtttgtcaaccatcagcaattcagcattctcttttcggtatacgaatatgatgatgggcttagagtcacacgcactgttagaagacttgtctagggaagtgtaccattctgttcatttattgaagcttgctcaccaggctggtagatagtgcattgttattattttttcttaaaaggaatgaaagaatgtaggtagtttattctttttaagatgtaccattgtccaggcatgatccccatctctccatcgtgtaaatatatatgtcccaagtgttccacttttcccttttccttccatgagagttgaggtgggcatgaaagcaccatttttccctcagtcccttggtagggggtctcggaaaccaggtccattaaattggggnaacgggaaaatngtggggaaatnccatggaccaaaggtccaaaccctctaccatagaagcnctnggcggttgca

SEQ ID NO: 10290 - DNA, 1514 bp, Zea mays
ttttttttttttttttcatccatgtgtttttcgtttctttgtactaatgtttcatccttgtgacagtttcgctacactgcataacaagctgtaataaaagaggctggctaatgtgttctcgtaacagttacaagttccaactctgtcctaacagcataaaacttcctaatgacatcaaagggacctttctaaaaaaatcgattcgaacttagaagcacaaaattagtttctactacagagctaaagccttcaggttgtgctcatgacatcaaagggaccttttcttgacccttcccatctgcttcacacaagaacggtggcctcgctgctttgtagtagaaaaacgccatcatcctcgaccatgcctccgccgaccggacaactttctcacggtgtattatcctcccggcgttggtgaagagaatctcagggaaaccagaaactttcagagcgtccacgaggtcaggctccgcacaggcatctacagccacacaccttggtgacggcagattgtgttcccaaaacatctcaattgccttagtaagctcagccctcgccgtctcattctcctgcggcctcttatatctgttatgcacaagcacaaccatcggcccgaaatcggtgaacacggacgcatcccagtcctgtgtcctaacatccctcaccggcctgatgtaattgtcatcctcccaaacaatctccttgtcgctctgataccccgagacgtcatcctcctcggtgtcgtccttcttctcggccttgatggtgatcttgtcgaagaactggccgaggctgaagcccatcccatcctcggcgtcctcgggccagtccgggtcctcctcctctaccaccagctcgtacttggtcagcagctcccgcatcttgaccctccgctcctccgggtccgtcagctccgccgtttccgggacgcggtccatcatctcccgtatcttccggcgcagcgtcctccgctcctcgtccgtcatgcgatcctgcgcgtcctcttcatcgctggactcggagtcagtgtcgccatcgtcgccgcgcgcacggccgcccagcaccagctccacggccttagagtcgctcgtccccgcccgcgcgcagccggtgtgcacgagcctccggtggcgcgggccagaaagagctaggcctacgaggcgcgcacgggacctcggaaagcggggatcaggccgcgccgctgctcgcagccacaacgtcgaacaggtcgcgggcagggagcagtgcagcgccatcgtgctgcctaccacgcactgacgcagggcgtatcactcacctctttgctcgagccaagctatgagcttggaagtggcggccacggccacgggcgcgggcgccaggcccagccgcgtgggcgtgagggcgccggccgcgggcgctcagcggagcggggagtcgtgggcgccgcgcgtgggtagggacagaggataaggaaatgagagaaaaaaactgatggatggataccgtttgagctgaccaaaaaaattctccgc

SEQ ID NO: 10291 - DNA, 760 bp, Zea mays
gccggccgggccgccttagggcgcttggggtccccgaggcgcccggggataccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagctacggacttcatcaagctgaagcacaaggcttgggcactccagaagagcacaaccatgtaccaaccttctacctaaaggtgtcaatagttcaagaagttgatactatatacttatgcttgtctctgtatagtctataagtcctaattcaaataacaggtgctgcttgcagccttggatatttgcggagtgaagttaccatggcatcattgctaagaataagaaagtaatgtggttatgaggagatgtgtaattttgtggcgatattatttgcaacaatgatgtatatagggcatgtttggttcacggctaactgtgtcacactttgcctaaggttagtcgttcgaattgaagaactaaccttaggcagaaaaagttaagcaaaatgtggcaagttatgcagcaaaccaaacaggcatatagttttactgctagttaatttgcttctatttggaaatcggaatagtaaagcatcgagcaaggttttcaaaaaagcggccaaaaaagcggcc

SEQ ID NO: 10292 - DNA, 695 bp, Zea mays
  misc_feature (665)..(668): n is a, c, g, or t
tgggccgcccgcccgcgcccgataccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgctgcttgcagccttggatatttgcggatgcggagtgaagttaccatggcatcgttgctaagaataagaaagtaatgtggttatgaggagatgtgtaattttgtggcgatattatttgcaacaatgatgtatatatgggcatgtttggttcacggctaactgtgacacactttgcctaaggttagtcgttcgaattgaagaactaaccttaggcagaaaaagttaggcaaagtgtggaaatttatgcagcaaaccaaataggcctatagttttactgctagttaatttgcttctatttggaaatcggaatagtaaagcatcgagcaaggttttcgaaaaaaaaaaaaaaaaaagcgccctannnnttctaaaaaaaaaaaaaaaaagcggcc

SEQ ID NO: 10293 - DNA, 635 bp, Zea mays
ctcgaggccggcctgggccccccggggcccgaccgcaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtcaatagttcaagaagttgatactatatacttatgcttgtctctgtatagtctataagtcctaattcaaataacaggtgctgcttgcagccttggatatttgcggatgcggagtgaagttaccatggcatcgttgctaagaataagaaagtaatgtggttatgaggagatgtgtaattttgtggcgatattatttgcaacaatgatgtatatatgggcatgtttggttcaaaaaaaaaaaaaaaaaaaaaaaaaaaaaaaaaaaaaaaaaagcccccaaaaaaaaaaaaaaaaaggaaaaaaaaaaaaaaaaaaaggggcc

SEQ ID NO: 10294 - DNA, 1131 bp, Zea mays
ctcctaagggcgattggggcgccccgggcgccgccggggccggataccgaccttccttgcattttctcaataccttgaacaactaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttccacttaaaggtgttgctagttcaataagtcaatactatatatacttatgcttgtctctatatagtctataggtcctagttcaaataacagatgctgcttgcagccttggatatttgtggagtgaacgcattgttgatagcatatggataagaaagtaatgtaattatctggagatgtgtaattatgtggcaatattatttgcaacaatgatgcatggagtactttcatgtataaaaaaaaaaaaaaaaaaaaaaaaaaaaaaaaaagcggtgaaggtcccagcagaggcttgattttaaagtatgagagctctctaacactacaaccttcacatatggattgtgccatgtcgtacaatgcttgaatgttgcttgatatttcacagcattttataccatggccacaaatgcattgaactaaattgttcacgtgagttgtatttggggaaggtcctagcaggtgcttgacccgaaagcatgagtggattgtaccatgtcgtacaatgcttcaatggtgcttacatttcactgcatttcgtaaactatgtatgatgtctggatgtctttagacatccatacttttaagaaaggatacaatctgaatgtcaagattgtacaatctagtagcagcttctagttgaattacatatgcttggttttaggccatttgatttgggtttcaatgatcagttctgttactttgtgactatcagaattataaattgagtgactgcaatttaagtttcaatggttacaagtaaaaaaaaaaaaaaaaaaaaaaaaaaaaaaaaagtactctgcgttgttaccactgct

SEQ ID NO: 10295 - DNA, 661 bp, Zea mays
ccatgtgatattcgtatctatgtactaatgtttcatccttgtgacagtttcgctacactgcataacaagctgtaataaaagaggctggctaatgtgttctcgtaacagttacaagttccaactctgtcctaacagcataaaacttcctaatgacatcaaagggacatttctaaaaaaatcgattcgaacttagaagcacaaaattagtttctactacagagctaaagccttcaggttgtgctcatgacatcaaagggaccttttcttgacccttcccatctgcttcacacaagaacggtggcctcgctgctttgtagtagaaaaacgccatcatcctcgaccatgcctccgccgaccggacaactttctcacggtgtattatcctcccggcgttggtgaagagaatctcagggaaaccagaaactttcagagcgtccacgaggtcaggctccgcacaggcatctacagccatacaccttggtgacggcagattgtgttcccaaaacatctcaattgccttagtaagctcagccctcgccgtctcattctcctgcggccagatggtcgagcgaacgagctccactgtcgtgtgtggctttaaagattctcttccctaacacatgctcggccgccacaacgctttgcctcctctatctgcaac

SEQ ID NO: 10296 - DNA, 666 bp, Zea mays
gtggcggccgctgccagcccgcgcccggccgggggataccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtcaatagttcaagaagttgatactatatacttatgcttgtctctgtatagtctataagtcctaattcaaataacaggtgctgcttgcagccttggatatttgcggatgcggagtgaagttaccatggcatcgttgctaagaataagaaagtaatgtggttatgaaaaaaaaaaaaaaaaaagcggccccctcggccacaatgatgtatatatgggaaaaaaaaaaaaaaaaaaaggccccaagggccgcggccgtccaaaaacaagggaaccccccgggttgcaggaatccaaaatcaagctaatcgataccgccaacctcaagggggggcccggaacccaatccgcc

SEQ ID NO: 10297 - DNA, 5131 bp, Zea mays
  misc_feature (4694)..(4694): n is a, c, g, or t
aggaatgaaaattcaggtggggaccctctcccttttggtgacattcaaaaaaaataataaatatatgcataattgcatagtcagaacttgaagcgatgttgcaacgaactctatacccttggtgacggcagattgtgttcccaaaacatctcaattgccttagtaagctcagccctcgccgtctcattctcctgcggcctgcaagaatggacatcatgctttgtcaaactaacttaggtaaatgggttctcaataaattcatggcctattcatcaataattgaaaccaaggcaatgcactaaatcccttgcaaatttagacaggaacatacaggttcagcatatatcaggtctattcagctgcaatgtgcaagcgcacacacaccaataagcccttctaaccgactactatgcaatcagccttaaatacaagcatgcaaacgaacctcatgtttcgttagatcatgatctaatcatatattacatttaacacttaaacccttccaccatcagttcatgtagatttataaaaaaatactaacaaaccacaactattgccaactatatctatggttagatcatgatctaatggaccagaaaactcgcttacacgtttgcatctaagacatgattgcatagtactcgttgcctctaatcagaacagacacatcatgcatatcttctacccatagagataaatgagttgagaaacaagaagcactcagcaagagcaaggaatgaattatacctcttatatctgttatgcacaagcacaaccatcggcccgaaatcggtgaacacggacgcatcccacccctgtgtcctaacatccctcaccggcctgatgtaattgtcatcctcccaaacaatctccttgtcgctctgataccccgagacgtcatcctcctcggtgtcgtccttcttctcggccttgatggtgatcttgtcgaagaactggccgaggctgaagcccatcccatcctcggcgtcctcgggccagtccgggtcctcctcctctaccaccagctcgtacttggtcagcagctcccgcatcttgaccctccgctcctccgggtccgtcagctccgccgtttccgggacgcggtccatcatctcccgtatcttccggcgcagcgtcctccgctcctcgtccgtcatgcgatcctgcgcgtcctcttcatcgctggactcggagtcagtgtcgccatcgtcgccgcgcgcacggccgcccagcaccagctccacggccttagagtcgctcgtccccgcccgcgcgcagccggtgtgcacgagcctccggtggcgcgggccagaaagagctaggcctacgaggcgcgcacgggacctcggaaagcggggatcaggccgcgccgctgctcgcagccacaacgtcgaacaggtcgcgggcagggagcagtgcagcgccatcgtgctgcctaccacgcactgacgcagggcgtatcactcacctctttgctcgagccaagctatgagcttggaagtggcggccacggccacgggcgcgggcgccaggcccagccgcgtgggcgtgagggcgccggccgcgggcgctcagcggagcggggagtcgtgggcgccgcgcgtgggtagggacagaggataaggaaatgagagaaaaaaactgatggatggataccgtttgagctgaccaaaaaaattctccgcggtgggtcaaagaaccgactcaattctatattacagagcgcgacgcaaagctcacaccacatgtgtccacgtctcctgaattcttcttagccgttggattcgacaagcacggccatgaaacatctcctcaggctcagcagctagcacgacatcacgggagactctggtcccttccagagacgagttgaaaaaacacacaatcaaaaaaggtgattctgttagcggttgtcttctccgtcggcggcggcggcctggtagcggtccctgtcccattggccctccttccccgaacgtccccgctcttctccacgccacgtgattcttccggtgagaggtccccgtcggcgagagcaacagtgctgacggtcgccgcgtcgtgaccctcctgctccatgagttcgaatacccattattcgtctgctcacccaggtacgaaaagttttctaaccatgtctctctaatcctcaagatctcaaggaggcagacaggtcgttggtagcctccaagtggactggaagggaaacagttggtagcccccaaatagactcatccagtcatcctcattctcatccggccatccaggagatcatccagatattcagatttgatctcaatctgaactatctatcaaagagccaagaggcagaggcccagagcgcagaccggagagccgagagaggccaagagcgaggagaattcgatgctgtgggtttggaacatgatggcactgcacccgccagatggtcgagcgaacgagctccactgtcgtgtgtggctttaaagattctcttccctaacacatgctcggccgccacaacgctttgcctcctctatctgcaacggaagcaaagcaaacacaaagagaacggttgtcacagccacgccaaccgtctatctctcctccctccctcggtgcaatgcaatgcacactctttctctcccatctggtttctttctttcttttttattggctcgtgtcctgatgaagcaaaattgtgagactggttctggttttcgatgcaacttactgtgtgatttatccatgtttatgtactttttaacctaccatgtgaaacatcttcctgtgggtgcagatctagcgtaaaaacatgctgctttggtgaaggagaaatgctcatcaactggaccttcaccatatgtcattgttggtattcttagcttttgttcccgaggcaaacactttatagtccgaccaaatcggccatgttacatgttgtcgtctgcatacgttgaacaaatgcgttattctataatttgtttgcaaagattagtagccacttgctaacatgtttcctaatcgtttcagcatgtcgcctcatcacaccatagaaatacatctccaatttctcggcactcgcaacaccgacaacaagaggtaaggtcaactaatgttagatttaaaaaaatgtatctacattcctatagttatcaacagtgagcgttcaccacttgcattcaaccaaaatttgtttaagcatattagtatctagatgctttttgattttctgttcgattctacatgctcaccatgtcaggtggatatatatccaatctcctaaagatttcaacgccgacgatagcacgtacatccatctaacacccttccctctatctattattttttcatttatttatccttaagtttgtccattacccttgctgcatcctcataaataatctatgcatgattacacatatacacattaaaatcagattatactaattgcacagtgtcgtatacatacgaattcaatattcaaagcaacgatccttccccttctattgtttgtccatttatttatccccacattagcttgcttcccttgctgcattctcatagacaacccatgctaatcttatctacttaattattaattgtggtaccagattacatatgaaatcagcttctacaaactatacaatggcgtatacaaacagattcaatatcaatcaacgatccttcacacattgatatatatatatatatatatacatttcctaacgtgcggccgctgctcattaagcaacgatcaaatgcaagcgctgatgactttaattattgccactaatgttatttttattattactacctttattattgccattagtactactacattattctcattcctcctccaatagaaacagatatggtctacatgtgctaatatgatgtcaccactcgatttggattctttattagatgatgctccttcgaatttccattttgagtttactcctttagatactatcatattactccatttcgtgcctggacaaaagattgttgttttgttagtgtgtttggcttcatcttgagttacagaagttttatcatatactcagaacatcaaaaccaatgttctaatactgcagacacgtgcctattctaataattctaccacttctaaatgtatatattcacatatattggtctttctatatgtacacgacaataatccaattattgtttgctccttcgaggtcaaggttccattttgagtatactcatttgcagtttatactctaattgcttaactacctcactcaatatgttattcttaccacttatattacttttatctatacgcgtgcggggcacgcgcacgttactagtaaacactagtttggaagcttaaatcctcacggagagtttactattttcccggtgttttcagcctacgtgagaagctttcacggactaccgctctgtcttgtttgtaaatcggctccgtgtgggatgatggcccagtccgagcccaacttccacgtggaaactggtccggccttcggacatagggttggattagaagtggaataagaggatttgaggaaattaaagacatgtttggttgcctacctcaattgccacactttgtctaactttttttgcctaaggttagttattcaattcgaacgactaaccttaggcagaaaaagttaggcaaagtgtggaaatttatgcagcaaaccaaataggcctatagntttactgctagttaatttgcttctatttggaaatcggaatagtaaagcatcgagcaaggttttcaaattgtccgattaatcgtcctttgcatgaactcaattagggactccgacccgattaggatgccttatcgtccaatcgtccgagtactcgtcacctaatcataactaatcgtccagtttggtagctactcggccaggaatatggaaagtcacctgactctgtctgggtccaaaaaaaatggcgcattgtttccattatggcgccctattgatttgggttattaaaggaactgattacctgattggctggctttccaaatcccaaattcctttccttatttcatctctctctcttctacttcctggctggccggctgctgcttcttttgtttcctggcgtttcctccattcctcctccctaagaaaaaagccgg

SEQ ID NO: 10298 - DNA, 2099 bp, Zea mays
ccttcatttgaccacacacacaaaaacatataaatctttaacccacagcataacttggcgccttctcttaaaagagaagaaacttattgggaactaaccttacaatcaaacaaaataacaccctagccatcaaaatcagctgaagtgctgaactgctactagtagtaaagagatgacacttagagtcatgtgaagcctaacaaaatttgaatgaagaaagagaacaaggcaattcttcaaaagaggagaatcggatgcttgattatctaaaaataataatctttctgaagtaaatatccattgtgcctataatatggggggccgccgggccggggcgggataccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtcaatagttcaagaagttgatactatatacttatgcttgtctctgtatagtctataagtcctaattcaaataacaggtgctgcttgcagccttggatatttgcggatgcggagtgaagttaccatggcatccttgctaagaataagaaagtaatgtggttatgaggagatgtgtaattttgtggcgatattatttgcaacaatgatgtatatatgggcatgtttggttcacggctaactgtgacacactttgcctaaggttagtcgttcgaattgaagaactaaccttaggcagaaaaagttaggcaaagtgtggaaatttatgcagcaaaccaaataggcctatagttttactgctagttaatttgcttctatttggaaatcggaatagtaaagcatcgagcaaggttttcaaaaaaaaaaaaaaaaaaggcccctaggcccctcaattagggactccgacccgattaggatgccttatcgtccaatcgtccgagtactcgtcacctaatcataactaatcgtccagtttggtagctactcggccaggaatatggaaagtcacctgactctgtctgggtccaaaaaaaatggcgcattgtttccattatggcgccctattgatttgggttattaaaggaactgattacctgattggctggctttccaaatcccaaattcctttccttatttcatctctctctcttctacttcctggctggccggctgctgcttcttttgtttcctggcgtttcctccattcctcctccctaagaaaaaagccggctgctcctcctccctgaccaactccggtggcgctggcgcctccctgatcaagaaacaccggcaacttcaatctgaacaacttcggcgactcctctatgatcaagacctgaggaagatgagcacctcatctaaaggtaccgtgatccctgtccctgatcaagctttgatttgagtgcagtacagaagtagtacaccatggatcaagcattcagtttgctgatcgcccacgtcatggtttgagactttgagtgcagtttgcattcgtttgtgtttgagactttgagtagagtttgcattagtttcgtttgaggtgctactcaaggtgattgctactctgctgtaatgctgtttgatactttgagtactgctaaatagctactgctgtttgagttggtactttgattactgctgtagttttgattactgctgtttgagtttgagttaaatgctgctgtagttttgattacctactgctgtttgaagtatattatatagtatataacaatacactatagtgtatataactatatataattatatatgtcctgattagtacaggaagtttaggacgactaggtggccgacctgtcaccgattaatcagcctggtcgacgtcctaatcgtgattatttgcctaatcggtcaccatcaatgacctggcgacgaggcgactgaaagccatgcatcaagca

SEQ ID NO: 10299 - DNA, 2146 bp, Zea mays
ttgacccgtcacatataattatttatgggccgtgggctcagtctatatgcgggcacaacccgacctacaattaaggccgtgctttagtggacatgggaccgtctcaattgtacatgtatagtcgacaaccagggcgaggccgccgtgagcggaggcggagagtgaacagggtgctgggaggaatagtggggaggaagccggaggggaaattcatggaaacctgcaacacatatataaacctgcacatcctatcaagaaattattgtggccaagcatgccatacatacatctcactagttgtcagcaaaaaaaaaaaaaagattgctgcttgtccaatagtctatggcactttggcatcgattcccaaatgataagaaaatgcccttgttttagtcagaataaatatcaaagctacaacttaagatgctcacgcaatagatattctgcagatattgtcagtgcacaagggaagcagcatcttccaaacaagagacactacgatatactccatagacctgcttttctgttaccaatcaacatcaggcctggccaaacctatctatctatccaccaagacccatgttttctgcttgcttctctgcctcccacccaattattcactataaaagagacaaaaaaaaagataaaagagaatcattttcaaccgaacgagtacaacaaatgctttccctgcaacacgaagccaagtcccagatcattcaaatattagacactacaaaacaaataaaaacactacaccatgtatgtttttcttgctattcatatttgagcatacacacacacaaaaaaaactataatctttgacctatagcataacttgacgtttctcttaatggagaagagaagagaagaaacctaactgggaactaaccttacaatcaaacaaagtaaaatactagccgtcaaaatcagctgaactactgctagcagtagtaaaagagatgagacatgtgacgcctgacaaatttgaatgaagaaagggaacaaggcaattcttcaaaagagaatcggatgcttgattacctagtagaaaaatagatgtcacgttgggcctataaaagaaggcggcacccccaggccgggccgggagaccgaccttccttgcattttctcaataccttgaacaactaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttccacttaaaggtgttgctagttcaataagtcaatactatatacttatgcttgtctctatatagtctataggtcctagttcaaataacagatgctgcttgcagccttggatatttgtggagtgaacgcattgttgatagcatatggataagaaagtaatgtaatcatctggagatgtgtaattatgtggcaatattatttgcaacaatgctgcatggagtactttcatgtatgatactgaggctttgcaattgatttgcttctatttggaaattaaaaaaaaaaaaagagcatccgccttcttataattattagccaactccacgatcagataagaaaaaaaaactgtggtgtcaaacagaaatacagcattgacaagaaagctgtaggagcttatagttgaagagtcctgacatgctcatacgagtaccccaataaaccaaggtatcactgaagcacacagcatctcccaaggctatggactggacatgtgggactgtagctccatagcacatttgtttagtaaaaattgtcatgttaaaatgcaacagacattacaccagatcaaatgattgtggcatgtagtaatattaagtaatactgctggtggttgaaatcatatataagcttatttgtccaagcatttgtatttcagagctcctgaaattaataatcgccagtaataacaaacatggtgttcaaactctgagcaagcgctttgattcatcttagtcatttttgaaggaaaatccaactgtataacgatc

SEQ ID NO: 10300 - DNA, 741 bp, Zea mays
aaatctgccaatttgtccgaggcccatctccataaaaccctaatccacggccgcggcatccagccctgcgcccccgcccgcttgctcgcctccacccgcggtcgcggcctccagtgcccagcgccaccgccgcttgtcagcctccacctttgagcctgttcctgagtcaagtgtctctcgtggccacaggacggctacatcgacctctacgggccctacgataaggttcttctcaactgctcagggggcagcgtgtgcgggacctgcatcgtcgaggtggttgaaggcaaggaaatgttgtccccgaaaactaatgtggaaaaggagttgctcaaaaggaaacccaagacgtggagattggcgtgccaggcaacggtgggcaacgcagattcgactggacaaatgatcattcaacagttgccgaagtggaagatacacgagtgggacaagtaggggttactgctttactggtcttcaagagtgctctcgtggccatactatagattacatgcagtggaaatgggaaaaaaagaataagaagcagctgatcagtggaagagctggtgcagattgattgatgaagcttttcatactccaaacaaacaaacaaaaacctgggcatgttttttcaccatttgtagcaaccgaaaggagcatggatcaattagccccgttctgtaagccgttcacttatacacacacaaaaaaaagcgacttgttcatgatcattgaaagacgtga

SEQ ID NO: 10301 - DNA, 1081 bp, Zea mays
ttgggtaccccgcccccggcggggcaccactaccgcactagcactggagcaggtcctcgccgtccacaggcgccagttcgtctcccggataagacgataattcgagccgaaaaatatcaccacacagacacacaggtacgcaaggcacagcccaagaccaccgcaccgcacctgcacaccgccagggatggcggcaaccgcgcacctcaccggtgtcctcggcgtgtcgtcgccgcctctcgctccgtcccactgcagctgcagcggcgccaagaagcagagctgctctctgcgtcaggggcggcagcagaggaggcgcctccgcgtcgcccgcgccgtcgaggtggacgcgccttccgccggcgcaccggagccggaggaggcggaggagccgtccgtcgacttcgctttcgtcagcccgcggctgctgccggacgggacgccggacgtgcactaccggacggcgcgcggcgggcagaagctcagggacatcatgctcgacggctacatcgacctctacgggccctacgataaggttcttctcaactgctcagggggcggcgtgtgcgggacctgcatcgtcgaggtggttgaaggcaaggaaatgctgtccccgaaaactgatgtggaaaaggagttgctcaaaaggaaacccaaaacgtggagattggcgtgccaggcaacggtgggcaacgcagattcgactggacagatgatcattcaacagttgccggagtggaagatacacgagtgggacaagtaggggttactgctttactggtcttgaagagtgctctcgtggccatactatagattacatgcagtggaaatgggaaaaaaaggaataagaagcagctgatcagtggaagagctggtgcagattgattgatgaagcttttcatactccaaacaaacaaacaaaaacctgggcatgttttttcaccatttgtagcaaccgaaaggagcatggatcaattagccccgttctgtaaaccgttcccttatacacacacaaaaaaaagcgacttgttcatgatcattgaaagacgtgatttttttttgtccaaaaaaaaaaaaaaaa

SEQ ID NO: 10302 - DNA, 1256 bp, Zea mays
cctcgagggccggccgggaaaaaattactaaaaaaaaaaaaaacttattaaggctacaagggtagccggcctcttttgtgttctgccttcggacgatctcaaccgtttgttctctcccgcctccgttttggtcatccgtcggatgctgcccacgcccgcaaaccacccccacccacgctcagagaaaggaggtctgggttgcgtacaggcgaaaggcacgcgccgccgctgccgcgcgagcctctctgtccccatcgccgcacagatggatccattgtcggagcccgtgtacgcgtcggtcgagccgtacgactctgggttcctcaaggtctccaatgtccacaccatctactacgagcagtccgggaacccgcagggccatgtggcggtgtttctccacggcggtcctggagccggcacgtcgcccggcaacaagaggttctttgacccggagttctacaggatcgttctgtttgaccagtttatttcggctgctcatctttttttcttaaacgtaaccaaaggggcttggggggttgtgtgctgttcctgatctgtgttatggttcgattgcagaggggtgcaggcagaagcactccccatgcttgtttagagcagaacactacttgggacttggtagctgacattgagaagctcagggagcatcttggcatcattcaggtgtttgatggttcatggggaagcaccttggcacttgcctacagccaggagcaccctgataaggtccctggccttgttctgagaggaattttcttgcttaggaaacaggagtttgattggttctatgatggtggtgcagcagccattttcccagatgcatgggaaccatttagagattttattcctgaggatgaaaggaattgtttcgtagatgcttataacaaaaggtgttgaatgctgatttgttgtggcctgttacgtcttccccagttcatatattaaacttgaagaaccccgtggttgaagaaaagctccctgaaaatgagtaatacgtcatcttcgtcaagtggtgagcgtgctatgcagcgacagagggcaaggggtctatcttgggttgggtcttttttcttttcttttcttttcttttctcttttccggcaacatagagtcccttttacttattaaagagatcctgcctgttttagttcatccttaacatatcagatgatggtaaatggttgatggttatgttccaaaaaaaaaaaaaaaaaaaaaaaaaaaaaaaaaaaaaaaaa

SEQ ID NO: 10303 - DNA, 869 bp, Zea mays
tcgagtcagctacgtaggccccccccaccacgcgacgcaaacaacagagctgccagcctgccactgaggagtgaggaaccctaagcggcgcactgtgcaggcgacggcggcgcgctaccggcgacggccgacgggggatacggcgacatcgtccccctcgacccctcctccatccccgacgcggcggcgccagactgcaggtgttgaatgctgatttgttgtggcctgttacgtcttcacccgttcatatatattaaacttgaagaaccacgtggttgaagaaaagcccactgaaaatgagtaatacatcatcttcgtcaagtgggatgtgatatatgctgatattccaaagctcattccatttattgatctgccttgccaatttgccagttgggctgttccctccctaaaccccagcgtcgcctccgacgagtcaccgctccgtcgtctgcttgctgcagtccaggccacgcgctacgccgtcacggtcgctcctcccgtgacgcagccgccgctaggcgccgcctatttctcggacaaagtcgctcgccaccatggtggcagcgcctgctgccgcagaagccagcggcgagagtaaaaacgaattcctcatacgcgacgacgcgccggggctactcgccgctctcaaggagatgaaggacggactggacctcgtcaggggcaaggttgaggccatcacgcggaaggtcaaggcgaaccagttgccggcggccaacgggatcgggtacctagaagcgaagaaccacctgctccttggctattgccaggacatcgtctactacctcctccgcaaggccaaggggctctcggtggatggccaccccgtcgtacagagccttgttgagatt

SEQ ID NO: 10304 - DNA, 1486 bp, Zea mays
  misc_feature (13)..(13): n is a, c, g, or t
cctcgaggccggncggggatctcgttcggtcacccccgcccccccgacggccgaatggggttcctgactcgtgagtttgtgacagtggttttctctgtgccgccttttgcaggggaagggggtctgggttgcgtacaggcgaaaggcacgcgccgccgctgccgcgcgagcctctccgtccccatcgccgcgcagatggatccgtcgtcggagcccctgtacgcgcaggtcgagccgtacgactccgggttcctcaaggtctccgatgtccacaccatctactacgagcagtccgggaacccgcagggccatgcggcggtgtttctccacggcggtcccggagccggcacgtcgcccggcaacaggaggttctttgacccgcagttctacaggatcgttctgtttgaccagaggggtgcaggcagaagcactccccatgcttgtttagagcagaacactacttgggacttggtagctgacattgagaagctcagggagcatcttggcatccctgaatggcaggtgtttggtggttcatggggaagcaccttggcacttgcctacagccaggagcaccctgataaggtcactggccttgttctgagaggaattttcttgcttaggaaaaaggagtttgattggttctatgagggtggtgcagcagccattttcccagatgcatgggaaccatttagagattttattcctgaggatgaaaggaattgtttcgtagatgcttataacaaaaggttaacttcctctgatcctattgttcaggttgaagctgctaagcgctggacgatgtgggagatgatgactgcgcaacttatccaaaacaatgataacattaaacgaggagaagatgatgaattttcactggcatttgcaaggattgaaaaccactactttgtgaataagggatttttaccctcggactcattcctattggacaatgttgataagatccgacatattaaaggttttattgtacagggacgttatgatgtttgttgccctatgatgtctgcttgggatcttcataaggcttggcctgaagcagaattcaaggtggtagcagatgcagggcactcggccaatgaagttggcatcgctgccgaactgaggtcagccaccgataaactgagagacttgctgcgcaaatgagccggcgaaaggcaacctgcacctctatctgatcatggaactcagaggcccataataattacatagctgtgtaacggttagcactgtgccgttaaacaatgtcattgtcaccatcgatatgttgtttgtttgctcgctggagtgtatgaggaattgaagtttcaagacgggaccagaatgggtggggcgtgtttggtttgcgtttttagacctggtctgtctagccagctatgccagggcaacacaccctggctctcacctagatgcaaaaggctgtttgcttgctttaaaaaaaaaaaaaaaaaaaaaaaaaaaaaaaaaa

SEQ ID NO: 10305 - DNA, 593 bp, Zea mays
acatccagatccgtccagatccagattcacccgtctggcacttcacttggcatcacccccgccgtcgcgccgcggccggccgggcctgcaccaaggggtccaggtgaataggtgatgcggccgactcacccgcggcgcggcgcggccctcgtgagaactgcaaaaccaccggccgtatacagtaggcctgcctgcctgcctgccagcaaaccctcccgatcggccgcactgaaatgatcagagtgagtcccctcctcctcgtccgcccgctccgtgttcattgccccactccctcacgcctctcgcgcccgccgctccaccacccccatccacgctcagggaaagggggtctgggttgcatacaggcgaaaggcacgcgccgccgctgccgcgcgagcctctccgtccccatcgccgcgcagatggatccgtcgtcggagcccctgtacgcgcaggtcgagccgtacgactccgggttcctcaaggtctccgatgttcacagcataccacactacagatgcagtccggataaatcgcatctaccacatgtagggagtgtgacgtaacatgggtatttagcacgaataacgggg

SEQ ID NO: 10306 - DNA, 1429 bp, Zea mays
  misc_feature (1428)..(1428): n is a, c, g, or t
tgggtacctttgggaccctcgaggccggccggggaaccctcccgatcggccgcactgaaatgatcagagtgagccccctcctcctcgcccgcccgctccgtgttcattgccccactccctcacgcctctcgcgcccgccgctccaccaccccaacccccacccacgctcaggggaagggggtctgggttgcgtacaggcgaaaggcacgcgccgccgctgccgcgcgagcctctccgtccccatcgccgcgcagatggatccgtcgtcggagcccctgtacgcgcaggtcgagccgtacgactccgggttcctcaaggtctccgatgtccacaccatctactacgagcagtccgggaacccgcagggccatgcggcggtgtttctccacggcggtcccggagccggcacgtcgcccggcaacaggaggttctttgacccgcagttctacaggatcgttctgtttgaccagaggggtgcaggcagaagcactccccatgcttgtttagagcagaacactacttgggacttggtagctgacattgagaagctcagggagcatcttggcatccctgaatggcaggtgtttggtggttcatggggaagcaccttggcacttgcctacagccaggagcaccctgataaggtcactggccttgttctgagaggaattttcttgcttaggaaaaaggagtttgattggttctatgagggtggtgcagcagccattttcccagatgcatgggaaccatttagagattttattcctgaggatgaaaggaattgtttcgtagatgcttataacaaaaggttaacttcctctgatcctattgttcaggttgaagctgctaagcgctggacgatgtgggagatgatgactgcgcaacttatccaaaacaatgataacattaaacgaggagaagatgatgaattttcactggcatttgcaaggattgaaaaccactactttgtgaataagggatttttaccctcggactcattcctattggacaatgttgataagatccgacatattaaaggttttattgtacagggacgttatgatgtttgttgccctatgatgtctgcttgggatcttcataaggcttggcctgaagcagaattcaaggtggtagcagatgcagggcactcggccaatgaagttggcatcgctgccgaactgaggtcagccactgataaactgagagacttgctgcgcaaatgagccgggcgaaaggcaacctgcacctctatctgatcatggaactcagaggcccagaataattacatagctgtgtaacggttagcagatcccgattgaagtagctgtgtaacggttagcactgtgccgttaaacaatgtcattgtcaccatcgatatgttgtttgtttgctcgctggagtgtatgaggaattgaagtttcaaggaana

SEQ ID NO: 10307 - DNA, 3514 bp, Zea mays
catagatcagtggataccactccatcatcctgcttggccccggccggctggtagatcgtcgttccggagtcgtcgactggaataacgaactggcgcagcaggaggccaataatggccaccatgaagctgggttccaagccggagattttcgtcctccaagacctcacatggagatgcacgaccgagctcgagagtgatgtagttgtcgaagtcggagagatgtccttttacctccacaagttcccgctgctgagccggagcggcgtgctgcagcggatgatcagcgagtaccaggctccggcggatggcggcggcatgtgcacgctgcagctggacgacatccccggaggcgccaaggccttcgagctggcggccaagttctgctacgacgtcaagatcgagctcaacgcgctcaacgtggtgtgcctccgctgcgccgccgagtacctgcgcatgacggacgactacgccgagggcaacctcatcacgcaggccgagtgcttcctcgtcgacgtgctcgccaactggaaggactccatcaaggcgctcgagacctgcgagggcgtgctccccactgccgaggacctgcacctcgtctcgcgctgcatcacggcgctggcctccaaggcctgcggctccgacgctgccgcgccagtggtcaggaacgccagcgtcgacaaggacgcgctctggaacggcatccggtcgggcgacacgacgtcctccgccgccgcggcggcggcggcggccgggatggactggtggtacgaggacgtgtccttcctcagcctgcccatgttcaagcgcctcatccaggcgatggaggccaagggcatgcgcgacgagagcatcgccggcgccatcatgttctacgccgggcggttcctcccggggctgaagcgcaacaccagcttcagcaacgcgctggccagctacggcgccgacggcagcggcggcgccggcggtggcatgagcagccgcaacatcaccccgcgcgccgccagcgtgtccgctccgtcggagggcgaccagaggtacttcctggaggagatcgtggcgctgctgccgaccaagaagggcgtggcctccaccaagttcctgctgggaatgctgcgcacggcgatgctcctccacgccagcccactgtgccgggagaatctggagcggcggatcggcgcgcagctggaggacgcgtcgctggacgacctgctcgtgcccaacctcggctaccacgcgcgccccgtcgacgacggcatctaccgcgccatcgatatatacctcaagtcgcacccgtggctgtcagaatcggagagggagcagctgtgccggctgctgaactgccagaagctgtcgctggaggcgtgcacgcacgcggcgcagaacgagcggctgccgcttcgggtggtggtgcaggtgctcttcttcgagcagctccgcctgcgaacgtccatagccgggtggttcttcgtgtcagacaacgcggcagggggcgacggcgcgcgcccacacgccggcggcgccatcgtccccaagggcaccgcggccatcgcaggctgcccgcaagcagacgccgacagtgacgtagagggcgacgcacccgatgggaaggagaccatcaccgacgtgaaagcgcgggtgtcggacctggagaaggagtgcaagagcatgaagcaggagatccggcggctcgggaagccccggcggtcctggagcctcctcacaaggaagtgcggttttggggccaaggtgcaacaagcgcagactgccatgagcggcaaatagattattttcccacttcatttgtttattaggcaggagcctcgattgcattccctaaggagtcttatcatctatttgctacagtaacagttcctaatctagccctagctcctagtgttatgcaataattacgtgcggatggtttgcacgggatgataataaacgtaacttcagcttcagcacagccatcaatatcttctcatgtttctgctgttactagaatttctgttgcctaacaccatatctgaaccaaaccttgatagaaagagatagtaagcaaagacagaaaaaaaaagatgacctgaatatccacttcagcaagaatctgacaaagttcttttttttttggtttcgggccgtgcaaagaatcactcgagatccaaagaacaacaacaattgtctcgcgagttaagagtacaaatcatgtaggaaatgtataaaaaaaactagttacctataagcacatctgaacctaggtaagagatcaagctccggtggtaggtggtatacattgcatgaaggcaagaaggctataagctagtataagtaatctcagagacgaacagcatatgtacataacgtagttacccattgtcacaccgtgtctcttccagtcgcctaggtcgctctatcaaaaggcattcctcatagcaccacgggccgcctctcgcttcatctctgcagcttttccacttccacggaagtacatgtatacttgctgaatgacaacgatgctgagcagtgattcaaggcagaacattccaaatccaatgaagtaaaatatccccacaatagcactcctgcctatgatatcaatagccggcaaaatcccagccaaggattttcctttgaatggaaatggaggagccacagctgaccagacacagaataagatatggagaaggtaaaacaagaaaaaccacccaaacttcaaagcactttcagtcctcatcgcattgtaaagcgggcgataccaaagcacataggccccagggacaccagagatgaagtagatgattgctagcaaccagatcatgacaccttctgatttaatccatgctgctgtagttgcaatgatgttccaaaagaggcaagctgtcaatcccaatagtgaagaaaacgccaggtactgcatcctttgcaggtgaattggtatctcgttcgaaatgtcatgatgaataatgggcataaagggtggccaattcttatcttcaatgacaataccagctctggctgcagcttcctcctttcttttcagctccctttcccgtttgtttagctcagcttcctttgcctgcagttctttctcctttttacttaggtccttcgttgaatcaagaggtatgtccactgttgcaccacgatcattgtagaagccagctggttcatgaggaagtgctgacatccgagaattagaagcaggaggtacacttcctcccgcaaaggggttgacgtcatcctcctcgaacggattgcggtcgtacctccccgccatggttgcctcctcctcctgtggcagctgaggcggcggggtctccggcggagaaaggcaaggcgaagagcagcacgggggcggagtccagcctccaacgtgagcgtgtgtacgtgacggtggcgaccaactgctacgcgctgcctcctttaatttttagccggtgttgttgcttgacgaagtgggtttggaatttcgggtgctgctcatgcggtgcaggtgtgcttgttgcgttgcattttt

SEQ ID NO: 10308 - DNA, 1753 bp, Zea mays
cttagaaccaaaaccgtgttagctcgtaccaaagtaatacgtgccgaaccgtactctaggctactgatttcgggtcggcccgacccattctccacttcttcagcactagtcgcgggctcgcggtcgcggccgaggatatcgaagctgcgagcaacgcgatcgagcgcgacgcgggtgagacccgagagagccgtgagggagccagggagggaaccccgaacccccgtcgtcgtctcgtgctcggtctctccggctggcggcatggagagtgccgtgctcgcctgccaggcgccaaccgccgccgccgctgcggcgcctggagcgggaggggacagaggagccgagggcgtggtgatgctgaggcggtcgggcctcgcggcgtgcctcacgtgtccgctctgcggccgtctcctccgcgacgccgccaccatcaccgagtgtctccacaccttttgcaggaagtgcatatcagaggagtttgtaaataaggaagtgtgctgctgccctgtttgtagcattgacttgggctgtgctccactggagaaactcagaattgatcatagcctacagtatgtaaggtcaaaggtatttccttctaaaaaacgaaaggttgaggatccagaagtcacatcgccaattacatcacctataaagacgaaagtacggtctttatcttctttgacaaaacatgctcctcaaatgtctatgcaaaaatgcttgagaaagaggagaacaaaagcttcatgcttacaaaacctccctttgcactcaaccttgcggggcagtagtaatatcacaaaaaaatctggggggtggagacctttagggtgtcactttcgagcagctaaaaagaaaaggtctcttagacctaaatcagacgatataaagacagctggaaaaaggactgatgatccagttgatgtaactcttgccagtcaagcaaagactaggaagcagattacaagacgtggaaatctggagaagagaactggaaccaagaaagtattgattttaaagggaaaacagaaaaatacgaagacaaagaatacgcctaataagaggagattgccagcattatggttctaccttcttgctgcttttgaccagaaaggacatcctcctctgccgcagataccatcaaaatttctgaggatcaaggatgtaaatttgcctgcttccttcatacagaaatacctcgcgcagaaacttaatctttcaagtgaaactgaggtggagatattctgcggtggcagaccagtgagcccagggatcaccctgcacgacctagcagaccactggattggcaaacgatcgaagggccgagtgcggtcatctgtgggcacgcccgccgctgaattcgtgctgaaggtattttacgccaggtcaggagcgccccttccaaaaactgaaagcaaccaagactgatggagagcttcgagcttcccttcgtttcagaaccagcagtgtatcgtttgactcgtaggaccaattgattaatggtatcttagtaacatgtacatagatgttagtgtcacggattagaagctcccatgggcttactgttatatatatccccctagttcagtgcatttttaccgcttatatttttactgacaaagtgtgtagtatctaggctgtgtaattaaaactggatgagatgtcgagatagagtcaaatttcaagttgcactggttcagctggtatgaatcctggctgaaccggttttaaacctgcccaaaaaaaaaaaaaaaaa

SEQ ID NO: 10309 - DNA, 1739 bp, Zea mays
gtccggaattcccgggtcgacccacgcgtccgcgaagttggcgagctatgctacgctgccgagcagatttttatgcaagaaccaactgttttacaattaaaagcaccaattaaagtatttggtgatcttcatgggcagtttggggacttaatgcgccttttttgatgagtcccgcgcgcccgcatccgctggcgtctttacgtatattgattatctcttcttgggagactatgttgaccgaggtcagcacagcttagagacaatagctttgcttcttgctcttaaaatcgagtaccctgaaaatgtacacttgatcagaggaaatcatgaagctgctgacatcaatgccctttttggcttccgccttgaatgcattgagagaatgggtgaaagtgatggaatatgggcttggacaagattcaatcaactgttcaattatctcccactcgctgccatgatagaaaagaaaataatctgcatgcatggaggcataggaaggtcaataaacacagtggagcaaattgagaaacttgagaggcctatcacaatggatgttggttccattgtcctcatggacctgctatggtctgatcctacagaaaatgatagtgtggagggtttgagacctaatgcacgagggcccggcttagtgacatttgggcctgatcgagtaacagaattctgtaaacgaaacaaattgcagttgatcataagagcccatgagtgtgttatggatgggtttgagcgtttcgctcatggacaattgatcactttattttcagcaacaaattactgtggtactgcgaacaacgcaggggccatacttgttgtcggcaggggcttagttatcgtgccaaagttaattcatccacttccacctcctgttaattcacctgagtcctcccccgaacgtggggatgccacatggatgcaggagcttaacattcagcggccacctactccaaccagagggcggccacaagctgccggtgataggaattctcttgcttacatatgatacttgacacgacagagccacctccatctgctggatatgtttgtttgtaatcagaaatttctttaccagtttcaaggtacatatggtatagccaagaagaacaatcaaccaacaggacatcatggatacacttgtgatcagttccctggtaatcctttgtgatgcatcggttttaactgtagttgtgtgctaccgtgacttcagctcctaactggggagctgcataatcagcatttcagatctcaagcaacattgtatgattgcgataccagtggacaataatcaagtctgatgtagttgtaatagctaatctgtaatttcagtgtacatggatagattgttctttcgtcagagtaggaaggtttccaaatgtttgcatactatgcatgctgcagcctgggacgcggtttaaacaggacagctatacaagttgccagatctgagctagattgggcagagaagatttgaaccattttatttgctctccgcggagcgcgaatgtaagaggttgtgttgtgttgtgaaatactgaattcgttataggtatttgtgcaataaattaagttttgcttaaaaaaaaaaaaaaaaaaaaaaaaacgcgcccccggtacccattcgaaaaaaaaaaaaaaaatataaaagaatataaccgaccggtctaccttgatcaatcttagggtccccctcctattaaaaacattttatttaaaggggggggggt

SEQ ID NO: 10310 - DNA, 2621 bp, Zea mays
ccggccggaaacgagcgtaaacggccgcctccatggccactttccctgttaccaccgcccccactcctcaccaccagagcactccacccacagccggcctgcccggccacctccgtctgcccactgccgcctccgccgatgccgccctcatcaccctctccgccttcctctcctccggccgcctcacgacctcctccccttccctcctccaccgcaccctccgcgccgccgccgaccaccgcctcccgcggctcggcctgcagctccacgccttcctcgtcaagacccgcttacttgccgaccccttctcggcctccgccctcctccacctctactccaccatcgccccgctgcaccgcacccgcctcctcttcgacaggatccccaagtccacctaccccgtcccctggaacaccatgatcctacggtacgcgcaggacggattcttggatgaggcgttcgatctgatggtggccatggaggaatccggcatccccattggtgcctccacctggaacgccgtcatcgctgggtgcgtccgagctgagaacggagagctcgccatcgagctgctaggcaaaatggtttcggttgggggagttgtgcccagtgtggccacgttcaacaccgtgctccacgtgatttcggcgttgcgcggggtgaacgtgctccgagagttgcacgcatttgtgctgcgcaacgctgaggttgtgggacttgggcctgtggatttggatcgactccaggaatccctggcggcaggatacatgtgcagctcctgtgtccagtacgcaggccgtgtgtttcgtgatgtcaggataagcacttgcttcctgggcaacctgatgatatcgggatttcttgacacggggcagcggaatcaagccttgggtgttctgcgagaaatggcgtttggctgtggtcatgaagctcagcatctgccatcggcttcgcttacgctggtcctccctgaggtcaatctggcaacaaagagaggcctagagatccatgcttatgcctatcgccatggttttgagtgtgacacctcggtctgcaatgccttgatggcaatgtatgcaagagggggcaagatatgccggtcagacaaggttttccaaggactggatgctaaagatgtcgtgtcatggaatactatgatttcaggctatgccacggttcatgattttgatctctcatttgagctgttccgtgaaatgcaacgtaatggtaccagacctgatgactacacatttacatcagtgctcaacgcctgcagctttgcctgcaatcacaggacagtaatggcattgcacgggcaaatgataaggatggggctttgccattcctatgttgatgatatgaattctctcatggatgcttatggaaagtgtggtttcattgctgaagctcagaagatatttgatgaaaccgagcgaaaggatacagtttcgtggaatatcatcatttcgtgctacggctacagcggttttcctcaacgagcaatcaggcttttccatcagatgcaagatcaaagctacaaacctaccagagtcactttcattgctgtgctagcggcatgcagccatgcaggcttagtagacgaagcactgcgttatttcgaggcaatgcacggagactacagcattaccgctgatgaggctcactatgcctgcatcgttgactgttttggcagagcaggtcagctccaacgggcttatgagttcatcagaggaatgccggtggttccaaatgcttgtgtgtggggtgccctacttagcagttgcaggatacacggaaatataggcctagcagaaattgccgcgaagaagctcgttgagctggaccctcagcattctggatactggatgctgctaaaggatatgtactcaaaagccaagagatggaatgatgtatcgcaacttcgagctgctatgagagataatggcgttaagaagtgcccaggttatagttggattgaggggcgagatagcgaggtccacagattccttaccgctgacaagcttcactcacaaagccaccagatatacgaagtactaggtgggttaaccgagcagttgatggatgaaggatatgaaatagatgtcgatttgacatatactgagtgagggatgtactagatttctacaacttgtcttgaaaatctagccatttagctgacatccctagtcccaacaccatgtctattgcaagcagccacgcgaatcttattcaatgattacaaggttgcacgagctaaagagttcagtttctgcccaggttagaagcgctaagaagtaggcgcaagatgttacattttgggctcgtcatctgatgtgtaagttgatgccttgtcacgaaaagatcagacccggagcattgtgtaacaagaatatacagagttcacagcctagtttcaatatttttttggtgagaaattctgattcaaatattccaccatgactcataggaaaggttcctcaagatttactggataagagaagacaaaatgagattgtggaaacagaaaagcagctgctgacttcagtggcttgtaaaatgccttaacaggagtccttgttggaaaatacagaaggcaaagcagcaacggactgttacttttg

SEQ ID NO: 10311 - DNA, 1592 bp, Zea mays
accataccgggatgggcgccatgggcatcgtcgtcagagcgtgggcgcctcccgctcttgccgccgcggccgcgccggcaccctccggctccagggacaccggtcaggcccagcggaggagcaagccctcgaggaccggccgcgtgcgcgtgctcggcggcactggccgtgtcggaggatccacggccaccgcactctccaaactccgccccaagcttggcatcctcgtcggtggcaggaaccgggagaaaggcgagtccattgcagccaagcttgggggccagtctgagttcgtccaggtcgacacccgcaacacaggcatgttggaggaagcgctgcaggtggtagctgttcgcggagttgccaaaccggaggcagctgcgacgccggcgaggcgctcgcgccccatccctctggcttccgtggccgtgtggagtctggttgccactggcgccgcaaatgctgccgagctatgggaccccttggccctgcacggatcatcaggactcgtcttggctgaccttggcattggagattggtttgggggtttgctgttttcagctgggcagcaggctaatgaggctgtccaagatcagttgtctgctcttagtttctctagcctagcagttatttttggtgctggacttgtaactagtttatctccttgtacactaagtgttctaccactaactctaggatatataggtgcatttggctcagggaaaagccgatccgaggttgttgggaattcaattgcattttcactaggactagcaacaaccttagccattcttggtgttgctgcttcttttgctggaaaggcttatggtcaggtaggacaagggctcccagtggctgcttccggtttggccattatcatgggattgaaccttctggaggtacttgaattgcaacttccctcatttttcagcgattttgaccctcgcgctgctgcagctaacctcccttcaggtgtacaagcataccttgctggtcttacatttgcattggcagcatcaccttgcagcacacctgttcttgctacccttctgggatatgtcgccacttcaagagacccaattattggaggaagtttattgttgacatacacaacgggctatgttgcgcctcttcttattgcagcttcatttgctggagcactgcagagtttgttgtcattcagaagatattcggcatggataaacccaatcagtggtgcatttctacttggtggaggtgtttataccctactggacagggtgtttccagcaacatcaatggccatgtagaccatcgttggacaagaattgataggcaccagtctgtttggcgtgcgaatgatatttggatgtgaagtagtgaaatgatggcaacaaagtttagccagatctctcagcgttgtataggcacgcaggacattttgatcgggacaagcaaagcaccttgacctaagtacagtagtctgcatcactgtatctgtatgggcctcgatacttggggccggtctaccctactaaaatgtatttctgggacagattgaaagagtatgaaatccatataagggtttgttcgttccaaaaaaaaaaaaaaaa

SEQ ID NO: 10312 - DNA, 1736 bp, Zea mays
atttaggggtaaccgttgcagacagtctaatcaagtgaccatgcactaagttatccatccaccacatatatataacgctagtaaaaactataataggaacaagcaaaactctcaccaactacttataattcatcatttgataaaaattagagagtaaataagaagataacaagtttgttgttggtttataaaataaaatgacaatatcaataggtttggtctggtttaaaaaccccacggatcacgtggtggtctatagaacaaaccgtaccatgacctatgccatagattatgatcattaataaacctatgggtatgaaaattgacataaacccgtaccctaataggtaaaaaaacattggatttcgattacccattgtcatttctagtcaaacgtatccaaccactaaatcagataacaatttgaatagtacagtacagtgagcacaagtggcaataggaggacaataatcacgctgaataagtaggccccacatcacagtccttctggcaactgcacatggttttatcattttatttttaaaattgttttttatggacattatctcgatcacgttcctgccacagaagctcatcaagcatcggacggcctgtagttgtagacgtgaaagcttgcatgtggggccacggcgtcgaggaagatcctggccgtcgcctcctgggccaccgacgcctgctccttctccacgagcgccgccgcgaccacgtccacggcggggccgcctccggctgccaccatcgcaatgatggccgcctggacgggacccagcgtcgggttgtaggccgcggactccaggcagccaccggcatagatcctcccgtcgccgtctgccaccgcgaaccccgacggacacttgctgtacggcgcgtgcgccgcccgcgccgccgcctccgcggcctgcctcaggcgcgcgtccaggtcgccgcgggcgaggccattggcgacgggatcacccagggcgttgtcgtgcgcctcgaggacgaggggcacatctccggggaggagatcgttgggcccgaaggggcggaggaggagggacgccaccgtgcgccactcgggcgcgcatccctcagcggcgtcgctggtcacgaggattcggatgctggcggcgccgcggatctcctgcaggaactggcggcagtggccgcagggcatgtgggagacggcgacggcgcgcagctcgggctcccccgcggcggccgcgttggcgacgaggaactgctcggcgtggacggagtggcacagcgggaggccgcggaactcgaggtttacgccgacgtagacgcggccgctggcgcccagccccacggcgcccacggggaaccccgagatcgggacctgcgcgcgcttcctcgcggacgggaccaggagcggcagcaggtcctggacggtcgctacgccggcggccgccgcggcgcgctcggcgtcctccgcgcccataacgaaccccgtcagctccaccgacgtggcggcggcggcggcggcggcctccggctttggcgccaccacctgctcctcccccatcgctcagatccaactgtaactaggctaccagtactcttaatcgcgtttagtctccgaactcgtaacacggatgtgctttggatgttccttggagcttggaagaggccagcacccaggaccacgcgaccacgagggatgagaagagagagaggggttttcgattaggatgttctaggtaatggtctcgtgc

SEQ ID NO: 10313 - DNA, 462 bp, Zea mays
gactacagagaaccggaggactgaggaggaggaggagacgtcacgcctgcgcggctgcgcccaccatggacgaggaggagttccggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggagaataagattggagcgacaaaggcagagttcttctgcaagacattcgaagaagttcatgagaaacttgttcacagagagctgaatttggatgctgctaagaagttcctgagcgcatatgagagctgatgatgaacaataggcaaacttttaacaacaggtagatgctgttgagcgcatactgataccgcctgttggttca

SEQ ID NO: 10314 - DNA, 919 bp, Zea mays
  misc_feature (848)..(848): n is a, c, g, or t
  misc_feature (861)..(861): n is a, c, g, or t
aactcgtttcacccctccagttcccacttttctaaattgaacaccgagaccattacttccaacatcctaatcgaaaagacggcccgctggccttagatgtattgggcccactggcctcacaggtcatatccggcccatgtggtaagactcgaaagctcgaagcgaagcctccctgactacagagaaccggaggactgaggaggaggaggagacgtcacgcctgcgcggctgcgcccaccatggacgaggaggagttccggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggagaataagattggagcgacaaaggcagagttcttctgcaagacattcgaagaagttcatgagaaacttgttcacagagagctgaatttggatgctgctaagaagttcctgagcgcatatgagagctgatgatgaacaataggtagatgctgcttaagggtcggtagttgccaatgatctggaaagttgttgatgctgttgagattttgatcacaggcaaacttttaacaacaggtagatgctgttgagcgcatactgataccgcctgattggttcaccgatcgcccgtagccagctcgtatgcagccaggctgtccagagactgttatttgggccgtagaagtggatgcactcaaaataaatgttgcgtttactcgtgcaaaaaaaaaaaaaaaaaacccgccgatcaaattnaaaaaaataaaanaaaaaaatgaaacttcccttaaaacatactgaaaaaaacccggccccttggcttttgc

SEQ ID NO: 10315 - DNA, 713 bp, Zea mays
cctcgaggccggccggggaaccggaggactgagaccagaggaggagacgtcacgcctgcgcggctgcgcccaccatggacgaggatgagtttcggcgcatgctcgacctcttcccggtcgtccgctcccgagactactgctgctccgatcctggaacatccagcagaggaaccagacagcgatcacgagttcaggaggcaactacgggcgataataaggactcgtccggtgcacaagatatgtttatgcagaaattgaagatggctgcggagaataagattggagcgacaaaggcagagttcttctgcaagacattcgaagaagttcatgagaaacttgttcacagagagctgaatttggatgctgctaagaagttcctgagcgcatatgagagctgatgatgaacaataggtagatgctgcttaagggtcggtagttgccaatgatctggaaatttgttgatgctgttgagattttgatcacaggcaaacttttaacaacaggtagatgctgttgagcgcatactgataccgcctgattggttcacccatcgcccgtagccagctcgtatgcagccaggctgtccggttatttgggccgtacaagtggatgcacccaaataacttatgttacgtttactcgtgcagccccacgtctttcacgtgcatgcaattaaacatatgctcaataaagccaacagatgggatggttcc

SEQ ID NO: 10316 - DNA, 1217 bp, Zea mays
acccaaccctgccttctcttcttccttattcccagtttcccacagcttgcgcggtctcactctctctcggcgacgactacgccaaggcccaagtgtgccgaggtattttttaggctcaggtcgctaccgccctacggccccggtcttcttccggcccttcgccggcgacgagaaccagcagggcagcagacggatggcttcgtcggtgccggcgccatcggggtcggtgatcaccgtggcgtcgtcttcttcctcagcagccgcggccgcggtgtgcggcacgggctccccatgcgctgcgtgcaagttcctgcgtcgcaagtgccagccggactgcgtgttcgcgccctacttcccaccggacaacccgcagaagttcgtgcacgtgcaccgcgtcttcggcgcgagcaacgtgaccaagctgctgaacgagctccaccccttccagcgcgaggacgccgtgaactccctcgcctacgaggccgacatgcgcctccgcgaccccgtctacggctgcgtcggcgtcatctccatcctccagcacaacttacgacagctccagcaggacctcgcccgcgccaagtacgaactctccaagtaccaggcggcagcggcagcttctgcgtccacggcgccgacagggccgcaagcgatggcagagttcatcggcaacgcgatgccgaacggcgcgcacaacttcatcaacattggacactcggcggcgctcgggtccctcggaggctccgcctccgtgttcgggcaggagcagttcggcaacgcgcagatgctgtccaggagctatgacggcggcgagcccatcgcgaggctggggatcaacggcggcggctacgagttcggctactcgaccgcgatgggcgggtctggcgctgtctccggcctcgggacgctcggcatcagcccgttcttgaagtctggtaccgccggcggcgacgagaagcccaacggcggtcagtaggcggatcgatccatccactcccatcaatcttgtcaggttactgaattggaacgagaaaaaaaatccataaagttctgaagactaagtggatcgagcctgcgcgcgcgagggttgtcgtaaaatgtccaccgctattaggagggctaatgatgaattccccgtcgattgtagctacatgcatgaaggagtacacacgcatgcctatgttgtttgaattaatcaaatttcttgtttgttagtg

SEQ ID NO: 10317 - DNA, 7018 bp, Zea mays
  misc_feature (762)..(762): n is a, c, g, or t
  misc_feature (771)..(771): n is a, c, g, or t
  misc_feature (1790)..(1790): n is a, c, g, or t
  misc_feature (2007)..(2007): n is a, c, g, or t
  misc_feature (4936)..(4936): n is a, c, g, or t
agttgttgggtggagagctggtggtatagaggtggaagatgcaatgcttggtaggtgaagtacattttgatttctaaaaagtctggttttggtactatgaaccatttgttttctttatgtttgtttaatgaaaagaacaaatgttcacaaacttgagcttcagagattttatgcacaagtactgttctctatgctatgttctattttcgtggttgatctgcttcagtagcgcacatacatacatattgattgatgtctttttttctttatgcagccaatggacatggtcttgctaggggttgttgactttaagttatcagtcaagccggggaatgaagttacaaccatggacttggtttcagcataactcaaatgcttagtaaacattgtgttgtcgggaaatttgttgagttctatgctaaccgtaattttttgaaatttgatttctaaaaagtctggttctggtactatggaatatttgttttctttatgtttgtttaatgaaaagaacagttggtcacaaacttgagctttagaatttttatttacaagtactgtcctctatgctatgacttacttttgtggttgatctgcttcagtaacctacatacatacatattcaggtacccagaccactctttatgaccatgatgaaattataaccacttcgcttctttagtgtgctactaatgaactcatttgttctgtagttgagctgccatgatgcttcacttgcaatacaacctatttttgatcgttttnaaaccgttntgatcacttttggaactcccagctctcgctagaagataaatttcatttggcatattgaagtcaacatacttataagaattgttgtgtgcaactcaggtgaatatttttgctcagtttggtggtgtttcttcttttttgcttttggtctcgagttttcactaactaaggtactaaaaaaaaatctctgaatgttgtcttgagtatctctttccagagtaacttttgacaaccttacatgccaaaaggttttcttactgggactgtcatttttattagttgaaagtcattggtcctattgctgtacctagaggtctgcttcagattgctctgtttatgttcctgtgttgcctcactgcagcggtatatatgcatctatcaggctaagaataagagtgaatgaatgccatgtagtaagccatgacgctaactgctgagtgtaaaatatgtagcagactcaaacatgcctttttattattaaaagtgactataggtggcgtgcaatctagctctgtacaaacacatgtagatttcaatatgtttcgcttacctggaacatgtatacaaatctgttttggaccaatatctaacatactttgtaaattgtcttagatatatgtatcatgtctttttcattattttaacttctgaacatggggtttacaaatgttgcagtttcaaattatctggatccacattttttgccctttacaagggttttttgtgatttggctctttgtaatgcccttctaaactctactcttttggccgagtagggcgcgacgaagcgcggttctttttctagtcgtcattaacaatgcattaggcagcgcgcgatctcaagccatccggcagcatcgatgccaactcctcttctcgagcaaacgccttgatgacaagttgccattagcaggcggctccgtatagtagaaagagaagacgacctgtgttttggggtttagggtttaaagcaggccaaaaaaaaagttataaaaagtaacggagcgcgacgagggtagaanagcggaaggcccgccgcttccccttcttcattcccgtcccacacacgccgcgcgccgccggtgcggctcgcttccgtcccccccggtccgcgcgggctgcctgcgggagcagggtggcagggcactccggcaaccacgtgggtggggaggcgacgacaccaccctatgctctgtcctcgcccgcagggtaaggtatgggatcgattcctgtgtcgcntccacgcgcctcgcgcctttttcttgcgccctgtctctgcggaggcttcctcgcttctctctgttttgcttgcttggcgggatttggccctggatctgtgcaccggtagccggatttgggcggcgagttggtgcgctgtatgtaatggctcttacgtgatgctgtgttttgtggtacgatgttttggatctgtttcattggcttgatttgtatcctcttctcttttttttttcttgtctctgtttgcatctttttttacggagaaggtgtaatttatgattgagggccaatgcaggctgtttggtctaagttacaggctaacgatatcgtttttccagttgaggctaatttcctaatagaacattgtctacgtttttatttggactataccatgattttcttgatattgttattgcaactgatagaatagcagcatgtatttatctctcgtgtgtggtactcatgctctatatctataattccctagtttataaaaacaatagggacattcttatcttgaattatggttaatgtttatttgggatcgtatacattagtagtatagtggtgagtattcccgcctgtcacgcgggtgacccgggttcgatccccggcaacggcgcattttttatatttccattcctttttatatattttcctttttttttcagaggggccggctgttgcgggctctgggctcagacctctcacctcgggcctcagagagtcagagcgagagtcggtccaacggctactggttccactgtctccgcttccagactctacgttcctgtctcgttcaaaaccctaaacctttcctctccatcggactctcgccgccgccccatggcggcggaaccaagagagcccacatcctcgctggatgcccagctcgcggcctcttcctcctccgcagccggcgtaggcggccccaacccgtgctgcgcgacggtaattgaccctccctcttctcatcatgacaccgcattctgtcttgttctgttcttgacgtgccttctttttgggggcgtttccttttggggtttgggttctacagcagtggaagaattgccagaaattggtgaggagccggacggcgctgcgggaggcggtgaagctcctgcaggctgagaacgagaagctgcggaaggagaactcggagctcagcaaaggttcctattgtgttccctgatttcttttcctagtgttctgctttctttttctgcgttgcgattctagttacaaatggaaacaaaaagaacaccttaattatgccgaggtaatgcacatgttcagactgtacgcattatgtctagtattttggctcttccttttttcatacctaaggctgcattcaaagaaagtgaacttttttcttataaaaaactacttctgtgaagtatctaatgctctaaattctaatttcatagcatgctagtagcgtgctagcaggaattttaacagaaggtgcctatcacagagaagatgtctttcaaagtatgtctggtttctcaataatgcttcatgtatttgttaacatcatgtttggtttctcttcaatgcatcttttattcgttagcatctattaggctccctcccccccaattttatccttaacttagtacactctaaaacacttgattacatgatttgatgtcacccacccaaagcatatgtattcttgatgaacagtgtatcatgtatgcatcttgaaaccattcttatgtgtatcatgctttaacgttggactctctctgtttttcctttgatgaatagtgtgcaaggaggaacgcctccgaggtgattcagcagaagcagctagggcaactgagtctgatgccagagatctattggaaaaggagataattgaattaaagacacagaacatgagtttgaagcaaacacaaaatacctgcaaaaataatgatgaacttttacgtatctctgaattagaggaagaaaatagaaagctcatacagattttaggagaagaaaggaagaagatcacttctgagaagaaaaaatttgaagaagaaaagtgcaaaactctagaaatgcaaaggatatggaagtcagaagcacagaagtctgaagagtatagaagagttgctgatactgaaagaaaagttgccaatgattggagagcatcatgtgaaaggttgaggagtgaagcaaatgaaatcagagctcagttgactgctcaaattcagaaaacagaagaaatacttaaaagggctgaagcggagaagcagaaggtcgccagagaaaagaaacgtgctgattcagagaaatcattatctgaaaagaatagaacacttgttgaagttgagaagaaaaaagtaacggaagaaaagtgccgcgctgacaatttatttgctaagttagaggagcagaagaaactcaatgaacatttgcgaactagcatacaggttgaaacgaagaatgcaatagaagagaaaaaacgaggagaccatttgtttcagaaattagaagagatgagagaacagactgaatgtttacagagaaaggcaaatgaattctctgcaggtagagatgtaatttcttctggcaagtgtggccggcgacacattgatagaatttctgagaatgcaaacgttaagcttctcaaagagaaacttaagctgaaaaaagaacaactaaagcatgtcaagaatgtgtccaagctagataaagcaaaaactgctttaataagaagagagcttcaaagtttaaagcaagactggacacagctactgggtcggtttaacatgctggatgaccaccttgcacgtggtgttgaagatattcatgtcttaacacaggtctgtatcctgcatggtatttattactgtcttcatctatgtttgtggtggtaatttgggtaaaatcaagaatttcttagcaatagccaataggtaactcttacatnctagtagcaacaatgaactgttatagtgttcttcaaatatgtgcaatttggcatttttttcatggacttcctttcttctcatgctaataaaaaaatgagttgttaatgaaatcataggggacaatcattcggtatctgaaatagcaccttttttagcgttcgttttttgtcctaaaaaatatcctttgttttttaaagcatatgagtgggggaagcgcataagatatgcacttgcaattactacatgtaaatgttatatattcctctctggtcacaaacccatgtcacttcatacttggggtggtcgacaagattaatttttctcatttaattgcatatagcctgccagatcatactaataaaactcgaaaagaccgcccccatggtattatattaagaagctcaatcaaagccccgaccaagaaaggtcacgaaagctggtccctcgtgcagcacgagggaccgcactctatatgccagatctttacttgtgctttgagccctcccaggctcccagcccctacacgcctccctacaggccagtccatctcgtgtgcacacaaccaagggaaccggtaagtgacctttttttttttacctcagtctgaaattcgctcccattgggattcaaaactcagggccagaggagtgcttactcagaccacctaaccaactcagctagagaccatttcacgtcagatcatactaataaaaacttatcgcattcaagtattgtatacataattgtttcatgctgattgctttctgtttatcatcatttatttcggaagctggccgtttccacacactgttgcagaaattttatcatgctacttctttagtctgatgacagtatcatcatttctacaattttttcctggctactacacaaaaaaattataaaaatagaaaattcgggactcttaggtaaaatgtgtaacttttaagtcaatcactccatgatatttctccaaggctgcacccaccacatggacaatgtggcactagaccgtaaaataaaactactcaacctattatattatcagagaggggaattattgctgtagccacacctgttttaaaagggcaaacatttcgaaaaggacgattctcaagataatagtcagaatttgtgaaacagaggggctgtcttcaatgttgtggttgccgggagggaggctgtgacttcacatgacaaacatgatgtttttttgtctttatgttttctgtgaatggaatgctgggccaaactaatatattacaggtaacgttgttatgcattgaaatgccacaatattggttttccctctagatcactgtacattgactatgaatgagcagttataactcataaattatatgttctagtagatatgagcagcgtattctttgatcttgttcctgatatattgcatatgttttgttaagttcatttgtacttgttatgttctatctatataaactgatgcaattactggcattgtctcatatttacagttgaatcagcatccagagatacatggctttgaacagaagctgcttcctaatgattcagttcctgccccatattttcggttgcaggctgggacagttccatttggctcttctatcccaagtgaatacacttcatatcagttgcccagagaaagctgctcacgatcaatctcaggtactagttctgaattatgcccccctcttggtagctctcacagactgctgaagtcaaaatgtcagcacagatcttcatgtccaacatccatatctgatgaaaaattcatgggctcacagggcaaggataaccctatttgtctcatcgacagatatcaggaaaaaacaggattcagttgttcccgagctggctcctaaaattagaaatgatagagcattgccttgtggtacgcttacagatagaagagaaacacttggtggtgataggaagagaaaacacaccaaaatgtctcaagacccctctgcttttcttccctcaaaaaatgatttgctacatttgaaatcaaaggtgcctgctaccacttcaaatgttgcattatcctttgatgatgatcctttgtgtctgcaggcatg

SEQ ID NO: 10318 - DNA, 1094 bp, Zea mays
  misc_feature (945)..(945): n is a, c, g, or t
  misc_feature (957)..(957): n is a, c, g, or t
  misc_feature (970)..(970): n is a, c, g, or t
  misc_feature (974)..(974): n is a, c, g, or t
  misc_feature (980)..(980): n is a, c, g, or t
  misc_feature (984)..(984): n is a, c, g, or t
  misc_feature (989)..(989): n is a, c, g, or t
  misc_feature (991)..(991): n is a, c, g, or t
  misc_feature (995)..(995): n is a, c, g, or t
  misc_feature (1007)..(1007): n is a, c, g, or t
  misc_feature (1010)..(1010): n is a, c, g, or t
  misc_feature (1015)..(1016): n is a, c, g, or t
  misc_feature (1018)..(1018): n is a, c, g, or t
  misc_feature (1020)..(1020): n is a, c, g, or t
  misc_feature (1023)..(1023): n is a, c, g, or t
  misc_feature (1029)..(1029): n is a, c, g, or t
  misc_feature (1031)..(1031): n is a, c, g, or t
  misc_feature (1035)..(1035): n is a, c, g, or t
  misc_feature (1040)..(1040): n is a, c, g, or t
  misc_feature (1043)..(1043): n is a, c, g, or t
  misc_feature (1046)..(1047): n is a, c, g, or t
  misc_feature (1051)..(1051): n is a, c, g, or t
  misc_feature (1055)..(1055): n is a, c, g, or t
  misc_feature (1058)..(1059): n is a, c, g, or t
  misc_feature (1061)..(1061): n is a, c, g, or t
  misc_feature (1063)..(1063): n is a, c, g, or t
  misc_feature (1068)..(1068): n is a, c, g, or t
  misc_feature (1071)..(1071): n is a, c, g, or t
  misc_feature (1074)..(1074): n is a, c, g, or t
  misc_feature (1080)..(1080): n is a, c, g, or t
  misc_feature (1086)..(1086): n is a, c, g, or t
  misc_feature (1088)..(1088): n is a, c, g, or t
  misc_feature (1090)..(1091): n is a, c, g, or t
  misc_feature (1094)..(1094): n is a, c, g, or t
tcggccgggattaggcagcgcgcgatctcaagccagccggcagcatcgacgccaactcctcttcccgagcaaacgccctgatgccaagttgccagtagcaggcggctccgtatagtagaaagagaagacgacgtgtgttttggcctccggaggagcaagccccccaaaaaaaacgagcagggagcggttaaaaagcaggcaaaaaaggggagacgccacgagcggaagacagacaggcaggcaagcgagaccaaggcgggggcggagcgcgagaggcgacgcgagaggcgagaagtggaggcggtgctgcggtggcatgccatggttataaaaagtaacggagcgcgacgagggtagaaagcggaaggcccgccgcttccccttcttcattcccgtcccacacacgccgccgccgccggtgcggctcgcttccgtcccccccggtccgcgcgggctgcctgcgggagcagggtggcagggcactccggcaaccacgtgggtggggaggcgacgacaccaccctatgctctgtcctcgcccgcagagtaagattgcagcagcagtgaatttgggagcttgaagcattcatctgagacatggaaaaagtgatctgctgggcatatctccttcaacgcaagcagttctcgaaagaaactcttgattgctgtgtcttagctcgtgggaacactcctctctcctctctcgtgaactacacatagtggttatatgttcctctatgctcaacaacaagcaggctgatgcgatattttgctgaagttattatatttcagtctatgccagacatctacatgtagatggtgctcatataagtgggggttgatatatttgctgtgttcagcttacatctgttgcggccctagttagctatttgctcttttgggtactatctggaggcaagagatggatcagctaggacttgggcgnacacttgcctgnggttgggctgtcntctngaaggngaanttttncncgangaccacctcggnatnttacnncncntgncaaccncncctngttgnctnaanncaantccnccnntncnactcnccnacncccttnatcgcngncnnacn

SEQ ID NO: 10319 - DNA, 1578 bp, Zea mays
gcacgagaccattacctagaacatcctaatcgaaaaattaaccgtacacgcggacgggcgcggggcgccgttggcccctagctgcggtgatccgccgctctcgcagcaccgtcgcgctcgcctccgcccgcccgctcgtcgagtggacgcgcgctgcaccgcgactccagtcatggttagtgttgctgattctctcgtggcggatcttgatgagctattggagtataggacagagaagactatcctggagatgaaaatgcagagacagaaaacttggaagatgatgctaatgatagtgtccctgacctgaaatctcttgatcttgattgtgtctaaaaacatcagaaggcacaatggtataaagatataatgaagacatgatcacaatggcagaaacgacaactggtggggagcctctttctgaagataatttagtaaatactattgaagcatccgacagagctcttaaccttgatgccgacaaagaagatgatacttgaatttttgaagggcagaatgggatacgttgcatgaaaccttgccgccattgttggcagtgctgttgcctcgaaactgagtcgtgctgccgtgctggtggtttggtaacactggccaaaatgcccgcttgtaatgcgctgcactgctgcttctcggtgcaaaaaagacaaatctgtctggattctctactgcgtcactgcagtctcgtattggttatctagaacaaactgaagtgctatttgaaagcacacctccatctttaagatttcagtctagtagacttatagctgcaaagtcaacactagcagcaaggatcgattgcataaggctatcttcaggagtttactcattctcatctcttatcttaatctacactctataaacagtgcattttacagtgcaaaacagtgttttacatgttcatgtgcacgatctgctggccatagcctaagagatgatccaactagaacagctgggcagaacttgttagaagaaattagtaagaagattgaaaactggcaacaactaccacctgcaaggcttccaaagccaattccaattccagactttatgcctaaaaagaaaactttctcatgtccaaattgattaaaactattgtacttcatgtaaaagattgctatataatgcccattcacatgtctcattagcattttgcaacttgttatattactcgagttccctgattgcattacctgtttgtctgtttgtcttagttgcattttgcaacttactttgttatatcactctgagtgacccttcaatttcctcttaccttttcgtatttgggaactcaattgtgaagatatgcacagaccaacacgatgaagcttgtgaatcggatgaagtttagcatgccagaggagagcacattgggtgatggcttaggggaaaggttacggcttccttgggcaggctggaagcgggaagctacgtgtgtcagctggtcaaagcaaactttctactaaaattgctaaaatgtaagcgatttacacgtgagtgacggtgttgaagtatataagtgaattgagtattttcttcctaccaaaaaaaaaaaaaaaa

SEQ ID NO: 10320 - DNA, 730 bp, Zea mays
cccacgcgtccgcacaggcggactcgcggactcggggctcgtaccaacaggaaaaaaggcccagaggcagtgccgtgaccgattcgagacgcaagagaaggatcgagacgaggcggcggttttccggggcagcatcgtctcggccacgaagatgtcttactcaaggggctcaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatcgctgcatcaaatatctggaccgttctgtgttgcaaggtcgggtcataactgttgagaaggcaaagagaagacgaggtagaaccccaacacctgggaagtatcttggcacaaaatcatcccgtggacggaggtactccacaagctactcacctgatcggaggggccgttacagttcccgctactcacctgatcggagggactgtcatggtagagacccgtcatactctccatatgacagaaggcgatcatactctccttacggcagggatgaatcatattccccttactatggc

SEQ ID NO: 10321 - DNA, 4439 bp, Zea mays
  misc_feature (712)..(712): n is a, c, g, or t
  misc_feature (1372)..(1372): n is a, c, g, or t
  misc_feature (2255)..(2255): n is a, c, g, or t
aataacattagcttgatcacataaatattggcagatacaggaacacactaagaaagaggctgatttcttaatgaccagtggtggaggtagcataaactagtaaaaagcttagttttttctcgcttcctcctccttgttttctctctaccctctatctctttctcgaataggatggggcctcatttttatatttttctctttttttattcttctttactctccacctctctatatacaatggagcttcattccgtaggtttaattcgggtactgaggtattaatctcaatctacatatattaaagtggattggagtacatatattaaggtggattgaagtgtaatttaaattaatttataccctaatctaactcaatacatgttgattaaaggcaatagtagattaaccgaacaaagccgtagggctagatccctagagcctccaacccctcgagatccatctgcacacaatatgtttttataataaaatattttaattatgcaaacgtgcaatacagtattctacgtaactagtaaattttaaaatagttgtctcgaaatctagaattattatatatttttacgaaagaaaactaggggatcaaacgatgccgcgaaactgcgtcatgtgcgcgtggccgcgggctgtgtggtgtactgcgcgtgcgcccagccgattcaaccacatttgagaaaattttcgcgtccggccntatccagaagtccagaaccttccccaatcacccacacggccacacctggccccgcccaacttccatttatgcacaggcggactcgcggactcggggctcgtaccaacaggaaaaaaggccccgcggcggtgccgtgaccgattcgagacgcaagagaaggatcgagacgaggcggcggttttccggggcagcatcgtctcggccacgaaggtgccgcacccgattttctccgtgttctctatatatattgatatgatagtcgtgcggtgcgagtttgtgtgtggaaaatttatctattttcggtttttattctgttggttttgcggcacatgtctgatctgatggtttcacatgccactggaactttgacttgcgatgtgtttgtttaggaacatctgaacgaaggtttacaacattagacccatgatctgccatcctataactgtgatggtgccttatccatgaggcagtaatataattagggttggagattgggttgatcaccatttcggtggttgtttgaggttgaagacgtactagatttctagattttcgagatgatggaagagattgaacttagcctgtgcaccgttttcttggtcttaggctatccacattcatactactctaaatccctactctaaaaggaatattatgtcnctcgtcatcaaaattctttcccctatatcacaatttttctcagccatgtttactttatatcttaactctatatcaactaacacatattatattttttcttttcattggtattcataccaccgatgctagctcctagcgtttcccgtaggaaagagtacgctggaaataccatttcctgtggccactgtaaatttccagtagcatatagggtacctcattgcagcactttgttactgcatttgtaactgcaagcgtgtagcgtattctttgctgtccttcactgcggctagccttgaacttatgtttgcagtatcaacttaaaatttgcttaaacttatgtttgcagtatcaacttaaaatttgaagcgctaactacagattttcataaaggtatttaattggcctacatcattcattatggtatttttctaacaattggttattcaatattgaaaggaatttttacgcaaataaaatttatcttaaaagcaaatataaaagatgcgctagaaacaaactctggatagggttgcagttgcactgtattgtgcatctcgggatgggaacaggaacaaactctggacgtcaggacgtaagttatgtggaaaaaggggaataaaaagggaggaaccaatttccttcagaagaaatagatgtggaaagggtggttataattcattgcttaccagtcgactcatgatacatcagctagcagcatggggaagttatttaattagaaatatctgcgttgatatattatgcaagttctgtgataaattgacaaatttggattctttctgtaagctgtccactttctcgtccgatatgttatgcagtcacaacatgttttagaagttcattcagttttattttagctatgctnacaaagtcatcatctattaggctgtatatttgaatgatcgtttcaggtgttaatatattttttacctctttgtcttgcagatgtcttactcaaggggctcaaggtaagcactatttattttataaccttgaatgacctactttaaaaaccttcttgtttcaatttgtcttcaagtgatcttgctcggtgttctgatagtttttttacaagtgaaaggtatggatctcgctcaccttactcgagaagcacaaggtaccgaagtcgctctaggtatgccctttatccttgggccagttaatgtgtttttgccaatgtcgtatgtttaaagtctatatatgaaacatctatgttgcttgtattccaaggagtatttgatattcctataatttatttaggagtgtcgactctagtgatgctgaaaaccctgggaacaacctgtatgtgactggtttgtcggctcgtgtaacggatcgagatctggagaagcacttctccactgagggtgaggtaggtaacctttacagaaaacagtaaaatatctgcatctttaaagtgtgtaatttctgagaaattttcatataattattgaacaattcgctttggttactgattgtgctataggtgattgatgcaagcgttgtgtatgatccttggacaagggaatcacgggggtttggttttgttaccatggctgctgttaaagatgcagatcgctgcatcaaatatctggaccgttctgtgttgcaaggtcgggtcataactgttgagaaggtaaaatcataagattgggagcatctaactttcttatttaacttggctactaaatgatatttatatcattccttagtactctacactgaacattttagtgctctgtccattgaagattttgttgacagcaacagggtagatgttggtagctgctctgcaacaaactgatacaacctaacaccaaaccatgccaacctcagccaaagggttgtatgccctacattgcatattatttttcttaaatatgtttattcagattgtagatgattgctctcttgcagtcttgcttttggtatcaaagacacttccttatttggtcccctattacacaggcaaagagaagacgaggtagaaccccaacacctgggaagtatcttggcacaaaatcatcccgtggtgagtgttttcatgaactaatcaccacctataagtctataaccattgggtgtctttgcccgatttcctcaaagagaaatataagcactgtaaaattatcttgatataacctgtcattgttgacattttttgttatacgatgacaccaggacggaggtactccacaagctactcacctgatcggaggggccgttactccacaagctactcacctgatcggaggggccgtcatggtagagaccggtcatactctccatatgacagaaggcgatcatactctccctacagcagggatggatcatattccccttactatggccggcgatcatactcaccttactatagcagacggtatcgttcaaggtccccatactgctacagaagacgtaggtcaccttctgtttcgccatactaccgccggcacaggtacagatctgtgtccaagtcatccagttcatctccaagggccagaggacggagctattcgtgcagtttatcaccacagagaagctactcgcgcagccattccccagaatccgagagatcaacaagctattctcctaagaaagggagtaaaagggaaccctcgcgtagcagatactctggcaagagtcgtcattcaagggaaagccactctcatagccgcagttcgtactccaggtctgtgtccagggagcgctcagcttgatctgcgaggtgtgtcgtcctaggtggttataagatatgcgctgtatttgcatctatcagaacttgtgtacttcgtatattacgaacttgagaactgtatggatgtgtgcattgtgccaaattatgttcattctgtgctatctttctgatgctatcttgctattgttggtttgaacttggtaatttagtttacaaaatcattcgacatgtggagtccctttttatggaacatttcgttcattattttgggatactagtggaaatgtatgtggcacgcgtgtgtatgtgaaaacatcatatgtataaaataaaaggcataatgttagtgtc

SEQ ID NO: 10322 - DNA, 1733 bp, Zea mays
  misc_feature (11)..(12): n is a, c, g, or t
cctcgaggccnnggcccgcgtaccaacaggaaaaaaggcccagaggcagtgccgtgaccgattcgagacgcaagagaaggatcgagacgaggcggcggttttccggggcagcatcgtctcggccacgaagatgtcttactcaaggggctcaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatcgctgcatcaaatatctggaccgttctgtgttgcaaggtcgggtcataactgttgagaaggtaaaatcataagattgggagcatctaactttcttatttaacttggctactaaatgatatttatatcattccttagtactctacactgaacattttagtgctctgtccattgaagattttgttgacagcaacagggtagatgttggtagctgctctgcaacaaactgatacaacctaacaccaaaccatgccaacctcagccaaagggttgtatgccctacattgcatattatttttcttaaatatgtttattcagattgtagatgattgctctcttgcagtcttgcttttggtatcaaagacacttccttatttggtcccctattacacaggcaaagagaagacgaggtagaaccccaacacctgggaagtatcttggcacaaaatcatcccgtggacggaggtactccacaagctactcacctgatcggaggggccgttacagttcccgctactcacctgatcggagggactgtcatggtagagaccggtcatactctccatatgacagaaggcgatcatactctccttacggcagggatgaatcatattccccttactatggccggcgatcatactcaccttactacagcagacggtatcgttcaaggtccccatactgctacagaagacgcaggtcaccttctgtttcgccatactaccgccggcacaggtacagatctgtctccaagtcatccagttcatctccaagggccagaggacggagctattcgtgcagtttatcaccacagagaagctactcgcgcagccattccccagaatccgagagatcaacaagctattctcctaagaaagggagtaaaagggaaccctcgcgtagcagatactctggcaagagtcgtcattcaagggaaagccactctcatagccgcagttcgtactccaggtctgtgtccagggagcgctcagcttgatctgcgaggtgtgtcgtcctaggtggttataagatatgcgctgtatttgcatctatcagaacttgtgtacttcgtatattacgaacttgagaactgtatggatgtgtgcattgtgccaaattatgttcattctgtgctatctttctgatgctatcttgctattgttggtttgaacttggtaatttagtttacaaaatcattcgacaaaaaaaaaaataatggtccacaacgtcgtatggggcaggattggtccttggaaaaaaaaaaaaaaaagaggttgttttttaaaggggatccaaaaattaccttaaaaaaaagggggg

SEQ ID NO: 10323 - DNA, 1359 bp, Zea mays
atgcacaggcggactcgcggactcggggctcgtaccaacaggaaaaaaggcccagaggcagtgccgtgaccgattcgagacgcaagagaaggatcgagacgaggcggcggttttccggggcagcatcgtctcggccacgaagatgtcttactcaaggggctcaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatcgctgcatcaaatatctggaccgttctgtgttgcaaggtcgggtcataactgttgagaagggtagatgttggtagctgctctgcaacaaactgatacaacctaacaccaaaccatgccaacctcagccaaagggcaaagagaagacgaggtagaaccccaacacctgggaagtatcttggcacaaaatcatcccgtggacggaggtactccacaagctactcacctgatcggaggggccgttacagttcccgctactcacctgatcggagggactgtcatggtagagaccggtcatactctccatatgacagaaggcgatcatactctccctacggcagggatggatcatattccccttactatggccggcgatcatactcaccttactacagcagacggtatcgttcaaggtccccatactgctacagaagacgcaggtcaccttctgtttcgccatactaccgccggcacaggtacagatctgtctccaagtcatccagttcatctccaagggccagaggacggagctattcgtgcagtttatcaccacagagaagctactcgcgcagccattccccagaatccgagagatcaacaagctattctcctaagaaagggagtaaaagggaaccctcgcgtagcagatactctggcaagagtcgtcattcaagggaaagccactctcatagccgcagttcgtactccaggtctgtgtccagggagcgctcagcttgatctgcgaggtgtgtcgtcctaggtggttataagatatgcgctgtatttgcatctatcagaacttgtgtacttcgtatattacgaacttgagaactgtatggatgtgtgcattgtgccaaattatgttcattctgtgctatctttctgatgctagtgtatgcaaggcgtacatacgaggtcataggtcgtcatagtattggat

SEQ ID NO: 10324 - DNA, 1241 bp, Zea mays
aattcggcacgagggtgccgtgacgcgatgtcgagacgcaagagaaggatcgagacgaggcggcggttttccgggggcagcatcggcgcggccacgaaagatgtcttactcaaggggctcaagtgaaaggtatggatctcgctcaccttactcgagaagcacaaggtaccgaagtcgctctaggagtgtcgactctagcgatgctgaaaaccctgggaacaacctgtatgtgactggtttgtcggctcgtgtaacggatcgagatctggagaagcacttctccactgagggtgaggtgattgatgcaagcgttgtatatgatccttggacaagggaatcacgggggtttggttttgttaccatggccgctgttaaagatgcagatcgctgcataaaatatctggaccgttctgtgttgcaagggcgggtcataactgttgagaaggcaaagagaagacgaggtagaaccccaacacctgggaagtatcttggcacaaaatcatcccgtggacggaggtactccacaagctactcacctgatcggaggggccgttacagttcccgctactcacctgatcggagggactgtcatggtagagaccggtcatactctccatatgacagaaggcgatcatactctccctacagcagggatggatcatactccccttactatggccggcgatcatactcaccttactacagcagacggtatcgttcaaggtccccatactgctacagaagacgtaggtcaccttctgtttcgccatactaccgccggcacaggtacagatctgtgtccaagtcatccagttcatctccaagggccagaggacggagctattcgtgcagtttatcaccacagagaagctactcgcgcagccattccccagaatccgagagatcaacaagctattctcctaagaaagggagtaaaagggaaccctcgcgtagcagatactctggcaagagtcgtcattcaagggaaagccactctcatagccgcagttcgtactccaggtctgtgtccagggagcgctcagcttgatctgcgaggtgtgtcgtcctaggtggttataagatatgcgctgtatttgcatctatcagaacttgtgtacttcgtatattacgaacttgagaactgtatggatgtgtgcattgtgccaaattatgttccttctgatgcataaaaaaaaaaaaaaaaaaaaaaaaaaaaaactcgagaggggggcccgtgtacc

SEQ ID NO: 10325 - DNA, 2402 bp, Zea mays
ctcttatgcttgctgaacgtccaaactgaaaaatacttgttctcgtattctgatatccttcaaaaattactagcaagaaaaaatatttcggccaataaaaggttatatagtggcccaatagaatagaaatagttaggcccagcccagatggccctaacccctcgcgtggcgggccgccacgacttctacgcctccaccacgaggcacgcaacaattagaacacatctcgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctccgccgccgccgcggatcccttccctgaagccttctcctccccgaccaaggcttctcaagatgccgctgaggccggagaggacaacctgagctcgatgtgggaggaagctggcgacgccgacgacatctttgcctcccccggcagcgccgacgccgtagccgacgatgaggaggtcgcccgcatctgcgccgccgtggagtccacccccgaggacgagatcgcctccaccctcgctgacatgaccgtggacttcaacgagccactcctagccgcagtcctccttgctgctgatcaatgctcctgtaagaagctgatttccctgttcaactatgccgcgaagaataaccccgcttccaagagcctctcgaatcttgaggttctcgtgagcaagctagctgattctgctgagatagacaaggcagacgcttacttgctttgggattcgattaaggaaataggctctgtgccaggatcagtgagtacaccgttgttgaatgaaatgattgccatattttggaagcttgagaagtcgaaagcagcgttggaggtgttctccaagttcgatgagtttggttgcactccggacagtgacagctattatcttgtgattgaagcagcacgaaagaagtccttgttccgctctgcttgtgaagtctgtgagaagatgattggctctgcctgcttccccaatggtgagaaggttggcaggattttgatttacctttgtgaggggaagaaggtgaagatggcacactcattataccttgcagtgaaggaaaaaaagattccagtcccaaaactagccttggatttccttgttggtgctttggcaaggaatgatgagaccattggtactgctctggagctgctggaagagtaccaaggggagtcgcttaagcatgcaggcaagtcctttgccacagttgtacatgctttgtgtaggctaagcaaaatggaggatgcaaataatttgttgatgaggatggtgcagcttgaagagtacaaaggggaatctcttaagaatgcaggcaagacatttgccacagttatacatggtttgtgtaggaaaaagaaattggaggatgcaaaagcattgttgatgagaatggtaaatgttgggccagctcctggtaatgcagtgtttaattttgtcatcacagcattgtcaaaacagggagaaatggaggatgcaaaaggtttgatgagaatgatggagagccaagggatcagccctgatatctatacttacagtgtgctcatgagtggctacgtgaaaggaggcatgattgatgaagcccatgatctacttcgtgaagctaagaaaattcatccgaagctaaacagggttgcttatcacatacttatccgtggatactgcaagatggaggacttcgagaaggccaatgagtgcctaaaggagatgaagaaagatgggttgcagccaaatgtggatgagtatgacaaactgattcagtcattgtgtctcaaggctatggactggagaagagctgagaaactcctggaggaaatggaggatagtggtttatgcctaaggggtataagtcgcagcctcataactgcagttaaggagttggaaggggaggaaatgcagtcaaaggcgagccaagaagcatagtttctctaggatactcgaatccatatgtctgctaattaacttttggatagagcctttctttttgagcttttcagctctggtgagcttgcaagaaacatcatctttgtacctgtgtttgtttgttgttatttactacaataattttgcatttatatttaaatgctagactgacaaagaagaatatttagttctggtctggacttctggagcttctgtttaggatttccatgcgccattctacatgtcgataatttattttcatgtcttatttaagaacacgaatgaattttggctgccagtggaattcaagttacgaaaatattctttcaaaaaaaaaaaaaaaaaagcggccctg

SEQ ID NO: 10326 - DNA, 2940 bp, Zea mays
tatatatatatatatatatatatataaacgatacccttctctctggaagggcaaacgatatggtatcgcctccttcctgcaggctgattctgagccttgctgctgtccggtgacgaaaaccacaggtaaccgctggggacttcgctgattctgagccttgcggctgtcacctagcgtttggaactaattagccttgtgctaatcgaggctttgccacgcttccgtcggacttcggctaagcgctcccacccaggacaagcgagacacgttctcttctgtctgtccgtttcctgttgttccagaccttggagatgcgtgtgcgccctgtcatgactcatgagtgcgttgctatttattactactacatgcatacagtgcacatacgtggccaactattcaagagatgttcgtcagagtaataaacagatagagataaagatacagatttttcttatcctccaattgcggacgcgcgcagtgtacgaggtgttcgagcggatggcgtactacggcatctcctccaacctggtcctgtacctgaccaagaagatgcaccagggcgtggtgccgtcggcgaacaacgtcaccaactgggtcggcaccatctggatgacgcccatcatcggcgcctatgtcgccgacgcgcacctcggccgctaccggaccttcatggtcgcctccgtcatctacctcagcgtgagtccgccgccgttcgcctccgtctctatccggagtgtccgcctatcctcatcttaataatcacaaaaaaaaagggcccacgccacagtgatctttatataggccgtcaatattgtgtcgtccgtcactcagggcatgatcctgctgacgctggcggtgtcgctgccggcgctgcggccgcccaagtgcggcgcgggaacggcggacccggactgcgtgcacaaggcgacgagcgagcagctgggcgtcttcttcctggccctgtacatcctcgccgtgggcacgggcggcaccaagcccaacatctccaccatcggcgccgaccagttcgacgacgcgcacccgcgggagcgcgcccacaagctctccttcttcaactggtggatgttcagcatcttcttcggcacgctcttcgccaacaccgtgctcgtctacatccaggacaccgtcggctgggccgtgggctacgcgctgcccacgctgggcctcgccgtctccatcgccgtcttcaccgccggcacgccattctaccgccacaagcccacctccgccgaaagccccttcgccaagatggccagggtcatcgtggcggccgccaggaagctggacgtccccgtgcccgtggacccgcgcgacctgcacgagctcgacgccgagcactacgccaagaggaacgtggccccgctcccgcacacgcccaacctcagcgtactcagcaaggcggcggtcaagaccggcgcggccacgtcgcggtggtcgctcagcaccgtcacgcaggtggaggagaccaagcagatgctcaagatgctccccgtgctggccatcacgttcgtgcccagcgccatgatggcgcagatcaacacgctgttcgtcaagcagggcaccacgctggaccgccacgtcggccgccacttcgagatcccgccggcgagcctccagggcttcgtcaccatctccatgctgctcgccgtcgtgctctacgaccgcgccttcatgccgttcgcgcgccgcgtcacggccaacccgcgcggcatctcgctgctgcagcgcatgagcgtcggcctcgtcatccacatcctcatcatggccatcgcgtcgctcacggagcgccaccgcctggcggtggcgcgcgaccacggcctctacgacagcaagggcaccacggtcccgctcaccatattcgtcctgctcccgcagttcgtgctcatgggcgtggccgacgccttccttgaggtggccaagatcgagttcttctacgaccaggcgcccgagggcatgaagagcctcggcacctcgtacgccatgaccagcctcggcatcggcaacttcctcagcagcgcgctgctctcagctgtgtcgcacatcaccaggcgccacggccggaccggctggatcctcaataacctcaacgcatcgcgcctggacaagtactacgccttcttcgccattctcaactgcgccaacctcgtcgccttcttcttcgtgtgccgcttctacgtgtacaacgccgaggtatcccacgtcgtcgacgccgggagcagtaagcagaagcgggaagtgcccatggcgatgcagccgccggccgtgggcgcagtggacgccaccctataggactagtgttccggtccattacaaatgtagttgtcatactcatacgtaccggtcatacatacgtgacgtgaaggatgaagcgccgcgtgtacagtgctgtaatctctacgtacatgcacctgcaatggatatgtgaaagtagtacgagcagctctgcagtgacggttaaaaagcgtttttttatcgttagtactatagcaagtggaaatcgacggttatgttagaacctcattggcggttttcttaaaaaacactatcagaatcttaactctttgctgagtgctcgacactttgccgatgttttttgtcgggcactcggcaaagctctatactcggtaatgaccgcgtttaccgagagcaggactctcggcacagactcggcgaacggcggcgctcgacaaagggttgtcagcagccgtctatagctgacggccgttatctttaccgagagccggactttggcactcggcaaataaacttctttgcctagtgtcctacgtctgactctcggcacagtgcagtttgccgagtgtcaccattggatactcggcaaagtatatttttatttttttatttttctagccaaacttttttggtttgtgcttacactatgtagacttatatgtacca

SEQ ID NO: 10327 - DNA, 2345 bp, Zea mays
  misc_feature (10)..(10): n is a, c, g, or t
  misc_feature (776)..(776): n is a, c, g, or t
  misc_feature (796)..(796): n is a, c, g, or t
gggcgagagnagcggaagcgacccagcagcgaagcgacgactagctctgcggcctctgcctgccccaagcgccgacgatgggtgccggtgctactgccagggacgaggaggctgctaccggccgccaccatgggaggaagccgcatggcgcggcggcggagtacgcgcaggacggggccggggacctgcgcggcaaccccgtgctccgctcccagcgcggcggctggaccgcctgctccttcatcgtcggtacgtagcgcgtgcgggcggtgtgccggtgtgtgtgtcgactgtcgactagctacttcctgtttcactcttgctcttgtcgttgcccgcccctcctcggtagagatggatgaaccgcgcgaatggacgatacggccgggcgcctgatgcggtgtgtggtgcatgcatgcagtgtacgagctgttcgagcggatggcctactacgggatctcgtccaacctcatcatctacctgaccgacaagctccaccagggcaccgtcgaggcctccaacaacgtcaccaactggtccggcaccgtcttcctcacgccgctgctcggcgcctacgtcgccgacgcctacctcggccgctactggaccttcgtcgtcggctccgccatttacctgctggggatggtgctgctggtgctgtccgtctcggtgccggcgctgaagccgccgccgtgcggcgccggcggcgtgtgcccgcaggcgtcggcgctgcagctcggggcgtacttcggcgggctctacatcgtggccctggngcaactgtgcggcaccaagncccaacatctccaccatcggggcggaccagttcgacgagttcgacccgcgggagcggacgcacaagctgtccttcttcaactggtggatgttcaccatcttcctgggcatcctcttctcctccaccgtcctcgtgtacctgcaggacaacgtgagctggtccgtgggctacggcatccccacgctgggcctcatggtctccatctccgtcttcctcgccggcaccaggctgtaccgccacagggtgccgcagggcagcccgttcacgagcatgggcagggtcctggccgccgcgctctggaagtggagcgtcccggtcccggccgacgccaaggagctgcacgagctggacgtcgaggagtacgccaggaagcgtaggttcaggatggactccaccgacgccatggccttcctcaacaaggccgccgccgtggccgtgcccagcggcgggccggcgtcgacgccggcgtggagcctctgcacggtgacccaggtggaggagacgaagcagatcctgaggctggtgcccctcctggtggccatgatcgtgccctgcacgctcatcgcgcagaccaacacgctgttcgtgaagcagggcacgacgatggaccggcacatgggcccgcgcttcgagatcccggcggcgagcctgggcgcgttcgtgacgctgaccatgctggtggctgtggtggtgtacgaccgggtgttcgtgagggccgtgcggcggtacaccaaggacccgcgcgggatcacgatcctgaggcggatgggcacgggcatgctgctgcaggtggcgaccatggcggtggcgtcggcgatcgagagccggaggctggcctacgcgcggagccacggcctggacgccacggggggccagctggggctcaccatcttcgcgctgctcccgcagttcgtgctgatgggcctggccgacgcgttcctggtggtgggcaagatcgagttcttctacgaccaggcgccggagagcatgaagagcctgggcaccgccatgtccctcaccgcgtacggcatcggcaacttcctcagcagcttcctgctgtccacggtcacgcgcgtcacgcgggaccgcggccacgcctgggtcaccaacaacctcaacgcctccaacctcgactactactacgccttcctcaccgcgctcggcgccgtcaacttcgtcgccttcctcgcgctcagcgccaggtacaggtacaaggcccagtccaccgacaggatcgacgctgccgtcggcctggggaccgagaaagccaagcttcaggcggagccactgggctgacgtcgacgacgacgacggggtgcgtctgcctctgctgttaaaagcggagaagatcagccatgaatgcgtatcgtccaaggcgacgtgtgtatgtgtagcatcaactcacttgtaaaaaaaaagcacaggatttccacccgaaaccaaaagcagtgtctgcagtatcaactcccttgtaaaaaaagacagtccatgatctttcatttcattcacacgcaaaaaagaagagtatagatcgatccctggctttctt

SEQ ID NO: 10328 - DNA, 2208 bp, Zea mays
ccgtgcgccgcccgccggccgggccgggcgggaccgacgggcgagagagcggaagcgacccagcagcgaagcgacgactagctctgcggcctctgcctgccccaagcgccgacgatgggtgccggtgctactgccagggacgaggaggctgctaccggccgccaccatgggaggaagccgcatggcgcggcggcggagtacgcgcaggacgggtccgtggacctgcgcggcaaccccgtgctccgctcccagcgcggcggctggaccgcctgctccttcatcgtcgtgtacgagctgttcgagcggatggcctactacgggatctcgtccaacctcatcatctacctgacggacaagctccaccagggcaccgtcgaggcctccaacaacgtcaccaactggtccggcaccgtcttcctcacgccgctgctcggcgcctacgtcgccgacgcctacctcggccgctactggaccttcgtcgtcggctccgccatttacctgctggggatggtgctgctggtgctgtccgtctcggtgccggcgctgaagccgccgccgtgcggcgccggcggcgtgtgcccgcaggcgtcggcgctgcagctcggggcgtacttcggcgggctctacatcgtggccctgggcaacggcggcaccaagcccaacatctccaccatcggggcggaccagttcgacgagttcgacccgcgggagcggacgcacaagctgtccttcttcaactggtggatgttcaccatcttcctgggcatcctcttctcctccaccgtcctcgtgtacctgcaggacaacgtgagctggtccgtgggctacggcatccccacgctgggcctcatggtctccatctccgtcttcctcgccggcaccaggctgtaccgccacagggtgccgcagggcagcccgttcacgagcatgggcagggtcctggccgccgcgctctggaagtggagcgtcccggtcccggccgacgccaaggagctgcacgagctggacgtcgaggagtacgcgaggaagcgtaagttcaggatggactccaccgacgccatggccttcctcaacaaggccgccgccgtgcccagcggcgggccggcggcgacgccggcgtggagcctctgcacggtgacccaggtggaggagacgaagcagatcctgaggctggtgcctctcctggtggccatgatcgtgccctgcacgctcatcgcgcagaccaacacgctgttcgtaaagcagggcacgacgatggaccggcacatgggcccacgcttcgagatcccagcggcgagcctgggcgcgttcgtgacgctgaccatgctggtggccgtggtggtgtacgaccgggtgttcgtgagggccgtgcggcggtacaccaaggacccgcgcgggatcacgatcctgaggcggatgggcacgggcatgctgctgcaggtggcgaccatggcggtggcgtcggcgatcgagagccggaggctggcctacgcgcggagccacggcctggacgccacggggggccagctggggctcaccatcttcgcgctgctcccgcagttcgtgctgatgggactggccgacgcgttcctggtggtgggcaagatcgagttcttctacgaccaggcgccggagagcatgaagagcctgggcaccgccatgtccctcaccgcgtacggcatcggcaacttcctcagcagcttcctgctgtccacggtcacgcgcgtcacgcgggaccgcggccacgcctgggtcaccaacaacctcaacgcctccaacctcgactactactacgccttcctcaccgcgctcggcgtcgtcaacttcgtcgccttcctcgcgctcagcgccaggtacaggtacaaggcccagtccaccgacacgatcgacgctgccgtcggcctggagaccgagaaagccaagcttcaggcggagccactgggctgacgtcgacgacgacgacggggtgcgtctgcctctgctgttaaaagcggagaagatcagccatgaatgcgtatcgtccaaggcgacgtgtgtagcatcaactcacttgtaaaaaaaagcacaggatttccacccgaaaccaaaagcagtgtctgcagtatcaactcccttgtaaaaaaaagacagtccatgatctttcatttcattcacacgcaaataaaaaagtatagatcgatcgaaaaaaaaaaaaaaaaaaggccccta

SEQ ID NO: 10329 - DNA, 1056 bp, Zea mays
cccgtccccaaggctccgccgctgccgcggccacgtgggtacgaggggagcacgcacagcgaccccggcgagctgcaccccaggccgcgccgccgcgataagggcgcccgcgccgccggcggcctcccgctctacgtcttcctgcgcgaaggctccgacggcgacggcaagaaggtggatccccgctgccccaacgcgcccaacccgttccacgtctgcaccgaccactgcctcgccaagatatccgaggccggccgctcgtcggagggagccaagtcgccgatctcgctcttctcccgccactcccgccgctcctcctcgtcctccgaagatggcagcgtgaagtccgcggggagcaagaaggtggatccaaggtgcccgaacgctggcaatctgttccatgaatgcggtgagcattgcgccgccaagatgcagcggtcggagcagcagcacaagggggtcaatctcaagtcaccgcgcaggaaagtggggaagaacgctacagcgatcccaaactggaaggttgatccgaggtgccctaacgcgtccaatccgttccacatgtgcgcccagtactgcttcgaccatctgagtgaaacagcgcagacaagtgcagcaaagtcagacaagagacgaggcaagggcgtttctgaagacgagggaagaggagaaaccaaaaccaaccctggttgcgccaacgcgtccaacccctaccacaagtgcggtgaccaatgcaagagaaagggtggtggtgataggtagaccgtagacgaggaaggcaggccggcaagacaggatctgtccggacggacgatcgacggcgggcgatgaagggaagaaagaaaaaacaaagctagttcccatcgaccgtccctgcgggctccgttctgtatgtagagtggtgtgcttccccgttttccattgtaatgcactatgtttctctgacgatgaaggttgcctgtacgagcagaagcctcctggaaagtttggtgccatcttgggcgcccttgctcccggttcgctttcacggaaatggagacatgttttggggttcca

SEQ ID NO: 10330 - DNA, 1609 bp, Zea mays
ggccggggtcgtctcctcgtcgcacaagtcatcaccgaccgcatccgcatctcgtcgtcctcaccatgccgatccggcgtcagcgctagggttagggtctcctctgcgcctttatcgccatggctcctaacgaagccgctagcatcaccaccccgtccgagccggagagcgtgggcggcagtgagatgagcagcgaagacatggccgccgccagtccgctcctctcgtcgtcctccccctccccttccccctccgcagccccggtgctggagagcatagaggaactggaccggaagtacgcaccgtacgcgcggcgggacgcgtacggaccgatggggctcggccccgtgagcgcagcggaggctgcgcggctggcgtttgccgcggtcgtgctggtcccgctccgtgtcgtggcaggtgttctcgtactcgtggtctactacctcgtgtgccgcgtgtgcacgctgcgggtggaggaggaccgggagggcggcgaaggggatgggtacgcgcggttggacgggtggaggcgggcgggggctgtgcggtgcggccgcgcactcgctcgcgccatgttgtttgtcttcgggttctattggatccgagagtacgacagccgccttcccaatgctgaggatggccatgtggaccagtctaaagaaatcgaaaggcctggggcaattgtgtctaatcatgtatcttatgtggatattctttatcacatgtcagcctcttttcctagttttgttgctaagagatcagtggctagattgcctctagttggtctcataagcaaatgtcttggatgcatttttgttcagcgggagtcgaaaacaccagatttcaaaggtgtttcaggtgctgtatctgaaagaatccatcgtgctcatcaacagaaaaatgcaccaatgatgctactcttccctgagggcacaactacaaatggggattatctccttccattcaaaacaggtgcttttcttgcaaaggcaccagttcaaccagtcattttgagatatccttacaaaagatttaatgcagcatgggattccatgtcaggggcacgtcatgtatttctgctgctctgtcaatttgtaaattacctagaggtggtccgcttaccagtttactatccttctgagcaagaaaaagatgatcctaagctctatgcaaacaatgtacggaaactgatggcagtggagggaaacttgattctttcagaccttgggctggcggagaagcgagtgtaccatgccgcactgaatggtaatagtctagctcgtgctttacatcagaaagatgattgaaatgccatgctatcgtgcttccataatactggcttgcttgtaactgtgtgcttgcttgtgcatcgtcatggttgagaggaatgtcgtgaatatactatccggcataaatctgtaaagtaatttaccaactgtcatagttcagtaattatgttggttatactcctacatggttgggcatccgcacatttgatcctgtggtcaatccatgtgagccttttttactaaaaaaaaaaaaaaaaaggccccatcgactgggccttccctgcaaaaaaaaaaaagtactctgcgttgttaccactgct

SEQ ID NO: 10331 - DNA, 936 bp, Zea mays
cgtcacatgcacgcgcgcgtgagctcggaattcggctcgaggccaggtcacttcttctttgcttctatgacccctgttggatatgggggtgctggtgaccaatgtgtggacttctcgatgcagtacagaaataacattcatccttactcgggtcctgaatttggttttctgccttcacagccagttcacaagacctcagtgaacttccatgcggtaccagtgacaccactgaccccgttgtgtagccgcggaatgccaggggcgacaaatcaagagaggcagcagagtcctgccctcttccctaaattaaaacaggcagtgctggtccctgagaccgtctgtgcaggagacaacaccttcaaacagaaaggcgatgacgtagacagcacacccttctccttgttccagttcaacctgccgattgcccctcccaccctggcaacatccaaagagcgaagtggggaactggcaccagctcagatagctcgagtccagccgtgctcgagggaggagaccaacgtcaaggaatacaacattttctctgggtgtgacggggtgatgtttcagctcaactagagacgaagaaaattgagcagctattcaatatacagcgttacatggtgagtgatttgtattctcgtaaaacagaataaggtagatcgaggtttttactgtgttgccctcgactattgattctcttttttctcattttgttttgctttgcttcccctcccagttttgtttttgtgtgtatggaaaactgaaaagatagtgagtggtatagattctgcagttttgtcactagatctagcgactttgccccttgatggttatgtggtataaacatggtttctccagagacggacggacagagataaaattaggttcgcgtcgtgttgtgattgggggcgggggggggggggggggggggggggg

SEQ ID NO: 10332 - DNA, 3123 bp, Zea mays
cctcgacgccggcccggggtaaagtacaaacagtcggtgtcgggcaaaaaaaccggttctcttcaacattttctccgagcagccaagcagcaccaagtagtaatgagtctcaggatgttctagacttgagatattcagatagcgaagaggaagacaatgttgtggtcagggaacactatcctgattcttcagctgatcaatcttcaagcaaggatactgatgaacgaagcaatgagcatgaatgcagtgcaacagcagaatttgttccctcagattgtgatggctcattcttatgtgatgagtctaattcatcaagaaacttgagatttagatgggacttcccagaaaaagatgtcagttattggtatgaagattgtcgtgttgattctggagatactcaattgcagtctagggagaggatcagaaataacactagaagttacaacactgtatttaatacaaataaccgaacaagagacaagtacaacccctgcagctgtggccatcaagaagacttcagatatttttccacagcaactagatcaagtagggagacaaagatttccaggaaaacagtggctgagaaacccaggttgcaataccgcaggtgctatcctccagaaagcttcgctgtgtcaaatggacgtgttggtggtacaccaaacaagaacacaggtccaaagcaagtatgggagccaatggatgcaagaaagaagatagggaatgggagaggatcagaaataacaccagaaactactggtgctgctgatggttcagatcaagtggaatgctcaaaggacattagtgaatgtgagaagcttgaggtagtgtgtgaaacacttgctgaaacttgttgtgagatatctgcagaagcctgtaagtcagatcaaccatgtagacaaggtgagaaaaatcagtctgcttgcagcgatggatctaaatgcgtagataagccaaattgctgcttgacaaaggacactgttaggacaacaaatttaaccagttcagacagcttttcgtgtctaagtgagggagatagagacagcagcatgagtagcatgacctcactgagtgctcagaatgtagaatcttcatctacatctgattcagatgagtattcagacaggaacgatagcagcccaggcgatccaccagtgaagaatgtttctcgttcattacttgagatgtgtgcaggaaatggtttcagggagtaccaaccgaaaggcttgaaccctcctaatggcaaccaatttggatttatggtggcacctttacaggaccagatgttgcaccaacagaagatccatgcaccgccgtactcgtcaccatttgtggggttccacaatcaccccttggcagttccaacaaatgggtacttgccatatcctcagccaggtcacttctaccctggccttatgacccctgttggatgtggagtcgctggcagccaatgcgttgactttccaatgcagtacagcaataacattcatccttactcgggccccgaatttggttttctgcctgcaaaaccagttcacaagaccccagtgagcttccatgctgtgccagtgccaccactggccccgctgtgtagaagcgaggtgccagtggtgataaatcaagagaggcagcagggctctgcaccccctaaattcaaacaggcagtgctggtccctgagaacggctgttcagcagaagacaacaccttcaaacagaaaggtgatgacacagacagcacacccttctccttgttccagttcaacctgcctattgcccctcccaccctggcaacatccaaagaagagcaaagtggagcgatgccgtcaatggcactgccaccagctcagataactcgagcccagctgtgctccagggaggagaccaatgtcaaggagtacaaccttttctctgggtgtaacggagtgatgtttcagctcaactagaggcgaagaaaagtgagcagctattcaatatacatacatggtgaacgatttgtattctagtaaaacagaataaagtaggtcgaggtttttactgtgttgccctcgaatatttatttcttttttaattttgatttgttgtgcttcccctccctgtttttttgtgtgtatggaaaactgaaaagacagtgagtggtatagattctgcagttttgacacaaaaatagtgtcactttttaccccccggatggttgtcatcttccaactaggctcgttcggtgtagctctgtcaattcattttggactgactgaatctgtagcagtttttcctacagatacagtaccaagccgtttgttttaattaagggtcctagacatctccggttgctcccccgttcagatctgattttttaaactacacaccatctccactaaatgtattcacgaagctctagatcgagggcagatccatggacttgatgcggcacctcaaagggtgtttcaaaaactcatggacctgtgaaattgctaacaattatctacttgtcacttgttacacaaaaataaaggttcacaagttctattagttttataatgtgcctgcccctccagttcttgaggaccttcgaatgaaggtagaatcactttataacttttggcacaatttcgttgcaactaacacacattctataccatttgcatcatcctcataacaacattacaaagaaaaatttgaagatcctcatatgaaggaggggtcgatttaattaagtattgccaaatgctttagaacgatttcacgagcatacaatgtgttcagcctctgtcaaacattttgggggcaaatgtttgtgtgtcgcctttgtcatgtgtgaaaaaaggaagatgttttttagccttcagctcaaaaaccataaattgtaatttcacacatcacaaaggcacgaagcatgttaataaacccaaactttttacatattacataaatggtaagtcaaatgttttttacaaatcacttctcctacataacttcataatagatgtcctcacaaatcttgagtacaattccatccacagttttctccacttgatcaatggtgtctatgggaatctttagctctaggtcgtcctctggacgatattctttaatctcctcctccaggagggcatattttcaaagaca

SEQ ID NO: 10333 - DNA, 2354 bp, Zea mays
agaacgagttcatgttgcttgcaaggaaataattacattggaaaaacagaccaagctacttgaggaagaagagaaagaaaaacgtgaagaagaagagcgcagggataggaggagaacaaaagaaagagaaaagaagaatagaagaaaagagaggctgaaaggaaaagacaaagataaagaaaaaatattggttcggtcaaaaaaaccaggtctttcaacattttctccgagcagccaagcagcaccaagtagtaatgagtctcaggatgttctagacttgagatattcagatagcgaagaggaagacaatgttgtggtcagggaacactatcctgattcttcagctgatcaatcttcaagcaaggatactgatgaacgaagcaatgagcatgaatgcagtgcaacagcagaatttgttccctcagattgtgatggctcattcttatgtgatgagtctaattcatcaagaaacttgagatttagatgggacttcccagaaaaagatgtcagttattggtatgaagattgtcgtgttgattctggagatactcaattgcagtctagggagaggatcagaaataacactagaagttacaacactgtatttaatacaaataaccgaacaagagacaagtacaacccctgcagctgtggccatcaagaagacttcagatatttttccacagcaactagatcaagtagggagacaaagatgcccaggaaaacagtggctgagaagcccaggttgcaataccgcaggtgctatcctccggatagctttgctgtgtcaaatggaggacgtgttggtggtacaccaaacaaaaacccaggtccaaaacaagtatgggagccaatggatgcaagaaagaagacagggaatgggaatagtgctactggggctgctgatggttcagatcaagtagaatgctcaaataatatcagtgaatgtgaaaagcttgaggcagtgtgtgactctcttgttgaaatttgttctgagatatctgcggaaacctgtaagtcagacacagatcaaccatggagacaaggtgagaagaatcagtctgcttgcagcgatgaatctaaatgcgtggataagccaaattgctccaaggacactggtaggacgacaaacttaaccacttcggatagctcctcgtgtctaagtgagggagatagagacagcagcatgacctcactgagtgttcagaatgtagaatcttcatctgcatctgattcagaagagtcttcagacaggaacaatagcagcccaggcgatataccagcgaagaatgtttctcgtacattacttgagatgtgtgcaggaaatggtttcagagagtaccaaccaaaaggcttgaaccctcctaatggtaaccaatttggatttatggtggccccttcacaggagcagatgttataccaacagaaggtccatgcaccgccgtactcgtcaccattcatggggttccacaatcaccccttggcagttccaacaaatgggtacttaccatatactcagccaggtcacttctaccctgcttctatgacccctgttggatatggagttgctggtgaccaatgtgtcgacttctcgatgcagtacagaaataacattcatccttactcgggtcctgaatttggttttctgccttcacagccagttcacaagacctcagtgaacttccatgcggtaccagtgacaccactgaccccgttgtgtagccgcggaatgccagtggcgacaaatcaagagaggcagcagagtcctgccctcttccctaaattaaaacaggcagtgctggtccctgagaccgtctgtgcaggagacaacaccttcaaacagaaaggcgatgacgtagacagcacacccttctccttgttccagttcaacctgccgattgcccctcccaccctggcaacatccaaagagcgaagtggggaactggcaccagctcagatagctcgagtccagccgtgctcgagggaggagaccaacgtcaaggaatacaacattttctctgggtgtgacggggtgatgtttcagctcaactagagacgaagaaaattgagcagctattcaatatacagcgttacatggtgagtgatttgtattctcgtaaaacagaataaggtagatcgaggtttttactgtgttgccctcgactattgattctcttttttctcattttgttttgctttgcttcccctcccagttttgtttttgtgtgtatggaaaactgaaaagatagtgagtggtatagattctgcagttttgtcactaaagaaaaaaaaaaaaaaaaaaaaaaaaaaaaaaaaaaaaaaaaaaaaactcgagagaaggcccgcgtacccaa

SEQ ID NO: 10334 - DNA, 1943 bp, Zea mays
accgagatgcaatgcaatgcaaacatcctccctcttctcctgctcctcacagacatcttatcctagctcccggtcgaaggccgtaggtaggattcccttctctattcctcgtccgcttcctcctccggcagccggacctagctagctagctttcttgccgttcgccgcccatggctaggaagtgctctagctgtgggaacaacggccacaactccaggacctgcggcgggcacagcaggaccacggcggccttcgagaacaacggcggcgccggcgtgaggctgttcggggtgcagctgcacgtggggtcctcgtcgcccgtagccgtagccatgaagaggtgcttcagcatggagtgcctgtcgtcgccgccgcccgccgcgccggcgtactacgcggccgctctcgccgccgccaacagcagctcgccgtcggcgtccgcgtcggcgtcctcgtcctcgtcgctcgtctcggtggaggaggcacaggcacccgagaagatggccagcgggtacctctccgacgggctcgtgggcagggcgcaggcggagaggaagaagggcgttccgtggacggaggacgagcaccggcggttcctggcgggcctggagaagctcgggaagggcgactggcgaggcatctcccggcacttcgtcacgacgcggacgccgacgcaggtggccagccacgcccagaagtacttcctccggcagagcagcctggcgcacaagaagcgcaggtccagcctcttcgacgtggtggagaacgctgctgagagggcgacgacgacgagctccagggagcgcccgaggctcacggtcacggatgcgataatcgcgaccgcctctgctgcagcacccggaacaacggcagcactcccggccctgtcgctcggcatccgacggccagcgaggcctgagtaccacgttgacgtcgcgctgcctccgagcagcctgtccatgcagctgccgcggtgctcggcggcaatgggtagcgcgtcggcgtcgccgtcgccgagcctggcgctggcgctggcggggccgaaacacaagcacccttcgccttcgtccctgacggcggcaaaggctagtagtagtggccaggcaccagacctggagctgaagatctcgaccggccggcagagcgagcaccaggtccagacgggctcgccgccgaggacgccctttctgggcaccatcagggtcacgtaaccggaatgacggcggcggcggttagtcgggaatgtcctgctggtagaagaagagcttggccgggccggggtgggaaaactgaaaaggaggagcttttggcagtggtgttggtgtgtgtgtgttgctgccagtggcagccgagacgacgatgccgttcgtttatcacgtgggtgtggtgttgtgcatcatcatcagaaagatggaaactttactttagtggcctaattagaacactaaaaactttactgtcctaatttagcatttgtttgtttcttgcaaataaagaacgccgttgccattcgctactctgccgtcatctctcgctcgacctcttcatgttgttgctgacacagacacagtggtcgatggttagagctccatgttcagctcagttgcttgtctatattattaataatattagtagtactaatgataatataaaagattggtttgcagttgcaggtggatagttacaaggatacggaacctgcaaccatccgtgtctgccaagtgccaagagctcctgtaatcctgttcctacacgatgcttgatgcgaaggcgaaatatcctctgcaactggcgcttgtaataattcgttgaacttgaacctttgttaggtacaggttcggtttccagcgacgaggatatctacggtcccaaagcaaagacacgtcgaacaggatctgcgtgctgccgttaatgctgtaaccgaccaggagcagcagtaacag

SEQ ID NO: 10335 - DNA, 1131 bp, Zea mays
  misc_feature (1)..(1): n is a, c, g, or t
nagtgcctgtcgtcgtcggcgtccgccgcgccggcgtactacgcggccgctctccgccgcgaccaacagcgcctcgccgtcggcctcctcctcctcgtcgctcgtctcggtggaggaggcccccgagaagatggcccacgggtacctctccgacgggctcatgggcagggcggcgcaggagaggaagaagggcgttccatggacggaggacgagcacaggcgattcctggcgggcctggagaagctcgggaagggcgactggcgaggcatctcccggcacttcgtgacgacgcggaccccgacgcaggtggccagccacgcccagaagtacttcctccggcagagcagcctgacgcacaagaagcgcaggtccagcctcttcgacgtggtggagaacgccgagagggcggcgacgagctccatcaagggcatggagcgcctgcggctcaaggacgccatcacgaccgcgaccgcgactggctccgcagaacccggaaccgggacgacggcacagctcccgccggccctgtcgctcggcgtcggcaggccaccagcgaggcccgaccacgccgcgctgcctccgagcagcctgctgtccctgcagctgccgcggtgctcggcgggaattggccgcacggcgccgagcctggccctggcgccgccgaaacacagccacccttcttcgtcgctgacggcggcaaaggctggtggcctggcgccggacctggagctgaagatctcgaccgcccggcagagcgagcaccagcagcaggtccagatggggccatcgctgccgccgccgccgccgccgccgcagaggacgccctttctggggaccatcagggtcacatgacatgaccggcaaagacggcggcggttagtagggaatatcctgctggtaggagaagagcttttgcccatctgaagctggagaaggttgcttcaaaagataggacggggtgggaaaactggaaagaaggaagcttttggcagcgtgtgcgtgtgtgtgtgttgctggcacctggcagtggcagccgagacgacgatggcgtcgtgtatcatgtgggtgttgtgtatatcatatcatcatcatccgaaagatggaaactttactggccaaaaaaaaaaaaa

SEQ ID NO: 10336 - DNA, 1374 bp, Zea mays
ggaaagggtaagaggggacccgcggcgcccgcccggggtgcacgacaaagagacgaagacagtgtggaggggaggcagggtagcccccgcggcgccgctccgctcgaaatccccaaaaaggcaagatcaaatcaaatcagatctctccacccccagcccatccatggcgatcgtgtacgccctggtcgcgcggggcacggtggtgctggccgagttcgccgccgtctcgggcaacgccggcgccgtggcccgtcggatcctcgagaagctgccgcccgacgccgagtccaggctgtgcttcgcgcaggaccggtacatcttccacgtcctccgatccgacgccgccggcatcaccttcctctgtatggccaacgacaccttcggaagaaggatcccctttctctacctggaggacatccaaatgaggttcatgaaaaactacggcagagtcgcccactctgcgctggcttacgccatgaacgatgagttctccagagtgctccatcagcaaatggagttcttctccagcaacccaagcgccgacacactcaaccgtctccgtggagaagtcagcgagatacacaccgtcatggtcgacaacatagagaaaattcttgacagaggcgatcgcatctcgctccttgtcgacaagacatccaccatgcaagacagcgcctttcacttccgcaagcaatccaagaggctccgtagagctctttggatgaagaatgccaagcttctagttgtgttgacagttgtcatagtagtgctgctctacttgatcatttctgctttctgtggaggcctttccttgtcatcatgcagatcatgagtaacacaccagatggctttgcccctcccttaaatggagggtagaacaccatggaatgatgcctgctgtgttgagcaccggagcttccggaggcaaaaaaaaaaaggagatcgatggataccactgtggtttccagtaactgggatcagattgtacagtggacgagtggagttggccgttgctgtttttgatgtcgccatggttgtgggtgaactcaattcttaaatcgtggtgtgcttagcatctttcttggcgtgtcaaactgtcgttgtgacttgtgagggatgggactagtgagttgggttttgtagagttacttggttatcaatgtgcagacatatatgtatgccgcgatgagtgttagtacatgcctactatggttatcggtgtacgaaagtgtcttagctgctgttgtttgagactgccatggatggatgtggttgtgttttgaaggaactgcccttgtggccatgtgatgaataaaagcacgtaaagcaaaaaaaaaaaaaaaaaaaaagaaaaaaaaaaaaaaaaaagcggcc

SEQ ID NO: 10337 - DNA, 2054 bp, Zea mays
ttttttttttttttgcaccagtccacccgaataattaagccaaaactgtaaccaaaatacagctaaattacattcgaagttcctcgcacataaaaaaaatgggaacaaattgaaggccactcacatttggacggagcgggggaaggaacagtaaaattttgcaagtacaagtctatgtgctgtgggaagctagcttgcctgtcatcctcatgtctatctcttcttctagaacacaaaacacaacctagcctatgcccccttgagtttgcgtgacggaggccgccggaatatgttaatgaggtcgtcgacaccccgtgtactgattactaggaaacagaagagaacgatcaggtaggaacccagcaccagaaggaacagcagatcaaaggtaacacttgcaacctggtacacatttagagtcgctttagttgtatcatagaaagtgaacatgccttcaagcgcatcactttgaacatgcacatcagacgtgtgctcggacagttcctttttcagcgctgctatgaagggatcattcttctgtagaaaaggtgcgactcgtggtgtccgtgacaaaagatccaaccaggaccggacgtagcgaggattgatggctaagctgctattctctgcaaaaacatcgatattcctccctctcaatccatagatgtgtctcgcaagactctcagaaactaatctgacagttcggattactgactcaacatctgtagattctctagtgtcatgaagaccaccagtgctttccaaaaattcaggaggggtagacatttctgaaagagtaagtgcggtcactctaaacctcgagaactgttcgtgttcccatgctactctaggatttgagacattaatcttcttgtgcttgattccaactgaaacacccatttctttagagacatccgaaaattcttcaaagatttgcttgatatagggattttctggaggctttgatacatgcatccagaggtcattgctccaggaaccaacactgttcaagcaaattgcatagtcaatgctctcgcgtacacgctgatcaaaacctctaagccacttgctagttccattgtaattgtagggtccaccagatgttaacccaaagagaatattgtacttgccccttgtcttaggatttgaatacagacgtgaaaatagtctcgcaatctctagaagagccacaactccacttccattgctgtcgcttcccacagaaagtgcaggtacagcaccgaaggtgtcatagtttgcaactatggcaatagtcggaagctgttcgctatcaccctctcctttaaatccaggtaaccatccctggatattagaaatggttggagatgacacttttctaggctctgctgaggatacgacaagtttgtaacctcctgttgttgcagaggctggttgacctgtggaggcaattttatggatatctgccagcaggttatcaagattgtcgtcatgcaaagcaaagtacactggatatggaacttgttcatgcagaagcaacttctccagctcagtcagtacacctttgaattgccccttgtcatccacactgtcattatttgtcgggagcagaatgagtaatccccccagatgttttttctccaccaggtactctctgaggaaagagagcgggaggtcaaggagcggcgcgacgagggcggagcgggagaggtctgcgccggcggggagcgggagcgcggcagcgtggtggttgaggaccgcggcgcgggagccgagcggagcgccggcgaggtcgtactggatgaggcggtagacgccgacggcggcggcggcggcgtcgccgagctcgacgcaggcgaggaggacgaaggcgacagtgaagacggaggagatggaagccagcagctcgccggatggagacatggctcccttggatggatggctggcggcgggatcaaggcttgcagatacgggagggagacgaggtgggagatgcagatgtcgccgctgcccagttgtggcgtggctgcaacgccaactgcagatcccatgggcttcacttctttggaaacccg

SEQ ID NO: 10338 - DNA, 906 bp, Zea mays
ctccacttccattgctgtcgcttcccagagaaagtgcaggtgcagcaccgaaggtgtcatagtttgcaactatggcaatagtcggaagctgttcactatcaccctctcctttcaatccaggtaaccatccctggatattagaaatggtcggagatgacacttttctaggctctgctgaggacaccacaagtttgtaacctcctgttgttgcagaggctggttggcctgaagaggcaattttatggatatctgccagcaggttaccaaaattgtcgtcatccaaagcaaagtacactggatatggaacttgttcgtgcacaagcaacttctccagctcagtcagtacacctttgacttgacccttgtcatccgcactatccttatcaccctggtttgtcgggagcaaaatgagcaatccccccagctgttttttctccaccaggtactctctgaggaaggagagcggaaggtcgaggagcggcgcgacgagggcggagcgggagaggtctgcgccggcagggagcgggagcaccgcggcgtggtgattgaggaccgcggcgcgggagccgagcggggcgccggcgaggtcgtactggatgaggcggtagacgctgacggcggcggcggcgtcgccgagctcgacgcaggcgaggaagacgaaggccacggcgagagcggaggagatggacgccagcagctcgccggagggagacatggctcccggctcccttagatggctggcggcgggatcgaggcagggcagatgcgggagggagacgaggtgggagatgcagatgcagatgtcgccgccgctgccctgccgcgcccgcacagcctggtttccggcccgccccccaggcgccccactttaataaacctgacccggccgcctcgagcgccgcacag

SEQ ID NO: 10339 - DNA, 815 bp, Zea mays
ttcaatccaggtaaccatccctgggatattagaaatggtcggagatgacacttttctaggctctgctggggacaccacaagtttgtaacctcctgttgttgcagaggctggttggcctgaagaggcaattttatggatatctgccagcaggttaccaaaattgtcgccatccaaagcaaagtacacttggatatggaacttgttcgtgcacaagcaacttctccagctcagtcagtacacctttgacttgacccttgtcatccgcactatccttatcaccctggtttgtcgggagcaaaatgagcaatccccccagctgttttttctccaccaggtactctctgaggaaggagagcggaaggtcgaggagcggcgcgacgagggcggagcgggagaggtctgcgccggcagggagcgggagcaccgcggcgtggtgattgaggaccgcggcgcgggagccgagcggggcgccggcgaggtcgtactggatgaggcggtagacgctgacggcggcggcggcgtcgccgagctcgacgcaggcgaggaagacgaaggccacggcgagagcggaggagatggacgccagcagctcgccggagggagacatggctcccggctcccttagatggctggcggcgggatcgaggcagggcagatgcgggagggagacgaggtgggagatgcagatgcagatgtcgccgccgctgccctgccgcgcccgcacagcctgggttgcagcccctgcccgatacgattgattttaattaaactccccccgaccccattctctctcccccaattaccaaaactgtatc

SEQ ID NO: 10340 - DNA, 1315 bp, Zea mays
gcacgagaccattacctagaacatcctaatcgaaaagattcccccaatcccgcacccgcacacccaactcgcaatccctagcactagcaccgccgcggcggcaggcaggcagggggggggggggggtgggggtgccggaggccgctcgtagcacggaacgtctccggatcgatccatggagcgcgcgaggagggcttcgcacgccggctcttggtacaccaacgatgccaggaagctggaagaggaactcaatggttggctgggggcagccggtctaaccaagtctcctgatgttagggcagtaattgcaccccacgctggttattcatactcgggccgatgtgcagcttatgcttttggcaacatcgatccaactaacatttctcgggtgtttctgcttggcccttctcatcactactacactccaaaatgtgctttaaccagggcttctgtctactgtaccccaatcggggatttgccagtagaccaggaagtcattgaggaactcagtgctactggaaagtttgaatttatggaccttaatgtggatgaagctgaacatagcatggaaatgcatttgccctaccttgctaaagtatttcaaggacataatgtgaaagtcgtccctatccttgttggtgcacttagctcccaaaacgaagccttgtatgggcagctgctctccaaatatgtggatgacccaaaaaacttcttttccgtgtcgtcagacttctgccattggggatccaggtttagctacacatactacgaaaagaagcacggtgccatccataaatctatcgaggccttggaccgtatgggcatggagatcatagagactggcgatcccgtagcgttcaaagaatacctgcaagagtacgagaacaccatatgcggacgccaccccatcagcgtcttccttcacatgttgaaacattgctcgacaaaaattaagataggctttgtccgctacgagcagtccagccagtgcaagaacatgagggatagcagcgtgagctatgcatccgcagcagcgaaggttgctggtgcatccggggaagaagataaacaagactgagcgagctacagctctgtttgatatactatatataagccgccaaaccttggtgcggaacgtgtgactggtttcccataagaaaaagaacatgtgatttggtaaaacattttcttcttcagtaaaaataaataaatatgcagactgctggggatctgtactaattaattaagagattttcctaaaaaaaaaaaaaaaaaaaaaaaaaaaaaaaaaaaaaaaaaaaaaaaaaaaaaaaaa

SEQ ID NO: 10341 - DNA, 1223 bp, Zea mays
ggccggccaggagcctgcgggctccccgttgcagctagctgctcgccacaactggcgcgcctcactcaccgcgccagttacgccacgctcgggctcgatcggcatcgattcccccaatcccgcacccgcacccgcacaccaactcgcaatccctagcactagcagcgccgcggcggcaggcaggcagggggggttgccggaggccgctcgtagcacggaaggtctccggatcgatccatggagcgcgcgaggagggcttcgcacgccggctcttggtacaccaacgatgccaggaagctggaagaggaactcaatggttggctgggggcagccggtctaactaagtctcctgatgttagggcagtaattgcaccccacgctggttattcatactcgggccgatgtgcagcttatgcttttggcaacatcgatccaactaacatttctcgggtgtttctgcttggcccttctcatcactactacactccaaaatgtgctttaaccagggcttctgtttactgtaccccaattggggatttgccagtagaccaggaagtcatcgaggaactcagtgctactggaaagtttgaatttatggaccttaatgtggatgaagctgaacatagcatggaaatgcatttgccctaccttgctaaagtatttcaaggacataatgtgaaagtcgtccctatccttgtcggtgcacttagctcccaaaacgaagccttgtatggacagctgctctccaaatatgtggatgacccaaaaaacttcttttccgtgtcgtcggacttctgccattggggatccaggtttagctacacatactacgaaaagaagcacggtgccatccataaatctatcgaggccttggaccgtatgggcatggagatcatagagactggcgatcccgtagcgttcaaagaatacctgcaggagtacgagaacaccatatgcggacgccaccccatcagcgtcttccttcacatgttgaaacattgctcgacaaaaattaagataggctttgtccgctacgagcagtccagccagtgcaagaacatgagggatagcagcgtgagctatgcatccgcggcagcgaaggttgctggtgcatccggggaagaagataaacaagactgagcgagctacagctctgtttgatatgctagccttgagcccagccaactcttggtgcggatcgtgtgtttggtttccgcataagc

SEQ ID NO: 10342 - DNA, 1004 bp, Zea mays
gattgcgggctgcgcgcgaagcagaagcaccggccgggtgaccgccgccgccggccgtttcgattcatttgcgggccgctgcgcgtccctcatacctcaccgccggcgccgcgccgcgccgtcctctcacctatcgccacgcgcgctcccgcccgccccttcgacctccttctactgcctcgcggcgttgcttcccgatgtcgttccgaggtcgtggaagagggggccgagggcgagggagaggtgggggcttcgggtacgaccacccggccaagcacgtgccacacgaggactttccggacatcgctctgcctgagatgaagtgcgccaaggcgagcaacgaggagaaagcgctgattgtgtccaccttgaaactcgaggagttctggaggagttcctgctactacctggaggaggatgctcccaagaaaaagaatgaagacaaagagattgaaagattttctgataggaaacgtaagacacaaagcaaacgtgaaggtcttgcgtcatatctcaaactagctccttcaaatttccctgctgaactggtgcaaggatctagaagagggcaagcaaccaacaagaaactccggtgggataaggagtcagatgagcaggcatttgaagcatttgagaagcttgaacaaaagcacaaggatggaagcaaggtggagaaggaaggtgatgacgaggatgagcaagaagaggaagtacaagaggaggaggaaaattcagacgatgactataaccaaaatatcgagtttgatgacgatgatgatgactggaaccaagaggatgaagcacaggaagacttctacgattaattgtggatgaacatatttttctcctttttcccctctccttttcacttgtgacttcacccagcaaaattattagagagcaatctttattctggtatttctagtcacgatggtcacatgctttgttagaaactcaggaatatcagaacagtgaaatacgacgttgcaaaaaaaaaaaaaaaa

SEQ ID NO: 10343 - DNA, 1771 bp, Zea mays
tctacctgcaggaagttagtggagagggcaaataagataaaaatcctactttagtcccttttagtcacccccttggcgactaaagaagtaagtcaccccattttagtcaccatgtttacttctttagggactaaaagtaactaaacttcggtcactaaactttagtcaccccaaaccaaacggtgcctcaatgtacacaattttgttcggatctctttctataaaccaccaactatataatacattttccaatttgatatttcctctggtaaaacactattctataatcaagccactgtatgttgtccagactccaagacgaacatgaactctgaatatagagactaaaatttattcaaaaattaaacttttatacttatacatatcctaatacaaatgataaaatgtgaatttagcaccatggcggcagcgcgcaggtgcgatggcaccatgctttgttcattataatcatgtccttgtttacagaagataaacctagagaagcaacatttgggacataatgcaatccattggcgattgtacagaaaacacacccaggacaacgatgtgctatgtgacgagaaatgtatcttccacatggaattgctttatgccctgtgagaaatagcaccggccaccgggctccatacttccattatattcttgcaaaatactctagcaaaacattggacatcactgctttcaaaaaacagtaatacagcacctactgaaaagccaattcaagtacctacttcagttagaaatgattcaaaatatctgctattcagcaccacatggttaactcgctcttcagaactaaaatatattctacaccagctctttccacttgaatgacacacggtagatccaccagctgcccagcattccaatgagatgcagcaccctcccatctactaattcaatggttccaattgaaaaaaacttgtaatcttcagtaataatatttcttgtacgcatgtactcctccttcgacacagcatggttttgatccacctccctatgacgaagctcctgaagaaacaaatatattgaatagcagcttggccttgagcagtagaggagaagcaaaatatttagggtgagacttaatgggctgtgtaacccagacataatcagaaaaatcaatccaactggcagctgaagtttcctgaccaaaggccaaaatgaaccaagcttggttttcaaagacccctggggtggtccagctatggcttttgatggttgctcttttgtggcagcagtaacctgtccctgatgaagcgtcatcgctagcatggtgcttgttccaaatcccttgatcagattgaggcctgacaactgcggccggagaccaagggccactctcgcggcgaacgaagggccgagccccgcagcgctaggctggagctcgggaaagcggggcttgaatagcgcgccaggaagtggcgaatggggctgccggcgactggtgcgccggaggagcaggaggacgcagcggcggaggaagaggagaagaaggcgggcgtggaggccgtggtctcggtggcggcgccccgccggagcgaggccgcgacggcgtccctcgccagccgccgacacgccatcatcgtgcgtggcctttctcgagtagcttcttgccgtatttcgtcttcccgcgcgcgcaggcgcagcggaagaggatgttgagcggcttcgcttcgtggagtcggactatcggagacggagacggagacgaggaggtcgcgttgggttctgggttagcaaaatcggt

SEQ ID NO: 10344 - DNA, 3423 bp, Zea mays
gccacaactggcgcgccgcactcaccgcgccagtacgccacgctcgggctcgatcggcatcgattcccccagtcccgcacccgcacacccggctcgcaatccctagcactagcaccgccgcagcggcaggcaggcagggaagggggggtgccggaggccgctcgtagcacggaaggtctccggatcgatccatggagcgcgcgaggagggcttcgcacgccggctcttggtacaccaacgatgccaggaagctggaagaggaactcaatggttggctgggggcagccggtctaactaagtctcctgatgttagggcagtaattgcaccccatgctgggtattcatactcgggccgatgtgcagcttatgcttttggcaacatcgatccaactaacatttctcgggtgtttctgcttggcccttctcatcactactacactccaaaatgtgctttaaccagggcttctgtctactgtaccccaatcggggatttgccagtagaccaggaaggtgagtgtttactcaatttggatggttgaatgtttttagcctagttctgtattatgtactctactgtcaagggttttgggattcaaggtagctggacctcggctacagagttcgtagtctcagacaataatggtgtgggaatttccccccggacaccctatggtgaagggggtgagattaggaagaagggagattggggaaatgaatctgttattgcttaatccttaaatgttcccatacatcatgtgtaagtttgaatctgtatatttgtttttgttggaatataatataagtgaattgtccatatcttcttatcagtttaagctttttggattgaactggttgatgcatgcaacttaatatgttactagccagttgaccgtgctttgctacgttggtatatagcatataaataggtattgaaatatttattcaaatataattattatttatttctaaacattaagatacgttggtctggtggttaggcccaaatttctggagcagggggtgcgggttcgagtgctcgttctacactattttttgctcggtgtgatagctgcgcgtgtggggtcggttgctgggcagatgcagtagctggttgcacgggtgttggggggtccccacagggcagtagttgagagagcgttgcgagggcaatgggcgtggggcccacagggcacggcgccgaggcggggtgcgtggggctatgttttctggtcgctcgaccagctagtcgaactgggggaccgaccagcgactaatctcgattagtcgtcgactaggtccgactaatcgagctctggtcgacctggtcgtttactggtcgtcctgttcatccaggagaccaggacctatgtatatactatataatatatactattatactatatagtaaataattatataactatatagtatatatgagcttcatatactatattatgaaggatatggtaaacatgacatgaattcagcaatactgaaaagtgaaaacagcagagaaacacttctagttattaatactacaagtcccagataccagtaccacacaacacacattaatactacaagtccaaaaaaaatctaggtcctaaacctagtcgcccagaaccggctaatcgagcgactaatcggccctaatcgtcgactagtcggacgaccagggcgaccaggtactctagtcgagttggctgcctaatcgagctctgctaaccgactagcctgactaatcgcgactaatcgcgattagtcggacgacttgaaaacacaggcgtggggcgggagaaccagtcgggacgtgtgggcgggcccagagtgtcagcgcggagggtgaagccgtggtagcaccagatgcccacattagggttttaaaagagtagtatagatcaaagccagatgtctcgagttcgaatcttggttagtgcaaataaataaaattattgttgctcggttctattccacatctgagagccaagagagctggaatataatatcagtgaattgtccacctctttctatcaacttaagcttttgggttgaactggttggtacatgcaaacttaatagttttgtaccggtacgtattgatatctggttctaatacggatgcaatatgttcagtattagagggatgcaaaactacattgtctgcataatctgggatgcaccactgtaagtacagatactagtcaggttaatttgcattctgagacatttctagatctttatctgtggccagtaggtgtcgcctgagcttgtgacaacccggaatatcttgtttagtccgctctgttgattgagcttggcatgatgagttttccttcaattgaggccgttcctcccctttctgaatattgtagtgttccctccatccttaattacatgttgttttggcttttctatatacctagtttttgctatcgacctagatatacgatatgtctagatatttagtaaaaactatgtatctagaaaagctaaaatgatgtacaatttggaacagagggagtacattattattatagttattttccagatactgaggaacccaagctgcatgaaaggttgaatttaatatatttccatctaccccaattggggatttgccagtagaccaggaagtcatcgaggaactcagtgctactggaaagtttgaatttatggaccttaatgtggatgaagctgaacatagcatggaaatgcatttgccctaccttgctaaagtatttcaaggacataatgtgaaagtcgtccctatccttgttggtgcacttagctcccaaaacgaagccttgtatgggcagctgctctccaaatatgtggatgacccaaaaaacttcttttccgtgtcgtcagacttctgccattggggatccaggtttagctacacatactacgaaaagaagcacggtgccatccataaatctatcgaggccttggaccgtatgggcatggagatcatagagactggcgatcccgtagcgttcaaagaatacctgcaggagtacgagaacaccatatgcggacgccaccccatcagcgtcttccttcacatgttgaaacattgctcgacaaaaattaagataggctttgtccgctacgagcagtccagccagtgcaagaacatgagggatagcagcgtgagctatgcatccgcagcagcgaaggttgctggtgcatccggggaagaagataaacaagactgagcgagctacagctctgtttgatatactatatataagccgccaaaccttggtgcggaatgtgtgactggtttcccataagaaaaagaacatgtgatttggtaaaacattttcttcttcagtaaaataaataaatatgcagactgctggggatctgtactaattaattaagagattttcctaaaaaaaaagaaaaaaaattgcggcc

SEQ ID NO: 10345 - DNA, 1235 bp, Zea mays
  misc_feature (1089)..(1089): n is a, c, g, or t
gggtacctcgaggccggccgggacccccgggctgcccgtaaatgcggacacaggcgtgggggcgcggggcggtggcgcgcttgatgacgccattcaatcgccgcgcggcccacgcctcttctccccacctgctccgcgcctgctcatccgcctcttataccatcgctctcgctcgcctccgacgccacttcacctcttctgcttccttctccccagcatacagtgccagacaggatacccacacattcatggaggtggttcaagaagtccttaggcatggctcagcagatagtgtccgtgctgtcataagagctaacaaaaagagctacagccttgtccagctcattgcagcctcttttgatgtctacaacattttgtgcagcaaaaatatgacaccaaatgggatgcaagattcttcttccaaaggaagaaatggaacaggattccttcatggagctcgtgttggcattgtggctaaaccctctcctgaatttgttgctggggtatttggaacctggctttctggtggagttgcagtaccccttgcccttagctatccagaagctgagcttcttcatgtcatgaatgactcagatatttcaatggttttaagcaccaaggagcatcacgaaatcatggagaacctttctatcaagtgttctgcttattgttctattcttccatctgtcactagtataccttcagaaatcaatcctcaagaaccttcaagcaatgaggcgatttcatcagtctctactttaataactgagaccaacagttcaaagaaaatcaaaggcgatgaccctgctcttatcctttacacaagtggcacaactggtaaacctaaaggagtagttcacacccatgagggcattctttctcaggttcagattctatctgaagcgtggggatatcgaagtgaagaccaatttctgcactgtctcccgctgcaccatgtgcatgggcttttcaatgctctatttgcgcccctttattcaggatcagtggttgagtttataccaaaattcagtgtaagcgggatatggcagagatggcgagaatcatatcccaacgatgcgagtaaaagtncagaggccattacagtatttactggagttccaaccatgtatacacgtctgctgcaagggtatgatagtatggatcctgatcaaaagtcggcctcttcttacgctgcaaagcatctgaggttaatgatgtgtggatcatcagctctt

SEQ ID NO: 10346 - DNA, 874 bp, Zea mays
gccggccgtccgagtactgtacaacatccgatccgaaacctagcaacacccccggacagacgggcgcgaactcaaaccctagaaacggtagccatggattcgggaggcggaggagggagcggcgcgcacaaggcggcctcgggctccgcgccctcgccggcgcctaaccccacggcgatgctttcggcgctcatgagcaagcgcgccaagctccaggaggagctccgctccatcgagcgccaggtttatgatatggagaccacctacctacaggagactaatcaatttggaagtgtgctgaagggtttcgaatcttttttgtcatcctcaaaaaacacctctaaccttaagcgctctcggaaatttcaggctgacgagaggttattctccctgtcatccgttacttctccagcggttgatgaacatttggctggacgagatgatggaagagagtatggagcaggtcgttctaagggtggaagcacccctgcgaacgggcaaggcaaaccgaagaagggagggcgccctggcgggcgagacggcaagagactacggccgtcgaatgacccagacctggacgacgaagatgactactaactcctccatcatgtaggcctactgtagcgggttaacttcaatttagcgtctagcagcacatgattctttacgaattgcttcccttctcgtttgttttgcttggttgcatcttcgcttccttccccaactcttccgatttgtaatataacataggtcaatgaaaattagccagattgttaaaattttgtgcaaaaagcggcctcagacgggccccttttctggatttccgagtaaaaatatcttcgttacatccttaaaaaaaaaaaaaaaaaaaaaa

SEQ ID NO: 10347 - DNA, 810 bp, Zea mays
gccggccggggccctgcactgcaaatcctcggtggttttgcagcttccagagcttgagaccagcgcggtagttctttcttggtcgatggcgctgaggaggatcatcaaggagctcaaggacctgcagagggatccacccacgtcctgcagcgcagggcctgtgtccgacgacatgttccactggcaagcgacgatcatggggcccagcgacagcccctactcggggggcgtgttcctggtcgccatccacttccctccggactacccgttcaagcctcccaaggtggcgttcaagacgaaggtgttccaccccaacatcaacagcaacggcagcatctgcctggacatcctcaaggagcagtggagccccgcgctgacggtctccaaggtgctgctctccgtctgctccctgctcaccgaccccaacccggacgacccgctcgtcccggagatcgcccacatgtgcaagaccgaccgcctcaggtacgagtccaccgccaggggatggacgcacaagtacgccatgggataacctgatgtgagccgtaacaacaacgacgctttggccgagtggttaaggcgtgtgcctgctaagtacatggggtttccccgcgagagttcgaatctctcaggcgtcgtctttttttttcctttttttttctattttgcctacccacatggacacatggttcccttcttcacaagctctggtactgtaacattcagaaatgcaaatggttatcatatcgtgagaattctccggttaaaacataagtgcaagctgtaacccaagggaatcgctgctgtatt

SEQ ID NO: 10348 - DNA, 2728 bp, Zea mays
ggtggccgttctcgctctcgcgtcaaccagcatgaatatggatagcgatggagagcatgcatggcgatgggcgatggcgagataagagacaaactggcgccactattaggctagccgcagtcgtgtactggaaccggagttgtaaaggatagcgttggatatacagtgcaaaaaacaatgcagcggcgtactggaaacatactccacgcggcgcagtaggccagcaaaaaactgtactctgcgagtagtacggacatctacgctatcagcacaaaccgcacacgtgtcggcgcctcgatagttggatgggtagtgggaataaaaaagtgtgggaaaaaataatagaatatgtgatagttggtatagggtagatatttagggtgaatatgaacgcgaagtattatagaatagagtagagaatcttgctgattaggatgaaatatttcttttagagtagaaatttagggtttcacgagtgcggatagccttagctccctcgagtggcatattccggcatatcccgatccgtggtctcgatcggccgccgtgttggccctgacagacaggttaatggcacgacgcgacgccggggctgctgtttcctgtaagacgacaaggacgcagggtactacgtggtggctcatcatgcatggagtccttccgatccgatccaaatctacgaaaccatacagggctgggccggtttctgcccgctgatagaaatcccgtcatcacagtaatcttacctgactgggcctgcatcgtcgtatactcgcactccacgtttttcctcgaaaacaattcgctcaaactaaacagaccagtagtgctcatcagccggttacattacatgaaggcattttcatagattaccggctgagataggtttgtttgtgatggttgatatgcaatcccagccaagaacacacggcgtgacgtgctgtggtctgtggagaacctgcagcttccactgctctcgcttgttcaggtcgttgtggatgagattgaggaatgttgcgtagcgaagcgaacatatctcacttcaatgcatgccgagctcaggatcaggagagggaatttttatcaagtcatgtaacgtcgttttggagccctcgccagtcgccaggacggcataatctccacgagaaaccaaaggaaaagaaaagaaactgtctggtgggaactgaaggacggcataatttctttacccaatcgcaatcggcccaccgagcatgagggggggcgacttcctcgaattttccttctcttctctgaccgactgatcttagcgatcttctccctcgaatcttagcgtagcggtagcgccgatcctgttcctgtgccgtgccggcttggattggaaaataggagggagaagatcaacgccgccgcggtgcggcctgtggagtattaaacaaagatgcgcagagcccggctgcgccggcagctagcagccaacgcgaaacttcagcttccgctccgccgtccccctcccggacccaaacaaacaaaccatcgtcacccaatagccaccggccaactgtcaagcactccttcggtgcttccccatctgcgccccccgatccctccggacccgcgagcgaggccgtcgccggcgcgcgcgagatttgagctgaggccatggagtcaccgttccgggccgacgtggtcaaggacaaggcggcgctggtcaccggcgggggatccggcatctgctttgagatcgccgcccagctcgcgcgccacggcgcgcaggtcgccatcatgggccgccgccgggaggtcctcgacaaggccgtcgccgcgctccggtcccagggcctccgggctgttggtttcgatggagatgtccgcaaccaggaggacgcggccagagtgcttgctgcaacagttgcacattttggcaagctcgacattcttgtgaacggtgcagctggcaacttccttgcttccccggaggatttgacgcccaagggattcagaactgttcttgagatcgacactttgggtacatacacaatgtgctatgaagccctcaagtatctgaaaaagggtgggccaggaaaaggcccgtccactggtggactaatcattaacataagtgcaacactgcattacagtgcttcttggtaccaaatccatgtctctgctgctaaggctggggttgatagcatcacaagatcactggctctggagtggggaacagattatgacattagagtcaacgggattgcacctggaccaattcaagacaccccggggctgaggaagcttgcacctgaagaaatgagcaaggggcttcgagaaatgatgccattgttcaaatttggggagaagcgggacatagcaatggctgcgctctaccttgcttctgatgcaggcaaatatgtaaatgggacaacactggtggtcgatggaggtctttggttaagtcaccctcgccatattcccaaggaggaagttagggagctgtcgaaggtggttgagaagaaggttagggcctctggtgttggtgtaacatctagcaaattgtgatttgcatttgtgtgatctgtagcatcgatcaatatgttattacagaactttattgtctgtgtggctcttgcaatctaattagcgagtttgtttagttgagtaacttggcatatttacagtacatttctttcttctaagttccatttgagacagttttgattgatatgtgatgccagccaagatgtttgtcgcc

SEQ ID NO: 10349 - DNA, 1259 bp, Zea mays
acaccaacccgttctgcctccgcttcgatcatggggtggtcgcgctttcgtcgccgccatcaacggtgtcgctatctcctccctatccggcgtccgcgatgctcgccacccctcctcccccacgcgtcggacgctcgccatgctcgcctccctcccctccggtccgcctcgctccccttccgcccttccgtcgcgtgcgcttggaaaaaggtccagcagccccaaactccccagcggggccatctcgcccacctctccctgcacgccggatccccgccgtccccaccatcgcctgtgttgggtccgacccagtccgctcatgcctcgacgcgcagttctcgcacaccgtccgcggcggcgtccgcctcgcgccggtctcgcacaccgtcccgcagcggatccaatcacgcctcctcaccctccgctgcctcctcccatcccctctcccatcgaatccgcgattccgcgtccacagtggataccgtgagctcgcccccgcctccatggctccatcctccgctcgcgattcccccgtgcccgttggaagggggtcacggatcctcacacggttcctgctgcactacctccgcgctgtcacgcgcaggccgccgacgcttgagcgggagggcaccccgctcgccggcctcgcagacacggccgtccacggcgtggcgctcgtcgggggcacgacgttctcgtgccggggcctcttctgggtgctccggatcgggtcggcggtgtgcctgagcagggagtggcagcacaagctagagcggctcatggggctgatgctggaccaggccacactcgacgacctcctcgtaagaccctaaggagggcgtccacaccatgcccccgccttcccgcgatgctatccgcccgagccctgctattctcgcggcagggaagatgtccccccggctctgctccaagcacgacactgtaacactataaaaaccatcaaataaaaataatacatttagttattaatggtaataatttttcttttaattgtttgttatttatttacatttggaatgctttttgattgctcataattgattttggatgttgaataacatttcttcttaaatggaaatccaaataaataatataattattagtccaaaaataaatattttatttataaataattttagtataattattatgaattttagggttatttaaaaacatattttgaatttagaaaaggaaatagaaaaaaagaaaaaacgtaacctaaaccctaaccctaa

SEQ ID NO: 10350 - DNA, 5512 bp, Zea mays
  misc_feature (3881)..(3881): n is a, c, g, or t
ccctcctgtatcctatcccgcactctgggtttctttaaagcaataagcaataaaatattgtaggaccccctatagtaacttttacttcaacaacaacaacaacaacaacaacaacaacaacaacaacaacaacaataataataataataataataataataataataataataataataataataataataataataataataataataataataataataataataataaaaaattaaaccgcacatgcatgcatgccatgacatcgccgtggttgcgtgggccctacggttgtggggctgaagtacgagaggatccggtctggaggcattttagcgccgggaatatccgtcgccaggagaatatccgctcgctatattctctctatcattactagccgccatcgaaatctgccggatggccagaacccagtgcgtgcggtcaccaaccggagggaacaaggagcagtcgtcgatcgcctctcctttgcagttgcggctttgcttgatcgcctcacgccaagcaagcaccgactgcctcaaattaaggttcgtacaacagcagaggtttgcagagctagtggtgatggtggtgtaaaaaaaaagtctgacaaccttaacacaagaagaagaccacggtaaattaaagtaacagatagtcaaaataaaacaatcgtgggtgtgactgtgacctcaccgggaccagaagaggtaaaagggaaacaaacccgccggccaggcaaaaggctcttgccgattttctcttctctttccctccctataagacccgagactcctcggaagccacggcccagaaagctggcctcctccgcctttctttccttcctccctcggggctccgcgcgcgcagcagccaggaacagctccgctgcctgctcccttggggaaaaaaaacttcaagaacagcggcggtcggctcttctccaatcctgcttcaaggttcgcgcgcgtcccgtgttctgccacttcaaggctatacgatatttaggttgttttatctacagataagtagttatcgcaaaaactatatatggatatttgggtggctcttatcggatggggagtaatgtctacttttttttttggcggaggcctattttttaggtgttcgcgcgcgtacgcttatgctgatgtcaagggctgtggaatttgactaataaatcgatatgtttagaactgttctgcaacaattataatagtttagagctcattgtcggtgccataatcctgtggatggtttctgatgccggctctatttgaccctttttcaggctgcaccgaccggctctatttgagctatatctctgcaggaaagctcagttcagatccattcacttcactcatgggctcatcctcgggccatcagagaagcaaaacgcgcagcaggaacaggaagcccttgggaattcagctcttggagcgggtccgtggcagccccatctccttcagatcatgccaggctctcgtgctagtgctcacgttcctatcctacgccagctaccacgccaccaggaaaaccacgagcgtcgtcaagagcgtcctcgacccaaagacgaagacgaacctaggcacgtcgtcggcgcattactggccccccagccacctcttctatctccataatctcaaagatgcggacaacagcagcgccggcggctctctctccagcggcggcggcggcggctgggttccgttcaacgaggcggaagacggcacggcgttgctgggcgagatcgacctggcgttcctcggcgcgtacgcggccggcatgttcttcgcgggccacctgggcgacagggtggacctgagggtcctcctcaccgtagggatggtggggaccgggctcttcaccgccgccttcggagcgggctactggctcgacgtgcacagcttctactacttcctggccgtgcagatggtggccggcctgttccagtcgtccgggtggccgtcggtggtggcggtggtcggcaactggttcgggaagagcaagagggggctcatcatgggggtgtggaacgcccacacctccgtggggaacatttccggctcgctggtcgccgctgccatgttgaggtacggggtggtgctggagctttgtggtgccccggtgtcgtcatcgcgctggtcgggctcgcccgtgttcctgctcttgcctgttgcgcctgatgtgattggagtccaggaggatctctgtttgaaggacgctccattgcttgaacgacgacgcgcagatgtagaggaaaaggcggttgggtttattgaggcgtggaggatccctggtgttgcccctttcgccctctgccttttcttctgcaagcttgtggcgtatacgttcctgtactggcttcccttctatatcagccacacaggtttgtttgtcaagtttctaaaatgttttgccattttattttactgcatcgaatcgctgtggttctaactaataactgtgttcctgtgtttcagctatcggtggagaatacttgtcggactccgcagccggggtgctgtcgacgctgttcgacgtgggcggcgtcgtgggcggcatcctcgccggccacatctccgaccacctggacgcccgggcgctgacggccgcgagcttcaccttctcggcgataccggcgctcttcttctaccgcgtctacgggaacgtctcgctggcctggaacatcgccctcatgttcgtcacggggatgctggtgaacggcccctacgcgctgatcacgacggccgtgtccgcggacctcggcacgcacagctcgctcaacggcaactcccgcgcgctggccaccgtcacggcgatcatcgacggcacggggtccatcggcgccgccgtcggcccgctcctcacgggctacatctccgccaggagctggagcgccgtgttcacgatgctgatggcgtccgcgctcgtcgcggggctgctgctgtccaggctcgtggcggcggaggtggtcgccaagatggagtcccggaggacgcccgcccctgctgcgagcgacctgctgcccgtgtcctcctcctccatggacgaaccgtagatcgcttctagctgcgccccggctgtggtctcctggtgacatggaatggtggcgggagagtagatcacctgtgattttaggcctggtgggactgtggcagcaggtgcgcagtgcgcttctgtcccggaactgtgggatcttgctcctgccgtgccgtgcttcaccgcttctggttcgtcatggtatatatgtatatggaatgtcttctggttgccgccgaagatgaatgcggttggctactcaccctgcaatactccggctgcggacgggcgtttcctggctccgacagcgcccggaggagagggactggctagatgtgccccataatagttgcaacctgctcgcaggaactccgtaggaggccactcttttaactgtgtcgcacacgtttacgaattctaaagtgggcttgatgacggcctcggatgggcttccacctcggatgagtccagcttcggcctcgatattagcgacaaaaagggcgcccgacattaccgaaaactacaaagctcatatattaccaaagggcttttcgccgtactaagcactccaccaaccactatggcataggcaaccttcgtgtcaggtaggctcgggaatatgaccgagcccttggccttagcctcggctctcaacaggaatcatgcgtttgcatcggacataagtcaacaacaagtacaagcctcatactcgaggcggtaccatctacaggggctcggctttacctcctcaccatacgcgggcaaccttggtgctcctaccagccctccttgaggctataaatatagcagtccacggcttcaatcaagcggaggcaggngaacagttcacgattctcacctccagcaccatattggcacttgcctcaatcaacctcaaggacttaggtacaagtaatatacgtctcatcctcgctctgctggaagtagggctttctctcacccgaaccaggataaactacttgtgtcactttgcatcactccatctggaccagggcacgtaacattatttcactagttagtaagaacttcgggtcgagacaccgacaatagataaatagcttgattggctgttgttttggttcgtctgattaaaagtttagtccatgtcatatcagatatttgaatattaattacaagtattacatatagtaaaaactgattacatagaacaaagactaaacgacgagatgaatctattaagactaactaattcataattagtaatggtttaatgtagcaccatacgagcggataattggctgattagacttgatagactcgtcttaccgattattatttatctatgtaattagttttatgattagaccgtatttaacaattctaactgatattcaaatatccgataggataagataggactaaaattttaggtggatccgagcgggcccttggtctaaagggcaagggctgcaagccagcaatcagatgagctatactgcagtgttagacattctaagtccagttgtatacttgggctctttccaggccttttgctagacatttgcgttcagatcctgccgctaaacagcagggccgaattttctctgggcctacagttccctatatctgcaaccaatgggcctgggatgggagttctctctctctctctcttggctctcgtgaccggatatgcggccgggtcactcattttcgtcacacgcgcgcgttgacgcgccccgcaccaggagaacaaacagtagccatctgtgcactgtcgtgggctcgtgtcactgcgccgccggcgatccaaggcaacgaacagccttgtccgcgaaggctgcacgaatatgttccagcatcggcatcggatgcgggagggagatagatggccacggcaaagcacgtaggcggtggacacgcagtagcgccatagctttcccctccttgtttattgtaaataacctgcagatcggttccgtgcgtggtagtaatctggatcgtctcggcgcggccgaaagcaaccaatatgatactagtatccaccagcaacgcggacaaggcagagcagtgtacagactacagcgcactgttccagctgcaccactcatcagtaccatacctacgggggagtctaggcactggccttctggctactgcctactgccactagcctgcctggtccaaaccattcgggcagccctgcaaagcaaaagctcggcgtctcgtgcagtcgatgccccgcctgttggagcaatgctcgccttttctcggctagggcagtgtacgctgctgctgctacgctccaaaacggatcgatgaaggcggtacagtgcagcggagagctccagcggcagcacccaacgccaacggggatcgatcgacctggatccacggtttacaaaaccgtttagccttaaaaaaccgctacccaccgataacggtttactgtcggtaaactggtggaaaccggtaaaaaaccgaccggtta

SEQ ID NO: 10351 - DNA, 2026 bp, Zea mays
  misc_feature (2026)..(2026): n is a, c, g, or t
cctcctccgcctttctttccttcctccctcggggctccgcgcgcgcagcagccaggaacatctccgctgcctgcccccttcaagaacagcggcggtcggctcttctccaatcctgcttcaaggctgcagtgctgcaccgaccggcaaccgctacggcaattagtttcgtaacctcgggtcgccgccggccttcttcctggcctgagctatatctcagctgcaggaaagctcagttcggatccattcactcatgggctcatcctcaagccatcagagaagcaaaacgcgcagcaggaacaggaagcccttgggaattcagctcttggagcgggtccgtggcagccccatctccttcagatcatgccaggctctcgtgctagtgctcacgttcctatcctacgccagctaccacgccaccaggaaaaccacgagcgtcgtcaagagcgtcctcgacccaaagacgaagacgaacctaggcacgtcgtcggcgcattactggccccccagccacctcttctatctccacaatctcaaaggtgcggacaacaacagcagcagcggcggcggctgggctccgttcaacgcggcggaagacggcacggcgttgctgggcgagatcgacctggcgttcctcggcgcgtacgcggccggcatgttcttcgcgggccacctgggcgacagggtggacctgagggtcctcctcaccgtagggatggtggggaccgggctcttcaccgccgccttcggagcgggctactggctcgacgtgcacagcttctactacttcctggccgtgcagatggtggccggcctgttccagtcgtccgggtggccgtcggtggtcgcggtggtcggcaactggttcgggaagagcaagaggggcctcatcatgggggtgtggaacgcccacacctccgtggggaacatttcggggtcgctgatcgccgctgccatgttgaggaggaggatctctgtttggaggacgatgagaagaagccgagcgacatggacgctccattgcttgaacgagaacgacgacgcgcagatgtcccgcgcgtcccggttgggtttattgaggcgtggaggatccctggtgtggccccttgcgccctctgccttttcttctgcaagcttgtggcgtatacgttcctgtactggcttcccttctatatcagccacacagctatcggtggagaatacttgtcggactccgcagccggggtactgtcgacgctgttcgacgtgggcggcgtcgtgggcggcatcctcgccggccacatctccgaccacctggacgcccgggcgctgacggccgcgagcttcaccttctcggcgataccggcgctcttcttctaccgcgtctacgggaacgtctcgctggcctggaacatcgccctcatgttcgtcacggggatgctggtgaacggcccctacgcgctgatcacgacggccgtgtccgcggacctcggcacgcacagctcgctcaacggcaactcccgcgcgctggccaccgtcacggcgatcatcgacggcacggggtccatcggcgccgccgtcggcccgctcctcacgggctacatctccgccaggagctggagcgccgtgttcacgatgctgatggcgtcggcgctcgtcgcggggctgctgctgtccaggctcgtggcggcggaggtggtcgccaagatggagtcccggaggacgcccgcccctgctgatagcgacctgcccgtgtcctccatggacgaaccgtagatcgcttctagctgcgccccggctgtggtctcctggtgacatggaatggtggcgggagagtagatcacctgtgattttaggcctggtgggactgtgggagcaggtacgcagtgcgcttctgtcccggaactgtgggatcttgctcctgccgtgccgtgcttcaccgcttctggttcgtcatggtatatatgtatatggaatgtcttctggttgccgacgaagatgaatgcggttggctactcacgctggaaaaaaaaaaaaaaaaggcccctan

SEQ ID NO: 10352 - DNA, 3445 bp, Zea mays
  misc_feature (1298)..(1298): n is a, c, g, or t
  misc_feature (1338)..(1338): n is a, c, g, or t
tcagattatggttcaactttgacaattccttcgccattattggagttgttacagcttcaccagctgttggaattgacatcagagaagacgattgaggaactttctcaatggtgaccttgcaatgctcgttcctgccaatgattgggtatgccaaatgatttccggtggctgtagaaggtgatgttgagcaagaaggaatttcctccgttagtacagattgtgtagcacctggagtcatcagttgggttccagctttggacaaaacgttggttgatgaaatctgtggatagacaacatctgacacatctgcaagcacaaattgtttctgtgaaggcttctgctgttcttgcttcattggtggtggcgcctgtgatgcttgcagcgaaacatcgctatcttgttgaggcaggatccgctgctgggcaagtgaatgagagcttgatagctgctgcatgtccaaaagtaacttctgctgttcctgtattacctgtaacggcgagagtgtaactgttggctgtgatacaagtgactgctgctgtagtttctgtaatagctgcagctgaagttcctggtcagacaattgagcctgttgaccagccaaattcacaagttgagctggcaacttgtttagctgctgctgattctgctgttgctgctgctgctgctgattctgctgctgcagttgctgaagtaaaagctgctgttgttgctgcagttgaaaattctggtcctgctgttgctgtgaaagaagcagctgttgcacactggttcccttctggcacctagttggagactgctgctgttgttgctgctgctgttgcatctgattctggataattacctgggcctggacaagattggtttgagcctgacttaaaggaattgcttggttaacgggctgctgttgcctctgctgattgccaacttcttgcttcagttcttgttgattgatgatgacgtcaagttgattacaagacaatgatcccttagcaagctcatttataggttgcacttgctgagggagcttggaagcattaagctgtacactgttttgttgcaggagatggttctggacatatagctgccttgcgagctcagccgcaccaaggttttgcatggcagggttacttagagatcgcagatactctgactgtatgcctgtatttaatgtggagctctgcggcctgttcatgttcatccattgaaccaagctcaaaccaggcattgtggtgttatgggtctgggcgtcctttatgcatatctcctcaccaagccaaggcattgccctcttgaaaagnttttccatctctgatgactcgtcatctgttaattcaaatnagtgaaccatgtaaaccatcagaatggctgtcgttgtatgcaatttgcgttgcaatataacacagaaagatgaacttatggctgatttacctatttgcctagggcgctttacgccaaagaaaggctgggggcatatgaagaaaggagcagcaattggttcaatctcccacattgaaactctgtttcgcctttcccctgcggcagattcatcccaaccaacctacaaaattacactacatctgtgaatcagatgcaaaccaaatccgtcatcaatggtgtggttcaggcaatctaacctgtaagttgcgccactgggagtttttccatcttacaggatctagatcagttatcccagttattgtacccatgtacctgaagaacattgaataatttgattagtgtagaataggcaacaaaaccatgcctataatttaggatttagaaaagtaaacataaattgattgtttgccaataatgtgccaaattaaaatagacaaaaagagcaattgtaccttctcatccctaattcctcggtctcaaacatcatccggaatcgcattcctaaagatatttggttactatacagtgccttctggaatttggcaaatgggataacaaactcagtagggctagccctgaaagtgcacatttcaaatagatcattaatagctactgagctacataaaaaggctgtttagagccatcagggtgggaaaaaatatagtgtaggaaaatcactcgcctaggattgtaaaatatggtaaatgggctattgttggcagcagcatgggctgctgcagccagcccccctatgtgcatactgtcacttgaaagtactgaagaagatatattagtgggttgccggctagcccgtctgattcccagtagaagttgctgcctttcgtccctaaaaacatgatgagccaaaacatagatgatatttaaactccagttttgttcattgtttcacaggtaagttggtaagaatctttactctagaaaggatcaagacaagcttttgcaagaggaaaaaaatcatgaaagttacctaacaaaaatgacagaatcaccagcaaatagtctcttgccgcccacaaaaagactccacccagtggttagtaagtgtcttttcggctgacctggtcatagaatgattcataaggtcggcaacagtaacagcaactttcccttgcagaccacccagaacataaaagaatgatgtgcaaggttcttcaaatgcttgaaaccatattggggggggggggggatgcttgcatacaaaaactgaagaagtcctactgctactgccatcttgtagcaatgaaagtgatatactttcttttccccacctcgaaatatatggcgaaatgtccacacattgtcatgtatgtccctggcttgaagttcttgagccggaggctgcataccgaagtcctataggggcagaccaggagagcacaaaaaaaaaacattaaaatggcactacgaagttgatggacagagagcatcttgttctggcaggcaatattaggtattcgatgcctggactggataccagtggaggtaatatcttctccgcagcacgacgaggcacagagaagcctccatgtgtactcgtatcacttgcagtaagcgtcttgcagaagaactccatctgtggccttgcatgtttcagtgcaagctccgatagctgtaaagcctctttcccatactgaacccagagccaaagacatggttttaggacgtctgaacaagcaacagccttttggggggaaccaccagttctagatgctcaccgtgttcactggctgaagagtcatctgcgcgtacacctcgtcagtatccgggtcagcctgaggacaaaaagaggaacggttttacaatgggcgatgatgcaagctccgtgtcaaaaggggacatggtaggagctgtgtgcattacgtgcaaagtaacactgtgaagaagacatatcagctttgagggaagatttgggtagcttggcacatgtgcatcgatgtccttttgcatagaagctgcaacctgaatcagcagcacggtaagtccaaccaccatacacaattccgtttggatggaagtgaaatatata

SEQ ID NO: 10353 - DNA, 1110 bp, Zea mays
gtggatgacgacatcagggacctgccaagatctccatggaggagatcgacgccgccaagctcaccaaggacaacgtcgacgtccgcctcaagtggctcggcctcttccaccgctacaagcaccagtgttgttgttgctgttggtaggagcgaccccgcgagcgtgacacacccacgcctccccgcgcgcccggggccatccattcttgagcgtgtatgatgacctgcatgcagaccacttatctggtctcaaggttcttcatggccttgactctcaaagatcagagtattcttgtcaatggggatatcaatgaaggcttgcttcgcctttgtcacaagcttcatcgtttaaggaaagaatatgcatacacatttgaaagcacaagcttatcttatcagtgttctgaggttagcaggatcttgcaaggctagggacccaggggctacacatcttataactgaaaaacacatgagcagtttatgaggttgtcaagttttcatttcaatgcaaatccagctggacaacaccatgtcacaaagcagtgtgcttctagatacagttcagtcttggcgtcatcgaatcaatgaaacatgaagttagaagcacactgagatccagtggctgatccagtggcttgtgaccccttgaccctttagaggaagcgcactagagtcattggcaagaagaagaggatcgccaagaagtctgaggctgccgagtaccaaaagcttcttgctcagaggctgaaggaacagagagaccgcgagagcttggccaagaggaggtccaagctttctgccgcttccaaggcttccgctgccaccgccgcttaagaatgttcgatgctttgagatgtttcaagacctatcttgttacaccttaaataccttatgctactctgattgtgttgcaacttgcaactgcccctgtacttgatagatttgtattagatgctcaagctacagagggtaggttcctaattatgaccatatgactatgtactaaattatatatctgttgctaagttacaatacatacaaaataagtttactccgcccctcttgtagaaaaaccagttatagtgaccaaggatatctgaaaaaaaaaaaa

SEQ ID NO: 10354 - DNA, 1146 bp, Zea mays
gtgtcggggaaagtgggaatttgactcctaatcgttaatattatgcaaaataagggggtaaattttgggtggatcatttctttttgtacccaatggtttttgaaatcggcaagtgccaacgataaagcatgaagaatacaccgggatagtccagacaagaggtttcaatatgtcaccccagtcctcaaatataggtgcggcttgaaaagaggccaagccgtgacaatcaagcgatcagagagattgggtcctttagaggggccggcacccttgagaaaggttttgtggggctgttgtttttgtcaggctatctaggtaattttttatttttttgttttttttttttttttttttttttttttttttttttgcctgccaaaaattagccacctgatggttctcttccacgcatgttcattgacaggcatcgtttatcagtagagtgaacaggcaggtgccacacctcagataaaaaggatcccactagagtgaaaaagggggagaatgtaacttgcaaattgtcaggaaaatacataaatccacagcaacatcgatgaccattatatgatgcattagctagaatgatccatcatcgttggcttatcgcgaaacggcattcatcttcgcgggtagcctagtccacgcagcagcaaccggagattaagtcgatctgtccggtgcattcccatccccagcatcaggtgagtcctttctgtcctggttctccttcctcttagcccaggcccatctcaacacaatgaacgccccaagcgcatacacctgccagaggttgcgcggggccatctcctcctcggtggcgggcggcggcgggacgccctcctcctcctcgagctttattggcggcggctgccgtgccttgtggcgctccccatcggggaagaaacgcaccgtagacggcggcccgcggcgagactccgcgtcggcagcgccggccccatccgccgagttcttgggctggtccggcgcactcccggcgttgcccatagcgtccgccgcctcctcgcaacccccgcttgctgtatcctcttcttctatccctcaagagcggcggccccaacactctctcacctcgttagcaaggcagcgtctttttctcttctcttctcttctcttctctttaccctt

SEQ ID NO: 10355 - DNA, 869 bp, Zea mays
ttttttttttttttttgtcggacggacaggacgtccaatattttattcagctgaattgttaggattcaaatcgagttttcagttaaccttttgcttggttcaattttgtctcgaggttttcagttaactgagacaaagtactattgttacataaattttaactgcatctcaagtagcaagtttggggggtgaaggtgaagctatgcttgtacatagaaacttcgccaggcgcgcgccaggtgcccaggtctgcaaagcaatgcgccagtttttaagttaacaaacgcagcaagccagcaacagcaaagcaacgcgccatatgaagcaagccagcaacagtgaaggtctgcagtctgcactaaagcagtagaaattaaagcattagagaataaataaacaccagctaaagtagctatatgaagcagagtagcagactgtgggccatatgaagcattatccaaactaaagcagctaatcagctatatgaagcagtagcagattagccaaactaaagcagtataccaggacttgtgcgtgtgtggagtgaagatgatcaaaggacttgtgctaatcaaagcgaggcaactaatcaattcagttcactagtagttagcacatcgaagaaaagggaggaacacgactgcccgcttactgaagaaaagcggtgctggccggtggccgctgggagcggggagcctgggaggaggactgcgcgtctgtgcgcactacggtgctggcctgctggggcctgggagcttgggaggagccggactagagcctggaggaggacgccgtcggcggtcggcccgtcggccacctgggagctactgagctagggttgctgccttgctgggacctgggatgggaat

SEQ ID NO: 10356 - DNA, 593 bp, Zea mays
  misc_feature (171)..(171): n is a, c, g, or t
ccccccccccaaagggaaacgcgggacccctccaggtcccggcccgcaattcccgggccgccccccgcgcccggggcggcccgttcgccgacaacatcttctggggctcggcgggccgggcgtgaaccccccccgccccgctccggtcgtgggtgcacaaaaaaagaaacncccacctgaccagcaacacctgcgaccccggcaaggtgtgcggccactacacgcaggtggtgtggcgcaggtccacccgcatcggctgcgcgcgcgtcgtctgcgccgacaaccgcggcgtcttcatcgtctgcagctacgaccccccgggcaacgtcaacggccagcgcccgttcctcaccctcgacgcggctgccaagtagaggcagagagcccggctgcatgcagtgtgcgtacgcacgcatctgcgtgtgcatggcgtggctactcgatcgatcacgtactgcgtgtgcgcgcgccccataataagtattgtgtgtgtacgtatatatccgcatctgcagtgtttgtgtcatatataaaataatcgtctgcgtgcgctatataatatctatagaacttcaataattttacataaaaaa

SEQ ID NO: 10357 - DNA, 833 bp, Zea mays
  misc_feature (4)..(4): n is a, c, g, or t
  misc_feature (28)..(28): n is a, c, g, or t
  misc_feature (40)..(40): n is a, c, g, or t
  misc_feature (49)..(49): n is a, c, g, or t
  misc_feature (51)..(51): n is a, c, g, or t
cggncgcgtgggcggccgcgtgggcggncgcgtgggcggncgcgtgggnanaataactaatcaagatcgatcgagaatggcgtttccgaagccttactagtcgtctagccgcgctagctgccctcgctgcggccatggcggcggcgatgatggccgcgaccgcctcggcgcagaacacgccgcaggacttcgtggacctgcacatccgcgcgcgcgcggcggacggcgtgggcccggtggcgtgggacgccagggtggccaggtacgcgcaggactacgcggcgaagcgcgccggggactgccggctggtgcactcgggcgggccgttcggcgagaacatcttctggggctcggcggggcgggcgtggagcgccgccgacgcgctgcggtcgtgggtggacgagaagaggaactaccacctgagcagcaacacctgcgaccccggcaaggtgtgcggccactacacgcaggtggtgtggcgcaggtccacccgcatcggctgcgcgcgcgtcgtctgcgccgacaaccgcggcgtcttcatcgtctgcagctacgaccccccgggcaacgtcaacggccagcgcccgttcctcaccctcgacgcggctgccaagtagaggcagagagcccggctgcatgcagtgcgcgcacgcatctgcgtgtgcatggcgtggctactcgatcgatcacgtactgcgtgcgcgcgcgcaccataataagtattgtgtgtgtacgtatatatccgcatctgcggtgtttgtgtcatatataaaataatcgtctgcgtgcgctatataatatctatagaactcttcaataattttacatacggc

SEQ ID NO: 10358 - DNA, 1039 bp, Zea mays
tacggattttttttttttttttttttttttttttttttttttaacccgatgcctgccaattttttttttttttttggttctcttccacgcatgttcattgacaggcatcgtttatcagtagagtgaacaggcaggtgccacacctcagataaaaaggatcccactagagtgaaaaagggggagaatgtaacttgcaaattgtcaggaaaatacataaatccacagcaacatcgatgaccattatatgatgcattagctagaatgatccatcatcgttggcttatcgcgaaacggcattcatcttcgcgggtagcctagtccacgcagcagcaaccggagattaagtcgatctgtccggtgcattcccatccccagcatcaggtgagtcctttctgtcctggttctccttcctcttagcccaggcccatctcaacacaatgaacgccccaagcgcatacacctgccagaggttgcgcggggccatctcctcctcggtggcgggcggcggcgggacgccctcctcctcctcgagctttattggcggcggctgccgtgccttgtggcgctccccatcggggaagaaacgcaccgtagacggcggcccgcggcgagactccgcgtcggcagcgccggccccccaaacttgctacttgagatgcagttaaccttttgcttggttcaattttgtctcgaggttttcagttaactgagacaaagtactattgttacataaattttaactgcatctcaagtagcaagtttggggggtgaaggtgaagctatgcttgtacatagaaacttcgccaggcgggcgccaggtgcccaggttgaagaaaagcggtgctggccggtggccgctgggagcggggagcctgggaggaggactgcgcgtctgtgcgcactacggtgctggcctgctggggcctgggagcttgggaggagccggactagagcctggaggaggacgccgtcggcggtcggcccgtcggccacctgggagctactgagctagggttgctgccttgctgggacctgggat

SEQ ID NO: 10359 - DNA, 1808 bp, Zea mays
cagagagagccttttcaactatgaaatttgtgaagacacgtcttcgaagaaaaatgggagatgcctatttacgggattatctggtcgtttatattgaaagggaattagcggcaatgatttgttctgatgatattatcaaggcctatgatctagctaatacatgtagagctaaattcaaaataactgagatgtaattttattttgtttgacaaaatagatgatgtttcattatactgttttttaatgaagattatatatcaatatataaattgtggttggttctcttgccatttttatattgtgtccttactggtttggtcgcttggaggctaaacctgccccctctgtcttcggatcctggcttcgcccctgtagaggaccaactactttatgccaacccaaactttgtttaatttaatctagagtttagctaaggtcggagttatcctcaatcagacaaataattgtcgcggcacattccaagcaccttctctttttgtgtcaacgtccgttgtcagcacatgccttagtagcagccccttgatgttgagaggacaagcagttagggttgtccaaaaaacattgtattgttcatgatgagtcgtacgtgtcatatgctagtggaactttgtttactatcaaactttaatttgttcataatgcataaatatattgcgtgtgcaccgtgtgtctgtcatatgctgcgctcgagaaccgcgcgcttattatctctagacgatgcatgcatgatagagatagtacttgcgtgccgagttaattaatgcatgcttcgcacattgtgtgtaaaaaataacacgcaaagtcgcacactgcactcactcagctacctaaccattatatatgtagagagagagactgcctataaaaacccggtgcgccccccggcgcccgcccgcgcatctcatataagaataactaatcaagatcgatcgagaatggcgtttccgaagcttactagtcgtctagccgcgctagctgccctcgctgcggccatggcggcggcgatgatggccgccaccgcctcggcgcagaacacgccgcaggacttcgtgaacctgcacaaccgcgcgcgcgcggcggacggcgtgggcccggtggcgtgggacgccagggtggccaggtacgcgcaggactacgcggcgaagcgcgccggggactgccggctggtgcactcgggcgggccgttcggcgagaacatcttctggggctcggcggggcgggcgtggagcgccgccgacgcgctgcggtcgtgggtggacgagaagaggaactaccacctgagcagcaacacctgcgaccccggcaaggtgtgcggccactacacgcaggtggtgtggcgcaggtccacccgcatcggctgcgcgcgcgtcgtctgcgccgacaaccgcggcgtcttcatcgtctgcagctacgaccccccgggcaacgtcaacggccagcgcccgttcctcaccctcgacgcggctgccaagtagaggcagagagcccggctgcatgcagtgtgcgtacgcacgcatctgcgtgtgcatggcgtggctactcgatcgatcacgtactgcgtgtgcgcgcgcaccataataagtattgtgtgtacgtatatatccgcatctgcagtgtttgtgtcatatataaaataatcgtctgcgtgcgctatataatatctatagaacttcaataattttacatacggcaaaaaaaaaaaaaaaaaaaaaaaaaaaaaaaaaaaaaaaatagtctcgttcatcacaatagtcaaacgctttaagttcgactgtaaatatataaaa

SEQ ID NO: 10360 - DNA, 1359 bp, Zea mays
cacagctgttgtctgcatttcttggaaatagcaagcacgggtctggtatagggtttaacattctttacttgtattgactttcgagcattactggtgacgtgctgagatatctaggcaactttcacgcacaaaaatgacagcttgcaaacgtttctatgtcgtttttatgcatctgattaccttaccattggttttctatattttaatgattctttgtacttctaactaataataagactagactaagcatacatacaagctgtataccaacgattcctcgctgcgtacaaacatgaattgctgctagcgaaggccagcacccttgccacattactgaaaattgtggtccctttgggttaaaataaaagtaaatgctttgcttctctcatctgcttggtgtacacattgcatcacagttgtcctcggctcccaaaggaaaaattgctgggaagaaggttcaggttgatgaaagttcggagttggaggaactagagaagagactggctgctctaaaaaatgcataagatctgtttacaaccctctcctctatgcacatagcaagcctgtcgtgtaccttaattccaaatcttcattcgacacgcaaagtcactgtgatttgtatgtatcaaaaggaagatgatgcaaacccccaagtttttgggcgaatcgatgttgctgctgttcgtacacactcacgtataagatggggctgtgctgccttattagcgacatgattcagagcaagggattccatagtcttgtaaagaagtttgattatttttacatgacagctttttgtttttggtcgttcgttacatgacagcgtttttttagccttgtgggaactcacagtaacgccgcacgtcatttttttaagtgcctaggctttccttgaattgattgctttcagcctttctgggcatttcggcataacattgggacatcgtcatttgttttgggtatgttcaccgtatgggagccagtgtccatcgtactcaggggctggtttggtggaagaaaaattaaaggagatttatggagaaagaactctcatgctattcaattttgaatagcaaaagaattcctctctcatatatcctttcaaattccactaccaccaaattagccctcacatgctgaccaaacccgggttatgtttactatcttccatgcgagatgaataccgcgcacagtgagtatctaaatgaactagttatctaattttataaaagttgagtcacggttaatctgaaagattaattggttgtccatctagagtagaagaaaaggaacaagtccatttttggccccaattaatcttttccattccgcatatgcagttgagaatcgcagacgaaa

SEQ ID NO: 10361 - DNA, 1150 bp, Zea mays
caaagctgccacatacccacagcccacggtcccataccacacgcgtacgcggcattctcctcggcgcgggttgccgagacgcgtacgcggcattctccttgggtgcgggggttcctctcgagtctcggcaacgacgaaaacgaaaataccgagtcgagtcagcgatgaatcccttcgccaaaaaaccaacaccgcgagaggtgatgcggagcagcaagcgggacctgacgaatgctacgcgagggatcgagagggacattgcgtcattacagcaggaggagaagaaactcgttgctgaaattaaaaggacagcaaaaactggcaatgaggcagcaacgaaaattctagcccgtcagctgatcaggttaaggcagcagatttctaatttgcaaggtagccgagctcagattcgggggattgcgacacatactcaggcaatgcatgccaacacttcagtggctactggtttacaaagtgcgagcaaagcaatgggagctttgaataagcaaatggaacctaccaagcagatgaaaataatgcaagaattccaaaagcagtcagcacaaatggatatgacaaatgagatgatgtctgattcaattgacgatgtcttagacgatgaccaggccgaggaagaaactgaagaacttgctaatcaggttctggatgagattggtgtagacattgcatcacagttgtcctcggctcccaaaggaaaaattgctgggaagaaggttcaggttgatgaaagttcggagttggaggaactagagaagagactggctgctctaaaaaatgcataagatctgtttacaaccctctcctctatgcacatagcaagcctgtcgtgtaccttaattccaaatcttcattcgacacgcaaagtcactgtgatttgtatgtatcaaaaggaagatgatgcaaacccccaagtttttgggcgaatcgatgttgctgctgttcgtacacactcacgtataagatggggctgtgctgccttattagcgacatgattcagagcaagggattccatagtcttgtaaagaagtttgattatttttacatgacagctttttgtttttggtcgttcgttaaaaaaaaaaaaaaaaaaaaaaaagtgggaaaaaaaaaattcggcacgagctcgtgc

SEQ ID NO: 10362 - DNA, 1834 bp, Zea mays
gcacgagcgagtttttttttttttttttttttttttttgattgctacctgcaggctgttacaatctataataagctgcgctgaaacaatcatggtccagattgtaacaatccacacgccaaattgccacgatcaaactatatgcttccccgcgggctaaaacaaacacgcaaactttgctttttttttctacaacctaccaaaattcatctttcagcacgcccgttgggtaagggcaatacagcgttgaaacggcagaggggggaaggaaatgcttgttcaatgcattggctatgtgctctacgcctctacaaccaggtactgagtgatcgagtggtaactactcaatactcaaacacacgtgaatgaccactaaacatacaaagacgtgtctacttgtggaaaaagaacgctatatcaaatttgatcttttgagttctgacacaacaccgccatcttcctggattttctcgttgtatatcaccttgtcgatgatgccataatccacagcttcactggggctaaagtatttaggacgcctgatgtcccgagcaatctcttccattggtttaccaatgtgtcttgccagcagcttaaccatttctatcttgacatttcgaatctcttttcttgcaatgtcaacgtctgttgcctgaccttgaaagcgaccaattggctgttttatcattattgtcgatgatggaagtgcggcacggttacctttagcgccagcagctaagagtaaagcagcttctccccatgcattaccgacacacagagtgaaaataggaactttaacatacctcatagcatcatatactgcaagagcttctgtctcatagcctaacttctcgccattcttggtggtgccagtggaattgatgtacatgtagattggcttctcggcgtcgtcatactggaggtagagaaactcggcgagcatgagctccgtgaccgacggaacgaggcacatccccaagtacacgatccggttcttgtacaggaacgaggccaagtccggcggtggctgctcccacgcggcccccctcaggaacggcaccaccatcgcgacgacatccctggcgccgcgaccgccgtcgacggcgggttctcgatgggggctcaggaaccgcggcttggcgccggcgagcgcgcgggggcgggcagcgaggcggagctgggatgagggcgagacggggaggcaacggggcggggagaagagtgtgcggacgtcgagggcgacgcggggaggggacaagaaggcggcggcagctgcctccatggcgaggcggcggtgcggactgcggaggggactgggagtctaggagcgggctcagcttggaggtggcaccggtcggagtgcggataagctcccgccgcggccgacctggccggtagacctctcccgcccgccctctctctctctctctctctctctctctctctctctctccccccccccccctccccccacccccacaccccgccggccataacgcatttccctcactccgaacgttttacgccccccccccccccccccatgcggtaccccccccccccacgctctttcctctctcctaccccccccccttcttcccctccgctcccccatcccccctcccacttcagccaccaactcttatggttgttccccatgccttctctgccccccctctttgacaaccctttttttttctcccctctcttccccccttcctgcacccgacccaatccacttccccccccccccgcaaccgaatttgggctccccccatattcccggccctcctccccacacgctcccccctgcccaacggcaagcaccccagcaa

SEQ ID NO: 10363 - DNA, 799 bp, Zea mays
  misc_feature (29)..(29): n is a, c, g, or t
  misc_feature (33)..(33): n is a, c, g, or t
  misc_feature (35)..(35): n is a, c, g, or t
  misc_feature (37)..(37): n is a, c, g, or t
  misc_feature (67)..(67): n is a, c, g, or t
agagtaaagcagctctcccccatgcattncggncncncagagtgaaattaggacttttacatacctncatagcatcatatactgcaagagcttctgtctcatagcctaccttctcgccattcttgggggtgccagtggaattgatgtacatgtagattggctttctcggcgtcgtcatactggaggtagagaaactcgggcgagcatgagctccgtgaccgacggaacgaggcacatccccaagtacacgatccggttcttgtataggaatgaggccaagtccggcggtggctgctcccacgcggcccccctcaggaacggcaccaccatcgcgacgacatccctggcgccgcgacccccgtcgacggcgggttctcgatgggggctcaggaaccgcggcttggcgccggcgagcgcgcggggccgagcagcaaggcggagctgggatgagggcgagacggggaggcaacggggcggggagaagagtgtgcgggcgtcgagggcgacgcggggaggggacaagaaggcggcggcagctgcctccatggcgaggcggcggtgcggaaatggccgggaaggggaactgggagtctgggagcgggctcaggttggaggtagcaccggtcagagtgcggataagctcccgcagtcgacgatttggcccgtagacctctctctctctctctctctctctctctctctctctctctctctctctctctctctctctctctctctctctctctctctctctctctctctctctctctctatatctatatctctctcgtgccgaatt

SEQ ID NO: 10364 - DNA, 557 bp, Zea mays
cactcctatggcccctcgggccgctcgcggcccgcgagctggcgaatcgagagggaggcaccacgcaccatcttacattgcctgccgtaagcagatcgactactcagctcaaggttgaaggcatggctgcatccaaattctacgtcgccagctgcgccctcctcctaatcggcgtggtgctgctggggcagcagggtatagatggcgccgtcgcctgcccccagttctgcctcgacgtggactacgtgacctgcccgtcctccggctccgagaaactcccggcgaggtgcaactgctgcatgacgcccaaaggctgcacgctccatctctccgatggcacgcagcagacctgcagctagctctgaaccaaagtgtgcgtgattcgatctggacaaagaccaacctgccggttttcgcaaataaaactttggcgcctgtgcatgtggccatccgaataaatgtgtgcatgatcgtctatatagaaaagtgaaaaactagtcctttcccttttttttaaaaaaaaaaaaaaaaaaaaacccgcggacaaatttgcggcc

SEQ ID NO: 10365 - DNA, 2059 bp, Zea mays
gtctgcaagcaatctacgcagcacactcgttctagaaaaactaacgcgataaggctcaagtgggtcaacaaaaaaaaaggaaggaaagaccaaacgataaggctggaggcttagctagaaaggtccctagcgccctgcgacgacgcttggtaaatagatccttttctaaagtacacttcgattttctcagtttgttgctcagtgcgggtgtcgcggtccccgctttttccaggatcacagcgttgttggacgactgcgcatctaccttcgcagttatctggaatttggagttacagtccacgttcgcatgaattggaactttcaactgccaaaacatacaattatctggattttggagttatagtccacgttcgcaaaaattggaactttcaactgccaaaacatacaagatggcagtaaaaacacttgctgaactatctctacaagacagagatgtgaccattcaagtccaagtcaacaggaaatgggaatttaaaggaaataccgatgatggtcctatcttacatgttgacatggttctaacagatgcaatgggaaatgcaatctatgctgaaatgcctagcaaattaatagagcaaaaaggttcattgttacagttaggccaagtatactacattcgacgcttcagagttgcaaattcaaagtcacagtacaaagttctcaatgcccctctcatgatctatttgactctttactcgatcattgatctttgtcgtgatccaccatctacttttccactttatgtctacaatcttaccacgtatgatgatatagatgcaaatggaccaaaaagtaaagactttcatgcatctctatatctaaatggtggtgcagcttgccactggaatccatccagtgctcttagaagctgacccaaatttgctaccaaaggatgaaggttgtaagtgcactgtcaccattactagaatacttgatgatcaaccgtggtggtacagagcatgtaatgcatgtccaaataaaccatccatgcaatcagcagtgtcctcatgtcgtacatgtggctctacagatgctattctgaggtacaaactgaacttcatggcttccgatggcactgctgaaatgcgaatgttctgtttcgacaacattgccaagagaatcattggaaaaccatgcgcttctctcttaacatcagctacaagcacttccaatattccaccagatttagcagcgattgtgtccctcaaattcacatttgttgttgtttacaatgaaatgtcgtttcaagtttcagaaaaagaactcttcatcaagtcagtcatagcttcacatggaagagatctaactttcccgtcacccaaactaaagattccagtgcaaccgtcaactccaacgcaactactaggtgcagcaaaacagcaagtttcaccttcttcagcactgtccaaactatcgactgccatttctccagagaatagtcctcaaactgaagacaatcttcaaaatgaagaccagaacatactggcttttgaatcaccaccaaaaagggctaggcgtaaatccttgaagtttgactgtgacaaaaatctacacgatgaataaaaatgaaacaagtctggcttcaaagttggaacttctacgcagcagcacatgtatatagcttttaccttacttggaaaacaatgtccagacaacttttgttgatgcatcctactatatatgtatgaagtctcatgtactcctaaaaatatatgtatatatgagtactactaaacaagaactgtttgaagcttgctacaccctatggtgacaatttactatgtaatgcttacagtcgtccgtatcgctctatatacatgtgtaatagtataataatattccttctatatgatttagatagaaataagtattaaatttccacaaaaaaaaaaaaaaaaaaaaaaaaaaaaaaaaaaaaaaaaaaaaaaaaaaaaaaaaaaaaaaaaaaaaaaaacgggcgggcggccctaataaaagtaaccaaactgtcacctgacattcaattcactggctctcttttttacatacgcccacaatt

SEQ ID NO: 10366 - DNA, 3128 bp, Zea mays
gtacctcccccgctgctgcctgctctcctccccgaaggccgaatccgatagctagcggctagcgccaacaaaacccctctctccgcgcccgctccccaccggtgacagcgcgcccatggctgccttactccgaacggccgcggccctcgcgcccccgccctcgtcgtccctgtccgcacgggagccgcgtgggcggtgcctgcggctagcctgctcccggcgcgcgccggcccgacagcttcgggcgtggctactgccgactccgcacgtcttcggtcgttctgggggccggttccggcgcctgagcgtcaccgaggccgaggaggccgcgcagacggcgacgcaggaggatccagaaaccgaagttactggagagagtgctgcagatgacagtgctggaagcacagacgaaactccatcatttattgtgacaacactgcaatcatacagagaagctctgattaatgatgatgaagcaaaagctgctgagatagaatcctttttactttctatcgaggatgagaagaactctcttttgagcaaaatcactgctctagatgtggaactagcaactcaacgagaacgtatcttgcggattagtgctgattttgacaatttcaggaaaaggacagaaaatgagaagcttaacatgatggaaaatgtgcaaggggaacttatagagagctttttgcctgttctcgataactttgaaagagcaaaaatgcaaataaaggtggaaacagagggagaggagaaaataaataatagctaccagagcattaataagcaatttatcgagattcttaattcattgagtgttgaagatgttgaaactgttggcaaaccatttgatcctatgctgcacgaggctattatgagagaagaatcatcggagtatgaagaggggatcatactccaggaattcagaaaaggcttcaaacttggggaaagactacttcgcccagcaatggtcaaggtgtctgcagggccaggccctgaaaattctggagatgatgaccctacagttgttgaagatagtgtggcacctcaaaaggttgaggatgttgaagaagacggttttgatgacggcgatgcagaataggtggctggagcttcagctgtgaatcaacaagaacaggtccagaaattttgatgcttttctggagcgtgccaagcaggtaataggattagtaccaattcgttcaagctagagttaggtccccaaatgtgctgttctttactgctgctgacatgggggtgttggtattgcgacaaatttgtgtttctacccgccgtggtcaactttttgttcttacgaaggggaattttcgtggttcatagatgcaaaaatgatatttgtaaggactaaattggctcagtttgctattgataatcaatatatgaattccattgtttgtaaaacaaaaaaaaaaaaaaaatacccgttgcagaggcccggggggccttcttcgtttgtttttttcaaagaaaatcggacatatccgaatttgcgaattctaagcaagaattatacatatggttaataatttaaaccgtttggtcgtgtatgatatctcagcagtattgcacggtggaaaatccatctacgagtagacagaagtggaaatcaggatccatttgttcagctgtggaaaatccatctaccaatagcatctttgaaatgaggccagaaacgatcttctctagcttttggatgctcgccgctgaaagtaggatcccttggtttgatacaatctctcgccaatttttcccaaacatgacaatacatctctgaacttcatgtgaactgtccataaagaccttacaaaccaattttcagcttgggagaacgacagagtgcctccaacacgagcagctgttgccaccgcatatgcattacctcgccattttctgtgtcaccaaacgcactgagatttattattcacgctcgaccgaccaaagccgtgtccttgaagcagagagcagaaaaggaaaactgagctgtatcgctgtatcaggctgcttgcttgatctgcactcatgataactataatgcgtatgcgtcgtaacctgtagcgcgtcatcaactagaccagaatccggacaggccaaagaaagcacgagttcaggacagcagagtttgcttggttgattcgccttctgctcccgcccccgccggcctcgtgccaccatatatacactcttatagcgtgaatcgcgcgctgacttggattgattcctacaccaactcagaaccttgcagcagcagcggcggcggcagcaaacatgagggagaaggatgctggttggttggggcttgggacctgagaggcctgacaagtgaagtgacacatacagtacgcctgatgagaggcccggacgcgggggaggcgcgagcgagctggcggccgaattgcgacgtgggcgcaccaccggccggcgcacgcaagtacgcaaactagcagaagctacgaaaagggccaactggtccagccatggacgaaatcatgcatgacaagtggtggcagccatcgagcctcgctggagtactatgttaggatgtatcctctacaaacagtaactgaggtagagttaatcttaatcgtctaaccgcgtccttgatcgggggctatcctaaccgttggttgcagccctcggtcatacgacgccatataaatagattaagggggccgactggtttagccaacgctaatcgctccaccacaaaaccctaatcgacaccttaagaggaaccgatcccctaggcgctcggagtgattgaaatcgctgtaactatgtctcagatcctcgttatcccatcgagatctgaagttcccctgcagacaacattggaggagccgatccaccgtcgatcaacgatgaaaaccaatctcctcgacactcgtagggagatcaagaaggaggaggcgggtcttcgctgcaagacgccgccgcaatgatggttaggaacaacaacgacagtatgtatatatttacccctcagtagaatagatctactcatcatcgaggtattttagacacggattggtattctagggacttaggaaacgatcctaagcaccaaagattctaaacataagccttgaacacatataatattcagtttt

SEQ ID NO: 10367 - DNA, 1494 bp, Zea mays
  misc_feature (755)..(755): n is a, c, g, or t
cattgggtacctcgaggccggccgggaattctcgatccattcccaatttttcatccatccatccatccgaaggctagagttatctcgtacctcgcccgctgctgcctgctctcctccccgaaggccgaatccgatagccagcgccaacaaaacccctctccgcgcccgctccccaccggtgacagcgcgcccatggctgctttactccgaacggccgcggccctcgtgcccccgccctcgtcgcccctgtccgcacgggagccgcgtgggcggtgcctgcggctagcctgctcccggcgcgcgccggtccgacagcttcgggcgtggccactgccgactccgcacgtcttcggtcgctctgggggccggttccggcgcctgagcgtcaccgaggccgaggaggccgcgcagacggcgacgcaggaggatccagaaaccaaagttactggagagagtgctgcagatgacagtgctggaagcacagacgaaactccatctattattgtgacaacactgcagtcatacagagaagctctggttaatgatgatgaagcaaaagctgctgagatagaatcctttttactttctatcgaggatgagaagaactctcttttgagcaaaatcacttctctagatgtcgagctagcaactcaacgtgaacgtatcttgcggattagtgctgattttgacaatttcaggaaaaggacagaaaatgagaaacttaacatgatggaaaatgtgcaagggggaacttnatagagagctttttgcctggtctcgataactttgaaagagcaaaaatgcaaataaaggtggaaacagagggagaggagaaaataaataatagctaccagagcattaataagcaatttatcgagattcttaattcattgagtgttgaagatgttgaaactgttggcaaaccatttgatcctatgctgcacgaggctattatgagagaagaatcatcggagtatgaagaggggatcattctccaggaattccgaaaaggcttcaaacttggggaaagactacttcgcccagcaatggtcaaggtgtctgcagggccaggccctgaaaattctggagatgatgaccctacagttgttgaagatagtgtggcacctcaaaaggttgaggatgttgaagaagacggttttgatgacggcgatgcagaataggtggctggagcttcagctgtgaatcaacaagaacaggtccagaaattttgatgcttttctggagggtgccaagcaggtaataggattagtaccaattcgttcaaactagagttaggtccccaaatgtgttctttactgctgctgacatgggggtgttggtattgcgacaaatttgtgtttctacccgccgtggtcaactttttgttcttacgaaggggaattttcgtggttcatagatgcaaaaatgatatttgtaaggactaaattggctcagtttgctattgataatcaatatatgaattccattgtttgt

SEQ ID NO: 10368 - DNA, 1319 bp, Zea mays
tgcggctggcctgctcccggcgcgcgccgggccgaccgctccgggcttccccgctgccgactccgcacgtcttctgtctcgccggggggcggctccggcgcctgggcgccaccgaggccgacgacgccgcgcagccggccggcacgacggatttagaaactgaagttactggagactctgctgcagatgacggtgctggaagcacagatgaaactccatctattattgtgacaaccctgcagtcgtacagagaagctcttattaatgatgatgaagcaaaagcttctgagatagagtcctttttactttctatcgaggatgagaaaaactctcttttgaacaaaatcactgctctagatgccgaactagcaactcaacgagaacgtatcttgaggatcagtgctgattttgacaatttcaggaaaaggacagaaaatgagaagcttaacatgatggaaaatgtgcaaggggaacttatagagagctttttgcctgttctcgacaactttgaaagagcgaaagtgcaaataaaggtggaaacagagggagaggagaaaataaataatagctaccagagcatttataagcaattcatcgagattttgaattcattgggcgttgaagatgttgaaacggtcggcaaaccatttgatcctatgcttcatgaggctattatgagagaagaatcatcagagtttgaagaggggattattctccaggaattccgaaaaggtttcaaactcggggaaagactgcttcgcccagcaatggtcaaagtgtctgcaggaccaggccctgaaaagtttggagatgatgacccaacagctgtcgaaggtagtgtggcacctcaaaaggttgacgaagtcgaagacgacggttttggtgccggcgatgcagaataggtggctggagcttgatctgtgaatcaacaagaacaggtccagaaattttgatgcttttctggagcgtgccaagcaggaaataggatggtaccaattcgttcaagctatagagttaggtcccaaaatgtgctgttatttcctcctgctgacatggggtgttggtattgcgacaaatttgtgcttctatccgccgtggtcgaccttttgttcttgcaatgaggaattttcgtgatcaattgatgcaacatgatattgtaagggctaaatggctcagatttgcgattgatgcaacagagtgcttgagtatatagcatcaaaaaaaactagcgggggcgcccggtgcccagcttgcgagttctaaccaaaaactatattactaataataattgaaacaattgaacgtgtatgctatctcag

SEQ ID NO: 10369 - DNA, 3049 bp, Zea mays
ctggtcacgagtccgccctggattagggatggcagcgggtcgggtttgttcgggtataataatacccaacccaaaaaatgtacccgagacttctacaaatatccatacccaccaagtcaattgggcgagaaactgtacccatacccatgctcatcgggtattcaccgggtatcgagtatccagtggatatgctattatagactaaataacatttgatcagtgttataataaatacataaaatattttaatttacatctaagcaccaatgcaacacgagaatgactatatctggctacacgtcgatataatatctcaactcataattatcacatccaataaatttaaatttgagtacagagaataaaagcttaatgagttcatgacagttgacagttataacattgtcaatgtctcactggtctcgattacattacagttgactgttaacacaacacaaattgatattcattaatcaacaacacatgcgagtgagtttttctagtgaatgtagcacatttttagtggatgtagcacatttaaagaggtatattaatatttcgggtatccactgaatacccgtgggtaaagtattttaagcatatatcaattaagctaattcagttttgtggaaaatatatttgtatattattattagtaatatatcagagatatttatgtgttttatctttaatatagaggaatgagacgaagagtgttatgtaagttacaaagtataaataaattctactaatatataaaattatttttcatccttcacctctaaggatttaagataagtttatatctgaagtttggaaaagttgtagaatgtcaaatttcaaactatataagttaattttttaagtgaattttaattcctccaaacgctgttagattaaaatacatcagaattctagattaaataggccgatccgaggcgtgtggatctgatccccctgatgtgagctgcttgtcgtcggcgaggctggtgagccacgcggggagctcgtacgtgtccttctcttggcggccaccgacgacacgccgtcgccgtagatgggacccgacaggcccttgacgtgcaactccaggtacgtgatggggtgccccacgtgttcgtcgccgtcaccacgtgccggtagtactccacgtctccaccccgtcccccgtcctcgagttgctcaccgtgtgcacgaactccagaggagaccctgtacgcgagagaatcgggagagtagtccatgtgatgtcatgattagtacggttgcagctgcaagcattaattgagctccagttcttagcctcatcttaccgttaaaatgattgtgtcacgccgcaatgcataaacattatgctagtctctaccttaatataatacaaattgacgtgagctatatatagtgataaaagcgaaacattatcaatgaagtggcctggagtcgaatcttgcatgtcccattttttttgtcacgctttaaaggtgtagtgacagtgattgtgaacgaagaaattgaaatcaaacatacaatatccgtaacatattgcaccaaacaactcaaaaacacatgcatggccatggatacatggtttagcacgctaaaaaatagactcgacgcagatgactatggatgtccgtgggccatagccagaccaatttacacatagaggccaccagtacacggcccaagtccatacctgtttctgctctcgtccctggcacgtgggtctcatccgtcatccgtgaggtgagcagctgccgggagtcgctgggacggcgggccccaccttctcggcttcccttccccgcccctccaatagtccaatccaatcaaggacaagaaacacggcgacgaaaaggctaggtagagtcaaatccccgggagaccaaccacccccgcaccgccacgaacacgcccaaatcggagagccataccaaaccaaagccttcgcatccctccggaaccctagcatcctccctcctcgctcctgggatgccccagtagctccgatcggcgcctcaccgccatggatccgggcggcgggggcgggatgctcctggaggacttcggccagcgcgtggacctcacgcgccgcatccgcgaggtgctcgccaactacccggagggcaccaccgcgctgcgggagctcatccagaacgccgacgacgctggcgccgggcgcgtccgcctctgcctcgaccgccgatcgcacgggagggcgtcgctgctgtcacccgcgctcgcgcagtggcagggtcccgcgctgcttgcttacaacgacgcggtgttcaccgacgaggacttcgccagcatctcccgcattggagacagcaggaaggtcgcccagacgtggaagactggccgcttcgggtacgcctctactgcctcattctcaatgcggagcttgcctggagtggtcacttgcaatgccgagcttccaatctggttgtgacgatgttgcttttgtgttatggcaatatggcgtcgtaatcactaccatttgtcaagcttttttgagggtgttatcgttcccaataatttagggaatttatcgacgtgctgtgtagtgtaccgagagagtgggatacagggacagatcaatatatatgttatgttttatcttctgcctcgttctatgacccatttatatttctatcatttccatttgtgttgcaacgtgttttaatgctttattcaaggctgatcagttgtccattcattggtttgatttgatcaataattagtttattatttggaaggcttcttaagcacaaaacacaattatgttcatgcagggttggttttaactcagtttaccacttgactgatttgccatcgttcgtgagtggcaagtatgttgtcctattcgacccccagggtgcttatctaccaaatgtgtcggcatcaaatcctggaaagcgcatcgactatgtcagttcgtcagcaatcacaatgtaccatgatcagttttcaccctactgtgcgtttggctgcgacatgaaagcatcatttcagggaactctgttttcgttttctttgaggagctctg

SEQ ID NO: 10370 - DNA, 865 bp, Zea mays
aaccttgaacattagcaaagtaattactgctactgcagagtcaaatatccttcccaatagcaatgatgccaatgatgccctctctctaatcagctttctcaccgacggcgaccgaccgaccagccatataataaagaagcgaagctaagcgagaccggaggggcacgagcgccaccgccttgatcccgcccgctcctccccagatctcctcgccattgccgccgccctgccaggattcgcgccctactcgcccagatccgaccgcggctctgattttccaactgacgcaggagcggtgggtctgaccgggcgcgacccgtcttctcatgggcgagacagcgtgatccctgcggctcgattgtaaattcgtgatctttcggggcattccttggtttgtctgtcggtgctggtggtgctgcgtttggagggccgcggagatgggcgtcggcggggagaagttccagctggggacggtgggggcgctgagcctctccgtggtgtcctctgtctccattgtcatctgcaacaaggcgctcatgagctccctcggctttaacttcggtgtgagatctgactgtgttcctgccacggtttcttgattattatgtgtatgctcgtgctggatgttatgtgattcgtgtagatctgcgttctccattgggggctgcagttctgttctggtgcatgagatgtgtgtgcaaggttcagcacttcagatggtgctttagggcttaagcttcagtggtaactttgaggcagggctaggagtgtcaattggtagttgtcgaaacttcaactgtcgttgccatttttttattgtgaatggtgaaacatgtgtgaccctggtgctaacttgctttctgtc

SEQ ID NO: 10371 - DNA, 3791 bp, Zea mays
  misc_feature (2979)..(2979): n is a, c, g, or t
  misc_feature (3022)..(3022): n is a, c, g, or t
  misc_feature (3289)..(3289): n is a, c, g, or t
cccctcatcatcacctctgctcaacaaaggcaccgtcgcaggtcgcaccgagctacccaccacccgcccggcactccgctagcaccactgggaagaagagcgcacgagaaaaggctgcttctgctaggagcagtatttccctctccggcccggccaacatgcgccgcacgttcctcccccgcttaaattaggcggggccgccgccctcccctttttttagttttcccgcggcccggcctcctccatcgcctcgcctaattcaacccctctcggccgtcgtgcgcgacatactctcttctccagcccgtcccgcccaccgctgctcccttgcctgagctgccgcccgccgtgggatcgatcggtaatcggtccagagcgcggtgcagcgagcgggagagcgcggggggcgtcgtcgacggccgtccggtccgtcgtgccgctcttgcgttcttggccttggtccgcgcgcgtccttcatcaggtgggagccagggtggcgcctcgtgagttggcgcggcggtgcaagaccgccgggtgccgcgcgccaagctcgaggcggtgggctgggtgatggtgcgcctcctccggcgcggacacagccttgaaaagaccggatcgcacaacaggaacatcagcagcagggaggacgccacctcaggagcggcagccacacggccgagatgcacgagtccctttccaatggagccggcggcaccccgccccttcccaacggtcgggcagcggctgccggggcggcgcggtcgcgcctgggccgcgacgggccgccctccggtacaccacgcacgccaccagctcttcttcatcggttcatgcatcctcttgtccgtcgtgaatcgtgatccgatcctctcggtccactcactgcttcttgcagagctggacgtgatgaaggagaagttctccaagctcctgttaggcgaggacatgtccggcaccggcaagggcgtgccgtccgcgctcgcgctgtccaacgccatcaccaaccttgcggcgtccgtcttcggcgagcagcgcaagctggagcccatggcgcccgacaccaaggagcgctggaagagggaggtcggatggctgctctccgtcaccgacctcatcgtcgagttcgtgcccacgcgccagaccgcggagaacggaactacgatggaggtgatcacattgttgtgtttggcagtttcgcgtgatgtgttagtatggctgtgagtgtgacacatcctttttgactcccagatcatgtccacggcgcagcggcgcgacctcgccatgaacatcccagcgctacgaaagctcgacgccatgctcatcgtgcgtgctcggtctgtctattttgtctgcaaaatatatatagtgccgatcgatggttgaacatacggttggtggcagggctacatggacaacttcgtggaccagaccgagttctggtacgagaagggtggggacaacaagcgcgacgacgacaagtggtggatgccgacggtgaaggtgccgtcggaggggctgtcggacgtgacccgcaagtggctgcagtaccagaaggagtgcgtcaaccaggtgctcaaggcggccatggccattaacgcgcaggtgctcgtggagatggagatcccggagatctacattgagtcgctgccaaaggcaaaaagacaaatttctttttcttctcctgacattatctcagtggatcgatcgccagctcacgccaaccaacgtatgtaatgtaacagaaagggaagacgagcctgggcgacgccatctaccggagcatcaccgaggaaacgttcgacccgctggagttcttggccgggatggacctttcgacggagcacaaggtgctggacctcaagaaccgcatcgaggcctccaccgtgatctggaagcgcaagatgcagaccaaggactccaagtcctcgtggagctccatcgtcagcttcgagaagcgcgagcagttcgaggagcgcgccgagaccatcctccacctgctcaagctccagttccccggcacgccgcagtcccagctcgacatctccaagatccagtacaacagggtacgtatgtggtggatgcatgtcatgtgaatgatactccggtactgctatctatgtggatgatgatggccattccctgctgcaggccggcgggtacgccctcctggagagctactcgcgcgtgctcgagagcctggcgtacagcgtcatgtcccgcatcgaggacgtgctgagcgcggacgcggcggcgcagaacctgacggcgagcgaggcggcgcggcgagcgctggagtcgacgtcggcggagctgcccgcggcgcggaagctggacgccaaggaggagctggagaagctgaacgaggccccggcgtcgatgacgctgttcgacttcatgggctggcacttcgaccaggacgagctgatgaagcgcagggaggacggcacactggacgcggacggggaggccatgctcctcaagaaggcgcccagcatggcccccaagaaattctcctacgtcgacagcctctcctccggcggcatgaggagcccctccgcgcgccactgatagtgcgccaccatccactgaccggccgacgtgctaacagcagctcagtcatctacgattcgacaccatggatcgtcgatcgttcagcagcacaagagacgacaatggagacgacagctcctcgggtccggtccgatcgattcttgcttacgtgtacatagctgaggcgcaggcgcagcacctacttacccattaacgtcattgccagtgagagtttcatcataattttatttttattaaacaagatgatacatcacgatatttgatgacatgacacggtattataataagagaggcgaagagaattttatggaaggagaaaaccagataaaacttagaattcactggtttatagataaaagctgatttgccacttttgaaaaccgcaatgaaattttcacgcgaaatganctatgtgacccatgttctctcctcttacatttctttcttgtcnttgcctctacgttctagaagattctagatgaggggaagaaaagggccggattatttcatccacgcgctacacattcgagggttgctaatgagcgtagctactgcttaatttctcaactagtacgtattttcgacatggctctcaagtctcaagagcgcggttctcctgaagaggagacaatgagctctgggcatatgtaccaaactcgcagtaaaaaaaaatacaatgtgtattctttaatttgtcttagctaaggttgtctccacnaatttacgcgttctacctctatgaatatctcctattttaaataaatggtatagtatacagtataaaacagtattttacacaaccgtatacacaacctgctagagacagcttaatcattttttctggactcagatttttgtaatacccaaatacttgagcaataaaataacccttgggccatagtgattatgtgactttgtttattttctttagcatctcaacaaatagagaacttgatttaaagcaactaataatcaaaaaattaagaaaacatgcaccatgctgatatttcttgttgttgcatttgatttgaatttgggatcacaaaatacttgaatttgagctcaatatttaatggaatttaaatttgaatcagaaaataaaatagaaaaaagaaaataaaagagaaagggaactctaatttgggcccaaaccacctcacatcggctcagctagactcccagtcgacctagctggggcatccacgtgccgacggtgggcc

SEQ ID NO: 10372 - DNA, 2247 bp, Zea mays
cccttgcctgagctgccgcccgccgtgggatcgatcggtaatcggtccagacgcggtgcagcgagcgggagacgcggggggcgtcgtcgacggccgtccggtccgtcgtgccgctcttgcgttcttggccttggtccgcgcgcgtccttcatcaggtgggagccagggtggcgcctcgtgagttggcgcggcggtgcaagaccgccgggtgccgcgcgccaagctcgaggcggtgggctgggtgatggtgcgcctcctccggcgcggacacagccttgaaaagaccggatcgcacaacaggaacatcagcagcagggaggacgccacctcaggagcggcagccacacggccgagatgcacgagtccctttccaatggagccggcggcaccccgccccttcccaacggtcgggcagcggctgccggggcggcgcggtcgcgcctgggccgcgacgggccgccctccgagctggacgtgatgaaggagaagttctccaagctcctgttaggcgaggacatgtccggcaccggcaagggcgtgccgtccgcgctcgcgctgtccaacgccatcaccaaccttgcggcgtccgtcttcggcgagcagcgcaagctggagcccatggcgcccgacaccaaggagcgctggaagagggaagtcggatggctgctctccgtcaccgacctcatcgtcgagttcgtgcccacgcgccagaccgcggagaacggaactacgatggagatcatgtccacggcgcagcggcgcgacctcgccatgaacatccccgcgctgcggaagctcgacgccatgctcctcggctacatggacaacttcgcggaccagaccgagttctggtacgagaagggcggggacaacaagcgcgacgacgacaagtggtggatgccgacggtgaaggtgccgtcggaggggctgtcggacgtgacccgcaagtggctgcagtaccagaaggagtgcgtcaaccaggtgctcaaggcggccatggccattaacgcgcaggtgctcgtggagatggagatcccggagatctacattgagtcgctgccaaagaaagggaagacgagcctgggcgacgccatctaccggagcatcaccgaggaaacgttcgacccgctggagttcttggccgggatggacctttcgacggagcacaaggtgctggacctcaagaaccgcatcgaggcctccaccgtgatctggaagcgcaagatgcagaccaaggactccaagtcctcgtggagctccatcgtcagcttcgagaagcgcgagcagttcgaggagcgcgccgagaccatcctccacctgctcaagctccagttccccggcacgccgcagtcgcagctcgacatctccaagatccagtacaacagggacgtcgggtacgccctcctggagagctactcgcgcgtgctcgagagcctggcgtacagcgtcatgtcccgcatcgaggacgtgctgagcgcggacgcggcggcgcagaacctgacggcgagcgaggcggcgcggcgagcgctggagtcgacgtcggcggagctgcccgcggcgcggaagctggacgccaaggaggagctggagaagctgaacgaggccccggcgtcgatgacgctgttcgacttcatgggctggcacttcgaccaggacgagctgatgaagcgcagggaggacggcacactggacgcggacggggaggccatgctcctcaagaaggcgcccagcatggcccccaagaagttctcctacgtcgacagcctctcctccggcggcatgaggagcccctccgcgcgccactgatagtgcgccaccatccactgaccggccgacgtgctaacagcagctcagtcatctacgatccgacaccatggatcgtcgatcgttcagcagcacaagagacgacaatggagacgacagctcctcgggtccggtccgatcgattcttgcttacgtgtacatagctgaggcgcaggcgcagcacctacttacccattaacgtcattgccagtgagagtttcatcataattttatttttattaaacaagatgatacatcacgatatttgatgacatgacacggtattataataaaaaaaacacaaaactaaaaaatctcaaacaaataggaaaacacactaaaagaatcatacatacataacacgagaaaaggaaataaatgaaccggtcaaaggcgccaagtcaattcaattcaaggggacgacacaaaaaagggggggccccc

SEQ ID NO: 10373 - DNA, 2058 bp, Zea mays
caattgccaaaaaaactgtcatcttaatcgcactttaaacacaaatctgttgatgcaaatcatacacttcaaaatattatgatttattgttggtgaaaaagctgtaattttttttcttcccctctagccaaaatgtacttccaccgattgattgtgtttgaccggttccgtagcacgcctccttgtcttggaagcaggcgccaacgagtcaacgacactctgctgtgtcttttgcccagtcttgcgatgcacactaccgagtagtataaaaggtgtggcgaaagcagagcactctcaacatgtcagaaccaaagcgatgccgcactcgcatcgcacgcaccccgcttaacatggagatgcaatcgcaccaccggatcaagcgtggagacatggaggtacatgagcagagggaggaccggctgagcaggctccccgacgacatcctccactccatcctccgcggtctcccactcaagcacgccgcgcgcaccagcgccctctcgcggcgctgggcgcgcacgtggctgggtgtcggcgatgcaaaaggtatccccagaggctcagctcaccgtgtgctcaccgtgtgcagccagaatcctgtgcacacaaggctctaccacgaacttttggaagaataaacgggcaccatttgatccctcaacatctacccttcgttgaaagcgttaggtgtcgacaatgacatgccgtacttgtaattgtaagtactataaagtgcactactgtaacggttgtgaagcaagcagcgataacattatatcatctacccttcgttcagcttttttttttttttttaacagcgcaacaaagataacctttcacataccaaaaacagaacgatacatatcggtatttcagtttcagcaccacgcaacaggttgctcccaggtcaaacaacaccggacactccagcaaaaaaatctgcatggataaaatgagaaccagaaattcataaagaaacctgaacgtgaacttccagcacagctgctcgagccactgattgataattcaagggaaaattgatcacctgccaaggtgacactactactcaacgatcttatccttcttcctcctcttctttgatttttccggtggtgactgtggcatctctgaagccgtgttgctccccgcgcctcgagcctcagatccttctgtggccttgcccgacacatttgagtgccccaggctgctttcatcctttctcttccccttgtgtttggatgttggctctgcgctcctttggcccagtgaaagcgccgaaccttggctactgggattctttgatgcaccggtgaaccgagacatggtcttcttagaacctgcagatttctttatgctaggagtaagactcccaaaacttggttttgtaaattcctcaggtttaggataacgaactaaggatactcgccgtgaaatcttccccacaggttttgtttctgagcctgaaggcaggaagacggttgcatctggtttctgagctgcaaagctcgcaatctcataagatttccctgaggaattttccaagttgcccaagtttccatcactatgcagcttgagagaaacctctttgccatgaaaatccaaaacatctatctggtccttaggccactgaattaaccaaaactctgtcgagtctgttggtgatatatcaagcatggcttcttctttgacctcctcaaaagccggtccaggctcatagcggacccttgcttttgccttcaccatctctagcgcgagtccagcctctagtgatccctcacccgcacgggcgcagttggacgcggtttttgctgaacacccccaaatatagtttgggaaattaactgcgcccagcgcctcagtggattgatatcacgcactgaagaacgagaacttgctctcaaacataacagaaattagtagttcctgcgacagtgaagtgcaagaaaaaaaaaagcgtcgaggaccagaagctatgtagtaattagtacaggaattggcaagaacggagaaaaaaaatcacactcctgcggggacgggagtcttgtacctaaagggaaa

SEQ ID NO: 10374 - DNA, 1066 bp, Zea mays
ccgccccttcacgctcaagtatcagctacccaacgaggacctggactccctcatctccgtctctacggacgaggacctcgacaacctcgtcgacgagtacgaccgttgggcccctcgaggccggccgggaggatcctcgcgcacctcccggatccgcctcttcctcttccccgccaagcccgagtcctcgtcctcgctcggctccctgctcgacgactcttcaaagtccgagaactggttcgtcgacgccctcaacagcgccatctccggctccctcgacggtatcccgaggggaatctccaccgattcagcctccgtcaactgccttctcggcctcgaggacgactcctccgtgcactcccgtagtggagtaaccaactcggctcccacggaggaccagcgcgccagccagccgaagctcccggcgggcgccgccgctgccgccgtcggtgccgggaggcacccgcacgacgtccagtccgtgccagactcgccgatgctggataagaactcctcgttcgggtctacctcctcggccccgtcgctatcgaatcttccgcctatacgcgtgcggccggaggaccgcccgtcggacgcccgcatcatgcaacctaccgccgtcgaggaccacttcgcgcagatgggaatctccgagcagcagctgcccatgtatatacaagctcaacagcaggtgccgatccctgctatgaccggcatgtcgccatctgaggcgtccagccgattgttctctgacgatgataagtccgatcacggtggtggcggaggtcggaaacaacaacctcccaagcaggacgttccgccggttgttgatcccaccaatagagctgtgtactataatgatagatctactccggctgaattgaagcgagacatgccggtgggaactgaagctgccagctaccgcctccccgtttcagctacggacgctgctgcggcagctgcagccaccgccgcgacacaggcccctcctggatatgtccttgcccagatgcatgcgcctccgccaccgcagcaaccaccacagcagcaaccacaacagccagct

SEQ ID NO: 10375 - DNA, 1221 bp, Zea mays
  misc_feature (4)..(5): n is a, c, g, or t
  misc_feature (18)..(19): n is a, c, g, or t
gccnnggccgggtttccnnatattctgctttccccaaaatctgatcttcggccccacccagaaacccacggaggagacaagcgtagccagagcagcaaaccaccccccttcctcgcccgttcgcttcctcatggagccgctgccgtcggcgacggccgccggcgtgggggggcctgggcccgggtaccccgagtccacggagtcttctccacgcagccggggtggggattcgtgggacgagcccttcccgtcctccgcggcggcggcggccgctgctgccggcggtgggggccggctccgcctgatgtgcagcttcgggggacggatcgtcccgcgcccgaccgataagtcgctctgctaccttggcggggagaccaggatcgtggccgtggaccggcacgcttcgctcgccgatgtccacgcgcgcctcattgggtacctcgaggccggccgccccttcacgctcaagtatcagctacccaacgaggacctggactccctcatctccgtctctacggacgaggacctcgacaacctcgtcgacgagtacgaccgcatcgctgcgacctcctccggcggaggatcctcgcgcacctcccggatccgcctcttcctcttccccgccaagcccgagtcctcgtcctcgctcggctccctgctcgacgactcttcaaagtccgagaactggttcgtcgacgccctcaacagcgccatctccggctccctcgacggtatcccgaggggaatctccaccgattcagcctccgtcaactgccttctcggcctcgaggacgactcctccgtgcactcccgtagcggagtaaccaactcggctcccacggaggaccagcgcgccagccagccgaagctcccggcgggcgccgccgctgccgccgtcggtaccgggaggcacccgcacgacgtccagtccgtgccagactcgccgatgctggataagaactcctcgttcgggtctacctcctcggccccgtcgctatcgaatcttccgcctatacgcgtgcggccggaggaccgcccgtcggacgcccgcatcatgcaacctaccgccgtcgaggaccacttcgcgcagatgggaatctccgagcagcagctgcccatgtatatacaagctcaacagcaggtgccgatccctgctatgaccggcatgtcgccatctgaggcgtccagccgattggtctctgacgatgataagtccgatca

SEQ ID NO: 10376 - DNA, 1562 bp, Zea mays
aacagcgcaacaaagataacctttcacataccaaaaacagaacgatacatagcggtatttcagcaccacgcaacaggttgctcccaggtcaaacaacaccgggcactccagcaaaaaattctgcatggataaaatgagaaccggaaattcataaagaaacctgaacgtgaacttccagcacagctgctcgagccactgattgataattcaagggaaacttgatcacctgccaaggtgacactactactcaacgatcttatccttcttcctcctcttctttgatttttccggtggcgactgtggcatctctgaagccgtgttgctccccgcgcctcgagcctcagatccttctgtggccttgcccgacacatttgagtgccccaggctgctttcatcctttctcttccccttgtgtttgggtgttggctctgcgctcctttggcccagtgaaagcgccgaaccttggctactgggattctttgatacaccggtgaaccgagacatggtcttcttagaacctgcagatttctttatgctaggagtaagactcccaaaacttggttttgtaaattcctcaggtttaggataacgaactaaggatactcgccgtgaaatcttccccacagcctttgtttctgaccctgaaggcaggaagacggttgcatctggtttctgagctgcaaagctcgcaatctcataagatttccctgaggaattttccaagttgcccaagtttccatcactatgcagcttgagagaaagctctttgccatgaaaatccaaaacatctatctggtctttaggccactgaattaaccaaaactctgtcgagtctgttggtgatatatcaagcatggcttcttctttgacctcctcaaaagccggtccaggctcatagcggacccttgcttttgccttcaccatctctagcacgagtccagcctctagtgatccctcacccgcacgggtgcagttgacgcggtttttgctgaacacccccaaatatagtttgggaaattaactgcacccagcgcctcagtggattgatatcacgcactgaagaacgagaacctaaagggaaggagaggtagatgcccccactcagaggaggcttcagtcgaaggggccggggggacttcctgtgcggctgtgtccctacgccagacgtgtgtgcggccaccggtggtggagcgaggcggacggggatggcagctgtaggagagacctgtagtctgcgcctctgcggatcggtggatgtggatcgaacttcagactttggggttggccacgcgcgaatgcggcgcttggactgttggaaggcgaggcgcgagcccgggggcgtccgactccggctaggccgtcggacggtgggtggcggcgccggcgtcacgcgtcgagccggcgagggccgatcgtcgagggcgaggccgcgaggggtcggccgacggcgggggcgggacactgtcggcggcgagggcacgccagcgccgcgcgtgtggcgagtgctagcaggtggcggcagccggttccgggcttggcggcggttgactgtagggctaggc

SEQ ID NO: 10377 - DNA, 2040 bp, Zea mays
  misc_feature (9)..(9): n is a, c, g, or t
  misc_feature (2017)..(2017): n is a, c, g, or t
ctcgaggcncggccaggccgggaattcaattcaatcaatttcagcgcggccaccctctcgccgcgggccgggctcggccagtggccagtgaccacgctccaccccattgctctggctctgtgctgtgcagctgtgctgccgggctcctgcgccatggccgcggccacgctgctccagggcccggccgccgcctcgccgcgtctcggcgccgcggcttcagcgccgtccgcgtcccacgggaggcgtcgcctcaccttcagcttcaggtgccagtcgaccagcgtcgacaagcaacaggagcggccgcccaagccgaagcagcggaacctgctcgacaacgccagcaacctgctgaccaacttcctcagcggtggcaacctcgggaccatgcccgtcgctgagggcgccgtcaccgacctcttcggcaagcccctcttcttctcgctttacgactggttcctcgagcatggctctgtctacaagcttgcttttggacccaaatcattcgttgttgtctctgaccctatcgttgctagacacatcctccgggagaacgctttctgttatgataagggagttctcgctgaaattttaaaacccataatggggaagggtcttatacctgctgaccttgatacctggaagcaaaggagaaaagttataacacctgggttccatgccttattcatagaagctatggtgaggacatttacgaaatgttcagagagaacaatatcaaagcttgaggagcttactgaaagtgaaggtcgtgaacaaaattcgactattgtggaccttgaagctgagttctccaatttggcacttgatatcattgggattgggtgtgttcaattttgattttgactcggttactaaggaatctcctgtaataaaggcagtgtatggaacacttttcgaagctgagcaccgttccaccttctacatcccctattggaatcttcctttgacaaaatggatagttccaaggcagcgcaagttccatagtgacctcaaagtgatcaacaattgccttgataaccttataaaaaatgcaaaggagacgagacaggaagctgatgtggaaaagctccagcaaagggactactcttctctgaaggatgccagcttgctgaggttccttgttgacatgaggggagctgacgctgatgatcgccagcttcgagatgatcttatgacaatgcttattgctggacatgaaacaactgctgctgttctgacatggtctgtttttttgctagcccagagccctaccaggatgagaaaagcccaggcagaggttgattctgttctcagcaatggggcaattactgtcgaatctcttaagaaactggagtacataaaactgattattcttgaagctcttcgcttgtatcctcagccaccattgttaatcaggcgttctctccggccagacaagttgttttcgggtgcaatggagcaaaagagggatatgaaataccagctgggaccgatatatttgtttcggtatacaacctgcacagatccccgtatttctgggaccggccaaatgagtttgaacccgagaggttttccgtcccgaagaaggacgagagcatagaaggctggtctggttttgaccctgaccggagtcctggcgcaatgtaccccaacgagatcatagcggacttcaccttcctccccttcggcggggggcctcgcaagtgcgtgggggaccagttcgcgctcctggagtcgacggtggctctggccctgctgctgcggaagttcgacgtggagctgagagggtcgcccgacgaagtggagatggtgacgggcgccacgatccacacgaagaacgggctgtggtgcaggctgaggagaaggacttgacggcccaacattagctttgcagtttgcactgagtgagaagtagctctcgttcttgactcctgtgatgtgctttagacgagctaaactgcatcgcagacagaccagtggatgggaaccgtgtatcgaatcccgcggccggcatggncgcctggagcatgtcgacgtcgg

SEQ ID NO: 10378 - DNA, 1763 bp, Zea mays
ccggccgggagttggccatgtagtaaaattcgattagacactatgaggacaggtggacagcccctgcaacactgacctgttatgatgtcttaattcacagcatggctctgtctacaagcttgcttttggacccaaatcattcgttgttgtctctgaccctatcgttgctagacacatcctccgggagaacgctttctgttatgataagggagttctcgctgaaattttaaaacccataatggggaagggtcttatacctgctgaccttgatacctggaagcaaaggagaaaagttataacacctgggttccatgccttattcatagaagctatggtgaggacatttacaaaatgttcagagagaacaatatcaaagcttgaggagcttactgaaagtgaaggccgtgaacaaaattcgactattgtggaccttgaagctgagttctccaatttggcacttgatatcattggattgggtgtgttcaattttgattttgactcggttactaaggaatctcctgtaataaaggcagtgtatggaacacttttcgaagctgagcaccgttccaccttctacatcccctattggaatcttcctttgacaaaatggatagttccaaggcagcgcaagttccatagtgacctcaaagtgatcaacaattgccttgataaccttataaaaaatgcaaaggagacgagacaggaagctgatgtggaaaagctccagcaaagggactactcttctctgaaggatgccagcttgctgaggttccctgttgacatgaggggagctgacgctgatgatcgccagcttcgagatgatcttaccgctacccgcattcccgggcatgaaacaactgctgctgttctgacatggtctgtttttttgctagcccagagccctaccaggatgagaaaagcccaggcagaggttgattctgttctcagcaatggggcaattactgtcgaatctcttaagaaactggagtacataaaactgattattcttgaagctcttcgcttgtatcctcagccaccattgttaatcaggcgttctctccggccagacaagttgccaggcgggtgcaatggagcaaaagagggatatgaaataccagctgggaccgatatatttgtttcggtatacaacctccacagatccccgtatttctgggaccggccaaatgagtttgaacccgagaggttttccgtcccgaagaaggacgagagcatagaaggctggtctggttttgaccctgaccggagtcctggcgcaatgtaccccaacgagatcatagcggacttcgctttcctccccttcggcggggggcctcgcaagtgcgtgggggaccagttcgcgctcctggagtcgacggtggctctggccctgctgctgcggaagttcgacgtggagctgagagggtcgcccgacgaagtggagatggtgacaggcgccacgatccacacgaagaacgggctgtggtgcaggctgaggagaaggacttgacggcccaacattagctttgcagtttgcactgagtgagaagtagctctcgtgcttgactcctgtgatgtgctttaggcgagctaaactgcatcgcagacagaccagtggatgggaaccgtgtacactgaaaacatatcttgtaggcttgtagcgtaacaggtgcaaccacaacaatatattatttatctatctatctaattgagcttgacattccgcggcccgcgcgcacacgaaaaaaaaaaaaaaaaaagcggcc

SEQ ID NO: 10379 - DNA, 2053 bp, Zea mays
gattcatctgcattggaacctatctgggatgatgaagataccaaagctttttatgaatctttacctgatctcagagcatttgtgccggctgtattactgggagaggttgagccaaagtcgaatgagcaacatgctaagggccgtgagcaatctagtgagtccacttcagaacaagagactgaactacatgacgattttcaaacttctgcaactgaacatcaactagaagttaaattagatggtggagtgaaagagagtgatgacaaagataaagagaagggaaaggatggagaaaaggaaaaatctaaggagaaggatctggataagaaaaatgacagagagaaggagaaaggaagagccatggacggtgcaagtctggataacatcttgcagaggctaccgggatgtgtcagtcgtgatctcattgatcagttgacggttgagttttgctacctaaattctaaagcaaatcgaaagaaacttgcgcgtgccttattcaatgttaataggacttcactggaactgttgccttactattctcgtttggttgcgacactatcaacttgtatgaaagatgttccaagtatgcttctgtctatgcttgaagaggagttcaactttttaataaataagaaggatcagatcaacattgaaacaaaaataaaaaatatacggtttattggggagttgtgcaagttcaagatggctcctccagctcttgtttttagctgtttgaaggcctgccttgatgatttcagtcatcataatattgatgtggcttgcaaccttcttgagacttgtggtcgttttttgtatcgctcacctgaaactaccattcgcatggctaacatgctggagatactgatgagattgaaaaatgtcaagaatttggattcacgccacagtacacttgtagaaaacgcttactacctttgtaaaccacccgaaagatctgcacggatatcaaaagttcggccacctttgcatcaagtaagatttccatttattctttgttacatgttatattgtgcgttgtctacaaaaatgtaccaactaactattctccctccttttcctgtgtagtacataagaaagttgcttttctcagatcttgacaaatcaagtgttgaacatgttttgcgccaactacgcaagttaccttgggcagaatgtcaacaataccttctgaagtgctttctaaaggttcacaaaggaaagtacagccaagttcatctgattgctcttctcactgctagtctcagccgctatcatgatgactttgctgtcgcagtggtagatgaggttagttcttttagctgactgctgcatacataaaggaaaacggaacattttttgtaatatttgttggagtctgttctttttcccccctgttgtagtcaccataaaatgaaattgtaacacattaattaactggcagttttcagttttccagctggaaatcgttgcttgcctcagcggcatggagaatttcgaacaaagaaccattagatacgaaatcatacacaagaagtgggacctcagtttcaagacaacatccgaagagtcgtactatgttgcggtggtttatctgagaaagaatggcgacctcattgataaaactgtcgatttcaccttgctccatgatcttggaaatttttattgctaccacacgctgatccgacaagattcctttgtaaaccattccatggcctccacgtccaagtatgcgtgatgtatcaaagtcatttgtagccttcttgagctcttccagagaaaaaatcttcgtattgttgcgggcattctcatcagatgatattagttgttctaggagaagtccttggttttttctaaagtattttctccgtagttgcttttgaatgtcccttttccatctacggatgacaagcatcccgcccaagcaagatactagaatgccaaagccaacacaaagcccaataatcacacctacaaagattttttgccaatgtcataatgcgctttattagaacatagttcagaaaactaaacagaacatacccaaaacaagacccag

SEQ ID NO: 10380 - DNA, 842 bp, Zea mays
tcggcttctggaggacaattttattcatgcggatatgcaccctgtcaacattcttgttcgtttaaatgagaacaagcttgcaaggagacgttttttcagagctaagccccatattgtgttccttgacgtgggcatgactgctgagctcacacgattctgaccgggataacttacaacagttcttcaaggcggtggctactagagatggccgtactgctgccaaagtgtacccttcagttatcaaagaatcagagctgtccaaatccagtggccttcaccgaggagctagacaagacgtttacattttggggaacacctgaaggggatgtttttcatcctgttgaatgcatgcatgagttgcttgatacagttcggcgccacaaagtcaacattgatggcaacatatgtactgtaatggttaccattttggtccttgaggggtggcaacgcaagctggacccaggctttgatatcatgcaaacgttgaagactttactgctagagaaggacataaagcaaccaattgattttttctcataaacaaacctgtcagatcgttcttatgtatagaagcagtggaagatgatgccctaccaatcagaaggcgaaacatctaatctaactcgaagcaacctggcattaattgagcagatatattatgcagtatgttctatctgtcctttctgatagtagaagtagcagaaactgtctgcactgagtttcattttttactacgtcagtatgaaaattttgccgaccaaaaaaaaaaaaaagggtccagccatggtgttctttaaaattcttgggaagttcctgtcaaaaaaaaaaaaaaaaaagcggcc

SEQ ID NO: 10381 - DNA, 3506 bp, Zea mays
gcttgcatgcctgcagcggctctccctagcgagcactctacgcagaggcaagactctctctcccccttgttctggcgtgtgcctctctctccctttaaacactgttcacgtgggtccactttcaattgttagtagataaaaagtatatataaaaatgatattttatagtgtagtgggatatagggggagtatttagggggaaccgctgcgggagatgaaaaaatagggggtgaaatgttgatgatgtgacctaaaaaagtgatatagagggaaaaatttagggagaacggttgcggatagtctgaaggccggcagcgcccacgcatgcttgacttcttgcgccgcgttcacaaccaagccaacgtagaggggaccgaggaccgaggccctcggcgaaatccgtccacgcgctcccggctcccgcaccccactccccgtttttctccgcaccgccctgctccccgaccccaactgctgtctccttcctcgggtaatgcgaccgcgcgccagagcatgctccgcccggagcccgcgctagggttcctcgccgccggccccgcgcgcgcgtgcaagccgccgcccgagcgccgccgcaagaagcagccaccgacgcggcggaggcgaccggccagtgccgcagtaaaatctctctctctctctcttccttttttttggtcctcgccgcagtaaaaacctccacaggctctttgctctcggcgcggcgcgtctcgatcaattacttaactaatgaaggcgcagcagaagtcaatagatcaaaatccaaattccaaacgcgcgtttgtctattgtgctactaccgctacgctactaacccacatgggatccgaggttggcgtttggcgatggcgtcgtcgaaaccctccggccaagcaaagcataacaaaaaagaaaaaaagggcaaaaaagccgagcgggtttgaacgaagcgaaagcggagctgctctccccgcccgcgctcgctccatcgctttactatcattttgctcttttggtcgtttctcagcggctcacggatcgcgcgcgctcccccgctcgtcgtggcgcggccgcgctccacgtttcaatccgtttttgctgccgtgcggtgacgtgacgcctctaccgttggcgctttctgcagacggtggtgggactgggaccacgcggcgcggccgatccagatcccgcgcactcgtccgcgctgctgcctctcaccagcggcggcagcggcagcggctttgcctcgcggggcacggttgcgccaggttcgtggcgttcgtcgcgctgaaatcgctgtgctcgtatgttgcctcattttttgtcgccatgcgttctaatagctttctcgcttcagacgaggaagaggggagagacgaggcgagctcggctgaatcgcaggaagtggcagaagcagcaaacgattcgttctcctactcactaagaggtatctcatttgctaggaatggatgttagctgtgtttacgtgaactggtgaaagtgattgcttattgatggtggaatctgtttgcttggtagagtgccagaagcagcggcgtctcaagtcagagaggtctgcactggtgcggccaccggcctcgcatgagctcaataatgccggaggtattgagcttctagtgctctcgccgaggtgcttgattggtggtaacccgggaggaatgagcaagagctcaacgacatcatcccggagcagatcaggcacaggcacgttcccaagccctgggactccgagctgcaaccggcattgtgcaggcagcatgcagtactcccacgagaccattacctagaacatcctaatcgaaaatggtaggaatagaaggtatgggggcagtggggttgtgcttccatttaacaatggtaggaagctgccatcgaaatgggaggatgcagagaagtggatcctaagtccagtttcctgtgatgggttggggaggatgtctgcaccagctccacatcatagacggcccaagtcgaatagtgggccacttggccatccagctggcattccaggggcttatgcggctgtttcaccgcttgttccttgctttgatggtgtgctggcagcagctaatttcgcagcacattcacctttctctgctggggttctcataccagagcacgggcgcattggcgacttcagcagtggaagagacagatgtggtgatgacggtagcagcagatcctactccgctgagaaagagtcctatatattaagatctgcaagcatacatgcatggacagaaacacttatggaggcatctgcttttgctaatatctcagaagaaaccgtacaagatgataaactgcaacgccagacagaagcaacttccatgatttccagtccaatcataaagaaagacatcggcacacagatgagtcctgaggatagtatatcttctccaaaagcgagacattcctgctccagtctgccttcaggacatctgataaaggaagcaaatagtcatatacctaaacctgaaattcgggacgtgcaggttgatgaccaagtaactgtgacccggtggtccaagcgacatgtaacacgaggctctgataagaggtcaacaaatattattgaatggaggaagaagaccactgaaacccgaactccatcttttgatgaaaaagaaagagaaagatgcatgtcacagtgcaaaagggaggaagcaaagatcacagcttgggaaaatctacagaaagcaaaagcagaggcagctatccgtaagctggagatgaaacttgaaaagaaacggtcatcatcaatggacaaaattttaggcaaactccgctctgctcagaagaaagcacaagacatgcgaagtgtagtttcttctagtgaaggtcagtgtagtgtgagggcaaccaagaagacatcttcctctgtcaaaactggcaggcctttcagctgctgctttacctaccgtgcttgctagttgtgatacacagttggtgcctgtggatacagcaatggatataggtctattcgacctcttctcaggcaacagttatggacgcgaagggaagtcagttgggttttgactacaaggcctaattgttaatgagatttgcactgatgaatgagatatcgttatggagcagcagacgaagaaagccacgcgaaatccactcatgtaactgatggagtggactaatgcagtctagtatgcgacgatcaatctctgtacacccggtagaaaaagttcatgagcttcatggcagttagaatcaggattgagctgatattcatcccgcttgatgtgtagctagcattcttgtaactggaattgtgtgtgtaatgcaaatcatgggcgcattagactgtaatgaagaaaaagtcagggctgcgcctttagaatgcagcttgctcactttttgagtttagtactgagactggtgggcttgtttgttattggttggcagcaattggaactgtgacgacgtatattttcctttagaaaaaaaaaaaaaaaataaacttggtttccccg

SEQ ID NO: 10382 - DNA, 2513 bp, Zea mays
attccgctccacgctgccctgctctgctcccccagtcccccaccccaactggcgtcgccttccccggggaatgcgaccgcgcgccagagcatgccccgcccggagcccgcgctagggttccccgcccgcgcgtccaagccgccgccccagcgccgccgcaagaggcagccgccgacgaggcggaggcgaccggccggtgccgcaccggtggggccacgcggcgcggccgatccagatccggcgcactcctccccgctgctgcccctcccaagcggcggcagcggcttcgcctcgcggggcacggttgcgccagacgaggaagacgggagagacggagcgagctcggctgaatcgcaggaagtggcagaagcagcaaaccattcgttctcccactcactaagagagtgccagaagcagcggcgtctcaagtcagagaggtctgcactggcgcgcccgccggcctcgcatgagctcaacagcgctggaggtgttgagctgctagtgctctcgccgagatgcttgattggtaacccgggaggaatgagcaagagctcgacgacatcatcccggagcagatcaggcacaggcacgtttcccgagccctgggaccccgaactacaaccggcattgtgcaggcagcatgcagtactccaagggttggagttcagagcgcgtgccgctgggcactggtagcaatagacggtatgggggcagtggggttgtgcttccgtttaacaatgggaggaagctgccgtcgaaatgggaggacgcggagaagtggatcctaagtccggtttcctgtgatgggatgggaaggatgtctgcaccggctccgcatcatagacggcccaagtcgaagagcgggccccttggccatccagctggcattccgggggcttatgccgctgtctcaccgcttgttccttgctttgatggtgtgctggcagcagctaatttcgcagcacattcacctttctctgctggggttctcataccagagcacgggcgcattggcgacttcagcagtggaagagacagatgtggtgatgacggtagcagcagatcctactccgctgagaaagagtcctatatattaagatctgcaagcatacatgcatggacagaaacacttatggaggcatctgcttttgctaatatctcagaagaaaccgtacaagatgataaactgcaacgccagacagaagcaacttccatgatttccagtccaatcataaagaaagacatcggcacacagatgagtcctgaggatagtatatcttctccaaaagcgagacattcctgctccagtctgccttcagggcatctgataaaggaagcaaatagtcatatacctaaacctgaaattcgggacgtgcaggttgatgaccaagtaactgtgacccggtggtccaagcgacatgtaacacgaggctctgataagaggtcaacaaatattattgaatggaggaagaagactgttgaaacccgagctccatcttttgatgaaaaagaaagagaaggatgcattttaaggtgcaaaagggaggaagcaaagatcacagcttgggaaaatctacagaaagcaaaagcagaggcagctatccgtaagctggagatgaaacttgaaaagaaacggtcatcatcaatggacaaaattttaggcaaactccgctctgctcagaagaaagcacaagacatgcgaagtgtagtttcttctagtgaaggtcagtgtagtgtgagggcaaccaagaagacatcttcctctgtcaaaactggcaggcctttcagctgctgctttacctaccgtgcttgctagttgtgatacacagttggtgcctgtggatacagcaatggatataggtctattcggtgagtcccactggcatttgtattatgtgtaatttaacatctaaaactcacactagttcagcattaatgctttactgcttggaattttgtatttgggtaattttatcgaatttattaacttttaacctattatctcaatagtttctaatgctagaagtggctatctttctcaagacctcttctcaggcaacagttatggacgcgaagggaagtcagttgggttttgactacaaggcctaattgttaatgagatttgcactgatgaatgatatatcgttatggagcagcagacgaagaaagccacgcgaaatccactcatgtaactgatggagtggactaatgcagtctagtatgcgacgatcaatctctgtacacccggtagaaaaagttcatgagcttcatggcagttagaatcaggattgagctgatattcatcccgcttgatgtgtagctagcattcttgtaactggaattgtgtgtgtaatgcaaatcatgggcgcattagactgtaatgaagaaaaagtcagggctgcgcctttagaatgcagcttgctccaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 10383 - DNA, 2708 bp, Zea mays
ggaaatgcgaaaggcagccgaggccgcgagccgacgcacgcggctcgttgcttcctccatcccctttcctcacgccgacgccaaagtataccaacgaattcctcctcgggctcccacctaatcgtgttcgccgcctgcctctcccaaaccctagcaacccacgatcgaacccaaatccgctcctcccacccgaggaattatgcgaaattccccgagatcctagcccagcactagcagatcgatccatcgcttgcccacctgccggccaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctcccgcatccgcagccgcgacgcccagtggtacttcttcgcccgtctcgaccgcaaggtcgccggcgctggcgccgggggccggggcggtcccggcaacaggaccaaccgcgctacgccgagggggtactggaagaccacgggcaaggaccgcgaggtgcaccaccgcggcaagcccgtcgggatgaagaagacgctcgtcttccacgccgggagggcgcctaagggcgagaggaccaactgggtcatgcacgagtaccgcctcctcgatgcagacggacctcaggatctgcatgtggtttgtagaatcttccagaagcatgggtctggaccacagaacggtgcgcagtatggtgcaccatacatggaagaggaatgggaagaggatgatgatgctattgagaatggttctacccacgatgcatctggtcaaattgctgcaaccacctgtgctgtagatgaggagtcaaatgaggacgatgagaatgcatattgtgaaacaaacagacctgctcgagtagaaccatctcatctgccttcggtccatgaaatgctcaatccaccagagatggctcctctccaaggtcaagattctaaagagacaagcgatggaagttgttctgatgttgctatttctctggaagagattttgcaggaacctttgtcaaatattagtgtggagaatatgcatagacttgaagggcagaatgccactgatgataacatcagtgttgataacttgttatcagcatatcccacgaaagataatggctacgtaggccagtataacactatgaatgggagtgctccagcagatgaagctcacgcacgctggcctttgagaacatatagtaatcagaattatgtcaatggccctcttgctgatgagttctttgacacagggaatgataccaatggggttgcatattccaggcagcagcaagctgatggcttcccagcacctcgccaagttgatgaaagtatggtattttatgatgccccatctgattacaacttggtggatggaaaagatgacttcgtatatctgaacgacattctgaatgagccacttggaaatgaatcgctctttgatggagatgatatgatggcttactttgatgccacagagaatgatttcaagtatgacattttgggctctggtcagggtttggattatccacttgcagacatgccgttgaactttgcccaaaagagtgacaaggaagacaagtttacattcgaagggatctctgaggttccggaagcaaatcctcagtacggtgcatcctcatctggttcacatgaagatctgtatactgatactgaatttctaggtgtgccaacagatgacactgctgataaaacttacggaaatcgcctggccagcatgttaggctctatcccagctccacctgcaatggcctcagaattcccgccgtcaacagggaaatctgctgggatgctttcggctgtcagctcgagctcaattcgttttactgctggtatcatccaacttgatggcctcactttcagcagcggctccggtcagtggcccttgcagaagaatggagacttgagtttgcttgtctcttttgctgtggagggcgacgtggcatccaagctccctgttggtcttgggcgtgctactcggattagcaccgttcccatggtgctgcgcagtggtttttaccttttctttatgtcggccatgattctcttgtttagctacaaagtagggtcgtgtatctacagcaggtaagttgaagttgatggcgcctcttgtccggccagacctgtgggctgtttattttagttcaacacgtggatcattccctcagtgatgggggtatagcagtcgttcgacaccttttttacacatttaccattttgacctgtcaaaacatacagcaataaactttcgaactggtggtggtgatcatgccgggaccatgttctcgtcagggaaagcagtgcactgtgaatttggtgctctgctcttattattgtaaccaaaattaactgcaatatgttatattctgtcctgtagaggaaaagctattttatctggttattgtaaccaagattataccttggtgggttgctgtcaaagaaacaatggaaatatgattattatcaggccgtgttatttgctccaggccagataattaccatttgatcaacat

SEQ ID NO: 10384 - DNA, 1853 bp, Zea mays
tggttttattgtttttagaatatatttagacataatgtgtaccaagtatatctagaaaaaaatataagttagaataaagagaaaatacttgaataaaaaatcttgtttaaatctcatttttttaaacctaattcacattttttaaagatccacctgcatgaccttattgatgttcaaatgtcaagctagctagaattgccatgtacgttgtggcagcgagttcgaaaatgattagcaggacgccacgaatcacgctaaatttatttatcttctactgttccttggccggagatcgactcatcgcgtgctgccacgaatccaacacgcaaacccccaacgtgtcagccggctagatgcgacggctgactatttaaagcggtagatcgcgcggtcgcatcacggcatcgttgtccacgccgagtcgccgactgatcacttctcttccagcgagtacacacatcacacagcgaagggcagcgcatcgtgctgcggcggccggaggtgatcgacaagcacctctctaggaataataaataatggcgcagttggtggacaaggcgaaggggttcgtcgccgacaagctggccaacatccagaagccggaggcggagctggccgacgtcacggtggggcacgtgggccgcgatggcgccacgctggcggggcgcgtggacgtgcgcaacccgtactcgcacgccatcccggtgtgtgaggtgacctacacgctgcggagcgccgggcggacggtggcgtcagggacggtgcccgacccggggtcgctcgccggcgacggggctaccacgcgcctcgacgtgcccgtcaaggtgccctacgacttcctggttagcctcgccaaggacgccggcagggactgggacatcgattatgagatgcgtgtcgggctcaccgttgacctccccgtcgtcggcaaactcacgctgccgctcaccaagtccggcgagctcaagctccccaccctctccagcatcttctgatcgatcgatctgcgtgctgctcgctcgatccgtaactgcggccttgcgtgttcatgactgatctgcctactcgataatatgtaaaccgctctcttgagtgttgttgttgtgctgcttgagtagtacgagacctaataataataaactacagtgatgtgtattatgcaagtttcagaccaataaataataatacgaaaaagacgcgtctgcacattccactactgcattccgtccaaaaaaatattatggctatcaaaaaagaatttcaaatttgttttccaaggtgtcgacaaacaacatatttgactaaatatataaaaaatacaaacagtatgtatataaatattttgttttttcaataaacatgtcaaacttttcaagaaaaaagtaattctaaatttggaactgaaggcaaccttccttgtggatcactagtataatatgatcaaagttagaagagaaattggtcgtagtcgaggttaagatttgtttcagctctaaattatatgctaggctctctacagcttgacctccactaaaaatagctatggtttttggctaaccaactaaaaatagtcgaggttagcgaagaaaaatgtaggagccggtagaaaccaattatttcttctatttcttctagaatatcgtataagtaaaatgtataagtaaaatgtagaagctgatacaagccggttaaaatgcatgaagagatgatagaaaccgatttttaagtaaaatatgttggattaatgtggtaattaattttcaataatagttaatgctaacggtcaaatataatgctatgatgtactaataatttagtattaaattgacagttttaaagataaatcaatcaac

SEQ ID NO: 10385 - DNA, 3057 bp, Zea mays
cggaataaattctccgatatagatggagatgggagaaaaagctctcacgtgagagcattttcctttcctccccgtgggtatggggagccatttcctgttgccatcccgagtcaaaggtataccacgtaagaagaagggaaaaaaaaggcagacctgtcggttggtccggcggtggcagcgaagccgccctcacagtcacagctacttccccccccccgccgcgcgctgcggcgcggtgcggtgcggtggtgagtgacaggaaggatggaagaaggcttcaccggcggcgtccggatcgtgtccaggcgtctcgtccggccggagccgaccgcgagctcgccggccaacaacagcgcgccaccggaggaggaggaggatgagataatgcacatgacgccgtgggatctgcgcatgatcacggtggactacatccagaagggactgctcctgcccaagcccccggcagcaggcggggcgcacgcgcaccgactcgtggacggcctcgcctcgtccttcgcgcgcgccctggcccgcttccaccctctggccggccgcctcgccgtggatgccgccaccggcggcccgggcgtcgtcctcgcgcccccctgcagcggcgagggcgccgagttcgtccacgccgaggcgccggaggtcaccgtcagcgacatcatcacgccgcccgcaggccgttactacgtccccagcgcgctggtctggtcgctcttcccgctgaacgggctgctgggcacggacgccgccctggacgacgactcccgcgcccccctgctatcggcgcaggtcaccgagctcgccgacggcgtcttcgtcgccatgtcgctgaaccacgccgtgggcgacgggaccacgttctggcacctgttcaacacctggtcggagatcagccgggccggcggcgaggggcgcgaggcggagctctccacgccgcggccggtgctggacaggtggttcctcgacacctgcccggtccccatcgctctgccgctgcgcaagctggaggacatcgtccggcagcccgagtacccgccggtgcgggagtgcttcttcgacttccccgcggagagcgtgcggaagctcaaggcgaaggcgaacgccgagattgcggcgggaggcggcaccgcgccggccgccgtcgtgctgtcgtctctgcagtccctgttcgcgcacctgtggcgggcggtgtgccgggcccgggagctcgcgccgggcgcggagacggcgtaccttcttcccgtcgggtgccgcgcgagggtgcgaggcgtcccgcaggcgtacgtgggcaacgccgtgacgctcgccgtggcaaagtcgaccgccggcgaggtgctgggcggcgggctgggctgggcggcgttgctcttgaaccgcgccgtggcgtcgttcgacgaggcgggcgtgagggccgagctcgcggcgtgggcgcgcgaccctcggttcgcgtacgtggagccgcgcgggtacggcggcgccgcaacggtcgcgaccgggagctccccgcggttcgacgtctacggcaacgacttcgggtggggccggccgctggccgtccgcagcggcgccgggaacaagatggacgggaaggtgaccgtgtacgagggccgcggcggcgcgggcagcatggcgctggaggtgtgcctggagccccaggcgctcgccaggctcgtcgccgacgacgagttcatggaggctgtgactgtgagcgctgccgcgccgtgaatgccttgttaattataaacccagcgcatacttagttgtagactgcatatttatctttcagtttattgcatgcgtgtgagccccagtctgtggtgagccgcacgagtaggagggcgttacgagaatagctccgcacgaccctgagatggccggagttttagcagcatcgtgcgcatggggatggacatgcgaccaagcacgacgcaggctgaacacgactgttttctccttcgttgttctctgaataaaggaatagacaatatacagaaaacgctgccactttcagcagcacccaaaaaaacagcctctattcgtttttctttcgaagcgagattcagtgattgttccggttcacagaatcacgtcgtcggtgtacatcaccagaggacgaggtgcctaacattatggcatcagagctaggttgaaggagagagcacaccatcaagatggagtcacctccacgacgatcgccgccgcgccgaccgcgaacacgcgatgcacgccgcacgccgtcacgcggtccacgccatcagagggaggtcgtagtcgagcgcgtcatcagagagacgggcggctccggcaactggccacggcttacgaagacgaactacgacatatggtcgctgctgatgaaactgaagctgcgggcgtgccacctctcggacatcgtcgagttcggctccagcgacgacaacgactaccacgacgaccgcaccgcgctggaggccatctgctcgggagttccccaagagatggtgcccacccttgcgaccaaaccgatgaccaaggatgcttgggaggcgatcaaggccatgcgcgttggcgatgagcgcgtgcggaaatcgacggcgcggagtgttcgagccaagtacaagcagaccgtacttcgggagaacgagcagatcgaagatttcacccttcgactgaccaacctcgtgcaacgtctcgccatcctgggcgacccggagcctgaagacagggtggtggccaagtacctgcgaggctgcgagtcgcgtgttcgaggtacaagcagcttgtcatttctattgaaactctgctcgacatcagcacactgtccatcgaagaggtgacggggcgactcaaggctgcgacggacgatgagccgacggtgccatctcagtccttgtctgggaagctactgctcacggaggagcagtggttggagaggtacaagaagacagagactgcccacagtggctccaattcaggcgcgcgcggcagacatcgaggcaagccacgaggtcgaggtggagcaagaggttctgcaggcagagggaatgcaaaccccaagaaagcaggttc

SEQ ID NO: 10386 - DNA, 3623 bp, Zea mays
  misc_feature (2979)..(2979): n is a, c, g, or t
ggaccctcgaggctggcgggtccccgagaaaggcggcagagccggcaccaaaccaaactaattacctcttcccgcgacctcctcccccggcgtacctccggagatccaccccgacccaccaccgcgtgcctcggcaatggccgccgctccgaccaccgtaaccaagtccccgccgtccctggtcccgccggcggggcccacgccaggcggttccctcccgctctcctccatcgacaagactgccgccgtccgcgtctccgtcgacttcatccaggtcttccccgcccctacgtcggggaaggaggaccggagcccctcctccacgatcgcggctatgcgcgagggctttgccaaggcgctcgtgccgtactaccccgtcgccggccgcatcgccgagcccgttccgggggagcctgagattgagtgcacaggggaaggggtgtggttcgtggaggccgaggccagctgctccctcgaggaggcgcggaacctcgagcgcccgctgtgcatccccaaggaggagctgcttcctcgtccgccggccggggtgcgcgtggaggacaccctgctgctcgcgcaggttacaaagttcacatgtggtggatttgctgtgggcatttgcttcagtcacttggtgttcgatgggcagggtgctgcacaatttctgaaagcggtaggtgagatggctaggggcctccctgagccatcgatcaagccaatctgggctcgtgatgccatccccaacccacctaagccacccctaggtccgccgccgtcattcaccgcattcaactttgagaaatcagtcgttgagatctctctggacagcatcaagagtgtgaaggatcaggttgcaagtgaaaccaaccagaagtgttccactttcgacgtggtcacggccataatcttcaaatgccgcgccttggcagtcgacttcgcgcccgacgctgaggttcgcttgggcttcgcagccagcactcgccacctgctgagcaatgtgctgccctccgtcgaaggctactacgggaactgtgtgtacccaggtggtctcaccaagaccagccaggaggtgaaggaagcttcgcttgtggagatcgtgaccgcgatcagggaagccaaggaagctctgtcatcgaggttccttgactggttgagcggcggcgccaaggagaaccactacaacgtgtcgctagactatggcaccctcgtcgtgactgactggagccatgtgggcttcaacgaggtggactacgggttcggtgagccgagctacgtgttcaccctgaacgacgacgtgaacatcgtcccctccgttgtgtacctgaagccgcccaagccgaagcagggcatcaggctggtcctgcagtgcgtggaaggccatcactctgccgtgttcggcgaggagttgcagaagcatgcatagagtgagtgtattctacagtgggaatctgttgtattttatttgttgtgtcaaattgctgctcccggaatttgcttgcaataaggcagattggtcgtgtttatactttgtaccattatcagcacgttacattatacatgtgatgaatattgacagtgacgaaagaataataatgttcccatttggaacaaaatatttcagattcgttggcctgctgtaggttcctggtgtctcgagttttaacgtgtgtaactgtgttatgtataagtataactctgacagtgtttgatgattgatccccggcagaaaaaaaaaaaaaaaaaaaaaaaaaaaaaaaaaaaaaaaaaaacagacgtgaccagacaagcacttagcgaagaaaatgagctggagtgtcacatttgagatctgcaaagttcagaaattatctatagaaaacaactggtcatgcaaggtccactattccacaaccgcaaagccaccaacccttgtgcctttaggttttagattagcatggtgcatatgattgtgtaaaacccattgtatatagtttacaaatagaagatcaaaataattaagccgttagagatagcctaacagataacccggtgactcccaaattccaatccagcgttgagctcgtccaaacaactcaaacgaggccgcagccgacagcaatctccgctcctcttattacttccggtgagcacctccgcttctcgcacccgagttttttttgttgttgcaattttgccactcgtagtgttgtctcttcgatattagactgtctctagtaatcacgataaaataagagacatgtaactatagatgacattgtttgacaccgtttatatagtaaattttaaaatagatgaagataggagaagagacagtggagatagccttatgccatccatatttatgatccgtgagtccgtacgtgtcaataatttgtaagtttggtgtcaaattagggaaacccacgattaataatggtaacggggaattctttatcagggaatggctcccaaacactcatatatgagttttttctctcactccgatctcgtaggaaatttattctcgtgggaaatctatcatcttcagaaaatgcaacacttagaggcaaaatcaaattgagtatatcaaatcaatataaactgaacaaacaaaatttaaaataacaagagagatctactttagattttaatttactattttataatagtttatgtattgagtttttagtataattttaacatgtcaatgaactaatttaggtaaagagaaacttgtggggcggatacgcgaaaaacggggacgaatccaaggaggactaaattttttttgttacattcaccctttggactaaattacccttatcctcgtcctctaaccgagaaattgtcctctagaaatcttggattgaatcctcattgccatctctactcgcacccaccgctccgctccaccagccgacgctgtcatgtctgtcgccgcccaacaccttaatgaaatcggcttcgtagcttgttaagccagacaacataattttcacntccgctgacatcaatccatccgccacaaagaaaacataccaaagagaaatatattgtaactaaatctaaagatttagggtctgtttggttcgcggctaactacgtcacatgttgcttgagattagtcgactgaattgaagaactaaccttagttagaaaaattaaacaaagtgtgacaagttagacgtgtctcaaatttagatgtatatggtgtccacctactaaccgaaggacttcaccattcgaaataaacatagcaacctttggaaacacaggattcagaaatttttccttcgttccaaatgggacctttggagttggtgagatggtgatcatcatttataggtaaaatttatttatcaaattccttagaaaaaggtataaattacccctctcacctatggacgatgttcgtataacctcctaaactatttttcgttcaaattaccttccgtatgtttgagttgattcaatctatcacttaacaatatttttctttttatttatttatttatttatgtacaaactaagttttctatttaaaatttgttggttagtagataatgtcacaacctagcctaaataaatatattatgatttttcaaaattattttgatggggttaaggatcatataataatttta

SEQ ID NO: 10387 - DNA, 1678 bp, Zea mays
attgggtacctcgaggccggggggttcgccaaagtctgaaattaagctgggacaccggctcccgcaccaaaccaaatcacctgttcccgcgacctcctccccggcgtacctccagtctccagagatccacacgaccacaccgacccaccaccatctgcatcggcaatggacgccgcgccacccaccataaccaagtccccgccgtccctggttccaccagcggggcccactcccggtggttccctcccgctctcctccatcgacaagaccgccgccgtccgtgtctccgtcgacttcatccaggtcttccccgcccctacgtcggggaaggaggactggagcccctcatctgcgatcgcggccatgcgcgagggctttgccagggcgctcgtgccgtactaccctatcgccggccgcatcgccgagcccgtgcctggtgagcctgagattgagtgcacgggggaaggggtgtggttcgtggaggctgaggcaagctgctccctcgaggaggcgcgtaacctcgagcgcccgctgtgcatcccgaaggaggagctgctcccgcgtccgccggccggtgtgcgcgtggaggacaccctgctgctcgcgcaggttacaaagttcacatgtggtgggttttctgtgggcatttgcttcagtcacttggtgttcgacgggcagggtgctgcgcaatttctgaaagcagttggtgagatggctaggggcctccctgagccatcgatcaagccaatctgggctcgtgatgccatccccaacccacctaagccacccctaggcccgccaccgtcattcaccgcattcaacttcgagaaatcagtcgtcgagatcgctctggacagcatcaagcgcgtgaaggatcaagttgcaagcgaaaccaaccagaagtgttccactttcgacgtggtcaccgccatgatcttcaaatgtcgcgccttggcagtcgacttcgcacctgacgctgaggttcgcctgggctttgcagccagcactcgccacctgctgagcaatgtgctgccctccgtcgatggctactacgggaactgtgtgtacccaggtggtctcaccaagaccagccaggaggtgaaggaagcttcactggtggagatcgtgaccgcgatcagggaggccaaggaggctctgtcgtcgaggttcctcgactggttgagcggcggcgccaaggagaaccactacaacgtgtcgctggactacggcaccctcgtcgtgaccgactggagccacgtgggtttcaacgacgttgactacgggttcggtgagccaagctacgtgttcaccctgaacgacgacgtgaacatcgttccctccgttgtgtacctgaagcctcccaagccgaagcagggcatcaggctggtgctgcagtgcgtggaagggcggcactctgccgtgttcagcgaggagctgcagaagcacgcatagagcgagtgtattccatcccacagtggagattgttgtattttgttgtgtcgaattgctgcccccggaatttgcttgcaataagatagggttggcacgtgtttatactctgtactgttatctcagcacgttacattatacatgtattgagtgagtattgacagtggtgaaagaataatagtgttccatttgaaacaaattatttcaaaaaaaatggccccaagggccg

SEQ ID NO: 10388 - DNA, 2081 bp, Zea mays
  misc_feature (1809)..(1809): n is a, c, g, or t
  misc_feature (1812)..(1812): n is a, c, g, or t
  misc_feature (1816)..(1816): n is a, c, g, or t
  misc_feature (1828)..(1828): n is a, c, g, or t
  misc_feature (1834)..(1834): n is a, c, g, or t
  misc_feature (1847)..(1847): n is a, c, g, or t
  misc_feature (1887)..(1887): n is a, c, g, or t
  misc_feature (1918)..(1918): n is a, c, g, or t
  misc_feature (1952)..(1952): n is a, c, g, or t
  misc_feature (1958)..(1958): n is a, c, g, or t
  misc_feature (1987)..(1987): n is a, c, g, or t
  misc_feature (2072)..(2072): n is a, c, g, or t
cttgtgtccagtcggggtgggagttgggctcgtgcagtggcagtgcagtgcactgcaggtgcagtcttgctcgcctgtcttcctcggcaccgggacagcggacctccaccgcaactgggccatctgttctccttcctcctcttcctccgccaccgcgcttctgaggaggctagggcgatgcaaccgcttccgctttgttattagcaaagggaaccgtccgagaacgggcagccaattctccgatgccgtccgctatggccaaatccctcctcctccctcaccctttcttctccgtctcaccccgcccacaccctcatccgcgcgccggattccctgttctcaagccccgccgcgccgcgctgctcgcggccacgcccgcgccggacgccaacaccagctccaacaacaaccccctcgccgcgctctggcgccgcaccctgcagcccctcggcgactacggcttcggcaagcgcagcgtctgggagggcggcgtcggcctcttcatggtctccggggccgccctcctcgccctcgccctcgcatggctcaggggattccagctccgctcccgctttcgcaagtacaacaccgtcttcgagttcacgcaggcgtgcggcatctgcgtcggcacgcccgtccggatacgaggggtcaccgtcggatccgtcgtccgcgtcgactcctcccttaggagcatcgatgcaactgtcgaggttgaagatgataaaatcatcataccacgaaattcaatggtcgaggtgaatcagtccggtcttctaatggagacactcattgatatcacaccaaaggatccactgcctgcaccttcagtaggaccacttgacccagactgcaccaaagaaggcttgattctctgtgacaaagagaggatgaaaggacagcaaggtgtaagcttagatgcattggtgggaatatttacccgtctgggtagagacatggaggagattggtgttagcaaaagctataagttagctgaaaaagttgcatctataatggaagaagcacaacctcttcttacacggattgaggctttagctgaagaaatgcaacctttgctctctgaggttaatgatagtgatctgctgaaggatgtggagactatagctaaaggcctggccgacgcgtctggtgacctaagaaggctgaagtcgtccatgcttaccccagagaacacagatcttattaagcagtctattttcacccttatatttaccctaaagaacattgagagtatcagctccgacatctctggtttcacgggcgatgagacgacaaggcggaacatcaaacttctgatcaagtctctcagcaggctattgtgattggtgtgcataatgatggattgctttgcatgggacggggaatggggaaatggttgctggtggggggtctctcggtctcggtggcacagaggtaggaagagaaggcatagctaattaacgttccacgaggttttggttattctgcttctaagtttccgaaaatttcttgaatgaacaatcttgaaacaacatcaaaagagcagtcatgaggggagagatcggtctccctccctccttgttgagctgttggtacttggtagacccatttttttacgtcaaataaaataaaatcaattgcatgctaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaatattttcctatcccgccaaccctcgagggggggcccggaacccaattcccccaaaagggagccaaatnacncgcnctcctgggccgncttttnaaaacgccgggangggaaaaacccgggggttacccaattaaatcgctttgaanaaaatccccttttccccagttggggaaaaanaaaaaaggccccccccaatcccctttcccaaaanttgccnaccctgaaggggaaaggaaaattgaaagngtaaaaattttgtaaaaattcgcgtaaaatttttgtaaaaccagcttctttttttaaaccaaaaggccaaaatcggaaaaatccnttataattc

SEQ ID NO: 10389 - DNA, 949 bp, Zea mays
accacgcgttcgtccacgcgtccgtagtcgggtcttctaatggagacactcattggtgtcacacccaaggatccactctatgtaccttcattaggaccacttgacccatactgcaccaaagaaggtttgattctatgtgacaaagataggatgataggacgtcattgtatttgcttagattcattggtggtaatatgtacccgactaggtagagacatgtaggagattgtcgttagcaaaagctataagttggctgaaaaggtttcatctataatggaagagacacaacctcttcttacacggattgaggatttagctgaagaaatgcgcccgaggctctctgaagtcggtgatagtgatctgctgaaggatgtggagactatagctaaaggcctggccgacgcgtctgttgacctaagaaggctgaagtcgtccatgctcaccccagagaacacggatcttattaagcagtctattttcacccttatatttaccctgaagaacattgagagtatcagctcggacatctctgggttcacgggggatgagacgacaaggcagaacatcaagcttctgatcaagtctctcagcaggctattatgattgtttttcaatgtgcagaacagaatgatggattgctttgctttgctttgtttgagacaggaaatgatgctggtagagtagggtgactgtgtgtgtgtctcggtggcacagaggtgtaggaagagtagcagctaattaatgttccacaaggttttggttattctggtaacaagtttctttttttttcttttttctttttaaaaaaactcagatcagtattgagctgttgtaggtcatatagtaggcccatttttcatcagttgatggatcgcccttgttggctgcctgagcaaatgcgcaaccgattgtttcaaaaaaaaaaagaaaaactcggggggggccggca

SEQ ID NO: 10390 - DNA, 1566 bp, Zea mays
gacggtgccgcaccgcccgcccgttttcttcctcagcgccggcacggcggcgcccccgcgccgccgcaactgagccatctcttctccttcctcctccgcgcttctgaatgtgaggaggcttacaacgcccggtcccccctaaatccaaatccagcttccgctttgcagggcacgacccccttcgcaactgactgagtccaaatccaaatccagttaccccactcaacctcttttgatttgatttcgcaggatccatccgagaacaagcagccacttctccgatgccgtcctcaatggccaaatccctcctcctccctccccagttcgtctccgtctcaccccgccacccccaccgcgccggattccccgtcctcaagccccgccgcgcctcgctgctggcagccaccggtggagacgtcacgcccgcgccggacgccgacaacggctccaacaccaaccctctcgtcgaggtgccccgcgcgctctggcgccgcaccctgcagcctctcggcgactatggcttcggcaagcgcagcgtctgggagggcggcgtcggtctcttcatggtctccggggccgccctcctcgccctcgccctcgcatggcttaggggattccagctccgctcccgcttccgcaagtacaacaccgtcttcgagttcacgcaggcgtgtggcatctgcgtcggcacgcccgtccggatacgaggggtcaccgtcggctccgtcgtccgcgtcgactcctccctcaggagcgtcgatgccaccgttgaggttggagatgataagatcatcataccacggaattcagtggtcgaggttaatcagtcgggtcttctaatggagacactcattgatatcacacccaaggatccactccctgcaccttcagtaggaccacttgacccagactgcaccaaagaaggtttgattctctgtgacaaagagaggatgaaaggacagcaaggtgtaagcttagatgcattggtgggaatatttacccgactaggtagagacatggaggagattggcgttagcaaaagctataagttggctgaaaaggttgcatctataatggaagaggcacaacctcttcttacacggattgaggatttagctgaagaaatgcaacctttgctctctgaagtccgtgatagtgatctgctgaaggatgtggagactatagctaaaggcctggccgacgcgtctgttgacctaagaaggctgaagtcgtccatgctcaccccagagaacacggatcttattaagcagtctattttcacccttatatttaccctgaagaacattgagagtatcagctcggacatctctgggttcacgggtgatgagacgacaaggcagaacatcaagcttctgatcaagtctctcagcaggctattatgattgtttttcaatgtgcagaacagaatgatggattgctttgctttgctttgctttgtttgagacaggaattgatgctggtagagtagggtgactgtgtgtgtcttggtggcacagaggtgtaggaagagtagcagctaattaatgttccccaaggttttggttt

SEQ ID NO: 10391 - DNA, 2530 bp, Zea mays
aaaaacttggattgagtagggtgggttggtcggaagtccgacggccgcgccgccgcgcgagacggtgccgcaccgcccgcccgttttcttcctcagcgccggcacggcggcacatccactccaccgcaactgagccatctcttctccttcctcctccgcgcttctgaatgatccatccgagaacgagcggccacttctccgatgccgtcctcaatggccaaatccctcctcctccctccccagttcgtctccgtctcaccccgccacccccaccgcgccggattccccgtcctcaagccccgccgcgcctcgctgctggccgccaccggcggagacgtcacgcccccgccggacgccgacagcggctccaacaccaaccctctcgtcgatgtgccccgcgcgctctggcgccgcaccctgcagcctctcggcgactacggcttcggcaagcgcagcgtctgggagggcggcgtcggcctcttcatggtctccggggccgccctcctcgccctcgccctcgcatggcttaggggattccagctccgctcccgcttccgcaagtacaacaccgtcttcgagttcacgcaggcgtgtggcatctgcgtcggcacgcccgtccggatacgaggggtcaccgtcggctccgtcgtccgcgtcgactcctccctcaggagcatcgatgccaccgttgaggttggagatgataagatcatcataccacggaattcagtggtcgaggtgaatcagtcgggtcttctaatggagacactcattgatatcacacccaaggatccactccctgcaccttcagtaggaccacttgacccagactgcaccaaagaaggtttgattctctgtgacaaagagaggatgaaaggacagcaaggtgtaagcttagatgcattggtgggaatatttacccgactaggtagagacatggaggagattggcgttagcaaaagctataagttggctgaaaaggttgcatctataatggaagaggcacaacctcttcttacacggattgaggatttagctgaagaaatgcaacctttgctctctgaagtccgtgatagtgatctgctgaaggatgtggagactatagctaaaggcctggccgacgcgtctgttgacctaagaaggctgaagtcgtccatgctcaccccagagaacacggatcttattaagcagtctattttcacccttatatttaccctgaagaacattgagagtatcagctcggacatctctgggttcacgggtgatgagacgacaaggcagaacatcaagcttctgatcaagtctctcagcaggctattatgattgtttttcaatgtgcagaacagaatgatggattgctttgctttgctttgctttgtttgagacaggaattgatgctggtagagtagggtgactgtgtgtgtcttggtggcacagaggtgtaggaagagtagcagctaattaatgttccacaaggttttggttattctggtaacaagtttttttttcttttttctttttttttaaaaaaaaaactcggatcagtattgagctgttgtaggtcatatagtaggcccatttttcatcagctgatggatcgcccttgttggctgcctgagcaaatgcgcaactgattgtttctgttgtggattggtgcaacttgcaaatgattgaagcttatgacgaggccgtggggatggtgtaggcgatcgatcttaaacgccgaagcatgcacagatgcaggagtggaagcagccgagctggaatgatgatgaagtgcaggggtagacattttaaaaccgaaacctgaattcgaatagaccgaattatcgatctattctgtttttcgggttcgattcatatatatatgctatattttaggatatgggttcagttcctaacctttaaaatccgaataacccgaaatataaaaaaagcttttaatatgtgatggtattattatgtgatttatgaacttattaactaaaaatcatgatatcatatgtatatatgtatgttatttttttagtcacttgttgtaataatagtactttcaattaattaattattgtatatattataataaaaaataatagtctctactattcgggtctattcaatgaaccgaatagaccgaactaaaattgtgaatctattcggatttggtttctaaaattattttaaaatttttggttcttattttttgaacctaaaatttcataaacccgaataaatttcacaaacttgaatagaccgaaccgaattacccctaatagacgatctagctctaatgaagtggtcatctggatctaatgcatggtctactgtttcttgcatcctggactcgacagatagaagattagatggacaagatcacaagacaagatccgcagttccgcacaatgcaatgtagggtccccaaatcaatatattccaccctacacaattacaaaccgatttttttgcaatttagtttttttcgaaacaatttcatgtttgaacatttaaatgacttaatgtcattttaaac

SEQ ID NO: 10392 - DNA, 4633 bp, Zea mays
  misc_feature (289)..(289): n is a, c, g, or t
  misc_feature (857)..(857): n is a, c, g, or t
aacgcacctaaacctacatcagtgtacttatatgtctagtaatcaaaataaaagaggtctcaggcgctcaagataactttctctacaattttcttcaaaacatggagtgtggcgtaattcttgtgtgtgctgtgtgcaccgtccggacgagcttgctatggaataattgtactagctagtacggcgatatgggacccttgatttaatttattggagccccaggtttggcattgccaaattaaaggtcaaaaagagcagcattttcttattagaattagcatgatcgagncggcctactttattgtggatagaacttagagctaaggatcgagttaataaagtctagaactaaggtcccgtcttgccaggaattgaatgtcgtgtaccagagcattagagttgaagaagccataaatcgacttcattgagggtgtcggtacaagcaccgcgtaatcacgaagatatactgtacagtgttttctttttgggctcttcgtttggcactcaatgttctacgtattgttcgatcgagcctaatatttgagcccctttaaatcgatattactaattgttttctttgaaactatgttatatttaatagtctacagctataaattttttagtattatattagtcagttcagggcagaactcttttctggatactgtagctgctcgccaatcaaaactcccttgcagcagagtttaaaaacgcagggtggcccaccgagaacacagcaggagcaccgagggccctagaaagaaaaaaaaggagaaacgggtacgtagctcgttttgcacgaacgtctgttggagttcaccgatcgtcagagtcagggtacgtagctcgttttcccncctatctctgttgattattctgatgtatttgacgatctaaaatccaatcggatagaagaatggacgtacgtacttgtagtcttttacgtgctgaagaaactggtgatatggttgctggtaaaaccggcgcggcgtgcgtacgctagcctgcaagcagcaaagaagctgcacgccacctcctgactcgtcgcgtctgcgtccaacatgacaacttgtagtcttttctttttttcttttgtaggtgcgagaaaacgagacctgtgtatagtaacataaagccatcaattttttttatataacacaagatacgtcatggaaattaaaggaaaagttgaacacccttttctattgataaataattgcatggtggtaatgtgcatgcatggtaccgcacacactcggctgtttggtttcttggctaagagcgtctccaacaaacgtgtagtgtaaaaacgatctataatttaaaaatgagtagatgttatatgatataaggtatcaataaaatattctgctctaacattaaaaccctcaatttagattatagagcagcttactacggtgtagtatatttgagttatttgagatggtgctctatatgtgttgataacattgttggaatagttttgctgtacagatctctatattcaatttaagacacgagtttaaggtactgttaaagatgctctaacgccacaacatgtctaaacttaatcgcttgtattgaacaagtaatcttagacagaaaagtaagttagacaagaaacaaacagcccatcaggctagaattggccctccccagtacggcttttaccgacggcgacgaggcagcccaaacccatgttcgccacagctcattattcttattcattaatgatgtcgcggcgcccggcctgacggttctgaattttgcgcccaattattagcggccgggactagatgattgattggcacgtatcagcagtccttgatgatcgttcttgaaaggaaccagttgttgatcaagcttgcaaatggcgacagtgacacgagcagagcagacgaggcgatgggattgcgggacgtcctcatgacctcatctcgcgtagtagaatacaactcttgtaatgcatgatgaagcgagtatgccgagttcattgacgactgtgctagtttggcagtgagggcctgtggcagaggcgcagagcagagaagaggagaggagagcggagcaggggcttctggctgtgtcctgtccctctccggcgccggccgggaatagaaggaccttgccccggaacaacgggaaccgttcgaagcatccgcattcgcggcagattccccaaatcttgccccgctgtagcggagccggagcgggctcagattctggtcccaagaagcatccatggcagaagcacccggcaagcagtggcaccagcgtgacagttcaggctccggcagcctgtagtgtagggtttctctgaaaaaaggaaggggcctcagaatgaggggagaaactgtgggagaggacgcggcgtgctgcgcatgcagtagcagcggatggcaagcgctgcatggcgttgggatgggatgggcggcgaagccatggaggggcgggctggaggtggagcagctagcaggtaggtagacgagcagggacaagatgatgagcgagcgcgacggtgcgtggcatttggcattggcatggggccgccgaggcatttggtggcctggtggggggtgggggcggcaaccgcaggcacagcacggccgcgtgggacggacatgtggactgctcgcctcttttggtgccgcgccagaatgccagatggacgggaacaagccgtagagcggctggccggctggcctgggactgggaaagtcccacgcaccgtcccggcgtccccggcctcaggctcaggtcacactgccaacgagaaggcaggcactgccggtgccctccgggatccaggctcgatctgagctgctgatccagagtcaagctgcagctgcgtaccgtgcctgctacatggagcacggagtgggggaccgctccacagcaggcagtgtgtgtgtgtcacagctgagaggtggagacctgtcacccgccgccactagctactccggtagtctgccctgcttctgtagcacagtcggccactgctcactccgcttcgcaccaacgctacctccgcgctctgcatctcctctccactcctgctatttagcgccgccctgcgcctcccactcccgaattcccctgcgcctctcacctccctgctcgaatccagcgctcacccgcgccgcgtcgagacatgtcgaaggtgagccctgccctcctcttgtccattcatatcggtggcatgcatcgcgcggcggccccccgttcatctccgtgcattgcattcctctcatcttttcgaagccggtagaggaagcggatgactaaactaaccgtatgtgtgccatggccatgaacgtgcagaaaatcgtggtgaagctggacctgcacgacaacaaggacaagcagaaggcgctgaaggccatctccgtgctcgtcggtacgtatcgtatcacagttaattaacagcggacgactgagcttccgtttcccgcgcccaccatccatcatccatcctcccccacccaggcatcgacgccgtgtcggtggacatggcggcgcacaagatgacggtgatcgggacggtggacccggtgcaggtggtgagcaagctgcgcagcaagtcgtgggcggcgcacatcgactccgtcgggccggccaaggagcccgagaagaaggaggagaagaaggacggcggcggcgagaagaaggacggcggcggtggcgagggcaagaaggaggaaggggacgggaagaaggacggcggcggcggtggcgacggcaagaaagacggcgagggcaagaaggaggacggcgacggcaagaagcaggacggcgagggcaagaaggaggatggcgatggcaagaaggacgacaagaaggacggcggcggcggcggcgcagaggagaagaagcccgccgccgcggtgcccccgattttgccgttcccgccgctgcaccagctgccgccgcagtacatgcacatgatcaccaacgactacatgagccagtaccaccaccgccccccgccgccgccgcccgtggcgtaccacccgtacgcggcgccgcccccgccgcccccgcagtactactacgtgcgcaacatgagcatggaggagaacccaaactcgtgcgccatctgctgaagcaatcgatcccggccgctttgtctctcgcgtcgcgcgcgcgaacgtgagtacgtactacgtgtctcccggcccggcccggcccgtccatcagtccatgtgtacatccgtcgtcgtgttacgttattattacgatgagaagaaaagacgaatcaaactagctactcgtagcttttattattttgtgagtcaaaagtccaaaccgtatagctgccagttcgtgaatgaatctgtaactaaattctccctggcggtctttgggtggtgttggtggtcgtcgcagtgcgtgcatcgatctgcatcatcatcttctctcttttttttcctgctctgaagaagcaacgagatgaacgaacggatggatggatgggagccagaaacagaaagagagggagagggtgatgggtcagaacagaggagagagccttggaagggaggaggaatatgcttgcggtgcagcgtgatcgttggcgggcgacgcaagcacgcatgtgggcgctgcacgaaccctgcaggtcgactttaaagga

SEQ ID NO: 10393 - DNA, 1362 bp, Zea mays
  misc_feature (79)..(79): n is a, c, g, or t
ggggcgacccacgcgtgcgggacgcgtgggccgcgctctgcatcttctctccactcctgctatttagcgccggcctgcncctggaattcccctgcgcctctcacctccctgctcgaatccagcgctcacccgcgccgcgtcgagacatgtcgaagaaaatcgtggtgaagctggacctgcacgacaacaaggacaagcagaaggcgctgaaggccatctccgtgctcgtcggcatcgacgccgtgtcggtggacatggcggcgcacaagatgacggtgatcgggacggtggacccggtgcaggtggtgagcaagctgcgcagcaagtcgtgggcggcgcacatcgactccgtcgggccggccaaggagcccgagaagaaggaggagaagaaggacggcggcggcgagaagaaggacggcggcggtggcgagggcaagaaggaggaaggggacgggaagaaggacggcggcggcggtggcgacggcaagaaagacggcgagggcaagaaggaggacggcgacggcaagaagcaggacggcgagggcaagaaggaggatggcgatggcaagaaggacgacaagaaggacggcggcggcggcggcgcagaggagaagaagcccgccgccgcggtgcccccgattttgccgttcccgccgctgcaccagctgccgccgcagtacatgcacatgatcaccaacgactacatgagccagtaccaccaccgccccccgccgccgccgcccgtggcgtaccacccgtacgcggcgccgcccccgccgcccccgcagtactactacgtgcgcaacatgagcatggaggagaacccaaactcgtgcgccatctgctgaagcaatcgatcccggccgctttgtctctcgcgtcgcgcgcgcgaacgtgagtacgtacgtgtctcccggcccgccccgtccatcagtccatgtgtacatccgtcgtcgtgttacgttattattacgatgagaagacagacgaatcaaactagctactcgtagcttttattattttgtgagtcaaaagtccaaaccgtatagctgccagttcgtgaatgaatctgtaactgcattctccgtgacggtctttgggtggtgttggtggtcgtcgcagtgcgtgcatcgatctgcatcatcatcttctctcttttttttcctgctctgaagaagcaacgagatgaacgaacggatggatggatgggagccagaaacagaaagagagggagagggtgatgggtcagaactgagagagccttggaagggaggaggaatatgcttgcggtgcagcgtgatcgttggcgggcgacgcaagcacgcatgtgggcgctgcgcgaaccctgcaggtagactctag

SEQ ID NO: 10394 - DNA, 1576 bp, Zea mays
aaatttgtttaaatttgagattaatttgacttttaaaattagaatgatttgtaagttaggaggtgggagtagtatataaactgcagctgcagtactgtctcactttctgtctgtaatgtgaaactgtcgtcttctcgcgcggagcgtctagctattgtgccaatcttcaaatacaatcgccacggctcatccatttgccgccacaaatctgataaccaccacgccatcatcgcgctaccagggtcgacatggatcccgacgcagaggtcacgttcgagttcgtccccgtgatccggcagtacaagagcggccgtgtggagcgcctgctccccgtcaatccggtcccaccctccgtcgacgccgccaccggggtcgcctctaaggacgtcaccgttgacaaggccacgggcctgtgggcgcgcctctacctcccagacccagatctatccgcgcgccccgacggcgacatgcgtctccctatcgtcctctacttccacggcgggggcctcgtggtcggatccgcggccgacgcccccgagcacgccttcgtgaaccgcctcgcagcgcgggccggcgcgctcgccgtgtccgtggagtaccgcctggcgccggagcaccccgtccccgcctgctacgacgacgcctgggccgcgctccggtgggtggtggcgccggcggccgacccgtgggtccgcgaccacggcgacgtggcgcgcgtgttcgtgctcgggttcagcgccggcgggaacctcgcgcacaacctcaccctccgcgccggctcggagccggacctcctcccccgcggcgcccgggtgcaggggatggcgctgctgcacccgttcttcctgtcgccgccggcgccgggaagcgaggccgcggagggcgaggtagcgaagtacgcgtgggtgcgcgccaagctggcggagatgtgggcgttcgcgtgcggcgggtggacggcggggcccgacgacccgcgcgtgaacccactcgtggacggcgcggccagccttaggcgccttgggtgcgcccgggtcctcgtgtgcctcgcggatgacgcgctggctgctgagggcaaggcctactacgatggcctgctggcgagcgggtgggcggcggcggacgccaagctgctggactccgcgcccgcggaccacgagttccacctccgcgagcccgagagcgccaaggcggtgctcctcatggaccggctggctgcgctcatctccgggaactagcagtagcagtagagtcacacgcacgtcaacggagctgacgcaagagcgtacgtgcacttgctgccattgatgtactggaattggtcaaacaattccaagttctaatcggaacgatataaaatgctgacctataataaagaacttattctcagttcaggccgtcttcagccgatctcatcctcgtcttcaaattttacttgactgaaacagtgcgtctctattttattctatccaccgaaaacaatcttagctgatagaacgcgtgtacaaatgaaaccactacatgctaacgatagtgcacgtgcgttagggtgggtattgaaggtttcttctcccatcga

SEQ ID NO: 10395 - DNA, 1842 bp, Zea mays
aactcagtctggtgattatttaaaattcatcaatcgcgcaaaagcgaatttaaaaatttagttcagccctctgaattcatcccaaataaaataaatttattagaattcgacgattaaaatgttcagtgcaaaataatctgaatcgcgcatggtccaagagaaatcttgcgcgagattgataatcatgagttaattggtagtaaatcattcaaagcagaaccaagctaactagagtcgaaatcaaataattgctaatcaggtcgatttcaatagggatcagccgcacagtaaaatgtcgaatccgatgtagtctggttcggtccgtttacatcgtgcccaggataatcacaaaaattatccaaacgagatttagccaaaaccgtataaactgttattcctctgattttccgtttcatgattcggaaaatgaaacgtgtagccgtatagcgcgttgacccattatacatcgctaaaaactcctaattcaaaatatctgcaattttatttataaaataaataggaaagtggaaaatctaaaaaaaatccgtctcctctcatccttatcccgtcgttttctctctctctctctgatattttccaccgctctctctgttatcctggccgatggccttcgaacagagccaccattgcttggctcatcctccccgacgttgctctctctctctctctctctcccggtgctctgctggccgccgcgcccctggtcccggccccagcttggcctcctccccatgccgctcggccgcccatctccctgctgccgctctcccatggcgcgcccctggtccttgctcctagctcgcctgcgctcggcctccagctccagctcgccgagtccctctctgtctgcgccatggagctcgcccggccgcgacctcgccttgcttcctgttgcgctcctccttcagcgtctctcccatggcgccggccaccctcacctctgctcctctgcgctgccgttctctgcgcccggacatggagctccctcatccgcgattccctgtgctagcgtgtactctctccatggcgcccagcccccagctcggatctcgcccgaccccaagcggagctccatccctggccgccgtgtgcccctgcgctcggcctcctctccattttttctagccaagcccagccaaggttcctccctgcgcgcgcgagctctattgcgagcgccgatctgtacctacaaagcctcgccagtgaagtctgtcgttgttctctggttcgagctcaccctagccatagctcctcatcgtgtgcctccacgccggtgctcgactggctcgacgatgaccctatcgtcgccctgctgttcgtgctccatttccgcagcactgctctttgtcatggccgttagaccgccgttgatctagccgtcgtagctcctctgtcacggttgatcttggtttcctccgtgccaccgaccgtcgacctcgtcgttgcttcacagcgcttggacaccgctgtcattgctcagccatgctatgggcacggacgctttacttcctcgccactgcatcaccatttgctgtaggagagaaagactctaggaccttttggtggaaaggagaagaaagctcatgcgtcgctcgcgaggtgctcgaagtaatgccggaattggaaatcatgattgtgttcatggaatcatggccttcgagacggattaatttattactgagctatcgtcgctctcgctcttcgttttaatatttctcatcaatttggtacgtttgcgctgtcctggtgggccggtgacgtatatgtaaatcgcagtagtgtgatttcgtatgacgctcgataggtttcggcgatttaggg

SEQ ID NO: 10396 - DNA, 2485 bp, Zea mays
gaaggtatagaattaatgaaggaaatacatgcaggcctgtgtggatctcacattggatctaggcccttgctcgggaaagtttttcgccaaggattttattggccaaaggcagcttcggatgcagcggatatagtccaaaagtgcgaaggttgtcagaaatgtgcaagggatcaaaaacagccttcgtctttaactcaattaatacaacccacttggccgttgcagaggtggggccttgatttgctaggcccattaccaccagcacaggggaacttaagatatgtggtagtggcagtggagtatttttccaaatggattcaggcaaagcccttagccacaataacttcatttactattcaaaagtttttctggcagaacattgtttgtcgcttcggagtgccgaaggccattattgtggacaatgggacacagtttgattctgaagccttcatagaattttgtgatcaaattggcacgaagatccattttgcatcagttcgacacccagagtcaaatggacttgtcgaaagagctaatgggatcataattgttgggggccttcgtcctccgaaggtcctcaaaaacatgatttgacaatgttttccaagtggattatgtgaacaggtaccttcggactcagaattacgaacatgaagtgcggtcaggacgaagcctgaaccagacgaaggacgggctgattaccaagctccacgaaggatggtgcacagccgaagctgtgcgcagggaagcttcgtcgcgatagcagagaggggaaccgacttaaagatgaaaagactacgtgggccttgtcagatttccataagtcattgacaaatgtaatggacataaatgtaattttacgtgggctgcgtcccgcgtctataaatagatgaacagtactcccgtactgttcacgctgacttggcatttgcttttgcgtcacgcttgtactttttatcttctctcaggaccgaaggtacatttgtaatttgaaatcatttctatttttccatgtcaataaaatagaaatgattctatgatgatgcttatattatatttcatgctttatatgaatccttcgtcattacttgttatgtttacgaaggtatgtctcttatgaccttcgtccgaaactcattatttcccgaagggacataatgcttcgaaggacgaaggactttaacacttaacactttttatgttgccttgttcttaactcttagcatttgagaacaagtccccaacattggcgcccacctccggtgaactcacttccacttcgagttttttgaacaccttcggaagctatagaccctcgctatggcgccgaagaaagcttcagcgactggggctgcagcactgcaaccgctggaccccaaccaggagaccgtctctctccgggaggcccgaaaccagaagaggaaggctgtcagcccgacgattcaggaggatgaactagaccaagagatcagggacatggagatgctacatcaacaggtgcagaggaagaaggagaagatggccaggctagctgagctgcagaggcagatagacgaagcttctgaagaagtccgtcatcttacccacgatgagcagaaccgaaggcctcaacaaaaagaccttcatcaggagggcttcttcaatgaagatgactggtatgacaattttcatcatggaaattttgttttcgacgatgcttctcctctgtccgctgagctgcaggctacaccttggccttcgtcctataagccaccccagcttcccatgttcgatggccattcggacccgaagcagttcttgatgagttacgaagcaacagtgtcttcgtatggtggcaatgctgcagtaatggcaaagtctttcgttatggccgtcaggagtgttgctcagacctggtattcctcccttcggccaggaacgatcacttcatggcagaagctgaaggatatgttattgaccagctttcaaggatttcagacgaagccggtcactgctccagccttgttccagtgcactcaggatcatgaagaataccttcaggcgtatgtcagaaggttcttgcgtttgagggcgcaggcaccaacggtgcccaatgaaattgtcaccgaagccatgatcaaggggcttcgtcctggacctgctgctcaatactttgctaggaagcctcctcagaccctggagaagctgctccaaaagatggacgagtacattcgtgctgacaatgactttcgccaaagaagggaggaggccttcagattttccgaaatgaccaggggcttcggaggaagatcctatccgaggcatgtcaggtccatccacaactccactcagaatgatgataaggggagtcagcagaacagaccgcagtgctcctcacaggcttcggggcaacagcaaagctccttccgaccaccagctccaagaggcagaggcgccaggggcttcggcggaagattcggggatcaacccagaagaatattttgct

SEQ ID NO: 10397 - DNA, 3220 bp, Zea mays
aattgttaaaatcactctatttcccttactaatactttaatttgagatgacgtatcataactcatgagtgtatttcttattttttgtggaattactttatttccagtactagaataaaacattattttataaaaaaaaaggtaataacaaatgaacttatttcattctataaaaaacaatgacaagataatagaacatccaatattaaaaatacatataaacaccaagaagatcaagacatccagagaatggtctaccattacagaaccaaaggcgaaaaattcttcctttgcgtcggcatcggcccatttatactacaagtctttcccatgcacactagcccacgcttgatatttcagcccacatgaggctaagagcccacctccacatgtcggttcggctcagttcgttgcaccaataatcccgaaaacctggctcaccagccgctccgagctgtgcccggccgccctgagctcgagccagttcatgacgagactcgaacttttttttttcaaactaatatgtaggtttcacatatttaatactagttagataaaaaagttaaagaaatttttaccgtaggtcgttgcctttttatgttaagaagtcttcaaataatagagtttcaattgatattttctagaatctaaatatttaaatttttatatttacttctctatcttattattatcaattagagtatgggatatttgctaaaagaacggtttggatctatttatctaaactttagagctctaaaagctttagagtgttttaattattttataatttaaagttctaatattaaatgattttaagttcaaagctaatttaaactatttatttagagctttagttttaaagtaattttagaactctaaagtttcgaggagatatccaaacacaggaaacagtctccattgtgctgcttgggtgtggtacattaaaggcatatttggttcactgtctaatttgccacacttcacctaatttttctgcctaaggctagttattcaattcgaacgactaatcttaggcaaagtgtggcacatttatgtgttgtttggtttcgagggactaatttttagtccctctattttataccattttagtacctaaattatcaaatacagaaactaaaactatattttagttttcatatttagtaatttagaaactaaaatggaataaaaatgaagggactaaaaattagtccttaaaataaacacccctttagccacgaaccaaacagaccctaaatatgtatgaaggcccaacatttgtgacgtgggcattggcgaatgtcaattgcattttggggctaaaccgcgccccccgcgccccgcattccaagtcccaccttgcgtacgtgagccaaacgctcctggtcctggcagtctccatctccacctagggttccggcgatggtgcacggcggctacccgcgccgcgacgccgccgtccgccggcccaagtcctcgtcctccgccgtagttgccgaccgcaagcggaagtggaccgccgccgccaagaacacctcacttaaaaaccagatccgttccactgagcgctttctccacaaggtacttaccgacacctgggggctggggtcttctcgactgagctcggaacctctagtttagcgttgttcctacccagtggatgggctttggctgttgcttgtggagcgctgggtgtttctctaggaacctctccattttctagttgattgggaagcttccccgaacgtagctaggaattttagcacgaaagtctttctacaatgatgaattgttcaaccacaaatatttatttacttgttgcttctgtagggggctaggggcaaattgatgcttcaactgaggcctctgtttgttgcattccgctcagtagcctaattcatggtgtagctggattactgcagcttgcataggtgattaggtgctattaagtatcaagtattgattgaaaaactatcagactgaaatgttaactatgttgctcaaacggttagtcagaaatgctgtgaaagggcatttgttcttgtcagaggagaagtgacgaagcctaattgaccttgtgttggtgaagatattcactcaaacatcaaaatcataataacaagtttgattgaatatcgatttcatgcccatgaatagtacatgtcagggggtatttatagaggtccttgctttcgtaattgcttatacaaagtctaaaatacccctaacttgttagattacaattgttcgtccgcgcaaggacagtttggtcatttgtcctctctgttgggggccttcgtcctccgaaggtcctcaaaaacatgatttgacaatgttttccaagtggattatgtgaacaggtaccttcggactcagaattacgaacatgaagtgcggtcaggacgaagcctgaaccagacgaaggacgggctgattaccaagctccacgaaggatggtgcacagccgaagctgtgcgcagggaagcttcgtcgcgatagcagagaggggaaccgacttaaagatgaaaagactacgtggaccttgtcagatttccataagtcattgacaaatgtaatggacataaatgtaattttacgtgggctgcgtcccgcgtctataaatagatgaacagtactcccgtactgttcacgctgacttggcatttgcttttgcgtcacgcttgtactttttatcttctctcaggaccgaaggtacatttgtaatttgaaatcatttctatttttccatgttaataaaatagaaatgattctatgatgatgcttaaaaaaaaaaaaaaaatttatatgaatccttcgtcattacttgttatgttcacgaaggtatgtctcttatgaccttcgtccgaagctcattatttcccgaagggacataatgcttcgaaggccgaaggactttaacacttaacactttttatgttgccttgttcttaactcttagcatttgagaacaagtccccaacagattcatatacaaaatacaaaaaacaatataaacattatcatcaacttatttttatttgtattaccatatccacaataacaaattataaatgtaccttcggtttgacggaaagtaagggtacaggcgtgatgcaaaaagcgaatgccaagtcagcgtgaacaatacgggagtactgttcatctatttataggcaagggacgcagcccatgtataattacattcatgccctttacat

SEQ ID NO: 10398 - DNA, 2236 bp, Zea mays
gcacgagaccattacctagaacatcctaatccaaaagaaggggaggaatcccttcctccgcgagtcgcgagccgtggagatccgtcccactccacccctccgctccgccccagacctcgctacaaacctgccgcgaaaatagcagccgcccgtttgctctctcccgtctccgcactcctcccgcgatgagcgacccgcggggccgcgccgccggtcccgaccgctacggggacgaaccgcacgacctcccgctcgccgaggacgcaaacggcgaggaagcgtggcagacgcccgagaaagaggcggttgccgtgtcggaaggggccgctgcgcggagtggggatacgaccccggacgctgaacaggagagcgatgacggagaggaaggagtgggctccccggatcaggcggaacccaatgcgagcggggagggcgtaccgcccgtggccgcgactgtggagccggatgggattgttagcggcgcaaaggtggagacgaacagcgaggacgccatcagccatgacgccgacgaggaggaggaggacgacgacgatgactccacccaggatgcgtctccgatagccgaggtgaatgtggagggcgagagtggcgccgttcaccgcttggaggtggaaccggacccctttctcgatggagatgcctctgggacggaggaggagcaagccgcgttcatggtggagctggagcgcgtccataaggagcacagtctcgagttcaagccgcccaagttctatggcaagggcctcaactgcctcaagttatggaggcaggtcgcccacctgggaggccacgagcaggtacggctgatttcgttgtcacacatgcacttgctgctgtagatacaacagagtgaaatcttctttaggtggtgtttggttttagagcaactccaagagattagctaaaaagactagccaaatttactgatttagatactctctaaaatagattttagagaaaaaatgtaggctaatccaacagactcggtaaacctacggactgaatagagagtgaagcaggctatccaaaattggagagcgaagatggagaaatagagagccactaaatttgaagagtcgtttacagagtctattggatacaattttcttttaatattagctaaatttacctttacaaaaccatatacctagttgttgggggccttcggcttccgaaggtcctcaaaaacatgatttaacagtgtttctagagtgtaatgtgtgaacaggtaccttcggacatatatcaaagagggagaacctcaaaagatacgaaggttggcagtgccgaagctgtgaagcaggaaagcttcggcatgttcgcagaaaagggaaccgacttaaagatgaaaaggccatttagacctcgatagattgctatggaattatcaccaaatgtaaagggcatgtatgtaattttgtatgggttgtatcccgtgcctataaataggtgaacagtacccccgtactgttcacgctgactgggcatttgcttttgcgtcacgcttgtactttttaccttctctcaggaccgaaggtacatttgtaatttgaaatcatttctatttttccatgttaataaaatagaaatgattctatgatgatgcttatattatatttcatgctttatatgaatccttcgtcattacttgttatgtttacgaaggtatgtctcttatgaccttcgtccgaaactcattatttcccgaagggacataatgcttcgaaggacgaaggactttaacacttaacactttttatgttgccttgttcttaactcttagcatttgagaacaagtccccaacattggcgcccacctccggtgaactcacttccatttcctgagcttttcgacaccttcggcaagcatcagcttcgtcatgccgccgaagaaggctccagcaccaggggctggcacgctgcagccgctggaccccaatcaagacgtcctttctctcagagaggcacgaagccagaagaggaaggctaccagtccaacacatcccggaggatgatctagatcaggagattcagaatctggaaatccttcagcagcaggttcaacgcagggaggagaagatggtctgatggaaaataatcaactcatatcaaggttattaaggcgttaaggcgagacatggcgaccaacccccttccaaatgcctaggcgagttaggcgtgcggcgaggcgacgccatatgaggatcgcctaggc

SEQ ID NO: 10399 - DNA, 1132 bp, Zea mays
cagacgcgtggggacaacgcggccggcgcacgcgtggtggtcgacgactgcccgcgcttccccacgggccacgtcgtctggaagtgccgtggacagtacgtcggccaaatggtcccgcggcctggtgctggccgtaacctcgtcgagtctcttcgcggggctcacggtgcggcaggacgaccgcggcaccggccagtcgtggacgccgaccaacgtcaccgcgcccctggacgccgccatcgtggggttccgcgacctctgcctgcaggcggactacgcggggtccgtatccgtcgctgcctgccgcgacggcgtgcagtggtcgctctaccccgacggctccgtacgcccgcccgcgtggctcctccttcaatggcagtgcctggctgctgatgccagcgggggtgtgacggtgaaactctgcgacggggctggatcgtcttgcgagcgctgggtgttccgcaacgacggcaccatcttcaacaccggcaccgggatggtcttggacgccaggccatctgcgggggctaatgctactgctagccaagtcatcgtgtcgcccgccactgggagtcccacccagcagtggacgctcatgctgtgatctcatctacggctcatgagtcatgactgtgggggcagggcagtactgcactgcaacagctagctggtgtgttttgtgtatatatctggcgagctaggttgttaaagcaagcattagctattttaccagtacaataatgcatgcttgctactactactagtaatgcagtctagctctgtgtaccattgcctgcacggctgcacggcccctgttggagtactctataataaatgtacccctagtaaaatctgttttcagtttaccttgccgaaaaatataaacagggctagtttggaggggtgtttggtttgtcactccattcaaaatgaaaaaaccaaaaaaaaaaaaaaaaaaggcccctagggccaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccttttaaagaaccaaattttactccccggggattgaaaagaaaaattttttttttagggcccccaa

SEQ ID NO: 10400 - DNA, 862 bp, Zea mays
cattgcgaccccggccgggcggccatcccccaccaaacaagtttagatataaaaatatagcatcgcccgcgctctcgagagtctggatcctcctgaacctccaggcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtggggagcaagttcggctcctgtcacgcgaccgcggtccactcgcaggggcagtgaccgtgctgccggcgacggcgaggatcctggggtcgcggcatggcgagcgagagatctcgacgaggccatctcgtcgctgttcctgttccccactggcaacgctaccgaagaggagctgagacggggcgtcgccgcctgcgacatgatggtggcgagcgcgggcacgttcccgtacgtccagcggcggatgagcgccggcatgggggacagcaacggcgtggccacgaccctagcct

SEQ ID NO: 10401 - DNA, 2279 bp, Zea mays
cattggccccccgggccggaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactaccgtggcccgtggggaacaagttcggctcctgtcgtcacgcgaccgcggtccactcgcaggggcagtgaccgtgctgctgccggcgacggcgacggcgaggatcctgtggtcgcggcatggcgagcgagagatctcgacgaggccatctcgtcgctgttcctgttccccactggcaacgctaccgaagaggagctgaggcggggcgtcgccgcctgcgacatgatggtggcgagcgcggcgacgttcccgtacgtcgagcggcggatgagcgccggcatgtgggacagcaacggcgtggcaacgacccgagcctgcgggggctccaggcgcgctggacgtggctctccgccgccgtccagcagtccttccagggcgccttcgccgcaccggtccctgtccagcggagcaacggcaagtggatgcgggtggacaacgtgcgtagcgcggtccccctcgtgtccttcctggagcacggaagctgcaacaggacgcggggggcggcggccttgctgataaggtccgtcgtgcaagagccggacgaggacatgaagccgggcggcggcgctcgggccacggccacgacggcggcgtgcggcctgtcggccgagccgacggtgcgcctcgtcggcccggaagggaggtgcgtggacgtgccttacggctactactacaacggcaaccaggtgcagctgtggagctgcaagtccaccagcgccgtgaaccagctctggacgctcaagagggacggcaccatccggtccaacggcaaatgcctgaccagcagcggcgacgcggccggcgcccgcgtggtggtcgacgactgcccgcgcttccccacgggccgcgtcgtctgggaggtgcgcgtggacggtaccgtcgcgctcaagtggtcccgcggcctggtgctggccgtgacctcgtcgactctcttcgcggggctcacggtgcggcaggacgaccgcggcaccggccagtcgtggacgccgaccaacgtcaccgcgcccctggacgccgccatcgtggggttccgcgacctctgcctgcaggcggactacgcggggtccgtatccgtcgctgcctgccgcgacggcgtgcagtggtcgctctaccccgacggctccgtacgcccgcccgcgtggctcctccttcaatggcagtgcctggctgctgatgccagcgggggtgtgacggtgaaactctgcgacggggctggatcgtcttgcgagcgctgggtgttccgcaacgacggcaccatcttcaacaccggcaccgggatggtcttggacgccaggccatctgcgggggctaatgctactgctagccaagtcatcgtgtcgcccgccactgggagtcccacccagcagtggacgctcatgctgtgatctcatctacggctcatgagtcatgactgtgggggcagggcagtactgcactgcaacagctagctggtgtgttttgtgtatatatctggcgagctaggttgttaaagcaagcattagctattttaccagtacaataatgcatgcttgctactactactatagtaatgcagtctagctctgtgtaccattgcctgcacggcccctgttggagtactctataataaatgtacccctagtaaaatctgttttcagtttaccatgccgaaaaatataacagagctagtttgtaggggtgtttggtttgaggaataaagtagttcgtcatcttctccctc

SEQ ID NO: 10402 - DNA, 1735 bp, Zea mays
cattgggtacctcccggccgggccgggattccatccccaaccaaacaagttctgtagatataaaaatatagcatcgtccgcgctctggagagtctggatcctcctgaacctccaagcagcaagcgatgaaaggagggacgcaagcaattagcctgatggtccaccttgctgtgccatggatctgccttgcttcttgggcagctctgctaccagcgctagcatctggaaatgtgggtgcagcagctccgatactgagagcagagtacatgaatttgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgagtcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtggggaacaagttcggctcctgtcacgcgacctgctgctgctgccggcgacggcgaggatcctggggtcgcggcatggcgagcgagagatctcgacgaggccatctcgtcactgttcctgttccccactggcaacgctaccgaagaggagcgagaacggggccgtcgccgcctgcgacatgatggtcgcgagcgcggcgacgttcccgtacgtcgagcggcggatgagcgccggcatgtgggacagcaacggcgtggccaacgacccgagcctgcgggggctccaggcgcgctggccgtggctctccgccgccgtccagcagtccttccagggcgccttcgccgccccggtccctgtccagcggagcaacggcaagtggatgcgggtggacaacgtgcgtagcgcggtccccctcgtgtccttcctggagcacggaagctgcaaccggacgcggggggcgccggccttgctcataaggtccgtcgtgcaagagccggacgaggacatgcagccgggcggcggcgctcgagccacgacggcggcgtgcggcctgccggccgagccgacggtgcgcctcgtcggcccggaagggaggtgcgtggacgtgccttacggctactactacaacggcaaccaggtgcagctgtggagctgcaagtccaccagcgccgtgaaccagctctggacgctcaagagggacggcaccatccggtccaacggcaaatgcctgaccagcagcggcgacgcggccggcgctcgcgcggtggtcgacgactgcccgcgcttccccacgggccgcgtcgtctgggaggtgcgcgtggacggtaccgtcgcgctcaagtggtcccgcggcctggtgctggccgtgacctcgtcgactctcttcgcggggctcacggtgcggcaggacgaccgcggcaccggccagtcgtggacgccgaccaacgtcaccgcgcccctggacgccgccatcgtggggttccgcgacctctgcctgcaggcggactacgcggggtccgtatccgtcgctgcctgccgcgacgggtgcagtggtcgctctccccgaggctccgtacgccgccgcgtggctcctcttaatggcagtgctggctgctgatgcgcgggggggtgaacggtgaaactctgcacgggct

SEQ ID NO: 10403 - DNA, 851 bp, Zea mays
  misc_feature (773)..(773): n is a, c, g, or t
  misc_feature (813)..(813): n is a, c, g, or t
ctcgagggcccggccgggaacattgggacctcgagccggcgggattccctccccaaccaacaagttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctactagcatctgcaaatgtgggtgcagcagctccgacactgagagcggagtacatgaatttgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgagtcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtggggaacaagttcggctcctgtcacgcgacctgctgctgctgccggcgacggcgaggatcctggggtcgcggcatggcgagcgagagatctcgacgaggccatctcgtcgctgttcctgttccccactggcaacgctaccgaaaggagctgtaaaaacggggcgtcgccgcctgcgnacatgatggtggcgagcgcggcgacgttcccgtacgtccnagcgcggatgagcgccggcatgtggaacagcaacggcg

SEQ ID NO: 10404 - DNA, 4797 bp, Zea mays
  misc_feature (4424)..(4424): n is a, c, g, or t
tcatacttatcagaagattggaccacatctatatcagatgcatattggtggttttataggaaactaaaagctattcaatatctcttctttaaatgtatttatttatactaggttaatatggagggtcgtccatatagtgcttggtcttaatccatatttaaatgtctattcatatttaataattggtatcttacaagagatgagataaaaaccttcagataaaaaccagcttcacacccagcccgccgtgcactttcccccgggccttggatttgttgatcttcttggtccgggcggcgctggaggaggcgtcgttctgcggttccgccgtctcgggctgctgctgctgcggctgatcgcctgaccttcgtttcggtttcgtggctgggaggaggaacaggatggcgtcgtggagctcggtgggtgtcaagagcgggcggaggcgatgaatgacgccgtctctcggggatcagcagccggttctggtgagggtccaggtcggtggccttcaagcacttctcgtcgtcgatgaagtgcacgggcaggtcggcgcgcaggcccagcgccacgaggaaactgcttgcgcaggcacgggggctcctgagctcctctctgccggcatcgagcgacggcgtccgcggatgaggcgggatggctccgaatggcggcggtgccgatgcctcgaggagccaggaggaacgtgactgtggacttgtggaggtctcctcctcatcccgcgcacacttgttggcgacggtgtcgtagacggccatctcgactctagagggctcttcttgaagccggacaaggacggcgcagaatggaatgaggagaggagaccgttgccgtcccgcccagtcgttgcgatatttattgagcgacaggataagctcgcgctagactgaactctggtcccactcccaaattcatttttctaaattaaaaagggggaaagggaaagattatcttctccgttccctcccttcccctcccctcccgtacagctgtctgtcacggagcagcgggcagcggcggccggcaggcaatgcaatgaagaaatgctcggcgttggcctcggcgtccgactgatggtagctgttgcccctgcgcctccagttccagccccaccaggcaaaccgccccttcctctctgctcctctctccgccaccgctcctccggctggtggttctccaacggcgacgcccatggaagagacagcaccaccgccaccacgagcagcagggcgacgaggcggaagtggtggtccgaccccgacggcagccaagaagactacggttcctcttctctagaggaggacgagtacggttacggttacgactacgattacgaggatgaggctgcgttccccggatttggaggggctggggagatgttcgacgagccctggttctccaaggtctggtacatacgtattgtgtaaaatttctgctcctttccttcctttctggtaccctctgtcaatatgccatcaataatttctattttcctgcgtgcttgaaccttcatagtcatagactcataggtactaatgttacctgtctggacagtggatggggaccatagatcctttgccactcattcttagttataactaaaaatgcttcaaattaaatcaaatcgtcttccatttttttctctctctggtattaattcaagcaactgtataatgcttttgcctggtagatctaattaaaccaaatctctgcttataattctctgattgggatcttaacttacaatcaactaacctagacttgtcagctccagttcatgctgctttccattccatcagtaatgtagcatgcatcagtactgtaatcaatcgatggacgaataattgtgcttcattgttgtagtgactaatcaaatggcctgctgctttctgtacttgtgagtaggtattcaagacgtacggattcatgctaccggtgatgcttgcatccatgtttgctgtaacagggctaaaggcctttctaatggccatggcgatcccgctcggtcagtcggccatatcatttataattgacgctgtatggccaaggagaaaaggcaaccgtgacgacaggtggaggagaccagtccaagaggaggaggaggaggaggaagatttccctagggacgccactgactttgcaacaggtggtcgaggcagatacagcagcagctattatgaggggaggagagggaggcagagctaccagtcaagggtctctaacgattttgctgatgctgcctcagctgctgttggagctgatgatagcaccaagagcagcagcagtggagatggcggaggcaacaaaagcagcggtggatatggaggatgggatgagcttctggacaacaataacaacactgctgctgcccgggaggcaaagaggagcagcaactcattctcagctggcaacactgattacagcacgaaatcgcgcccttcggcgactggggaggcagatgcggattataccgccgctggcggtggcggaagagcggagcagggagtaggagctcctccggaaagaatgagaatgagacgacggcgggtgccgagaacgatggggctgggcagtaccaggtacaagcaggcgccactcttgatgcgcctgttggtggcagtattcccattcctgggatcatggttcagtgtgctctgaactgtgctccttcgttccaaattataagacgttttggttgtcggctttctctagattcatagctttttgctatgtacttggatatacactatgtctacaaacgttataaaagcaatgtgtatagaaatgtcataatttggaacaagcaatgtatatagaaaagtcatgatttggaatggagggagtagtattatatattagcccatgttggctcactcatgaattcacatataagtaaccagtggcagtaagcaaaagattatgattgtgaaactgccttcatacggtctccaggcagtcgcagaagtttgattcaatcataggctggagccgaatggaatcagaagtgaagctgtggattggaaggaagacaagtgtcgtgaagaagaccgattgattcaggcagtgtgcctgcagcatcagcttgctgcgtgtgtgaacctttgtttcggtcttctttttcttcgttgtgcagctggtaatatatttgcgttcacggtgaacattagtggcaagagctaagcggaaaagtatatacgtacctgttgctctagcgcaatggttttcacttgcactatatggtagtgatacatagacagttgccttgtcatttttttcgtgtcagaatgaaatggaacagtaaagaaggccttcgttccatagaagaatgcaactctcttcggtgggtggtgtggaaattaaaataaaaaatgagatataggatctgctagagataacctaatgtagtagcaaattaaagtattttgacttttgagtttgacaaaaagattggttttaactccattctaaaattcgctcccacagagagttcttaaagtgctaaccagaccctctaactaactcggctagatgtcctttcatatgcacactgtatatgcagcgaaaataaacatttgcccttgtcaattaggaaggccttcgttctgacagaaccaggtgaaactgacactgagagctagtttggcaactatattttctcaagggattaatgaactaattttctttatgtctcgtatggatccttggaattgaattccattctaataacaaggttcaaccatttaagttatgttactatcccatgaacttcgcttaacgcacaactcatgcatttagaatttaatcaactattcatatgaaccaaacccgtaaactcctaaaactacatgagataattatggtatgtttggtttggcttttgccccactaaaagtcaaacgtcaaaccaaaggtttgaatccagatagcaattttttctaaaagttgactttctcgcagtgcaaaactgaaatcatccatggacctgtttttagtggctttcgaattaaactgtgaaaacttatatcgaagaactattaatatattttagtagttttcaccaaacggattttagctttttaacagctcagagcccacaaaagctttttccacagcttacagtccacaacagtttttttttacatccacaacccaactaaacagacccttagtatgattagataggtcgttagatctatttatagaataacaaatttatttaaagatatgaattttgttagtattatctataaaactaatgaacctaacaaacatttgatcaacggagatgccatgaacacttcaaagggaacatagggagtagtacgtcacaactcacaaattaaaggtcatatgcatggcgttgattgctaaagagagcgaacgctgctgcagtgctgctactgctgtantgcgtgggcgagtaccaccagctccaggtccaggttaccacggtccacaggtagacagatggagtagtctgggccgggattggatcaggggatggacctcgccacgtcatccagacatctggaatctacccatatgaatcgcggcgttgacttttaataaaaccattaatttgtcaaagttgtgtctttttttctctagtaatatgtcaaactagagtatttattaagaccatgtttggtttcaattagtcttaggactaaactttagtcttatgactaatctttagtccctacttgtttgggtatagggactaaatagattctaaagtcattaaatacattgtacaaagacttaaatgcccctagaatacac

SEQ ID NO: 10405 - DNA, 1890 bp, Zea mays
  misc_feature (1398)..(1398): n is a, c, g, or t
cccacgcgtccgtttttctaaattaacaagggggcccccccgaggtcggccggtccctcccttcccctcccctcccgtacagctgtctgtcacggagcagcgggcagcggcggccggcaggcaatgcaatgaagaaatgctcggcgttggcctcggcgtccgactgatggtagctgttgcccctgcgcctccagttccagccccaccaggcaaaccgccccttcctctctgctcctctctccgccaccgctcctccggctggtggttctccaacggcgacgcccatggaagagacagcaccaccgccaccacgagcagcagggcgacgaggcggaagtggtggtccgaccccgacggcagccaagaagactacggttcctcttctctagaggaggacgagtacggttacggttacgactacgattacgaggatgaggctgcgttccccggatttggaggggctggggagatgttcgacgagccctggttctccaaggtattcaagacgtacggattcatgctaccggtgatgcttgcatccatgtttgctgtaacagggctaaaggcctttctaatggccatggcgatcccgctcggtcagtcggccatatcatttataattgacgctgtatggccaaggagaaaaggcaaccgtgacgacaggtggaggagaccagtccaagaggaggaggaggaggaggaagatttccctagggacgccactgactttgcaacaggtggtcgaggcagatacagcagcagctattatgaggggaggagagggaggcagagctaccagtcaagtgtctctaacgattttgctgatgctgcctcagctgctgttggagctgatgatagcaccaagagcagcagcagtggagatggcggaggcaacaaaagcagcggtggatatggaggatgggatgagcttctggacaacaataacaacactgctgctgcccgggaggcaaagaggagcagcaactcattctcagctggcaacactgattacagcacgaaatcacgcccttcagcgactggggaggcagatgcagattataccgccgctggcggtggcggaagagcggagcagggagtaggagctcctccagaaagaatgagaatgagacgacggcgggtgccgagaacgatggggctgggcagtaccaggtacaagcaggcgccactcttgatgcgcctgttggtggcagtattcccattcctgggatcatggttcagtgtgctctgaactgtgctccttcgttccaaattataagacgttttggttgtcggctttctctagattcatagctttttgctatgtacttggatatacactatgtctacaaacgttataaaagcaatgtgtatagaaatgtcataatttggaacaagcanaggtatatagaaaagtcatgatttggaatggagggagtagtattatatattagcccatgttggctcactcatgaattcacatacaagtaaccagtggcagtaagcaaaagattatgattgtgaaactgccttcatccggtctccaggcagtcgcagaagtttgattcaatcataggctggagccgaatggaatcagaagtgaagctgtggattggaaggaagacaagtgtcgtgaagaagatcgattgattcaggcagtgtgcctgcagcatcagctaagcggaaaagtatgtacgtaccctgttgctctagcgcaatggttttcacttgcactatatggtagtgatacatagacagttgccttgtcattttttttcgtgtcacaatgaaatggaacagtaaagaaggccttcgttttatagaacaatgcaactctgtcttcggtggatcgtgtaaaatagggaatgtagaattatagatgacactatttac

SEQ ID NO: 10406 - DNA, 2923 bp, Zea mays
aaaactgtttttgagtcaaaccaacgaaaaaaagctgaccgtacccaacaggttttgcttttggtccagaaagtgccccctcgtcatacgtcacgcgccgcgccgcagccctcacacttcactcacacacttcgccgcctggccatccggtgctcacgccgacctcgttcgatagcaaatccgcgaccccgagcaagaagccaggaaccagctcaaagttattcgtccaagaaccccaccccacccccacaacacatagaaatttcgtcttggagagccaccaatggcttgttccactgcatctttagcggcgacgctgctggcgttcgcgctgatgttccaggcctgcgtcgcggggaggaggaggctcaccgcgctcgtgcaggagccggccatcaccatgaagtaccacaagggcgcgctcctgtcgggccccatcgccgtcaacttcatctggtacggcgacttcacggcgccacagcgggcggtgatcaccgacttcgtctcgtcgctgtccgcggccccgcgggcggcggcgcagtcgcagccggagccgtccgtgtccacgtggttcaagacggcgcgcaagtactacgacacctccaaggcgcgtttcccggcgctgcgcctcggctcccacgccgtcgaccggaactgctccctcggcaggcggctcacggagcgggacctcctcaggctcgccgccaggggggcaccgagccgcgccatcaacctggtgctcacggccgccgacgtggccgtggacgggttctgcgcgtcccggtgcggcacgcacggcgcgtccccgcggtcccgcgccggccggttcgcgtacgtgtgggtgggcaacccggcgtcgcagtgccccggacagtgcgcgtggccgttccaccagcccgtctacggcccgcaggcgccgccgctcacgccccccaacgccgacgtcggggtcgacggcatggtgatctcgctggcgtccatgatcgtcggcaccgtcaccaacccgttcggcaacgggttctaccaggagggctcggccgacgcgccgctcgaggccgccacggcgtgcgccggcgtgtacggcaagggcgcgtaccccggctacgcgggggcgctgctggtggacccggccagcggcgccagcttcaatgccaacggggcccacgggagaaagtacctggtcccggcgctcgtggatccggacacgtcgtcgtgtgccaccttggggtagatttcgcggatcgtaaattagtgtttgcgatgtggcggtggtggtgctgtggagtgtgttccacgcggctaaaagtttgtgctaaagtagtactgaccaggttgcattatttcatttgttcaatgaaaatgaagtattttcacgcacatactactcttatgcatgtcgattctgcctgcaatttactcggtttcccaaaagtttttgccagcttggtatgaatcatgactatgacgtgaatcatgtgcttttacattcgtgcagatgggaagaaaagatagtataaagcctatagtagataataagacttggttagaaaaatatgcttatacggccatggtaagtgcgaaattcgcgagcatgttccgtcaagtcaccatgtgcgagcagcagaaaacagcacatcgaatgatcgaaagatgctccgagccgtgcagtaaaacgtaaaacacttgcaatccgagggcaggcaaagcggaaaatgcgtacacttcatgggccacccaagagtttgcgtcgggccacaatgtgaccccagttccaaaacagcccagaaaaagtaattctgaaggtttgaccagtgtggaccatccaatccaatgaaagccttccgatctgtttatcctttgacccgcgattagccaccattggcaaaatgttataatcttttgggacaacaacggaaacaaccagtaaagtcgaactctcgtagtaacaaggaccatagcattgaatctaacaacgtaaaactccctatgtctagaaaatagacacatcacatacttttaaaacaatgtattttaagttttactgagtaattttatacaaaaaatagtaccaatgtttatattttttatatagatttcctataaaaatgtaagataaaaatatcagtgcttttctttccaaatagattttctacaaaaaaagatatagtttattctatgatccatctaatgtttaccctaaaccgtaatacattttcatataagtttggttgaaaccgaattcttggaaaaacgccacatacactccttttggcatgggagaagagaataatgtactagcatccttattacacataagactggttttagtgaagatatagtcttagtgagaagtttaatggcattgctttcaacaatttttttttgcatatgtcatacagaacgaaataaagcattgcttaaaatactcactttcaatgaaaagtttttcagtctatagtttgataatcatagatagttggtaatcgtgctaagggaatttcatccggataaaattaactttcttgtttctcttcttaaatccatgtgtcagtctatcaaatcaaatagatacgaattactttcaaggaacaaaacaataaggaaacttaacccaacggcctcctcaggccacttcgtctgtgactgcttttctatgctttggatatatatcattaggtaaactatagtttatataaatactatgtatgttataaaacaaaaccgaccttagctcagttggtagagcggaggactgtagattgtgcagaataatccttaggtcgctggttcgaatccggcaggtcggattttttaatcagttttttgtcacatgacctttgtgtcggattgccagagttatcggttgttgaaatgacaggatcgcattcgcaattctaaagatgtgatacgaggcactatactg

SEQ ID NO: 10407 - DNA, 2282 bp, Zea mays
cccctgctcacggccttgcatgctgggacccgtggtacaaagacgatggtgtgctcgccttctgcttctgggatcatggccgtgatgctagtacgatccgatggaccactttgctctagcattggcttagccatggagatttgggatccacggggtcccgacccaggttttgccgtgtgatgggaaatacacgtcctactagttctttagcacagagggaccgctgggtccctccagcccggccggccagcctgccagccacagcagtccccaatactacccattgatgcagtaggccagctccagcctggctggcaatttacgagtacgtggtggatgaggaatggcctaaccctaatgccaccggcgacgggactgactgcgaggtctgtgactgcatatctggaatacagtcgtaccgacaaagtgaacagtgcgcaccaactgctgctgctgctctgttcacagctagtaatgtaataactggaaaccgggcccgtaaaccagtgaaccaacgttcgtatcccagtgcctaaaatttcaagcgcctcgagaagccaacctgcctttagccactccggcagtgcccactttgcccgtcccacccgcaatccccaacttgcccctgctttcctcccgccgtcccggaccagcagccgtttccccggcgccaaaagagccgtggcaaaacggtaagtgctcacccaactacagcgggaagctggcaggggccaacgcaaagccagctgtcagtgaccgttcgggcagcgcggcctaggacgcctctttactttggcccagaaagtgccctcccgtcatacgtcacgcgccgcgcgcagcgtcccaggccccggtcctccacactccactgtctctcacactcacacagtctcacaaaggctcgtgggctcgtgccctggcctctataaacccccgccccgcctccggtcccccgggccggccgggatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcaacttcatctggtacggcgacttctcggcgccgcagcgggcggcgatcaccgacttcgtctcgtcgctgacggcggcggccccggccgcggcgcagccggagccgtccgtggccacgtggttcaagacggcgcgcaagtactacgccagctccaaggtgccgttcccggcgctgcgcctcggctcccacgccgtcgaccggaactgctccctcggcaggcgcctgacggagagggacctgctcaggctcgccgccaggggagccccgagccgcgccatcaacctggtgctcacggccgccgacgtggccgtggacgggttctgcgagtcccggtgcggcacgcacggcgcgtccccgcggtcccgctccggccggttcgcgtacgcgtgggtcggcaacccggcgtcgcagtgccccgggcagtgcgcgtggccgttccaccagcccgtgtacggcccgcaggcggcgccgctcaccccgcccaacggcgacgttggggtcgacggcatggtcatctcgctggcgtccatgctcgtcggcacggtcaccaacccgttcggcaacgggttctactaccaggagggctcggccgacgcgccgctggaggccgccacggcgtgcgccggcgtgtacggcaagggcgcgtaccccggctacgcgggctcgctgctggtagaccaggccagcggggccagcttcaatgccaacggggcccacgggaggaagtacctggtcccggcgctcgtcgacctggacacgtcgtcgtgcgccaccttggtttagatttcgctggtcgtaatcagtgttttgtggtggcgggtgctgtgcgtggagagtgttccacgcggctgacgattctagtagtgtagtgacctgtgaccatggtggattctttcatctgttcaatgaaaaaaaagaaatattttcacgcacaaaaaaaaaaaaaaaactcccaccatatactctgttcccccaaagattttgcctggtttgagcatgagcaagatgcatgaatctgtacgacatgaaatcatgtgctatct

SEQ ID NO: 10408 - DNA, 2615 bp, Zea mays
agccttttttttctccctcaccgccgttcaacatcagcgtctcgacgacataatctcaaaaaaaaaaaacatcaccatccggactggtcgccggcacggctatattcctgcccggctgccccgcgcggccgcgcccccgccgccgccatcgcgctcggataaggccagtccaccctctgcatgcgccgcctcgtctcgtccgcgtacgtgtggttgggcatacgcgtcgtgtccacggaccacggctagcggccggccagccagccagccagcgggccgggcagtagtggtgagcacgcgagcaataagcgtggaggccgccgttcacgagcgcgtcgtgaaggccggtagggccgcctgcagctgctggcggccgcagcgcgagcgcgacgcgcctagccgcttcaccaccagctggcggccggtcgtacgcggccgggagagcccacacggggcgggggcccgcgcgcatacggcctctggccgctgtccgctgacgcctgacatgcgggacctgtaccttcgctcgctttacgccaaccgccgtacgctgacgggcctcgtcggagaccaccatctcatctcattctcatccgatcggatccgatcatgcgcgtgcgtcttccccgattggatcggcagataaggtgacgggtttcgcctgtcagctgctcacggccttgcatgctgggatccgtggtctgttatatgtacggtacaaagacgatggtgctcgcctgctgggatcatggtggaccactttgctctagcattggcttaagccatggcgatttgggatcgacgggggtcccgacccaggttttgccgtgtgatgggaaataacatggcagggattacacgtcctagttctgtagcacagagggactgctatgacctagagctagaggtaggccaacctgtcatccatagcagtccccaatagtactacccattgatgcaggaggccagctccagcctggctggcaatttacgagtacgtggtggatgaggaatggcctaaccctgatgccaccggcgacggcgaggcttgtgactgcatatctggaatacagtcgtaccgacaaagtgaacagtgcgcaccaactgttgtactcgtactcactggctagtgggtgctgctgctgctgctctgttcacagcttgtaatgtaataactggaaaccgggcccataaaccagtgaaccaacgttcgtatcccagtgcctaaaaatttcaagcgcctcgagaggccaacctgcttttagccactccggggcagtgcccactttgcccgtcccacccgcaatccccaacttgcccctgctttcctcccgccgtcccggaccagcagccgtttacccggcgccaaagagccgtggcaaaacggtaagtgctcacccaactacagctggaagctggcaggggccaacgcaaagccagctgtcagtgaccgttcgggcagcgcggccaaggacgcctctttactttggcccagaaagtgccctcccgtcatacgtcacgcgccgcgcgcagcgtcccaggccccggtcctccacactccactgtctcacactcacacaggctcgtggcctggcctctatacatcccttgggttcctcgaggccggccgggatcgcaaatcctcgggcaagaagagccaacagaaaagtattcatccaagaacaccacccccacccgctccaagcagaaattttgtcttgaagagagccaccaccaatggcttgttacaacaacactgcatctttagcggcgactctgctggcgttcgcgctgacgtttcaggcctgcctcgccgggaggaggctcaccgcgctggtgcaggagccggccataaccatgaagtaccacaagggcgcgctcctgtcgggccccatcgccgtcaacttcatctggtacggcgacttctcggcgccgcagcgggcggcgatcaccgacttcgtctcgtcgctgacggcggcggccccggccgcggcgcagccggagccgtccgtggccacgtggttcaagacggcgcgcaggtactacgccagctccaaggtgccgttcccggcgctgcgcctcggctcccacgccgtcgaccggaactgctccctcggcaggcgcctgacggagagggacctgctcaggctcgccgccaggggagccccgagccgcgccatcaacctggtgctcacggccgccgacgtggccgtggacgggttctgcgagtcccggtgcggcacgcacggcgcgtcccccgcggtcccgctccggccggttcgcgtacgtgtgggtcggcaacccggcgtcgcagtgccccgggcagtgcgcgtggccgttccaccagcccgtgtacggcccgcaggcggcgccgctcaccccgcccaacggcgacggtggggtcgacggcatggtcatctcgctggcgtccatgctcgtcggcacggtcaccaacccgttcggcaacgggttctactaccaggagggctcggccgacgcgccgctggaggccgccacggcgtgcgccggcgtgtacggcaagggcgcgtaccccggctacgcgggctcgctgctggtagaccaggccagcggggccagcttcaatgccaacgggg

SEQ ID NO: 10409 - DNA, 2606 bp, Zea mays
  misc_feature (1888)..(1888): n is a, c, g, or t
catgtgctaattatagagaatatttcgaattcaagtaaggtcccaaatctgaggcatactgttgctgccctgctggaataaatgtgctactttcccctgccttgttaagggaaagggttttgttcacgatgttaccttgtaaccttgtacttatgtttcatacttggaatgaaggttcatggaacaaaaatattctgctgcattgcatgcaagagctgttgatcattcagagcaatgtattggttgtgagtttttgacggcgctcacagtgatagatttgttatctatatgccagccccagcatattcatccttgtgctgtgggcgtctagaggaccgacaatatatatatttttaaaacaaattcgtgaagaacatcacaagttatgcatgcaaactgctcaagtcatgtggatccaaggcatcctaacaactagcacagcattacaacaaaatattggtgtatatgtgcctacaatgaagtgaaaggtgatgagtcatggtgatgtgtaaagaggcattacaaagttagcttcacaagcgtatgaattcattgacaacccttgacatgtaaagttgattcatatgtataagaaagcttaatgatctatctgtaaatccaaatccatgtactatgtttccacgtcatgcaacgcaacattccaaaaccatgggttgcaagatgctgcagaatgcaagccatggatcatctataaatggctagctcccacatatgaactagtctctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgctggcagcccagggtctcaaccccatggccatgatgatggcgcagaacatgccggccatgggtggactctaccagtaccagctgcccagctaccgcaccaacccctgtggcgtctccgctgccattccgccctactactgattcatgatatttgggaaatctcctctatccatctctctctatctatatatgtaataatgcagtaagacgacacacattatcatgtgtggtatgaccaataatatatgcatggtcataataaagttttggttttaatgaaaaaaaaaaaaaaaaaaaaaaaaagaaggacaaccccccagacggcccgtcccgcccctcatgctttcaaaatctctattcaggctcaaattcatagcatatgggtagagtagtatgcttgagattagcaactttatacttgagtatagagtataaaacataaagtcatgtgtattctattggctagataagtgtaaatgtgagtttagaggcaacaaccatgatttgaatcctaatttacacataattttagcgttttttccatttaaaggcggggcttgacgaagttggaagccgtggaactgctggggcttatcttgacaacaaatcattccggcagagacatcattcttaatagatactgaggccaatcccttgaacttattcacgagtagtttgataanattctgtcacccgaaaagattctgttagatggatgcagcaactaggatctggtgataactagccccgctaccggcgtgattggttgtggtgccaacgggagccatgctcacgctggcctggacgatccgggaagcctctcactagcatctccacgcgtgcaggcggagggttgaaaaaatgcttggcctgcttccgtgcatgcaggctgcacccggatagtgcaggtaaccaatcgtatgcccattcacggtcaatgcatacaacgagcttgagtgtagctatccgagcaactaatcacgtggtacctgacctaagtaatgaccagcaaataaaagtgttgagcaccaaaatagacaaggtggacggtccgcatcagtatcgcgtgcagagacagttagggttccgagtttcttgtgacggttgttagctaaattcgcggaattaactcgggagattggtttgtaacgggtccagacccctcctctataaatataaaggaatacagtggattgggataaacaatcgaacctacaatcaataaaatttgcattttatcttgtacatttaggagtcgctctagtttagttctagtttaacctttcaatccccaaattctctgtttctcttcggctctacatcgattataggtgtctaggtcggcctgccgactatagacaaagcataggacctctcctccccgacgggtcctgtgacacc

SEQ ID NO: 10410 - DNA, 1242 bp, Zea mays
accggccaccgcgaatccagagccccacgccccgtccgaaccccagagcagagcaaagcctcctcgacctccctgtccccagccttccccgatggcccgcacgaagcagacggcgcgcaagtcgacgggcgggccatcggggagggctggtcagggattcaaacagaggcttctcagcatatgggggttctacaagcatcatcaatgggctggaatggtgctcctgtacttgctgccactcctgttgtcaagaaagtcatgaggctggatgttccagtagacaagtatcctaactacaactttgttggtcgtttattggggccgcgaggtaactccctgaaaagggttgaagcttcaacccaatgtagagtttacattcgaggacggggttctgtgaaagactctgttaaggaagacaagctgagggataaacctgggtatgaacaccttaatgaacaactgcatgtgcttgtggaagcagagtttccagcagatatggttgatgtgcgtcttaatcaagctgtgtccatcctagaggatcttcttaaaccaattgacgagtccatggactactacaagaagcagcagctgagggagctggcgattctaaatggcacactgagagaggaaagcccaagccctcacctcagccctagtgtgtcccccttcaactccaccgggatgaagcgcgcaaaaacagggcggtaatctctgttccgaaagccttcatccccccaaatcaatcatggttcaatgcccaattattacacaagctactgctggagatgattggtgatgcatatgctgggatcatcagtgatggcctatgcctgtcatgatctgtgcgctttatcgacaggcacacaaacatgcctgtgctgtgcttggacgaatggtctccgggcttgttgtttgactctactattatttattctttgtgcttctgactgcctaagtattattaacattattggtttgggaaagttaacaaggcccggttggccagtcgctgtagaagcttggggagaggaggggggtgtcaatgtgacggacaataataaggtttcgttggtgtacctgagatagttgtaatatgtcatgtgctgatgcttttgtgtggtgctagtacaagacaaccagacagctatagttgaggcaatgattattttgcgttcataaaatgcatgtcggtgtgctttcttcatggttcatgaaccggaaccagtctaaaaaaaaaaaaaa

SEQ ID NO: 10411 - DNA, 862 bp, Zea mays
  misc_feature (861)..(861): n is a, c, g, or t
aaattccatcgtctccaatatggatgtccaaacgcagcattagggattacacgccccacgtgcataccaccgttgattgcctatccagcggtgctacgcgctcaacagcaggcgtggggttccgcgtgcccccccgcggcctcgaatccctctttcttcgcctgctggctctctcgtcgtccgttcctcgtcctctccggcattcgaggatagtttttcgccgggggcggcctagaaatcagccgtcaggtgaaccgggaggggtggttgcctgaggaggaagagatgatcacgcgagcgaagctggtggagcagctgcgggagcaccagatccggtcggcccagtcctactccgccgcgctcgccgtcttctcgcccaacccccacatcgcctccaggagagatctcaaggttgctgtcatctatgcggtcctgttttgttttctcatggtgtcctgctatgccgccctttacttgaaatggttcagactttcagccatgtttgtaaccttcgggatcctccttccagtgagtctcaaaatctctaggcatagaaggctgaagaggaaaagagaaaggagactgttgttgccactgtccatgtgaatacattttttttgatacaccctgtaacattctagtggagttggccagctacagaagatagggaaatcctcggcagacgaactcaactttacggccccagcctacgctttggaaaatgttgtatgcatcacctgttgtgcttctgtcctccacatgtgtacacacacacatacgtgccgaacactttgcgttgttttgccccccgcccctgtgtttgcccccggcctcgttccgttgaagtcgaaaaaaaaaaana

SEQ ID NO: 10412 - DNA, 1422 bp, Zea mays
cttgaccctggcctccacggcgtaggccttgtacccggcctaccctccgccgtcgcttcgcctcggggtcgcccgacgaccaccacgagtccacgacggcgcgcgcacctcgctgtcgcccccgtcgtgcgacgccgccggctgggcatcgccccggaactcctcctgaaggcccctcatcacgctcttgcaggctctggacggacgtgggaggccccgcggcgcccgtacgtatatctagcggcgagacggcaagctcccgccccatctccgccgcctccgctccccgtcgtccggctgcgctgttgctgctcatacggatcaagctcggctacacccgtttctgcgagcagatcagaggacgccatcgtcgggtcggtagggatgggacctgttcactccgatcaaaaggcgaagaaattggcgattatttgcgaacaaagagttataattccaaacgggcatggggagaagcttgttggtttattacatcgaacaagttcaaagaatcttgtgatcctttgtcatggattccaagccacaaaggatgacagcatcttggttgaccttgctgatgccatcacaaaggaaggaattagtgcttttcggtttgatttttctggaaatggggaaagtgatggtgaattccagtatggaagctacagaaaagaggcagctgatttgcgctctgtagtattacatttctcagaacagaaatatgacataattgctcttatcgggcatagcaaaggaggaaatgctgttcttctttatgcttccaagtaccatgatgtccctgccattgtgaacatttctggccgctttgcattagagcgaggtatggagggacgccttgggaagaatttcatgaggagaataaacgaagatggatacattgatgtgaagaataaaaaaggggagttgcagtaccgggtgtcgaaagcgagtctggatgaccggctgagcactgataccctattttccagccgtgccataagcaaagactgcagggttctcacgatccacggcgccaaagacgagatcgtcccggcggaggacgcccggcagttcgcggcgaacatccgcaaccacgagctgcgcatcatggcagaggccaaccaccgttacaccgggcacagggaggagctggcctcgctggtgctgggcttcctcagctcccatccctaccagatcacgtcgcgcttgcgtccgagactctagatagagtagagcacacccacttgaccgtttgcgaacaaaaaaaaaatcccctgtaccaatccaagagttgtgggtatggtgatgtgtttatccagaaccagaacacgagcacctgccgtccaaatcagcgtgactctgtctcgctcaagaatttcaaaaaaagtcagtgccaggcatctaacagcaaaaaaaaaaaaaaaa

SEQ ID NO: 10413 - DNA, 2048 bp, Zea mays
  misc_feature (9)..(9): n is a, c, g, or t
  misc_feature (14)..(15): n is a, c, g, or t
  misc_feature (18)..(19): n is a, c, g, or t
tttttttcnttctnnttnnatgagaaggaaagcatctgcaccattattaccaaacagctgcagtaggtagcaggtacaccagctaatgattaagataacagtatagtaatgagatccacagatttatgtattcacaatgattccccgatttgcttgcagtactaattactctgcgcattattttgatcactactgctagcagtacaattacaatagtttatttccactggagatggctgctgcacactcggatggttggttcatcaggcagaggcaggttgctcagctggaacagagagcacagcatgtcggtcgggcaaccaacccatctactcagcccctatgtgtgctgctaccacaactaccaaactctgcagctgcaatcatggcagctgccaacgcccgccgtcgcagctgaaacgctgcacctggatcactttacagcagcagcaacgtgttcgcgatcaggtctggtcatctggtttcttgtgtggtggcggccggcataccggcatggtgtgtgcttccagacggcgaagaatggcgcgcatggttcggcgccgttcagctgcaaaggcggacggtgcacgccaccgcctgcgcccagtacttgagccgcgccttcacctcgtcagggctgtcacctgcgctatccaaaaagaaaggactgcattcgttagaacatatgccgataaacaaagaagcgaacagatcgtcgacaagtggtgtccttggttggttccgtgacgggaaaagattccatcttgatgtagacaagttggttttctccgctccggtgaccaaggaaggaaggaatcccaagtcaagtcatggaggacgacaggcggcgatctgctatgtgttgcttaccggggctggagatcttccagttggtgacaggcggcgacggcgtggcggcatctggtgcggcggcctcgtgctgctgcggcttctcgtcgtccagctggaggcgctggctcatggagtagcacagctcgagcgccggcagggtgctccggagctcggggatctcgtcgtagttgaagccgaagcccaggtcggcgcatcccttgagctcctcgaggtcgtcgtccgtgaggctcctggaccgccccaccgcgtcgtctccgcccgcgagcacgacgggtttcgagtcccgccgcgccggccacgccgcctcccactgcgccccacgccacacgtcctccgcctcggggtcggcgacgccgtcgacggcgctggcactgccctgtttccggctgctgcggcgtcggcggcggttgcgttggcggagaaggcgtgctggtggcgggctcggcggcggggaggcagaggcggatggggaggaagatgagggctccacaaaggcggaatctgagatccacatctcggcggcgtggtgtcgtcgcttggacactgagaggggacagcgaggtagtcacggggaggcaagagggtgtgaaatggtcccgcgggccgggtgctctgtggctggcgggcgggggctatttgtaccgccggaccggatagaggctggggagtgtgcggtgcggaggctcgctgatggtggtggtggtgggatgtgggacccgccttggtgcatggatggacggaatggacataacatgtgccatgcatggaggagcaggtggggaatcatgtcatacgtaccagtagtagtatgcatcaaggcgtcaagcatcatgcatggatgatggatgtttctagcgatcgacaaagggatgcctcttcattcttcttttcttattaatggtcgcgctcgtgctcctcgagtactcaacaaaaccttgtgattttgtgtgcctcaatatatagtaggcttgtttggcgagttgttgattgcgctattactcgattcatttagacgacctagcgttagcttgagtgctaaacattgcgtggtgcatactgttacgataatcatttttggtagtgtaaaaccagtccaaaatatagttcctttttaccaactttttttgtgtgtccacatttgaatgaataataataaacatggacatacatacaaa

SEQ ID NO: 10414 - DNA, 1280 bp, Zea mays
ttttttttttttttttatgagaaggaaagcatctgcaccattattaccaaacagctgcagtaggtagcaggtacaccagctaatgattaagataacagtatagtaatgagatccacagatttatgtattcacaatgattccccgatttgcttgcagtactaattactctgcacattattttgatcactactgctagcagtacaattacaatagtttatttccgctggagatggctgctgcacactcggatggttggttcatcaggcaaaggcaggttgctcagctggaacagagagcacagcatgtcggttgggcaaccaacccatttacccagcccctatgtgtgctgctacacgactaccaacgatgctccaccaaactctgcagctgcaatcatggcagctgccaacgcccgccgtcgcagctgaaacggtgcacctggatcactttacagcagcagcaacgtgttcgcgattaggtctggtcatccggtttcttgtgtggtggcggccggcataccggtatggtgtgtgcttccagacggcgaagaatggcgcgcatggatcggcgccgttcagctgcaaaggcggacggtgcacgccaccgcctgcgcccagtacttgagccgcgccttcacctcgtcagggctgtcaccggggctggagatcttccagttggtgacaggcggcgacggcgtggcggcatctggtgcggcgccctcgtgctgctgcggcggcttctcgtcgtccagctggaggcgctggctcatggagtagcacagctcgagcgccggcagggtgctccggagctcggggatctcgtcgtagttgaagccgaagcccaggtcggcgcatcccttgagctcctcgaggtcgtcgtccgtgaggctcctggaccgccccaccgcgtcgtctccgcccgcgagcacgacgggtttcgagtcccgcctcgccggccacgccgcctcccactgcgccccacgccacacgtcctccgcctcggggtcggcgacgccgtcgacggcgctggcactgccctgtttccggctgctgcggcgtcggcggcggttgcgttggcggagaaggcgtgctggtggcgggctcggcggcggggaggcagaggcggatggggaggaagatgagggctccacaaaggcggaatctgagatccacatctcggcggcgtggtgtcgtcgcttggacactgagaggggacagcgaggtagtcacggggaggcaagagggtgtgaaatggtccggccggcctcgaggtacccaatg

SEQ ID NO: 10415 - DNA, 1668 bp, Zea mays
cgaacgcctcctccctccctggttccgttggctcttgcaccagcaatggcggcttcttggagagccgtggcgctgtcggtcgtcacgctggcctggctccttggcggtggcgcgtgggcgttcccggcggaggatttggtcacgcggctgccggggcagccgccggtaacgttcaggcagttcgcggggtacgtggacgtggacgtcaaggccggcaggagcctcttctactacttcgccgaggcgcaggagaacgccgtcgccaagccgctcacgctgtggctcaatggaggtccaggctgttcttctattggaggcggtgctttcacagagctagggccattttatccgcgaggagacggccgcggcctcagatcgaacaagaagtcatggaacagagcgtccaatcttctgttcgtggagtcaccggctggagttggatggtcttattcgaacacttcatcggactacagcactggagacgtgcggactgctcatgacatgtaccaatttttgttgggatggtatgcgaagtttcctgagtacagatcaagagctttgttccttaccggagagagttacgcagggcattacataccacagctcgctgatgtacttatcacccataacgagaaatcgaagggtttcaagttcaatattaagggagtcgctatcgggaatccgctcctcaagcttgacagggacgtccctgcgacctacgagtacttctggtctcatggcatgatctctgacgagatattccaggcgatcagccacagctgcgactttgaggactacaccttcaacgaccctcacaacgagagcaagtcatgcaacgacgccatcgcggaagcgaacagcgtagtaggagactacgtcaacaactacgatgtcattctcgacgtctgctacccatcgatcgtgatgcaggagctacggctgcgagaatacgcgacgaagatcagtattggggtggatgtctgcatgtcctacgagaggtttttctacttcaatctaccggaggtgcagcaggctctgcatgctaacaggacgcatctgaagcatcactggagcatgtgcagcgatatcctgaactacagcaacaccgacggcaacatcaacatactgcctacacttcaaagaatcgtcgagcacaagataccactttgggtgttcagcggcgaccaagactccgtcgtgcccttgctgggcacccgaacccttgtgcgagagctcgctcacgccatggggctgcatgtcaccgtcccctacagcacctggttccacaaaggccaggttggagggtgggtgacggagtatggcaacttcctgaccttcgccacagtgcgaggtgcgtctcacatggtgccctttgcacagccagaccggggctctcgggctgtttcgatccattgtactcggacaaagactaccgaacacgacgaatccacacattgactagaagtgtatctacagaagaaggtggagacagaaagaaaatagcttagattttgtttttttcttcagttttgctgcaatggatctacaaaagaaggtagctcataaagacgtgtgatgtgttggatgctcaactagtactttaactatttataaagagcagaaataatattttgattaaaaaaaaaaaaagaaaaaaaaaaaaaaaaa

SEQ ID NO: 10416 - DNA, 3428 bp, Zea mays
agcagtgagttcactgctgcgagataggagagacacccgtgcgagtgcgagataggagcgagagaggagagaaggaagatgtccggcgtccgtgctagagaggagaaggagagaacggacacctcgacggcgctaacggcaatggagacggcaaggtatcaacgacactaagcgtttaagttaccgtgtaatgtcgtggtccagtccattttagagtgtgggttgtccccaatttttccataagagcgaatctctcgcctacgcctccaaaacgtcgaagccgcacgtgaagatctccataatgccagagcccccctcccagccagggaagtctgctactgcctccagtcccagatccacccgtctgttccgccccgccgcgcgcaccatggatcccccgcggcggcggctacccgccgcgctcgtcgtcttcctcctgctcctcgccgcggcctctcccgtcgcgcgcgcgtggaagaaggacgagtttcgcaactgcaaccagacgcccttctgcaagcgcgctcggacccgcgccccgcactcgctcgacgcgccgctctccctcgccgccagctccctggccatctcccccgacggctctatctccgctgagctctcccacccgtcccgcccgcggcccctcgtgctccgcctctctgcgctgcccccgcacgcgctgcggctccagatcgatgaggactactccaccgccacgccgccgcaccgccggtttcacgtccccgatgtcctcctcccggacctcgaggcccgcacgctccacctccccgagcccaagactgccgctggcgtatccaccgttgcgctctcctccgaccttgacgtcgtcgttagacacgatccgttcgagcttgccgtccgccgtgctgggtcgggcgatcccgtgctctccttcaactcccacggcctcttcgacttcgagccgatgcgggagtccaagccggaggacgacacgtgggaggagcacttccggagccacaccgacaagcgcccccgcggcccgcagtccatcaccttcgacctctccttctatggcgcggacttcgtctacggtctcccggagcacgggtccacctcgctggccctccgcccctcccgcggcccgggggttgaggagtccgagcccctaccgccccttcaaccttgatgtcttcgagtacctccacgaatcgcccttcggtctgtatggctcgatccccttcatgattgggcatggcggccgggcgtcgtctggcttcttctggctcaacgcagcggagatgcagattgacgtgcttgcaccaggttgggatggggtcactgaccatgagaacgggcggatcgacacactgtggatggctgaggctggtgtcatcgatgcattcttctttgttggttctgagcctaaggatgtgatcaagcagtacataagtgtcacaggcacaccttcaatgccacaacagtttgctactgcgtatcaccaatgccggtggaactaccgggatgaggcagatgttgacggtgtagatgctggttttgatgagcatgatattccatatgatgtgctctggctcgacattgagcatacggatggcaagcggtactttacatgggatcattctgctttccccaatccagaggagatgcagcgaaagatagcagataaggggaggaagatggtcaccattgtggatccccacatcaagcgtgacagttcattccacctccacaaggaggcaacagacaaggggtactatgtgaaagatgcgaatgggaatgactttgatgggtggtgctggcctggatcatcatcctatcctgacatgttgaatcctgagatacgtgagtggtgggctgacaagttctcctatgaaaattacaagggatcaactccaacactgtacatttggaatgatatgaatgagccatccgtttctttcctccaataggtcaccatgcccagggatgcaatgcattatggagatgttgaacaccgagaattgcataatgcatatgggtactactttcatatggctaccgcagatggacttctcaagcgaggcgaggggaaagatagaccctttgttttgtcaagggccttctttgctggaagtcaacggtatggtgcagtttggacaggcgacaactccgcagactgggatcacttgaaatcttctatcccaatggtcttaactcttggtcttactggcttgcctttctctggcgcggatattggtggattctttggaaacccagaaccagacctattggtgcgttggtaccaagtaggagcattttatcctttctttaggggtcatgctcatcatgacaccaagagacgtgagccatggttatttggagagcgaagaactgccatcataagggaggcgatacatatgcggtattcattgttgccctacttctacacgctgttcagagaggctagtgtaaatggcattcctgtcatgcgtcctttatggttagaatttcctgacgataaagaaacttataacaatggcgaggcatttatggtggggcccagccttttagctcaaggaatatacgaagagggccagaaatcagtgtcggtctaccttcctgggaaggagtcatggtatgacttgagaaatggatctccatacaagggaagcgcgacacacaagctacaggttttagaagatagcattcccagcttccaaagggctggtacaattgtgccaagaaaggacagattcagacgcagttctactcagatggtgaatgatccatacactctggtgatagcactcaatagctcaggtgctggagaaggcgaactttatgtggatgacgggaaaagttatgagtaccagcaaggggcattcatccatcgccgatttgtctttgcagacaataagctaacttcattcaatattgggcctgacgatttgggcaagaaatttagaagtgattgcgtgattgaaagaattataatcctcggtttacgatccggagtgaagaaggctattattgagcctggaaatcaagaactagaaattgaatcagggccaattagtttaaggagtggttccagcccagtcgcgccaacaatccggaggcccaatgtttgcattgcagacagttggactataaggatagcataaaaggtaggccattcacatctggatcctgatgtctgatgtcttcttttgtctgctgtcaggttgcaaaattaggccagcctttagaagtttagttgtggccttgaaatatttgcatgtaactggtacttaagctgttccaactgccaattttgacataaatacttatatacattgctgatgtatattgtagctttgatacatgagcattttatcttgcaaaaatgatatacagttagtcagttacaaattaaaaaaaaaaaaaaacaaggaaaggcccggtaccca

SEQ ID NO: 10417 - DNA, 603 bp, Zea mays
gagaatgtaccaagattaccttgttgaaaatctaacttatggctcgaacttgtttcaacataggttcaagataaatcgaccactatttcttccgcataatgaaagtttgtggaacaacatgatgattacttcgagcagaagagaaatgcagctcaactcatcaataagggataagttgttttcaaaaggttattgcagttttccgtgtgctaacttatagagtggcagctgatgctacagatgagtacgtacgcattggagaaagtactgcgctggaaagtctaagaatgtttgttaaagctgtaatagaagtttttggagttgagtatttgaggtcaccaaatgaaaaagatatcgaacaattacttgcacttggtaatgaaagatgttttcctggtatgctggtttcactagatggcatgcattggaggcggaagaaccgtatgccattgttgcaaggtcaatttttcgggcatcgccatacatctacaataattttagaagcagttgctttgctagatttatagatttcgcatgcttttttgtttgcctggatctctcaacaatatcaatgttcttcatcggccaaaaaaaaaaaaaaaa

SEQ ID NO: 10418 - DNA, 2188 bp, Zea mays
ggccgcttttttttttttttttttcaaaatgaggtttataataataatataataaaaactccaggccaccgactggcctcgccgccggcccccgattccccctccccctccccttctgccccccggcaagacggcaagggattaacaacctaacctgactcgtggcgggacggatgacatccccaaaaccctaaccacgcgacgctcgccgactcgccgtcacagccgcacctcaaccggagtcgaagcgccattgatgaactccgagcctgccgtggccgcagctagcgatgcacaagctcctcccacgcgccgcctccttcctcgacgcagccgccgccgcggcccccctgctgctctccttcccacgcatgcccacgctgcggctgtctggtagcccattcgtagccatgcgtcctggcggaaaccctagccgtatccgtgcgccgccgtggctgcactgtgacgctgggtggaggcggggactctgttccgccgaggctgcgaggcgcgggggcgatacagaggagatggagaaggatggcgggggtcgctcggcgccggagaggaagcagagatgtcggaatgatgcgctggtgggaaggggggagctgcttaccattcccggagtcgggccacggaacctgaggaagctcgtggacaagggattcgatgacgtggcgcagctcaagcagctctacagggataagttctttggcaagtctaatgagaagatgattgaattcttgcaaaattcagttggcatcattcacaagaatcatgctgagagtataactttgttcattaaagagagtgttgatgaagagctgaaaggcaccgatacatctaagcttcctaaaaataggaggttgaccttttgtatagaagggaatatcagtgttgggaaaactaccttccttcaaagaatagctaatgaaactatcgaactacgtgaccttgtagaaattgtacctgaacctattgctaagtggcaggatgttggccccgaacacttcaatgtacttgatgctttctatgcagagccacagaggtatgcatacaccttccagaattatgtatttgtgacaagggtcatgcaagagaaggaatctgcgtgtggaataaaacctcttaggctgatggaaagaagcgttttcagtgatcgaatggtttttgttcgtgctgtgcatgaagcaaactggatgaacgagatggaaatcagcatttatgactcttggtttgacccagttgtgtcatcactcccaggtcttgtacctgatggttttatttatctaagagctagccctgatacttgtcacaaaagaatgatggtgcgaaaaagatcagaggaggctggtgttactcttgattaccttcgaggtttgcatgagaaacatgagagctggttacttccatccaagggaggaggttctggcgtgttgtccatcagtcagcttccagttcatatggagggctccctgcatgcggatatacgagatagggtattctacttggaaggagatcacatgcattcaagtatccagaaggttcctgctcttatcctggactgcgaacatgacattgattttaacaaggacatcgaagccaaacgacaatatgctcggcaagttgcggagttctttgactttgtgaagaaaaagaaggaatctcttacagcagagtcagagacggctgatggtgataagagtataaacaaacagattgtgctgccgcacggaggtggtttgtgggtgcccggaagcagcccgttaccagaatcagctctaaaatcatttgatttcaggagaacgatgtcttcctcgacttaaggtgggcaaacatcccaatggcgctatcaatttctgccgacaacctgcattggtgtggtccagcagcgtatctcgattgatatatatataccctgtaaatctttaaagattatataaagatttaggcttttagctagtgttggcgtacaatgtattatactagtggtatccaactctgttgcctgtagatgatcgagctgctttctgtttgcctggaaatgttgatcgaaccgctttcgagacagtgcttttgtaaatttggggtgcatcataggcgcagaatcttttgttttatcgttgtctcgccgcacaatctcacttctctggtttgttattagttactgggtgtctgattggtt

SEQ ID NO: 10419 - DNA, 2475 bp, Zea mays
gttccgatttagtttaaaaataaattattggacggcaaatatttgagaatgaaagtaatatttatttagaattaacctattttgaattaattagtttaaaataagttagattgtataatcattctgagtatattataattccaaacaaccaacgcaatcgatcggctggcatagtgcagccgtcgaaatctaccagagttggacggacccagccttcttccgtgcgccgtctgccatgacccgaccattcctgggcgccggacagctgcaactgcttgcgatgctgctgtccacacgcagcaacagttctcggaaccattccgccacgcagcggcagcggcagcgccgcacccgcgtgaacagcgctcgcagaccgccaaagctgcagcggttcctgtgaattcgctggcgcatgattgattattaccggattttaggctcggattcctctcctttgcaggcagcaggctagctgcttggcttaacttcctgcctgctgcagcggcggcggcgtccatgttgcaggagcagaactcccatcatgtgcgtcaccttcaaagcatgaatacgatggagtcatctacagttgagcagctctcaccgcgaactttgcttgccaggacatgggcttctcctagctagaatggctctcgggcctttggtaacgcgaagcagattatccaatgaagttaaaagcgtttttcttgttcgttttcgaaaataagtttatagagcatcttcgagaggaacagagacagacagagcaaagctctggttctggtttctaattcgaaaatggcatgggctttttgagaggcgttagtagggcttgttgataagagtttttttttttttttttgacaccacactagcatcgtatatatgcactgaactgaacgagtgaacagcatctaggaacagcagactgtagtacagcagtaaaaaaacgcagtactcctaacaccccctactaccatgcatgcactgaaatgcacctcctctcatctcatccagccaagaccacttggccctgcacctagctaccgctgctactcgatctccactactggcacctacagtacacgaagctactagccctagctatctagatgctcttcttgttgggccccgtgcaggccaccctccggcgcttcttcttctgggcgggcggcggcggcggaggcgcggggcgcgggcgccagaagagctgctccagctcctccagccgcaggctgagcacttcgacctcgaacaggcgcttccggcacgccgcgggcgcccgcggcttccgcggcgccggcgggcacgtccccggcggcttcacctggctctcgccgcccgtcggcgtccggcagcggtagtcctgatcctcctgccacatggtcgcggcggcggcgctgtcgtccgcccctgccccgtgcaggaggagcgtcggcggcgagaacgccggcggcgctggcttgtagaactccggcgacgcggacatggcggggatatggattgctcgctagctggttcttttttcgagagaagagaagaggagagtggtgggtgggtgtggattggaggagagaaacgaggaagcggcggcggggaggacgggaggttgcttgagacacttggtcacttctccctgggtctgcttcttgttctgggcgaaagcaaaggccccgtcccctcggcccttttgtattgggcggggtgccccctttttttttggtactacccagcgcgttcgaatgatgcggttattgcatttaggtccttgatggtacccgcgcacacatgcatggcatggatactctccactgggccaccaccactcgcttcaattattcggtggctcgatacagtggctcaggaaaaaaaaacttggtacgaattaaaacactgtgctaataaaacgctcaccagtttttggcacggttgcagctgcccaaactcatcgtcttccttagcttcaaagcatggtagccttttcctccactctagattatcttgaaaaggtacccgttttttatttgctactagtatacaccgtgagctcggctcgctcggagctgaatgaagggtgattttgtacaaacgcagcaatggcagggacctatacgcaagatggggaggctaatggatgggcacgcgcaggcaggcagccgacaagccgatcattcataggataccacatcgtcgacggcgtaaaataatcgccgccgccgcgaattttccggataggctctgcctctgcgacgatggtgattgtgactgtgactgtgatgactgtatctgtctgtctgtctgtcacccaggctcgctcagctcagctcggctcggccctgacgagcgcgcgtgcccccacgtacttggctgccgccgggccacgcatcggatgccgccgcgcccgtgcgcctagattctgtgttcgtccgcccacgttccgctgggcgtcgacgacgagagcgccgcgcgcggacaaat

SEQ ID NO: 10420 - DNA, 8889 bp, Zea mays
  misc_feature (6076)..(6076): n is a, c, g, or t
  misc_feature (7338)..(7338): n is a, c, g, or t
gtatcacgctcacaaatcgcagagcgcacggcggccactgcccactggcctcctgaatcctacgctcgccaagtcatcattcgcgaccagctcccgtgatcctcagctcacctgagctccgcgtataaaaagcgcgagctgcagaacccaaccaacaaaagactccacttcgccaagtcacgctcacgcacgcgttttctcggtggacggtgggcacggacacggaggagccgccgcaagcgcagcgcagcagtgggcgcgaaagcaaggcatggcgtggtcggagacggacgccgcgctgttcgcggcggtgctggggcgggacgcggcgcaccacctgagcaccacgccgccgcaccaggacgcgcccgcggcgtcggcccccgagctccaggcgcgcctgcaggacctcgtggagcggggcggggcgtggacgtacggcatcttctggcaggagtcctgcgccggcggccgcgccgtgctcggctggggcgacggccactgccgcgacggcggcgccccgcaccacgacgacgcggaccggagcgtggcgcggaagcgcgcgctgctgcggctgcacgcgctctacggcggcggggacgacgagggggccgactacgcgctccgcctcgaccgggtcaccgccgccgagatgtactttctggcgtccatgtacttctccttcccggagggcgcgggcgggccgggccacgcgctcgccacggcccgccacgcctgggccaccgtcgaccccgcgcccgggtggtacgtccgggcgtccctcgcccagtccgcggggctccgcaccgtcgtcttcctcccgtgcaagggcggcgtcctcgagctcggctccgccgtgcccgtccgcgagactcccgagaccctgcgcgcgctccagaccgcgctcgctgtcgcgcggcccccggcacgcgaggaatgcatgaggatcttcggccaggacctctcccccggcgggagcgcccgagccccgcgcagcgtcgacaattgggctccacatccacacctcgccgcccaagccaccgccgcgtccgcactagccagcaaggaagccgccgcgggacacaaggctccggagccgcccaggagcatagacttcagcaagccagggaagcctgggcacgggcaggccggcggcgaggagcggaggccgcggaagcgcgggcggaagccggcgaacgggcgggaggagccactgaaccacgtggaggcggagcggcagcggcgggagaagctgaaccagcggttctacgccctgcgcgccgtcgtccccaagatttccaagatggacaaggcgtcgttgctcagcgacgccatcgcgtacatccaggagctggaggaccggctccgcggcggcggcggcggcggcggcggctgctcggcggcgcgcccggacagcccggacgtggaggtgaaggcaatgcaggacgaggtggtgctgcgcgtgaccacgcccctgtacgcgcaccccgtctccagggtgttccacgccatcagggacgccgagctgatcgtggcggcgtcggacgtggcggtggcggacgaagccgtcacgcacacgctcgtgctgcggtcgcccggccccgagcagctcaccgcggagacggtactcgccgccatgtcacgggggatgaccagcgccaccccctccccgtgactctgtagcggtagctgtaagtcgtaaaccgtactcgccctcgtgcgtgccggccacatagtaaagccacagaaattgcaatggccaaggcccaacattaaatttactgctcgtttcctagtttttttgcatttggattttaattagatgagatgtgtacacgcaaggcggcaaggcacagtttgttgctcttactagctatagctactttagtttgttgctttcccaacctactagtatttttttctgaacaagaaaaaaaaaaaaaaaatttctagtggctaactgtactagtagtagttctgttgttttcacagtccacttagcttgtcgtgactcgtttttgagatcaaatctattccattcgatttttggtgtgcaagtgtgtcgaatgtcccttgaccactccaaccttgcggggagcaagcaaagcaaaagcacccgcggaccccacatgtgctgtttactttgaccaaacgaaactgagtctaataaatcactggctgatgaccgaccggcagcgcgttttcttcgtttcacatcgccattcgacacctcaaagagaccagcccaaaggttttcttgttcctctacgaaaacccgcgccgggtccccgcgtggtgcgtggaggtcctgctcctgctcctgcctggtcgtcgcgcgcgcacgcacacgtccatttgtcgagcgcgtccccccttcgaaagtgcggcgatcccaagtcgccgttggctcacgcgccgtctggtcggctggtgcctggtggtcgttgttcgccgcgaggccaaagtcaccggacacaggaggttggcgtgcgaccatcagggctaacttgggagcaacaaaaccggtgagattagagagctaaaatactctctctattcaattttaaataagaagaatattttagtccctacggttttttactcataaactagccctcagagataaatttcttggcgccgattttcggtgttttttcgtccccggtaaaggcctaaaaactcttttatcggtaaatttcgtttcaaattttatagttacaaaaataaaaacagaaaaacaaattatagtaaaaattagatgctttcctgagaaaaacataataaaatatgaaaggatttttagtttttctaaacattagtcatcatttttcggtaaaaaaacaatgctgtagagaaatacgaattcgtttttcagaatctaaaattcattctggtcgagaaaattcgaaaattggcgaattttggttgaattatagttttgagaaatttgaagaaaaacaaaatggttaatcgtggcgaccatattctcgcccagagcctccaaatatgcaggcctcaaaaaatagtctacataagcaaaccaagcataggtagtcatcattagggatggcaacggataaagtattcgcgatagtgtctctagacattcatatccgtgacttatatctgatatccgaatccgtacccgttacccgctatgaataaaaaatagtatccacgtctgttacccgcgggtaatggatatccacggatatatctgtttgcccactacacatacaacatatttaaatccagcaaattcaaatatgataacatatttgtccaacaaatttaaatatgataaaaacacgattgggatttggggaggctagacggtcaggagatgggcggaccgcgacgggacttgggttggctgtggttcgtgaagtggttccaaactccagtgaccccacatgtcaggttactttaacggacattcgagtattcgggtatggatactgatttttcgtacctgttttaaaaatatccacggatatcaaatgctacccgtatccgtatccatgggtacaggctcgtacccaaaaccgtgtccaacgggtttttatccgcgggtacacggataaatcacatccattgccatctctagccgtcatgtcatcacaatccatatagattggaggggttgagtgaatttaaaacctaaacaagtaaaaaaatccttctaattctttttcaatcacatttaatccatatgagatggaaataaccaaacagggaccgagcaggaataaatctagtatcaaaacctaaaagtttagtgcggagccagaattgaatgatgatttgaggttggaatgaagatttaggggttgtttggttcgtgcctaaatgtgccacactttgcctaaggttagtcgttcgaattgaagaactaatcttaggcagaaaagttaggcaaagtgtggcaacttagacatcaaaccaaacaagcctttactccttgaaaaatagaccacgagtctgcaactccgacaacccctgccatccgcccctgcaggtactcccttcgttcatatgattttagtcgtttttgggttttttctaagtcaaaatattttaactttgaccaacaatacatataatattaaattattttaaactaaaagaattatatattatggtagttcaagtcattatgaatctagtaactttaattttttatgatgcaaaattttatgaaacatccgatataactggtcaaaattgatagtaattgatttaggataaactcaaaacgtttaaatcatatggatggagatggatggagggagtggcacgtaactttgcattcctttcatttcgtaaatctctttcaattattcctcgccgcatgcaaacaatggtaagaagaccaacatgtcttggttttcgtccccactagtccagttatttattagacaaaatcacttgattatgagtagttctcactctgcttacctggacaatttttagatagattatacacatccaaatttaagtacttgacttaacatagaccctatatcccaaaatagtttatagctacatttcttcgtactgatcaaacatcttttaagattgaactaaatttataaatgaatactagcatttttctctgaataagtttatttaaaaatagattcaacgatctatatgatggtactaatcatgtactaccttcatctttttatatttgacgccaaacaatacaaatgtcaaataaaaaatatagagggagtacaaaattattaatattttttacatatttgatcaaagtaaaaagatgattgactcttcaaaaagcatgaacgataactattttatgatagagaaactatatgctcatttggggatagaaacgatgcaaattccggacccggatcctcgcgttcgcgcagtcgactgccgggaggcagacatgtggggtctctcggcgtcgacgtgtaagagcagtcgactagcgatgatcccaatccgctaattcctcaacgccaaatgactcgtttctttgcacgagatgttcaggcttctcagatgagaaacggttttcactcactttcgtctctttttctcttgacccggcttccacattataaagacggtgacataacatgaattttaatgctataaaggcatatatggttttagattgagagtatccttaatgtcgaccatcatttaaaggggctcaaagagtagaaatagaatatgaatatgcatagagatactccctctcatatgtaaatagttgacaacaccatgaataagattgagcgcaaacttgtaaagcctcgtttacttccaaccacgaaagcgtttaattagagaaaaaaatcaatcctttatacttatcgattgacaagaagaactttgttcaaaaatatatttttgttcagatggtcatatatattatgataaaaagaaggtcaaagctatgtttttttagatcatgtagtagttgtttattgagcattggaggtactagaatttattgaatgtgtaatccggagccgttatgactgtagaaatcactattagtctattactatctctgaaaactattctttcgagagagagaaaatcggtactccagtttaattaagggtgtattgcacaggcgtgtatattttgcgtgacggcccttcctacgctttggcaggacgtgtcgcagcggcaggcggcagcttccgagcgaagcgacgccgcgcgaatagacgtcggacaggcgcgtacggacggctgatgggcagaggcgatacgacgtgaccgggcaggactggggccggggcggcgccggcgccggcgtcagggtgggatctgccgatcatgcatcaaaggcggcgtcgggactcgggacgatggatccctcagatgcgacgtgccagcaaaccgaaccggcagcctttcaagggggtccggtccgctcccgttcgcgtgcgtgtcgtacagtacgctgggtgtgtcgaaccactgtagcgcgaatcgaaaggcttcgcttcctctgttctccggcgacccgacaagtgtccggatagaattctcaccggtgagcgctcagcagcagcagcagaagtgngtgggttcgtctcctgtgctgtgctggcgccacaggagccggacagatcgagcaaagtcacggggtctcagaaccgccgccgcagaaattgaagggagagagaaaaaaaaaagtaacgcgtcggattggctcggcgtgttacgatactttgtgcggtggtttcgttgattaagaagcatccgttaccggtcccacccaccatcccacggcagcgcagtttctatgtgttaggttgcacctactgttcagtattcattctctctctctctctgagctgagccccttgccaattttgtcagtttgttagttttaatctgtatcggcttctactgcttttacaatattttatttttatagattgtagctgtaacagtccgaaaaattagctttaatctaaaacgaacaaacctgtaaacgctagatacggtacgccgcgttgcacgtgcgctccttcgactctacaagctgcatcgcatgcccgactcgacaacaaccgcagcgtgccgtcgcgacattcattgtccttgcacttggctactgttggcacgagaaatttatcttaggtactggttgtgcggtgcatgcagcatgatgatgcaaaccgaggccctgtgcgttgtacaccgtactgtaccagaagggaaacgaacgcgccaccatcaacaatacatttagtgctagttttggaatcccatttgttttaagggaaattagtttattttctcttgcgaaaatagaaatcacttggaaaaaaatggagttgtcaagctagcacttaagcttggtacggtggtacctcattgacatggatggaaatagacgcctgaaattcgattcatgagaattggtactccctctgttctaaattaaagtccgtcctctctttttactagattcatacaataattattgtctagtttaattatcatccatatgaatatggacataaaagtatagagataaaacgactatcattttaatacggagggagtatttattaaaacttgtatacggataattaactgtacgctggtacagtagcacactgccctaatactcagggtccgatgcctctaataaaaccttgcaaccacttccaaatctgaaaactttgtaaatgtgtggcttgttgtaaactacttttggatgtcatctatgttgcctagaggtaaagaaactagtatgcaccacgctacactgaacttattagactcatctctattagtccataccccctttatagtatggtcaaaagaaaaatnaaatttctaaactactcttaagtgtctctcagttccttttttttgacgatgttcgagttgggcaaacggtaacgtcaagtgtcacgccggcgggatgaagtacttgcgctacttcatacaccggagtaaaaacatagtccattttctgttttatgtggtaaatatatagttgccacgataaagctagtaataaacgaagatgtggccactatatctatggcaaatagttaaaaaaacgcagttcctatagacacatagcaaaacaaaaacaaaaactatatatctaggaaaaaaacaaaataagttattattttaaatagatggaacagaaaatgtgaagagtgacattcctgctcctacgtcgtacatccgtttccatctcccgttcatacaccggagttacatggataggtccgtgagtccgtccaattttataagcgcacgtcacgtctccatgtgcgaccatggacgggaacacgtgaggagttaggcgggtggtcactcttcttccctcgctcgtcgcaagctattactcttctttctagctacatactatatacaggttaaacgtaccggtgtgcggtgctcatgtggtaacaaaacgctagccagctaacgctagacgatgccaggcgactctgctctgtgttgtctgtccggaattgccttttgcatggtgatgccgcgtcacctatagcttgcattgcacacaggtactctgcagccgagagctacgtacgtaaaaggttcatcgtggatcgtcttgcttgtgctcgctgagcatgcagaacctacaagacgacgtttttttttttgcgttgtactttgatcggctgatcgctcacgcaaccacagtaatcaccactctcagtagtacatccgtggcaactcagggcttgtttcgaagcactcgctttatatgaaattggtttataaaaattgagatggttccaaatatatcagtttatatcctattttatagaaaaatggatttccacattcttaaaaaccaccaagctagcctttcccctagctacacagccaatttatgaaaactgagatatatggttctaaacacaattaactagttttttaaataaacaagtttctattgaaattagacccactagtttgtggcccaattcaataaggaagtcaaggtggtgcatagagacggcatggggcttcagtaccatattgctcatctaggtaatagataaccaacttatatgtgagagtattgcctactcctcacatgatacaaataaagggctatggaggctgccacacacgcgcgccacgttatttatcgtgtcatgacgtgctctaaacgacagtttaatttttgtattttgtttatttggttatcaaataccacaactagactgctacgcgtcaaccgggagtaatggacgtgcacgattacgtgcgagatctccggatggttgcacatggagagattccaggggatggttcctaaaatttagcatatcgaatcaagaaggttgcgacaaccccctctgtaaagggcagatgtcctttagttgggag

SEQ ID NO: 10421 - DNA, 911 bp, Zea mays
tagggtggtaacatcctgttttggtgtacgcatcccgagtccagtagacgaagagtcttgtatggctatccttgtacagacctgggtaaacctgccaccctgcttctatagtattgaggtcgttgtttgcgtaggatccactggtaatccacagctgggccaaactgaatccttggttcctctcaaccgttggttcccacaggttgaaggttgcttgggtaccatagtagttgtcatcccccggtgcagatgctattgcatgctggtggcctcttagtacgctcgctgcgtccgggacgtcgtcgtcataacggttagggtcgttgctccaagacgatggccacttcctgccatatctctggacgatgttgaggacgtcctcttctctggtcctccggattggcactgtgttctctgggcacttgccattctgatgccatgtttgcgtcaaagcactgtgcgcaacgtcgtttgacttgttatagaggaggccttgttgtgggtggcaggagggcatcatctggatggtatggttcttgagggaaggatggtcgaacgcgggctgtttcgagatgtgcacacagtctatggtatctccatctgggctctcgatggtcgcgacagcgggcttgttgagacgcctgagcaggctccgaacctgtcgccgccgctgcgctgccgccgacgacgcggcatgcacaccaccgtccaagaggaagagaaacgctagagccaccaccagcgcgaccaagcacactcgcgtcgtagcagcaggcgccatcgagcagcggtctgtacgttccaggcttctagctagctgcagctgcttccgtggttcgcctcgacgacgggacgatgggccggccgcggcgtagccactgacatcccggccggcctcgaggtacccaatg

SEQ ID NO: 10422 - DNA, 871 bp, Zea mays
tcctctttcataacctgttcgaatcccttttccgagcagatatgaccagaacaccaatgtcagcttgagatgcaccactgatcatatttggaacataacttttgtgacccggtgcatccaagatagtgaatcttgtgtgttctgtctcaaagtgggctctaccaacttcaacagtctttcccttgcccccgcctcccccttttgtgtccatgatgtaagccatgtaccagctttcccgacttttatcctttgcttccttctcatacttctggatggtcctatcatcaacttgaccactcaaaaacaatatttgtcctccagtagttgattttccagcatcaacatggccgatgaaaaccacgttcaagtgtctttttgtttcatctacatcgtcttcaaccacatgagcaccttcttgagtagcaacatttgttttaagctccaaggattgcagagatgattgaatttccttgacaccttctgccgcgaccgcggccgagggcgcgggcgcgagcggggcatcagcgcccgaatctgccgcagttagctccgcagcggcaacgccagattcaacggacatgggctccgcgtcgtcgcgagcccaatcatcgacggtggcgacctccggtggcgggacggcgtgtggtggggcctcggcgtgcgcatcgtgctccatcccgcgatgcaagtgcaagtggagctcgaggtggcgcggcagcggtggagagacactgctggactgggctcggcggtctagggttttttttgtgtgtgttcggcgattgtgtttcggcgagttggggtgggcggtggctgataccatatcccgccccgcccgccgcgaggtacccattcaaaaaccccccaaaaa

SEQ ID NO: 10423 - DNA, 987 bp, Zea mays
agactcctttcccccctcccagttcccaacttcataaagttgaaacagaacatcctaatcgaacacgaagattcagaataccaacaagctgatctagttaagatggatatccttcttaatggtcaacctgttgatgctatggcaactatagtgcataaccagaaggctcagcgggttggaaaggatttagtggagaagctcaagaaatttatagaaaggcaaatgtttgagatcaccatacaagcagcaattggttcaaaagttattgcaagggaaaccctgtccgcaatgaggaagaatgtcctggccaagtgctatggcggtgatattactcggaagaagaagttgctagagaagcaaaaggaaggcaagaagcgcatgaaacgtgtgggatctgtcgacattcctcaggaagccttccatgagctactgaaggtctccaatttaaaatagatggtgatccactgcaattttagtttctgtagctgtccaaattttataagtagctgtgtggtgatgagtagcagcaaccttttctagtcatcttctgacagatcttgacagaatgatcgattccattgagtacataatggcctctcctgcgccttgtcagacgagccaacttgtgctggaagttgctcctcctgtagtcctgtcatccatcctgtggtgattgatatacacacaaggcttctcagctggccgcagacggatttcagtagagccaccatctttgtatttgttgattgattgatggagaaccatcctttgagcacttgctaaacccagttttctctgctgacctgatagtctgccttgtcacgttacactctattttttttgttagataatgcttttgagcaaaaataataggtcatacacattaattggtcactgaaacaatgtggtacatgtaataagaggagctgcattgtataaagacatagtagtatcatgtttttggagtttcgggctatctccttttcg

SEQ ID NO: 10424 - DNA, 3892 bp, Zea mays
ttctcctccgggtcacaaacaagacacgtttttagggttgtctacttgtcttaataattaagtccaaagtcaagtatctaaaaatagttctcatgatttgattcaaatcaaattattattaaaaaacagtggtcaaagttttgtactccctccgtttctaacaattattttttttgctttgatatcgtttacatataatatactttaaatataactttgaatttttcattgttgcaaaaaaaaacgaagtcaaatttactaaaaaagttaagcgaattataaattggtacaaagagagtattagaatgacccacttgtcttactcattataaatattctaacaaatataagtgggtctaagacaatctctcgtagagtgtgaaaaataggagggtgtgaaactgtagatgagattgtttttatagagaagtttgaaatagtaattgagctaggagatgagatagctaacccatttttcagcgtgggttgaccccgaccagcaacagtgccaagtcgtttgccgacttccaaactaggcccaccaaagccgccgtgatcatttgttgggttcttgtcgacgcgctacccgcacgaccgtaatttccatggataccaaaaaatccaagataggccgctcgcgttcgcgtctcttcttggcttgagccttggtgaagactgaagacgcgcaagtgtccgttacccggtgaatggacatgtgatgtgacgctgtgcaacttggtactagctaccttgcatggccgcacgaggcacgaccccatgctgaccaggtcaaccgtgaatgacccggtttgttttatcttctttttttttcaagttctaaccactagaagttaaacaactagtttttcagtctgattttataagattagttttgatgaaaattatttaaaattaacgtgaacatagaatcacttgagtcatcatgatattaataatccgtcactttttagattctaaatcctataaactcgtttatctttctctgtatataatcccctacggctagattcttaaaaaatctcatcagaaaaagttgaaataagcagatcttatcttgtctaacacacaggtcgcactaggttctaccgcggcgaacggtattgtaacggtcgagctccgacggttgcgccaccgccgtgacactcgataacaccggcgcttgccacgacaagctcccgagctgagggccagacaaggctgctccacatgttgatataactactgcagaatgaattttcagagacgttcattttttttcaaataaggagacagacgatcttactgtttcaattagagcaagtagaatgatgagcgagtagtcggttaaatcctaggtggaggacagagatgagaagagagagaatggaacgagcgtttcgcgaagcgcctgcttaaacccggctgagacgtgttctctcatctcccatttgctacttgctgctacacgtgctgcccaagtgccgattggctatatatgtgttgttgtccacgttgtgtcccattaactgctgcccacactagagattatttcgccggtatcgggcgaaatcattgcccttgctcttaaatagagagaagatcttactgtttatatttctaaaagttatttgataagaatctaggtgtttggcaacctaactgtgtgggagaagggtcacaggcttcgtcactttactgagtaggcaagaagtcgagcaacttctgggcgccgcggcctgctggccgcttctcgcaggccgttgtgcgggcgcttcgttatgaagtgcttggaagagaagctggccaggaagctacccgtttagttctgctttgagattatggcggccaaaatcctaaaaaaactgaaacaaacacaacatatagctcatcgagttcgtgccggtggacgtctagccacggagcttcctattgactctgaggattggtcagagggtgcattaggccactggtagtgggtatttcatgagagttttatcctcattaaatgatatgccacataagtaaaagcaagatatagcttacaacgggctttatgatattatcatgtcatatttatccaactaaaagtatagtcatataataacctttcaatgatacaagttgtatatttaatacgtggtccacccttcttctcatagactgtcttgagtttatcaggagtccgttttcagatggctactagtgagcagttgcttctattctctctccatttctttttttcttcacatcagtagaaatttaatgcgccatctcttagagtccaactatattaccttattatatatacttgctctaacaagtaggatgatatgatatgacatgtgatttaagtaggatgatatggcatgtaatttaatgaagagggatatgagagagttttatagtattgctctaacaacttttttttttttttttcgcgtaacaaacttgtaaaatatgatgaaactatacactgaaaatgaccttacacccaaccataatcattcgcgcaaaataaaggtgcactattttgctttcctatgagcaacggagccttggaggattctgacgcagcatatattacatccataattccatagctcacggcataagaaaagaacaggaaaaccgaatacagcaaagacattacagactgcactcggtgttcttatcgagtctcgaactgaatagttgaaggcaaaggagcggcaggcggtgaatcgaatggcaggtggaggtgggcgccgcgggagggatcggacgacatagtatagtagcaatcaactgaaggccgccgatagaacatcgagcaccggcgatgccaagcctccggttgctgcgttgaccgcgacattgaagcttgtcttgagaagaaacttggcgacggaggaacgacggctccgtcggacgggaaggctctggccgctgctgctactttcgcatgcagaagcagaactcacctgcgcggtggcggcgctggcatgatgagcactgccggtgttgcttcggccacagtagtcagtgctctggcgaccactgctgggcgcgccggagacgcacgcgatgtttactttcaacggacaagagcagacgtagttccacacggacagttcctcgcagccgcacatgcacgtgccgattgaagggaccaggcgaaggtcgtgccgtgggtggagggggctacggatggtctgcgggagcatggtgcagagagggtgcacatcgaagaggcaatcggtgcagcgatacaccaagtctcccggcggacagccctcccagcagaggtcgcaggaccatccgtcgcaggaactgggcatgcggcttagcgtgagggtgtgccaggggtgcgcgaagaaggagattgtctccttgaagtaattggcgcaagcctcgtggatgtcgaagtcgcaggcgctgcagcggtagccggtgaggccggcccccggggacccgctgatgtcgcatacgtggcgggaactgctgttgtactgcgtcttcagaagcacatgtgggtcggcgaagtgtctccggtgaccagcagacgccatggcgatggccaaacaaggatatgcgtttttctttggttgggacttgggaggaagaggaacacgcaggagaactctgaagctaagctaagctaagcctggtttctggggagtttgggtttgggcatggcattcaggagctaatcagttatatagagggacactagcatgtcggctggtaattcatatcatttgagtctttgagctagctctaacaatgtttcaatcatatttggcgttttccttgtcaagataagtctttacatttatacattatcctccatagcaacaagtggcccatgcgttgcgttgacgttgacctataactgtacgtgttattatgaatg

SEQ ID NO: 10425 - DNA, 2658 bp, Zea mays
cgagagggagaattgtggtggtgctgaagccaccgtacaatctaatgtgattggtgaagttgttattaaaaatgttaattgtggaagagatgttgcccccgcctctttttttttttttgtactcgtgtaacgacacttccattcattatttaaattcgatgtcaactgttctcctctcctgtcaaagacacatgatgcgcaggcaatttcggctagtttcagataaacgtgtacagaatatgatgaactatgatcatacttccatacgggacgtgctcggggaatcggtccatttccttttctcaacaaccaaagaagctgaagggaaaagaaaacaaacagaagcagtagcattaatgcattattgcggtctagatggacgtacacgtacgtttctgccactcgatagcaagtgatcacccatcgacaggagcagcagtgctcgccgtcgcaggaacagacatgcgcacgaccagctccagcaccatatacacctcggacaccacctcagccgtcctccacagcaagtgaccggcggcgcgccggagcccgcccgttccgccgacgacagcgagctccgtcgtgtcgtcgaagatcttgacgcggccggccacggcgaaggtgctgccgttgtagggcccgtcggcgagcacgacggtgacggcgaccacgagcacctgctcgcgctgggaggacagcatgtaggtgcccagcgcccggccgacggccctggagtcggcggcgggtccctcggtcacgaggtcgtcgatggccaccgtgtcgccgaagtaggcgcccttcagcgacgtgtgcggcggcccgacgttccggatgaggtggatggccgtctgccccggcccgccgatgatgtcgtgcatgtacaaccgcaggtgcaccgggcgctggctggcgtccgccgcggcgacgagcaggagaacgacggccacggtggcggcaagcagcagatgctgcggctttgcaaagctggccattgtgatgcgcttgttagctgcagtagtgcagtgtggaatgtatgtttattgtttaagatcgatctatatagctgagagtgagcctcctgagcttgagcgcaagatgatggccaccaccatgcattgttacaatcaacttaggtgagaagttgaaagtggatggtgtgatgagatgacagtcgaaattgtctgaaatgtaggctagcgtgtaggcaggctgccaggccaggagtgacaccatctccttctagagcgtgaggcggacgatggcaactcaacaacgggttcttgacagtgcaactattagttccgtatatagatgcgatagatcggcccaccataatgaaaactacttttgaggaaatgtagacgaactgaggaattttgtttatttttaacctttttaaaaaatattgttaatttccccccttaaatctaatctgttttcttgtgtaagcttcctgacgcggctaaaccgaattaccgcgggcttgccaacattgcaagccaactacacgctgacaggtgacaggtgctgttgcatcccttcaggcttcacggcatatacaacctcatttaatgagtctaattaaagaaaagagatggatctgtctctacacaactctccatatgtatggtctctttattatatttatagtctagtatattagagttatatcatacaatctcttaactcttggaaactgaaccactatcttagggttatatatgcccttatcgtcatagcagcaggtgtagcaccaccttgcatgacacaacaggtgaggactgttggaaccgactgacgcgtggtcgagtgggctcgagcagcaggaagcaggtatagatggccatttgacactaacacgatgggccagcccaggcacggcacgaaaaagcacggtccaggcacgacccggcccggttagtatagtgccagtgcctggcacgacacggttatagtgccgtgcctgggccattatctcaacccgtagtgctggcatgggcacgacacggttacattttttattttaaaaataatagtttacatatattaaatataagatttcaacatataatacaataaaactgcagttgcattggttagatggatgcgtttaaacctcttatgcactaggttgtgagttcgagcccccacaactacacattttttgctaaattctacaatatactcagatgggccatagtgccaccgggccgtgcctgggccgcggcagcggcacgccggcccatctgggcacggcacggtttgctagccgggccgtgccggcgacgggccgtgtcgggtcgggccgtgccggcccgtttggccatctatagattgattgttgattcttttcttttttttcttaaaagaaaagacgacggaccatgcaggaagactggaagaggatagaggaagtataccagcaggcggtgcctaggttagatatgcacgtcatccgtaccgacgaaacgactggagcttcaattcgttttgctacatatatatgtaccagtaccagctagtatgatgaagcaacaatttaggctttacataaatgggctgtcttcggctcagcagtcattccataatcctgtcaatcgggtggcccgtcgccatccatctcttccccttttttaaacgctgacgatgactgctgca

SEQ ID NO: 10426 - DNA, 1045 bp, Zea mays
ttttttttttttttttgtaaaggtgcactattttgctttcctatgagcaacggagccttggaggattctgacgcagcatatattacatccataattccatagctcacggcataagaaaagaacaggaaaaccgaatacagcaaagacattacagactgcactcggtgttcttatcgagtctcgaactgaatagttgaaggcaaaggagcggcaggcggtgaatcgaatggcaggtggaggtgggcgccgcgggagggatcggacgacatagtatagtagcaatcaactgaaggccgccgatagaacatcgagcaccggcgatgccaagcctccggttgctgcgcggtggcggcgctggcatgatgagcactgccggtgttgcttcggccacagtagtcagtgctctggcgaccactgctgggcgcgccggagacgcacgcgatgtttactttcaacggacaagagcagacgtagttccacacggacagttcctcgcagccgcacatgcacgtgccgattgaagggaccaggcgaaggtcgtgccgtgggtggagggggctacggatggtctgcgggagcatggtgcagagagggtgcacatcgaagaggcaatcggtgcagcgatacaccaagtctcccggcggacagccctcccagcagaggtcgcaggaccatccgtcgcaggaactgggcatgcggcttagcgtgagggtgtgccaggggtgcgcgaagaaggagattgtctccttgaagtaattggcgcaagcctcgtggatgtcgaagtcgcaggcgctgcagcggtagccggtgaggccggccagcttggaccggcagatgtcgcatacgtggcgggaactgctgttgtactgcgtcttcagaagcacatgtgggtcggcgaagtgtctccggtgaccagcagacgccatggcgatggccaaacaaggatatgcgtttttctttggttgggacttgggaggaagaggaacacgcaggagaactctgaagctaagctaagctaagcctggtttctggggagtttgggttt

SEQ ID NO: 10427 - DNA, 1499 bp, Zea mays
gccggccggtccaggagcagaccacgaccagcacgcccacttgcctgcgattactttgcccctggggccctcgggcccggcccgggccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtagcagtagaaggaaaagagtcagtccgcccgtgactacgagtgaatttgttgggtgtggtgtttgttgaggtcacgatgatgggaggcgggctgttggtggatcagagcgtggtgttccctggcgtccacaacttcgtggatctcctgcagcagaacggcgacaagaacctgggcttcgggtctctgatgccgcagacgtcctctggcgaccagtgcgtgatgggggagggcgatctcgtggacccgcctccggatagcttcccggacgccggggaggacgacagcgacgatgacgtcgaggacatcgaggagctggagcgccgcatgtggcgcgaccgcatgaagctgaagcggctcagggaactgcagcagacaggcggcaaggactcgttggctagcggtgtgggactggctgatggctcgtccaagcctaggcagtcgcaggagcaggcccggcgcaagaagatgtcgcgcgcgcaggacggcatcctcaagtacatgctcaagatgatggaggtgtgccgcgcgcaggggtttgtgtatgggatcattccggagaagggcaagccagtgagtggtgcctccgacaacctccgtgcgtggtggaaggagaaggtccgcttcgaccgcaacggaccggccgccattgccaagtaccaggccgacaacgccgtccctggcgccgagaacgagctcgcctcgggcgctgccagcccccattccttgcaggagctgcaggacactacgctgggctcactgctctcagcgcttatgcagcactgcgagcccccacagcggcgctacccgctcgagaagggcgttcctccaccgtggtggcctaccggcgaccgaggagttggtggccccacctcggccttcccaagggccagggcccccccccgtacaagaagcctcatgaccttaagaaggcctggaaggtgagcgtgctcaccgctgtcatcaagcacatgtcaccggacatagagaagatccgtcgcctggttcgccagtccaagtgccatatccttcaacaccagctcgagcgagtatgatgtggacatcatcgatgagtgcaagggggacgaggccggtaaccagaggacggcagtcactgacccaaccgcgttcaaccttggtgccgctatcctaagcgacaagttcctcgtgccgacgccgatgaaggaggagaccgccgacgtggagttcatccagaagaggaacgcccccgctgcagccgat

SEQ ID NO: 10428 - DNA, 1656 bp, Zea mays
ccacgcgtctgcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatgggggagggtgatcttgtggacccaccgccagacagcttcccggacgccgtggaggacgacagcgatgacgacgttgaggacatcgaggagctggagcgccgcatgtggcgcgaccgcatgaagctgaagcggctcagggagctgcagcagagccgcggcaaggatcccatggctagcggtgggggcctggccgacggctcatccaagccaaggcagtcgcaggagcaggcccggcgcaagaagatgtcgcgcgcgcaggacggcatcctcaagtacatgctcaagatgatggaggtgtgccgcgcgcaggggtttgtgtatgggatcattccggagaagggcaagccagtgagtggtgcctccgacaacctccgtgcgtccggccgggagaaggtccgcttcgaccgcaacggaccggccgccattgccaagtaccaggccgacaacgccgtccctggcgccgagaacgagctcgcctcgggcgctgccagcccccattccttgcaggagctgcaggacactacgctgggctcgctgctctcagcgctcatgcagcactgcgagcccccacagcggcgcttcccgctcgagaagggcgttcctccaccgtggtggcctaccggcgacgaggagtggtggccggaactcggcattcccaaggaccagggcccacccccgtacaagaagcctcatgaccttaagaaggcctggaaggtgagcgtgctcaccgctgtcatcaagcacatgtcaccggacatagagaagatccgtcgcctggttcgccagtccaagtgcctccaggacaagatgactgccaaggagatctcaacctggctggcggtcgtcaagcaggaagaggagctgtaccagaagctgaacccgggcgcacgcccaccggcgtctactggtggcatcgcaagtgccatatccttcaacaccagctcgagcgagtatgatgtggacatcatcgatgagtgcaagggggacgaggccggtaaccagaggacggcagtcactgacccaaccgcgttcaaccttggtgccgctatcctaagcgacaagttcctcgtgccgacgccgatgaaggaggagaccgccgacgtggagttcatccagaagaggaacgcccccgctgcagccgagccagagctgatgctaaacaaccgattgtacacctgcaacaacgtccagtgcccgcgcagtgactacagcta

SEQ ID NO: 10429 - DNA, 844 bp, Zea mays
ttgggtacctcgaggccggccggggtaccttcggccgggcggggcgagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtagcagtagaaggaaaagagtcagtccgcccgtgactacgagtgaatttgttgggtgtggtgtttgttgaggtcacgatgatgggaggcgggctgttggtggatcagagcgtggtgttccctggcgtccacaacttcgtggatctcctgcagcagaacggcgacaagaacctgggcttcgggtctctgatgccgcagacgtcctctggcgaccagtgcgtgatgggggagggcgatctcgtggacccgcctccggatagcttcccggacgccggggaggacgacagcgacgatgacgtcgaggacatcgaggagctggagcgccgcatgtggcgcgaccgcatgaagctgaagcggctcagggaactgcagcagacaggcggcaaggactcgttggctagcggtgtgggactggctgatggctcgtccaagcctaggcagtcgcaggagcaggcccggcgcaagaagatgtcgcgcgcgcaggacggcatcctcaagtacatgctcaagatgatgggaggtgtgccgcgcgcaggggtttgtgtatgggatca

SEQ ID NO: 10430 - DNA, 7355 bp, Zea mays
gcggtggttctcgcctccctgtgccgcggggtgggcgactgcggttcgagtcttcaaaagccgaagagcacggggcagcgggcccatctgccaggccgccaccaccaccgccagcacccactcccttttgtcctagctcttcgcgcggtacgatcctcctcggaccacgccacaccgggagaggagagcaggaggccaccgaccggcgaccgggccccgcgtgtcacacgcagacgccaccagccaagctctccgcgggtggcggtaaaagagcgccatcacgcgggcgattacggaggggcaaaatctttttttaccgccgcgcagcatcgcagtggcagctcgtgagtggagggaggcggggatcattagtttaagagggcagattataaaagccgggctgtcgctgttgaggccgagcacagcagcagagcaccatcagcaccagcacgcccacttgcctcctattatttgcgccagagggcagggcagggcagggcaggggccttggcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgagttcttcctacctgcctggacctcctacccttcccagttcttgtgtggctggtcctccttttcttcgctgatcttcttcttcccttgctgcttgtgctactggagtgtggtcgcctgattatctgatggatatgtagagtgatattttttttccccaggagatcttttttcctctctagattttttttttcagtatcctgtagcttcccgaggtggccaattcccgtttgagttccgatccttcttttcccttgctgatgttctgtcctccagcgtaatagctgcggctaaatccacgacagagttccaaggttgatgccttcgatgattttgcagctcccatccaaaaacctgagtttcttacatctctttcctcttttttttccccttctacaagtttcggttggatctcaataccacaattagtcaaaggctcagctcgttctacggttctaggaagtgtctaacagccgggtgtgatggaaacattctgttcctgcatcatcttcggaggcgcaaaatttgaccagttttcgttaggtttgatacgtgtttagtccatttagtcccttgttttcttccctttcatgtatgaccttgattccccctttcaagcacatgggtgcatgttcgctcggtccccctgtcagttcgtgcttggctggttgaaaaaaaaatgactacttatttttttttcctgaaaagctttccttccctgccctttgatctttttttagctttcccccttgtgattcaaccagagcttgtgaacatgctttcgtaaaaaaagggggaaagatgcaactttacctgcttgttccgtgaaccggcatatgagtagtttttttatggaactatttatatattctcataagttttcatgctttaattccttcttccacaagtatgtgtgatgcatatttctcacccatgctgtgtaatctgtttcttttatgtcgaaacaataagggccatgctatatttggccatgtatagtttgatcagatcaaggccctgttctgtttcaccagacacatgccaggttgctaactttggcctcccggctgttgcttcagtaggcaatcttgcctttttctgctacacgattgtctcctgtagctgtgtagatctatgatgccaaggcaaaaggccctcatgtaatcaccaaattaagatgccacagtagcgttcactggaccatctttaattaccttttttactaacacgcaatcgtgttgcacatgtttacccttgccctgcacttattgtctgtgcactgaattgctgacagtaaacacagcagctgacgtgttcgtcgtgttgcttccgcgcaggtgaatacttggagaaaaaggtcccccacaccccccacgcaggtgaatactacaagtagcagtacaaggaagagagccaatctgcccgtgactgccagtgagttgctcgggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatgggggagggtgatcttgtggacccaccgccagacagcttcccggacgccgtggaggacgacagcgatgacgacgttgaggacatcgaggagctggagcgccgcatgtggcgcgaccgcatgaagctgaagcggctcagggagctgcagcagagccgcggcaaggatcccatggctagcggtgggggcctggccgacggctcatccaagccaaggcagtcgcaggagcaggcccggcgcaagaagatgtcgcgcgcgcaggacggcatcctcaagtacatgctcaagatgatggaggtgtgccgcgcgcaggggtttgtgtacgggatcattccggagaagggcaagccggtgagcggcgcctccgacaacctccgtgcctggtggaaggagaaggtccgcttcgaccgcaacggcccggccgccatcgccaagtatcaggccgacaacgccgtcccgggcgccgagaatgagctcgcctcgggcgctgccagccctcattccttgcaggagctgcaggacaccacactcggctcgctgctctcagcactcatgcagcactgcgaccccccacagcggcgctacccgctggagaagggcgttcctccaccgtggtggcctaccggcgacgaggagtggtggccggagcttggcattcccaaggaccagggcccacccccctacaagaagccccatgaccttaagaaggcctggaaggtgagcgtgctcaccgctgtcatcaagcacatgtcaccagacatagagaagatccgtcgcctcgttcgccagtccaagtgcctccaggacaagatgactgccaaggagatctcgacctggctggcggtcgtcaagcaggaagaggagctgtacctgaagatgcaccctggcgcacgcccgccggcatccactggtggcatcgccagtgccatatctttcaacaccacctcaagcgagtacgacgtggacatcgttgatgagtgcaagggggatgaggctggcaaccagaagacagcagtcactgacccaacctccttcaaccttggtgcggctatcctaagtgacaagttcctcatgccgacgccgatgaaggaggagaccgctgacgtcgagttcatccagaagaggaacgcccccgctcctgctgagccagagctaatgctaaacaaccgggtgtacacctgcaacaacgtccagtgcccgcacagtgactacagctatggattccttgaccggaatgcccgcaacagccaccagtacacctgtaagtacaacgatccgatcactcagagcgccgagaacaagcctctgccagcaccgccgcaaccacaagccttccagccggccttcagccaagccaatcaggcagtgaacaatctggacttcagcctgcctatggacgggcagaggtccatcgccgagctgatgaacatgtacgacaccaacttcatgacgagcaagaccatgagcagtagtgacagcgtcaccatcatggagaggccgaacgcgatgccccagaggatccagatggacgagggcttcttcggacagggcaacggagtcttcgacgacgtcaatagcatgatgcagcaacaacagcagcaggcaccacccgtggtgcagcagcagcagcagcagcagttcttcatccgcgacgacacgccattcatgagccagatgggcgacatcaccagcacggcggagttcaggttcggctctggtttcaacatgtctagcaccgccgccgccgctgattacccaggcgcggcgcagaagaacgacgggaccaattggttctactgaagaataaaacttgtagggctcctcgttataagcttcggattcctccatggctctcccaagttgtcaagtcttataggtcttcgttatataggttttgcagtagctgcaagacggctggaacctggaactggtttatacttgtatgtccggccagccataaacctctcttatttgcaaacttaatgttattcctagctttaagttgttagtctcagtctgctgtccatgtatatggctgttaaaatgcttgtgcttgtttctgtactacctgctgtttggtgtctgaatgaagtgttttcttcagtggttctgctcgaaaaaaaaaaaaaaaaaacaaaaggcacatcatcgctgctgctcttcacacaaacaacatgactgacatattcaaatattttgagcgtccacatgtttgttttgattgatgcaatctctccggcgttttttctctctctctttctgttggtgtcaaattgtgaacaaaaaatgttccaacctaacatgtttggaattaccctggttctgtatctgtcgcgccttaattccaacctaaacatggacaggtgctcctgtcatatggtggaaattccgtcttaattccaccgagattgatgttgatgacacccagactacacctgtcctttatagatattttcccacggtaaaacataccctgttgcttcagttaccgtcttgttaaaagagagaccatcactagtgtctttcacatcaagatattcatccttgctttcccttaaggtccggtcaacgcgaagtggcagccctaagggaagttaggccgtccaaactccaaaccgttccaagtgctttgatgctcaagataccggatggtcctttctttgatcgcaagagccctcctttcttttatcgcttgcttggtggcactggcacctgtcatcgtccatgagaccatgacccatcctatcccttagacctcctcacatgctcgccgctggagctggatgctgtggggacgggagctcccctgctgcatcatggagatggaggggacggggatgggccggggtggggtggggcgacgcatcgctcgctggacagcaattgcgggtttttgcttccgtggtggcggatccaagcgtctgggtccgctgccagatttctgcaggcagcctgtattcagagaagccgtttcgaccccacctgcagaatttcctgaccatttcgcccagagctctgttcgttgggatcacgtccatttctgaagaggcatacgggttcttgggatggtctgcggtgaaagatgaagagttagagtctgatctaagctacactactgtgatcacgagtaatgaggccaccaaatctgggccctgccggctccaaatccttatcgagatctacctaatccgtcccctaaagaaacgcttaggtttttattttagtaagctgaaatttgcagcatggtttataattattaaaccaaacagatggctggctgatgtgacttggtacggtcaaattgcccctttgatattcgctagcggcttacggctagctctgttaacctagaacaatggctatagcgctccaactctacaccctacaacttgtttatgtgtttcattgctttttggtccagtttaccaatgatggtgataggtggggatcaagcagaggaataaactagtgctgctctctaactaaccaagtttcttaggcaaaataagccgcttaaaccacgtgcttaggcgcatgattctttaatctttatggactgcacgaacgaaagagcaggtctccatgataaattaaaatagctgaggaagcaaagcaaccctggccccaatgatttgtttggactcaactctcaactggcactaaacaaactggccaaatgggggtcaaaacaagggagagaatcggttcataaaaaaacgtgtgtgcgccatatcagtcgatggactgccggagaacggtctccgcctgggtcgtggtcatggccacgcctcgcctaacaaagcgcacgatcaactgaacccagtcatgctcatgctcatgcccagtcgacgatgtgcgtgatggcacggcgggcctgccacgctggctggacggggtggagctggctggtgaccggtgaactgaaagcgagcaccgtttcccggctaagtgcagcgtacgatggcgagaccaccgcatctggggctgttgagccggccccggtgcacagtgccgaccacgaggacagcgagaggatgggacgtggcgtcagacggcgacagtagatttcttataataacgacagaactcttatccggtgacaattgaagctctatagtggggacgaggaagtgggatggtgcgtggttgggctggccggctgggtgcctgaaagcaacagatcaatggcgacgacgacggtgggaggtggggagaggggccgccggagtggagtagcaccgcggccgggaccggaatgagatgagacctgcgtgccgcgtgcgacgagtgatccacgcgacttgagcgtccacgccgctgcgtccagcctgtttcgattcgacggcgcctcggcgcgatcgggttctggtaaagaggacctggagtggagatagacgacggagatcgcctcatccagtacgtacgcgcggatatgtcatgtcacgcaccgcgcacgccacgcgacacggggccttctcctcgccagatcagatggccgaccacaggtggccagtcctgaatgggatccccgaggcagggaggaccggaggagtcggcgtcggtctggcccacacgcgcgttgcggtggcggtttcccggctcctactgcagctgcaacttgcgagacgcactttgcgtttgggagactgtagccgcgttgcgtgcgtggtgcgcgtcggtgcgtgcggtgcgagcgccgtcgctgacgaacgggacgacatgccgccggcgccgggtgatccaagattcggggcgggggggatggatagcgaggcggacgcgggcgaccgacggacccatcgacctggctttcctggcagggcatattctgcggcgatgcctggatggccaccatgtcgccgcccctgctacaagcctagttttcacggcagctcccgctttgggtgtacgcgtcggcgtctcgcaccaccgaagtgtctcttggaagcccagaaggcctcagcgctgccacgccgcttccgttcatacgacttcgggctactatttttgtgtacggtcagatgagcaaatggtgggtccatatgtagacagagtagactgtggagagtagagacgtg

SEQ ID NO: 10431 - DNA, 2574 bp, Zea mays
tgggtacctcgaggcccggcccgccggggggggccttggcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatgggggagggtgatcttgtggacccaccgccagacagcttcccggacgccgtggaggacgacagcgatgacgacgttgaggacatcgaggagctggagcgccgcatgtggcgcgaccgcatgaagctgaagcggctcagggagctgcagcagagccgcggcaaggatcccatggctagcggtggggccctggccgacggctcatccaagccaaggcagtcgcaggagcaggcccggcgcaagaagatgtcgcgcgcgcaggacggcatcctcaagtacatgctcaagatgatggaggtgtgccgcgcgcaggggtttgtgtacgggatcattccggagaagggcaagccggtgagcggcgcctccgacaacctccgtgcctggtggaaggagaaggtccgcttcgaccgcaacggaccggccgccattgccaagtaccaggccgacaacgccgtccctggcgcggagaacgagctcgcctcgggcgctgccagcccccattccttgcaggagctgcaggacactacgctgggctcgctgctctcagcgctcatgcagcactgcgagcccccacagcggcgcttcccgctcgagaagggcgttcctccaccgtggtggcctaccggcgacgaggagtggtggccggaactcggcattcccaaggaccagggcccacccccgtacaagaagcctcatgaccttaagaaggcctggaaggtgagcgtgctcaccgctgtcatcaagcacatgtcaccggacatagagaagatccgtcgcctggttcgccagtccaagtgcctccaggacaagatgactgccaaggagatctcaacctggctggcggtcgtcaagcaggaagaggagctgtacctgaagctgcaccctggcgcacgcccgccggcatccgctggtggcatcgccagtgccatatctttcaacaccacctcaagcgagtacgacgtggacatagttgatgagtgcaagggggatgaggctggcaaccagaagacagcagtcactgacccaacctccttcaaccttggtgcggctatcctaagtgacaagttcctcatgccgacgccgatgaaggaggagaccgctgacgtcgagttcatccagaagaggaacgcccccgctcctgctgagccagagctaatgctaaacaaccgggtgtacacctgcaacaacgtccagtgcccgcacagtgactacagctatggattccttgaccggaatgcccgcaacagccaccagtacacctgtaagtacaacgatccgatcactcagagcgccgagaacaagcctctgccagcaccgccgcaaccacaagccttccagccggccttcagccaagccaatcaggcagtgaacaatctggacttcagcctgcctatggacgggcagaggtccatcgccgagctgatgaacatgtacgacaccaacttcatgacgagcaagaccatgagcagtagtgacagcgtcaccatcatggagaggccgaacgcgatgccccagaggatccagatggacgagggcttcttcggacagggcaacggagtcttcgacgacgtcaatagcatgatgcagcaacaacagcagcaggcaccacccgtggtgcagcagcagcagcagcagcagcagcagttcttcatccgcgacgacacgccattcatgagccagatgggcgacatcaccagcacggcggagttcaggtttggctctgctttcaacatgtctagcaccgccgccgctgactacccaggcgcggcgcagaagaacgacggggccaattggttctactgaagaataaaacttgtagggctcctcgttataagcttcggattcctccatggctctcccaagttgtcaagtcttataggtcttcgttatataggttttgcagtagctgcaagacggctggaacctggaactggtttatacttgtatgtccggccagccataaacctctcttatttgcaaacttaatgttattcctagctttaagttgttagtctcagtgctgtccatgtatatggctgttaaaatgcttgggcttgtttctgtaaaaaaaaagaaaaaaaaaacacgagggggggcccggtaccca

SEQ ID NO: 10432 - DNA, 1401 bp, Zea mays
caaccagcggctccggaatccggatctccccacacggccacacggacacggccacacgcttcggcaggcacggccggtccatgtagcgcgcgcccggacacggagcaggggtcacgcgcaacggcagcccggcttgtcgggagcgcgaggggcgacatgggggcggaggccggcgagcccagctccatcctcagcttagcttccgccttttcctatggagtcgcatctatggcaatggttttcgtgaacaaagcggttcttatgcagtatgttcactccatgaccctcctcactttacagcaaatagcaacagcacttctgatacattttggtcaagttctaggaatgtctaaacgaaaagactttagctggataaccgcgaagaaacttcttccagtgtcaattttctacaatgcaaatgtgggatttgctctagcaagcttgaaaggggttaacatcccaatgtatattgcaatcaaaaggatcactccccttgctgtgttggtggctgggtgcatgcggggaaaggggaagccaccgacacaggtcattctttcagttatctgcaccgccactggtgtcctcattgcagcacttggagatttttcctttgacctatatggatactgcatggctctaacatcagtcttcttccagactatgtatttgattctggtggagaaatcaggcgctgaggatggtctttcctcagtggacttgatgttttacaacagcatattgtcacttccatttctgtttttcctcattatagcaacaggagaattcccccattctcttacagtattatctgcaaaggcagcctctctgacgttcggtgtcattctcgttatctcactggtgatgggaatcgttctcaatttcactatgttttggtgcacaattgtgaactctgctctgactacaacaatagtaggagttctcaagggtgtcggatcaacgaccctcggtttcgttctgttgggaggtgtcgaagtacatgctctgaatgttactggactggtgatcaacacatttggcggcgtatggtactcttatgcgaagtataagcagaaaaggaaaacaccacggaagatccaacatgatgtagagtcgcatgcccacaagtagcgtcagattaactgtagttatacttcgttctttgatcagataataactggatgcatgtttaaatccattttttctgaactctattccatcaccagcagttaggttggtgcaattaagggaagcaacaagcttttccaaaaaaaaaaaaaaaaacaatcacgatcaatgaaatagggtgtaaagtcagttatttttcgcagctccagtgtgcgatgcatcacttttgctccaaagagagaaatccatgggtctggatgaggtgattgccggttc

SEQ ID NO: 10433 - DNA, 832 bp, Zea mays
  misc_feature (71)..(75): n is a, c, g, or t
  misc_feature (143)..(157): n is a, c, g, or t
cttagtgaacagcggttattaagagagcagcaggacgatgagtaccttgcgtcactacaagctgatcaagnnnnngagttgaaggccttacaggatgctgagctccatcgcctagaagaaacaactacaagagaagttgctcnnnnnnnnnnnnnnnaagaggaggaggaaaggcgtaaaaagcaacttgaggaagaggagctagagtccagtctcacttcgaagcaagcatcattaccaccggaaccgtctccagacgcagagggtgctgtgacagttgtagtccgaatgcctgatggtagtcgacaggggcgccgctttctcaaaactgataaacttcagttcctatttgatttcttagacattgggaggacttgcaagccagggacctacagattggtgaggacatacccaaggcgcacgtttaccaacagcgagggtgacgtatcattcagtgatcttggcctaacaagcaagcaggaagccctgtttctagagcagatcacggggtagaggataatcgttaggcatggttagagataccacagctgggcaggagaattttacacaaaatacttgcaccatatcgccagtgaaaactcggtctgtcaaattggttgggttggtcgaagaaaggttaaaaattcttttgtggcgccatgtgtcgtgacgcattgcgctttgcatgcaaattggttgggttggtcgaagaaaggttaaaaattcttttgtggcgccatgtgtcgtgacgcattgcgctttgcatgctttacgttattatatatatgcgtgatactttatacctaaaaaaaaaaaaaaggcccctagggcc

SEQ ID NO: 10434 - DNA, 2060 bp, Zea mays
ccacgcgttcgcgtacgcgtgggcggacgcgtggggaaatcattggctgccccggggccggccgggagtttgttgccgtctctctctctcctcttgacgcaactcctctcctatcttctctctctccatcgctccctcctccgcgccgcgttggcaccgaaccctcctgtcatggcaaggccgccgaaggaggcgattgataccttcatcagcatcacgggggcggacgaggccgtcgccgtacgcaaactcgaggaacatggtggtgatcttaatcgagcaataaattcacatttcaatgatggagacagcatattgaacggaatcagtcaaaacgccatgcctgctagtcgtgatgatatgatggacctggatggaccacttgataatacatttcaaagatctttgttgccagagagtttccgtgccccttttgctctaatggatccaaatttccaggaccaattttttgacagagttggctccactgatggtgtcattcgtgaaccgctagtttcacatccaagagaggtgagggagatacctatcgaagttaaggatggtgatcctcaaacaggttcatctggccaggatgttactggaaatgagtcttcaaatggccctgaagtccctgaaactatcataattgatgatgtggacggtggattgttatctgcaccatctgttccacatcctattattcctagcaatacatctactgtgccaactgctcctccattggttcatgttaatgactatgatgaggacatagaagaggaaatgattcgggcagcaattgaagcttcaaagaaggattctgaaggactggcaaatatagtcgagcaaggaggccagcatcaagaggaagtgaatttgagggaccattcttctgataaagcaggcatggaaaccgcaaatggaatagttgagaggcaaggactagcttcagaaaaggctggaacatctaggcaaccaatagatgacgagagcttccaggaggaggctgaagatgtagaagaacagccgttagttaggcgtcgttctcggcgtgccccttctgaggacaatgaattaccaaaaatagtgcacccaggtgctagccctgttctgaacaatcaccagtataatggagatgatttcccatctgagtggggtggcatttcttctgaggaacatgatgaagctgttatgcttgaggctgcaatgtttggtggagttcctgaaggaccaacatatcctttctctatgccttctcacagaacctctacttattatcccccaatatctcattctccatcaccagcattaactgaacagcggttattacgagagcagcaggacgatgagtaccttgcatcgctacaagctgatcaagaaaaggagttaaaggccctacaggaggctgagctccgtcgccttgaagaaacagctgcgagagaagctgttcttgagaaacagaagcaagaggaggaggaaaggcgtaaaaaacaacttgaggaagaggaactagagtccagtctcacttcgaagcaagcatcattaccaccggaaccgtctccagacgcagagggtgctgtgacagttgtagtccgaatgcctgatggtagtcgacaggggcgccgctttctcaaaactgataaacttcagttcctatttgatttcttagacattgggaggacttgcaagccagggacctacagattggtgaggacatacccaaggcgcacgtttaccaacagcgagggtgacgtatcattcagtgatcttggcctaacaagcaagcaggaagccctgtttctagagcagatcacggggtagaggataatcgttaggcatggcatggttagagatacctaccacagctgggcaggagaattttacacactatacttgcaccatttcgccagtgaaaactcggtctgtcaaattggttggattggtcgaagaaaggttaaaaattcttttgtggcgccatgtgtcgtgacgcattgcgctttgcatgctttacgttattatatatatgcgtgatactttatccctaaccaaaaaaaaaaaaaaaa

SEQ ID NO: 10435 - DNA, 2069 bp, Zea mays
tagcgtgctcgcggcccgcgtccgcgcgcggaatcagaacacctgccgctcttcagtttgttgacgcaactcctctcctatcttctatctccctcgctccctcctcggcgtcgcgttggcaccgagccctcccgccatggcaaggccgctgcaggaagcgatcgataccttcatcagcatcacgggggcggacgaggccgtcgccgtacgcaagctcgaggaacatggtggtgaccttaatcgagcaataaattcgcatttcaatgatggagacagcatattgaatgggatcagtcaaaacaccatgcccactagtcatgatgatatgatggacctggatggaccccttgataatacatttcaaagatctttgttcccagagaattttcgtgacccttttgctctaatggatccaaattttcagcaccaattttttgacagggttggctccactgatggtgtcactcgtggaccgctagtttcacaccctagagaggtgagggagattcctatagaagttaaggatagtgatcctcaaacaagtccatctggccaggcccctgttattgaggatgttactggacatgagtcttcaaatggccttgaagttcatgaaactatcataattgatgatgaggacagcggattgttatctgcgccatctgctccacatgctagtgttcctagcaatacatcttctgagcccactgctcctccactggttcatgttaatgactatgatgatgacatagaagaggaaatgattagggcagcaattgaagcttcaaagaaggattctgaaggactggcaaatatagcagagcaaggagaccagcatcaagagggagtgaatttgggggaacattcttctgataaagcagtcatgagaaccacagatggaatagttgagaggcaagtactagcttcaggaaaggctggaacatctaggcaaccaatagatgaagagagcttccaagaggagactgaagatgtagaagaacaaccgctagttagacgtcgttctcggcgtgccccctctgagaacaccgagctagcacaaatgccgcacccaggagctagccctgttctgaacaatcaccagtctagtggaggtgatttcccatctgagtggggtggcatttcttctgaggaacatgatgaagctgttatgcttgaggctgcaatgttcggcggagtttttggaagaccaatgcatcctttctccatgccttctcacagaagctctacttattatccccaaataactcattcttcatcaccagcattagctgaacagcggttattaagagagcagcaggacgatgagtaccttgcgtcactacaagctgatcaagaaaaagagttgaaggccttacaggatgctgagctccatcgcctagaagaaacaactacaagagaagttgctcttaagaaacagaagcaagagcaggaggaaaggcgtaaaaagcaacttgaggaagaggagctagagtccagtctcgcttccaagcaagcatcattaccatcagaaccgcctccagacgcagagggtgccgtgacagttgtagtccgcatgcctgatggcagtcgacaggggcgttgctttctcaaaactgataaacttaagttcctatttgatttcttagacattgggaggatttgcaagccagggacctacagattggtgaggacatacccgaggcgcacgtttacgagcagtgagggggacgtatcgttcagtgatcttggcttaacaagcaagcaggaagccctatttctagaacagatcacagagtagaggataagtgtttaggcagcatggttatagacaccacagctggagccggagaattttttttacattttatacttgcagcttttgctagtaaaaactcggtctgtgaaaatggttgggttggtcgaagaaaggcgtcacgttacctatacaatgtggacagctacgcatggccgttcattcgcacgagtctcagagtggctctgtacatactgtcggttctgtgaatcaaagcaatgttgcgtatacgtaagcaaaaaaaaaaaaagcggcc

SEQ ID NO: 10436 - DNA, 878 bp, Zea mays
ttcgcacgagaccattacctagaacatcctaatcaaaaaaaaaaaccgtaaatacagacaggagactgtggcggcggcggcgctcctctgcgcatgtgctcggcgtctcggctatcagcttctccagttctccttccggcgcaccgtgattcaggcgttcagcgccacgctgccgtcgctcgctcccaggcctagcgtcgctcaccgagtctcagcgttcagcgccacgctgccgtcgctcgccgagtctcaggtgtcagtcaggaaccgaaccaccgaacaacacagataagtaccctattctctcacaaattgctcgtgatgtgatgtctatacaagtgtcaactgttgcttcagagtctgcctttagtgctgctggccgggttgttgatccatatcgcaatcgacttgactctgagatggtacaagcacttatatgtactaaagattggattcgtgcatcaagaaaagattctacaattattcattctattttggctgatctaaaaccttcagaagcaattcctatcagtcagccctgcatggatgatgaggaacaagatgttgaaagtgatcctgacgtcatgaatgattatgatgagctttgaatgtgagcctgcgactacgccgactagtcatggtgcttaatgcttggcaacatgtttggaatttagataaatatgttgctgtgtcaatgtgtgttgtgtccatgtttggcaactgtgtgctgtgtgagataaacatgtttggcaacatctatatggagcagcagcagctgtgtgctgtgtactgtgtatttaaatctgaacagaactgtgtgttgtactgttgtgtgcgataaatatgttgttgtgtgctgtgcaaaaaaaaaaaaaaaa

SEQ ID NO: 10437 - DNA, 884 bp, Zea mays
ctcgaggccgccgccagtggctaaacctaaacggctaaaccgtaaatacagacaggagactgtggcggcggcggcgctcctctgcgcatgtgctcggcgtctcggctatcagcttctccagttctccttccggcgcaccgtgattcaggcgttcagcgccacgctgccgtcgctcgctcccaggcctagcgtcgctcaccgagtctcagcgttcagcgccacgctgccgtcgctcgccgagtctcaggtgtcagttacgtggagttaaattgttaaattgcactgctccagtcaggaaccgaaccaccgaacaacacagataagtaccctattctctcacaaattgctcgtgatgtgatgtctatacaagtgtcaactgttgcttcagagtctgcctttagtgctgctggccgggttgttgatccatatcgcaatcgacttgactctgagatggtacaagcacttatatgtactaaagattggattcgtgcatcaagaaaagattctacaattattcattctattttggctgatctaaaaccttcagaagcaattcctatcagtcagccctgcatggatgatgaggaacaagatgttgaaagtgatcctgacgtcatgaatgattatgacgagctttgaatgtgagcctgcgactacgccgactagtcatggtgcttaatgcttggcaacatgtttggaatttagataaatatgttgctgtgtcaatgtgtgttgtgtccatgtttggcaactgtgtgctgtgtgagataaacatgtttggcaacatctatatggagcagcagcagctgtgtgctgtgtactgtgtatttaaatctgaacagaactgtgtgttgtactgttgtgtgcgataaatatgttgttgt

SEQ ID NO: 10438 - DNA, 759 bp, Zea mays
attgccagccccccgcggcgtgggaaccctaacatacctaatcaacaataggagacggacagactttggctttgggtgtgcggcgggcggcggcaccgtggcagttggcactgcggtctacagactgcatcagccggcaggactctgcgtctcctcccgtcctccggttctccctgcgacggacaaatctgctgctcgatttctctggttgtccctgtggcggacggcacatcggcaagccaggcagccagctcgtcagctctaaatcagattcagtaattattcattctattttgactgatctaaatccttcggaaacctgcatggattttgaggaacaagatgctgatagtgatcccgatgtcatgaatgattatggtgagctttaactgcgagtctaccactagttatggtgcttaatccttggcaatatgtttgtaaactttagatacattgtatagagcagcagcagctctgtaccatgaaccttgatatatcttgtgtgctgtgtgtgatgaaccatgagcttttgtatcaaactattgtatggagcagcaacagttctgcaccatgaaccttgatatatcttgtgtgctgggtgtgatgaaccatgaacttttgtatcaaactattgtatggagcagcagcagctctgcacttgtgtgccttagtgcctatgtgtatttaaatccgtgtgcaactgttgactgttgtcatttataaagtcctcatggctgcttgtgtgctgccaaagcggcc

SEQ ID NO: 10439 - DNA, 1888 bp, Zea mays
ttaccaattgaaagaatgccacttgaagggaactattattggtcacataccaaatgaaacaactagttccatacctttgccttgagcattcctaatctttctttgtttgaagattaacctttaatgcttgtgattttaccaaatgaaagagcataatctctacttataaatttccatgaaatggcttaaaagagattgctttagaaacacaagcaatagtttcctatttagaaacctctagtatatgaatgacaagaaggttactaaaataaggaaacctcatgatatgaactaaattgcccttacaagcatcatgcataacaccaaaattaaacaaggtgaacaaagcacgattatttaattaagtttacatggcaagtttaattcatagcatggtgagtgattaatgtagaagactcaaaaccaatttaaacgagaatgaatacatcacatagtattggttcgatcttctttgaatgttgaatggcacactccatttgagaacctcattctcatgttgtgagactacataattcacttagatagaaacattagtctcacaactctagtcatatagagaattccccttttggtaagtgctttaagaatttgaatttcttactcagcactctattcatttaagaacatgggataatcctctttatgtctaggttatggcaataatatgatgaataacttgaaatatgccacaagatgcatacaatcaatttagagcatgtagattgtcacaatataaaaatatgaagttgcaatctaccatataattaggtcctttccaaagcaaggtaaaatcttttaagttcattctcaagtgcttcatttttcctatgtggctacaaaagacacaaaggaatataccaattaaaagcaatgtgcacttaagaattaattgttaccatcctttggatatcacttggttgtaggccttttgcttgattcccacaaaggttaatccttattccctacaacacaagttcttgctagagatgaatatgaagttagtgatataacaactcaattcatctttgggtcaatcttaaaggatagacaatgtaagattgatagcttgagataagaattgagttgaaccgctcaagcaccccaaagcttcatatcatctctgggtacctgcaaaacttattaagtacattttggtacccatctcatgataggtccatcaaggttagccaataaggacttaggcacccaaatagccttggtcctagaatgtggtgaactcatcacctttctagcacaagagtcaaatttgggtctcctaagcatatttgaatgtattgacaagttaggcttaggagttttaccctttggacaaaccttgaatagatgacctttttcacggcaattgtagcaaatgcgatgcttgtccttgcaatgcatttgccttttgctttcatcctttttgatggtcatctttcttgatcgtgcaaggtcttgattcttcatgtgggggcatgaatcaatttcatggcccttctccttgcatccatagcacctcctatcgcttctctttgatctttctttgttgaagcacataggtacattgttagagcaaatcatatgagcattaattttctcaccatggattttgctcatgcccttcttggaaagcttggtattcttttgaaggggttttgtgcatgctacggttgtccccttctcaagctttttcaccatattatcacggttatctttgagaaggttgagcatgacactttccctttaaaagagttaagctccttcttagacttccaacttcctcccttgagttatttaatttttcttgtgtcatagaaatatcactaatttcctgaaatttctagctcaatggaagaatggctttcttgag

SEQ ID NO: 10440 - DNA, 1549 bp, Zea mays
taaagagatgtttgtacacagcatagttctatttagcactctagtatatgatgacagaaggttactaaacaagggaacctcatgatatgactaaattacctttacaagcatcatgcataacatcaatgtaaaaaagatgaaagtagcatgattttttaattaagtttacatgacaagtttaattcatagcatggtgagtgattaatggagaagactcaaaaccagtttaaacaagaatgaatacatcacatagtattggttcgatcttctttgaatgttgaatggcacactccatttgggaaacacattctcatgttgtgagactacataaacacttagatagaaacattagtctcacaactctagtcatatagagaatttcccttttggtaagtgctttaagaatttgaatttcttacttagcactctattcatttaagaacatgggataatactctttatgtctaggtcatggcaataatacgatgattaatttgaaatatgccacaagatacatacaatcaatttaaagcatgtagattgtcacaatataaaaatatgaacttgcaatctaccatataattagatcctttccaaagcaaggtaaaatcttttaagttcattctcaagtgcttcatttttcctatgtggctacaaaagacacaaaggaatataccaattaaaagcaatgtgcacttaagaattaattgttaccatcctttggatatcacttggttgtaggccttttgcttgattcccacaaaggttaatccttattccctacaacacaagttcttgctagagatgaatatgaagttagtgatataacaactcaattcatctttgggtcaatcttaaaggatagacaatgtaagattgatagcttgagataagaattgagttaaaccgctcaagcaccccaaagcttcatatcatctctgggtacctgcaaaacttattaagtacattttggtacccatttttggatgggtccaccaaggttagctaataagtacttaggcacccaaatggcctttgtgctagttttaggtgaactaattacctttctagcacaagtgtcatttttgggtctcctaagcgaatatgaatgaattgacatggtagacttaggatacttactcatgggacaatccttgcaaaggtgtccctttcttcggcaagtgtagcaaatatgatttttaattttgcaagactccttcttgccttgcttcttgtttgctacatggttagtgagcctctttctttccaaagttaagccactatcttttatgtagggacatgacttaatctcatgtcccttctcatgacattgataacactttctagtgcatcttctcttatttggaagagtggcttgtttgttaccttgtgtggagcatgtggaggcgtggttgaggcacttgtcatgagctttggctttcttctcttgatgtttgctcatgcctttcttagggaagcttggcattctttggaagcgggattgtgcatgctacggttgtccccttctcaagcttcttcaccatgttat

SEQ ID NO: 10441 - DNA, 2049 bp, Zea mays
  misc_feature (674)..(674): n is a, c, g, or t
atccttaagaatacttaccaccaagtagagtgtaccatttgttgtatcaattgaaagatcttactatatgagatggtgtcatctaagtattcttcttttcttcatttgtggagacttccctctttagcttgttatctcttttccttttaaaactagtcgaaaaggcactttgaaaaagagatattagtggtacaaggaagtatttaataaatgatggtatttatatatgaatggcaaacaaatcatcatttatgaggcataaaggcataaattaaattcctttgaagttagtgcacatggatgagtgaattaatattatgcaccaatttacaaatttaagccaaaaagaatttaactttcatattgacatttttttcataaaatagattattaccaattgaaagaatgccacttgaaaggaacaattattggtcacataccaaatgaaacagtaaaagtctgcaaaaataaagctgaaaaggtactgcacaggctttctgaaaaggtgacctgacgcgacaaaaaaatgactgaaaaagtgctgcaaaaggtgacccgacgtctgaaaaaaggtactggcgcagtcttgaaaaggcgtctgataaagggggctgacgcggtcagtcaaacggtcagactgacgggcgcccagcggctcagactgcaccagaccnggttcaaccggtcctggacaccggttcaaaccggtttcagccagggggtttcctggtgaataccagccgagctgaagttcaactcagaagttcagctggtctccccagctgaactagaaagttcagctggtcaaaccagttgagcttggaatgaaaattttaaaataattttctcacaataaacctcatttcaaattttaaaatgtacgcatagattgaatgacacactccatttgagaaacacattctcatgttgtgaaactacataaatcactcagataagaacattagtctcacaactctagtcatatagagaattccccttttggtaagtgctttaagaatttgaatttcttacttagcactctattcatttaagaacatgggataatcctctttatgtctaggtcatggcaataatatgatgattaacttgaaatatgccacaagatacatacaatcaatttaaagcatgtagattgtcacaatataaaaatatgaacttgcaatctaccatataattagatcctttccaaagcaaggtaaaatcttttaagttcattctcaagtgcttcatttttcctatgtggctacaaaagacacaaaggaatataccaattaaaagcaatgtgcacttaagaattaattgttaccatcctttggatatcacttggttgtaggccttttgcttgattcccacaaaggttaatccttattccctacaacacaagttcttgctagagatgaatatgaagttagtgatataacaactcaattcatctttgggtcaatcttaaaggatagacaatgtaagattgatagcttgagataagaattgagttaaaccgctcaagcaccccaaagcttcatatcatctctaggtacctgcaaaacttattaagtacattttggtacccatctcatgataggtccattatggttagccaataaggacttaggcacccaaatagccttggtcctagaatatggtgaactcatcacctttctagcacaagagtcaaatttgggtctcctaagcatatttgaatgtattgacaagttaggcttaggagttttaccctttggacaaaccttgaatagatgacctttttcacggcaattgtagcaaatgcggtgcttatccttgcaatgcatttgccttttgttttcatcctttttgatggtcatctttcttgatcgtgcaagatcttggttcttcatgtgggggcatgaatcaatttcatgacccttctccttgcatccatagcaccttctatcgcttctctttgatctttctttgttgaagcacataggtacattgttagagcaaatagtatgagcattaattttcttaccatgaattttgctcatgtcc

SEQ ID NO: 10442 - DNA, 1312 bp, Zea mays
ggataatcctctttatgtctaggtcatggcaatatacgataaattcatttgaaatatgccacgagatacatacaactaatttaaatcatgtagattgtcacaatacaaaaatataactgcaaaatctaccatatgattggaacttttccaagacaaggtaaaatcttttaagttcattctcaagtgcttcatttttcctatgtggctacaaaagacacaaaggaatataccgattaaaagcaatgtgcacttaagaattaattgttaccatcctttggatatcacttggttgtaggccttttgcttgattcccacaaaggttaatccttattccctacaacacaagttcttgctagagatgaatatgaagttagtgatataacaactcaattcatctttgggtcaatcttaaaggatagacaatgtaagattgatagcttgagataagaattgagttaaaccgctcaagcaccccaaagcttcatatcatctctgggtacctgcaaaacttattaagtacattttggtacccatctcatggatgggtccatcaaggttagccaataaggacttaggcacccaaatagccttggtcctagaatgtggtgaactcatcacctttctagcacaagagtcaaatttgggtctcctaagcatatctgaatgtattgacaagttaggcttaggagttttaccctttggacaaaccttgaatagatgacctttttcacggcaattgtagcaaatgcgatgcttgtccttgcaatgcatttgccttttgctttcatcctttttgatggtcatctttcttgatcgtgcaaggtcttgattcttcatgtgggggcatgaatcaatttcatggcccttctccttgcatccatagcacctcctatcgcttctctttgatctttctttgttgaagcacataggtacattgttagagcaaatcatatgagcattaattttctcaccatggattttgctcatgcccttcttggaaagcttggtattcttttgaaggggttttgtgcatgctacggttgtccccttctcaagctttttcaccatattatcatggttatcttgagaaggttgagcatgacactttcccttcaaaagagttaagctccttcttagccttccaacttcttccttgagctctttattttcttgtgtgatagaaatatcactaattcctgaaatttctagctcaatggaagattggctttcttgagagcaacatttgtcagcgcattgataatatagtttctacttcagcacatgtgcacatgggaggttggtatgatttcaa

SEQ ID NO: 10443 - DNA, 1734 bp, Zea mays
ggaatctgtcacgcagtcaaggatcacgatcgcgagatgctcccatccgaatcccaggatccgaccgtctcacgaatctcgaggcgagctgttcgatcaccactatctgacgtagcttcttcgctcggctcttcttcaccccaccccggccggacccacccctctcccactcggccactccccccgcggggacaccgagcgctcgccgccgccttcgagttcggagcggagccacagccacgcatgccaatggccgtctccgctgttaccgcctcccatctcgctctctcttttccagcacgtagtcgccggagacgcgctgcgccccgcgccgcggcaggcggcctaacggctcgcgcacggcggctgcgctgcgagttcgtcgccggtggtgggaacggggcgctctccggagaggacgaccctcgcctcgtcgaccgccaaaaagttcttgatgccgctatgaatgacataaacaactcttttggaaaaggaagtgttacaagattaggcagtgctggtggtgcttttgttgagacattcccaagtggttgtctaacactagattttgctctgggtggcggtcttccaaaaggaagagtagtggaggtatatggtccagaaagcagtggaaagactaccctagctttgcatgcaattgctgaaatacagaagcttggaggaaatgccatgcttgtcgatgcagagcatgcttttgatccagcttattcaaaagctcttggggtagatattgaaaatctgattgtctgccagcctgacaacggagagatggcactagaaattgcggaccgtatgtgcagatctggagcaatagatcttatctgtattgattcggtgtcagcgctcaccccacgtgcagaaattgaaggtgagataggaatgcagcagatgggtctacaagctcgtctgatgagtcaagcattgagaaaaatgtcaggcaatgcctcaaaggctggctgtactcttatgttcttgaatcaaataagatacaagattggagtgttctatgggaatcctgaagtcactagtggagggatagccttgaaattctttgcatctgtccgtcttgagatacggctcattgggaagataaaatctgccaagggagatgaagatgttggtgtgaaggttcgtgtcagagtgcagaagagtaaagtatctaggccctacaagcaagctgaatttgaaatcatttttggggagggtgttagtaaattggggtgcgttcttgattgtgctgagctgatggatgtagttgcaaagaagggttcgtggtacagctacaaagatataagattgggccaaggcagagagaaggcactgcagtatctccgagagagcccaaccacctgcgatgagatagaaaaggtggttcgagctatgataccagaaggatccagacatatgagcctactagctttcgggcagtcatcatcaactgaagatgaacaggcgtatgatgaacaataatggtacatgaggttccgaagatggaacacttgtgaagccgtcaagctctggcttgtgtcccttgcggataacagaaaagatcagaggtaaccaaccaatatggcagttgtgtgagcgctggagtggagttgactaaggtcttgttcggttgtttgggattggagccccggattaattcctagcgggattacttctctaatttatatagattttgatgagctgaaatgaatcctgtcttatttc

SEQ ID NO: 10444 - DNA, 1841 bp, Zea mays
cattgggtacctcggtgcctacctcgaggccggcccgctccggcagcgaagctcccccctccctgcctccttccccggcgccccgctcttcctccttccgctccggcgatgggcactggccgccgcggcggcggcggcggcggcgtgttccaccgcctcctcgccctctcgtcgctgctgctcctcgcttccggcgaggtcgtcttcgaggagcgcttcgaagatggttgggagactcggtgggtggaatccgactggaaaaggagtgaagggaaagcaggaaggttcaagcacacagcggggagatactctgcagatcctgatgacaaaggaatacaaacaacaatagatgccagacattttgctatctcagccaagttcccggaattcagtaacaagaaccggacgcttgtggtccagtactccattaagtttgagcaggatattgaatgtggcggtggctatattaagcttatgtccggttatgtcaaccagaaaaaatttagtggggacactccgtacagcttgatgtttggaccagatatatgtggtactcaaacaaagaagctccatcttatactctcttaccaggggcagaactatcccatcaaaaaagatctagaatgtgagacggacaagttaacacacgtgtatactttcattcttaggcctgatgcatcttatagcctgcttgttgataaccgtgaaagagaatctgggagcatgtacactgattgggatattctccctcctcgtaaaattaaggatgttcacgccaaaaggcctaaggattgggatgacagagaatatattgaagatcctgatgaagttaagccagagggctatgattctatcccaaaacagattcctgatccgaaggacaaaaagcctgacacatgggatgaagatgaggatggaatatggaagcccagaatggtatcaaatccagcatacaagggaccttggaaacgcaagagaattaaaaatcctaactacaagggtaaatggaagaccccatggatcgataatccagagtttgaggatgatccagatctttatgtgctgaagcctttgaagtatattggaattgaagtttggcaggtaaaagctggttcagttttcgacaacattctgatttgtgatgaccctgagtatgcaagaaaggttgttgaggaaacttggggtgcaaatagggaggctgaaaaggaagcttttgaagaagctgaaaaggagaggaaagctagggaggatagggaaggtcaaaaggcaaaggacgatggtggccggcatcgaatacacaggcgtcataaaaaacactacagagatcactgggacgactaccatgatgagctataaaagtccccaaatattgcattcctcaaaagcataagctggaagttgcttcggacattgtgggtgcttttcaataataataattgattcgcctggtcagaacaacctgaagtgtttcttgctatgcgccaacaaattattgaactacaggatttgatatgtaatggacaaccgaagatctgcagggcattccagcgaaaacttggctctggtactgaaatagaggggacgagagactgtagtttgtgtctgtacaacggtgccggccatgtgctagctttgtaatctcaaaacattgtctttgcatgaataatgtaagttacccaaaaattactgcataccaagttacaaagtgttgtagctgacatatgaggaacactttaattttaatcttcatatatatacttctgtaatcttcaaaaaggatacgatgcaattggtctatctctgtcatcaccgggccccccgaaaaaaaaaaaaaagcggcc

SEQ ID NO: 10445 - DNA, 847 bp, Zea mays
  misc_feature (25)..(25): n is a, c, g, or t
  misc_feature (820)..(820): n is a, c, g, or t
ctcgaggccggccgggacgctccgnccagcgcgccggcagccatcctcccccctccctgcctccttccccggcgccctgctcttcctccttccgctccggcgatgggcactggccgcggctgcggcgggggcgtgctccaccgcctcctcgccctctcgtcgctgctgctcctcgcttccggcgaggtcgtcttcgaggagcgcttcgaagatggttgggagactcggtgggtggaatccgactggaataggagtgaagggaaagcaggaaggttcaagcacacagcggggagatactctgcagatcctgatgacaaaggaattcaaacaacaatagatgccagacattttgctatctcagccaagttcccggaattcagtaacaagaaccggacgcttgtggtccagtactccattaagtttgagcaggatattgaatgtggcggtggctatattaagcttatgtccggttatgtcaaccagaaaaaatttagtggggacactccgtacagcttgatgtttggaccagatatatgtggtactcaaacaaagaagctccatcttatactctcttaccaggggcagaactatcccatcaaaaaagatctagaatgtgagacggacaagttaacacacgtgtatactttcattcttaggcctgatgcatcttatagcctgcttgttgataaccgtgaaagagaatctgcgagcatgtacactgaattgggatattctccctcctcgtaaaattaaggatgttcacgctcaaaaggcctaaggattgggatgacagagaatatattgaagatcctgatgaagntaagccagagggctatgattctatccc

SEQ ID NO: 10446 - DNA, 4293 bp, Zea mays
  misc_feature (2801)..(2801): n is a, c, g, or t
  misc_feature (3194)..(3194): n is a, c, g, or t
  misc_feature (3312)..(3312): n is a, c, g, or t
tcagatataagaacgccacgtctacgatctccttgccacacccctcacaaaccacaaacacatctcgcggcggcggcggcggcagagacaggcggcggccgccgagcggcgtgggcagcgtcatccatggtgcacgtgaacttctatcgcaactatggtaagactttcaagaagccaaggcggccttatgagaaggagcgccttgatgctgagttgaaattagtgggtgaatatggcctgaggtgcaagcgtgagctgtggcgtgtgcagtatgccctcagccgcatccgaaatgctgcaagggagctgctcacccttgatgagaagaacccccgtcgtatctttgagggcgaggcactcctgcgccgcatgaaccgctatggtcttctcggtgagggccagaacaagcttgactatgtgcttgcactcaccgttgagaactttctgcagcgccgccttcagaccattgtcttcaagaatggcatggcgaagtccattcatcatgctcgtgtgctcatcaggcaacgccacattagagttgggaggcaacttgtcaacattccctcattcatggtgagagttgactcagagaagcacatcgacttctctcttaccagcccacttggtggtggagaacctggaagggtgaagagaaagaaccaaaagaaggcttctggtggaggcggtgacgacgaagaggaagagtgatcatgtgatgctagctccttcgttttgttagggacctaattttgttacatgaaaacaaaaagttggctgccgaggtttctgaaaaattgcaatttaaaattttgagaactgtaattgctaagactcttcattgccgaagttgtttatccgatgaacacatgttaattcagtgagcttgcactgctgcttacatgagatcaaataaagtcaggaagatattagtgtgtactccgatatatagatctgggatatgttgtttcgaagtattttatttatatatagctacgcactcgacatgtggtgtcctcaaaatgtgttaaaattctaaagacaggtggagtattcgttgcaaattgtaagctaacatcttagttgattggcctgatttccttctgaataaataacacgggttttaaaatttgtacccttagttttgccaactttctaatttttatcttttttttctcagttttgctcttatgatctatagcactagaagagcaaaattgagaaaaaaacacgaataagggtaaaaatgaggttatcagcaaacccaaaagatcacgatggaacagagacattttggacataaagttgtcaattgaaagtggcatgagcctgtattcatctaagacattattcaatggctgaaatgttaacttggatagttggatgaaccgaaccacaagttccaggcaaaatagctttttctactttgatgaagaacttgtagatgatgtagtgcttgtagagctagctggccagggcggtatacatcggctgggaagccgccggctcgtacatggcgccgctcttgccatcggcgcgtgcttgagaaagttccccgtgttgaactgcaggctcggctggtccggccatagctccccatgatgcgtccgaagtcaccttccacatgtgacacgccctgcgcccctattcgttgtttattccatttgtcccatgatgctctcattgacaatagacaacaagcagtctagaacctttaacttgtctggatcaataagacggcagattgtgtattccatttgttctattgtagtccatgtagtgttaaatgttttccataccatgggcacaattttgatcaaggtcaaggtgtgtcttacttctaaattctaattagaggcacaactaactggcatcctaattttccactgttctggatgtttatttaatagggctgagacttcatgcacttaacaatgcagaccatttttttttgactttgtaggctggctattatgaactaacaaaggattgtatacttcaaagttcaaacgaatgaactgctaagttacttgcagttttagtaaagcttagaaggccggtagaaacaaaacagcatgtggtaagcaaaaatgtaatagagaaaaagtttatagaaaaaaattggccagtacagggccaacggtattagtatattaaaaaaaagcttaatcattgtctagatcgagaaaggtcatgaaagctgtctcccgtgcaggatgagagtccgccacctcctatagatctcaggttgttcacttcatattaaaatcagctgttcgaactgctgcagctacaatccataaagaccagtagaagccggtacggattgaagccaaacgaacatgtttagattcagattttatattaacttctagatgcaagttattttaacactatgggtcctaagttcgaccgacaaaatagaagggaaaaagctaggcaggagaatcaattcgctcttaaatattactcactccatcataaaataaatgcatatcccgcattctaagagatcaatcaattttaaatttacgcacacgcactctatcggtcacataaagtgatgaataaatttgtgcatcacctagatctactatctaattgagctaattaaccagccgttcagctggttccaattaatctgcttattgaatctgttcacatctattaaattagggtgacggtttcaatcatttcattaataatttcagtcattttactacagtttcatacattccgttagtttcagttgttttattacagtctcatccattcactttttagccattcagttacagtttcantcattctattacagtttcaataatttcattaacattaacgttaaagtttcaatcattctagtacaatctgtcattcactcatttatctgtttcgttataatttaagttattccgttatagtttcagtcattccgttactgttacagtttcagtcgtccggtcaaaacggggagggggcgtgtgagggtagtgtgcggtggatggttgcaacacgtaggttgattggggtgcggtggttagcactggcatgcggggatgagtcagacacgcaagatcaattatgtttggtccaagaaatctccggtccatcaccctaggttatgaatagtgttgtcctatatatattagcatatagcccaacgttacggtcccgaaggggaggggtcaacaacngcggtggcgggagggacgtggggccgtggggggacggggagggagaggtggatggatgagggatgattcaaatagtattgttcattggatttgaataaacgagagagagttatccaangatttgaaccgagtgtaatttatttggtggatttagtggaagttatgagtgtggggtgatttaattgggtgttttttgcaaagtttaaagtggtggattatatagtgttatatattatagataacacactaatgtttatgctactaaatagatatcattaaactaatcacattatatattttatattaaatttatttagagatataaatattgatagtactcaacaaagagcaagatatgtatttattttagaatagatcatacaaagatgtgagtctaacacataatggtgaattatgattaaacacatgcaagtcttataaatttttttagttcttaagctcaattcaccaaaatttatttagggcctagttgcacttactaagctccaaatttagcaatgaagtgaaagaagtatatagctgcctattgattgtgcatccatgtaaccatttgttctttgttttttttatgacgaatctatttttaacactcgcctaatgctagatggctatttgataattggtcagccttatgatttggcacatgcttctaaagttcattcctgttgtttcaaattattcaattattcaggtgcacatgggtatcttctttccagtccactaggatgacaagtgttaaatctcttcatcatctcgctagatatcttgttgacaggagtatcatctagatacatagtacgacacatatctactgtatatttagatatttagatatgacaagtatataaaaaacctagtactatctataaaaaagataagacaacgtaagcataatcttattaaacggaaggagtaattgctacatttgttttaaaacattgttgttctaactttgctctaattcaaataattttaatgtaacttaaatttatgtaaaaaatataccaccatttatgacataaaacaagcaccaatagtgatcattagctatatttgtcataaaattaacaatactcta

SEQ ID NO: 10447 - DNA, 644 bp, Zea mays
attctgccattgtcccgacctgcggcctgcggccctctaattccttttactccccgccgagcgaaacaaacggccttcttggtcgcctcccccattttcgccgctgggcgctggctcaccccactggctttctcaagtttcaagcccccgctgcatcttagccagttgaagatgagcagggcatcaatcaaaatcatcccagagtgctacagcatgatagattgtatctctctgcattgtggtggcttggttgggcagactagtgatggatcttgattctaatttcttcaagaggaaggatgctaggggtagcatgttgcttgcttactccatgtcaacagcaagcagatcgaagttgttcctgtggatgctacaagcaacacttttggatgcatgctactttgctttgcattttgtagcagaggataaagttgcaagtgaactaggttcctgaacccaaaacatgtggttgcaacagtagacatttgatctatgagagctttgacaagccaaacttgttgttgcctacttattacgatttgaaaggtgacaagtagactcattattgtgaccgattattggcgctaatggaaatgtgacctacgttttgccgaaaaaaaaaaaaaaaaaaggcccctagggcc

SEQ ID NO: 10448 - DNA, 1758 bp, Zea mays
gggaccctcgaggccggccgggccggatcgtttccccgcccggggacccccccgccgggccggtacctcccacactagcccacagtcccacaccataccaggtcaccatacccgccggcgcctccgccgcctggccgcgctctcccgccatgaagcagctccacaagtcttcccccacccaagcgccatcgccggcgcacgcaccggctcccaaggcagccaagccggcgcgccctggcccgcgctcctggatcgggtatatcctccgcgagcagcgcctcctcttcgtcctcctcggcgcgctcatcgccaccaccttcttcctcctccgtccctacctctcgctctccccgtcctcccacctccccgacgtccgcccgctcttctccttcgccgcccgctccgctgtccccgccggcttccgcccgcccccgcgccgcgtcgtcgtcacaggcggggcagggttcgtcggcagccacctcgtcgaccggctcctagagcagggggacagcgtgatcgtggtcgacaacttcttcaccggcaggaaggagaacgtcgcgcaccacctccggaacccccggttcgagctgctccgccacgatgtagtcgaaccaatcctcctcgaggtcgaccggatctaccacctcgcatgccccgcgtcgcccgttcattacaagtataacccaatcaagacgatcaagacaaatgtcatgggaactttgaatatgttgggtctggcaaagcgagttggtgcaaggtttttgttgactagcacaagtgaagtttatggtgatccacttgagcatccacagaaggagtcatactgggggcacgttaatcctattggtgttaggagctgttatgatgaggggaagagaacagccgagacttcaactatggactatcatcgtggtgctggtgttgaggtgcgtattgcccgcattttcaatacatatggtcctcgtatgtgtctcgatgatggccgcgtggtcagcaattttgttgcacaggcactacgaagacaaccaatgacagtttatggtgatggaaaacaaactcgaagtttccaatatgtttctgatctggttgctggattgatggctctaatggagagtgatcacattggtcctttcaacttgggaaacccaggcgagtttaccatgttggagctagcacaggttgtgaaggaaacaattgacccaatggcaaccattgaattcaaacccaacacagctgatgatccccatatgagaaagccggatatcaccaaggctaagcaactgctacattgggagccaaacgtctctctcagagaaggccttccgctaatggtcaaagacttccgtcaaaggatctcggatgagtaatcgaggcaatcctacgatactggtgaccggtttgattctgaactatgctgcaaatacagtcagaagctctttatcgattggagccatgcagtacagtgtactgtgtacacagtacactgtactgcctcccaggccccacttggaatgtggggatccatacaatttccactggatagtactgtttctgtgaaatagctgaaaagttcatgggaagttcgtgttaatcttttttatatactaggagagtgcccgtgcgttgcaacgggaacggtataaaacccccgataaactagtgtacaaagtgtgtgttatacttttataggttagtgctcgtgcgttgcaacggagacatataatatatcgatatcttatatatgcatgtgtgttatat

SEQ ID NO: 10449 - DNA, 2157 bp, Zea mays
ttgggaccctcgagggcccccccgggtgcctcccgcgggcccggccggcacccaccaggccaccaccaggtcaccaaccacgcacccgcctccgcctgcccgctctcccgccatgaagcagctccacaagtcttcccctacccacgcgccatcgccggcgcacgcaccggctcccaaggccgccaagccggcgcgcccaggtccgcgctcctggatcggctacgtcctccgcgagcagcgcctcctcttcgtcctgctcggtgcgctcatcgcctccaccttcttcctcctccggccctacctctcgctctccccgtcttcccacctccccgacgcccgcccgctcttctccttcgccacccgctccggtgttcccgccggcttccgcccgccgcagcgccgcgtcgtcgtaacaggcggggcagggttcgtcggcagccatctcgtcgaccggcttctggagcagggggacagcgtgatcgtggtcgacaacttcttcaccggcaggaaggagaacgtcgcgcaccacctccggaaccccaggttcgagctgctccgccacgatgtagtcgagccaatcctcctcgaggtggaccggatctaccacctcgcgtgccccgcgtcgcctgtgcactacaagtacaacccaatcaagacgatcaagacaaatgtcatgggaactttgaatatgttgggtctggcgaagcgaattggtgcaaggtttttgttgactagcacaagtgaagtttatggtgatccgcttgagcatccacagaaggagtcatactgggggcacgttaatcctataggtgttaggagctgttacgatgaggggaagagaacagcagagactttaactatggactatcatcgtggtggtggtgttgaggtgcgtattgcccgtattttcaatacatatggtcctcgtatgtgcctcgacgatggtcgtgtggtcagcaattttgttgcacaggcactgcgaaggcaaccgatgacagtctatggtgacggaaaacaaactcgaagtttccaatatgttgctgatctggttgctggactgatggctctaatggagagtgatcatattggtcctttcaacttgggaaacccaggagagtttaccatgttggagctagcacaggttgtgaaggaaacaattgacccaatggcaaccattgaattcaaacccaacacagctgatgatccccatatgagaaagccagatatcaccaaggctaagcaactgctacattgggagccaaaggtctctctcaaagaaggccttccgctaatggttcaagatttccgtcaaaggatctcggatgagtaatcaaagcaattcttttttccccgaatgtgccatgcacgtgtttgtaatcagagcaatcgtatgatactggtgaccggtttgattctgaacgatgctgcaactacagtcaggagctcttcaccaactggaggcctggagccctgcagtacgatgtactgtgtacacaacagactgtagaatcacgcaggccccatttggagtgtggggattccatagtatttctacgacatagtactatttctgtgaaatagctgaaaagttcatgggttcgtgtcgatgttttatatatatatcttggtgaggcagaacagaagcaatcaattgttttttgtgcatgtgtgaaattcctgaattgtgggtggtgagagataggatacaatgctgtatttcaggagcttttgtaacacgggaacattcatcatgtgaaaaatgtaactgaatgtgttggccagctcaaaaaaaaaaaaaatctgccgcctggcagtccacaacttcattccccttcctcaaaatgtttgacagataaagtgaaaattggcatagccttatatacagtacctgagcaatttacatctgccatcagaggctgactttcaagacatcgaagcttgcaacatagtaggtgtttctgcaaattccgtagccttctacgtacttgagatgcacaatgaaactaagcgctctgttcgagctgacgttcccacccatttctgttacgtcagcaactctgacaaaggcaaagccggtggcttcactgtgggtaccgccccgtccctccgacaagcgcgatgtgggactcctgatcatcgcggcggcggccggcggac

SEQ ID NO: 10450 - DNA, 3165 bp, Zea mays
tagcagccttgaacattatgatactgctatcttggatttattccaattacagttatataaattatactgcttcatgagacaagttatgactattatgattcattatttacattactatgttgtatatacaggcttgttcaattaatcttctggtgggataaaaaacaaaataatgcagctctttattagccttagattttgttatctctccttgaatatgttttcctaacttgaatagttaacaggtgcgtattgcccgcattttcaatacatatggtcctcgtatgtgtctcgatgatggccgtgtggtcagcaattttgttgcacaggttcgtttgctacatattatggactctatttttcttagttgtgatcctattatgcatgtaagcagccatatgattgtccttgaaggcactacgaagacaaccaatgacggtttatggtgatggaaaacaaactcgaagtttccaatatgtttctgatctggtaagcactgaacagtcttattatacattttcgtgtgtggactgtgatccttacatgcggatcttctgtgttgttgttccctactgcaatttcactgggcaacagtctcttctgcagttgcatatcttaagaattaatacgaaatgtacataactttattacacttctttttaccataatattttttttactattcagtccctgattcattgtgatagattgttagcgccagttttctagaggcaccagggaattagctattcatattgttatcacttatattataatttggagagaatgttctgtgacaaatcttattgggctttgtttgtacatgtgagatgaatgctcacccatggcttcacatacctttgcatgcctcttatttaagttgtttttgtaatcttgctccatatgttcttaggttgctggattgatggctctaatggagagtgatcacattggtcctttcaacttgggaaacccaggagagtttaccatgttggagctagcacaggtttgtagacaatttgttaaaaaaaacttaaagtgcacaattgacaatagcaccttccccaggttgtgaaggaaacaattgacccaatggcaaccattgaattcaaacccaacacagctgatgatccccatatgagaaagccggatatcaccaaggctaagcaactgctacattgggagccaaacgtctctctcagagaaggccttccgctaatggtcaaagacttccgtcaaaggatctcggatgagtaatcgaggcaatcctacgatactggtgaccggtttgattctgaactatgctgcaaatacagtcagaagctctttatcgattggagccatgcagtacagtgtactgtgtacacagagactgtagaatcacccaggccccatttggaatgtggggatccatacaatttccactggatagtactgtttctgtgaaataactgaaaagttcatgggaagttcgtgttaatcttttttttttatatcttggtggggcagaacagaagcagtcaaatatttttttgtgcatatgtgaaattccagagttgtgggtggtgagagataggatacaatgctgtatgtatttcaggaacttctgtaacacgagaacattcatcatgtgaaaaaatgtaactgaatgtgttggccagctcgcgccgcctgttttttttttttttttttctttaactgacagtcccaaattccccattctcaagtgaaaaatacagtctcgtatacagtatctgagcagttttctggatacatttgtcatcagaagttgacttccaaaaacatcgaagctttgcaacacagtaggtgtttctgcaaattctgcagccttctacttgagatgcacactgaaactcagcactctgctcaggctgacattattcccacccgtttctggtacaccaccagcagctctgacaacggcaaagccggaggcgccactgtaccgccccgtccctccgacgaccgcgacgtgagactcctcctggtcgtcgcggcggacgccgaagaagctgatgctgtcgcccgcgccgtcgccggcgaacgaggccttcacggccaccatatggctgccgttgtcagccacgccggtgacgaggacgccctgcagcctcccatccagaggcagcccgaactccttgctgccgcggagccgctcgtcgaccacggtgaccgcggcaggccggagcgcgtccggcctcgtcaaggcgcgcagccagcggctgccgattggcccctcgtccgtgaagaccgggcgccgcgtggaaggagctgtgggtttgggcgacgcgacgccggtgccggtggtgtacagcgtgatcgtttgggcggagctgcgggacggcggcgacggcgaggaaccgcggcgtgccggacgggcgctggctgccgtgctcgtcaccgcgagcaggagcgcgagagcggcggcgcaggcttgcttgaggatgcgagtgcgagattgcgcgtgcatcttcgggcccggccggggccgtgcgtgtgtgtttttgcgtctggttggagcgtgtttacccggcgcctgcctcgatttttggtttaggtggcgaagagggcaggcagatgtaggatcagagggagttggtttatgcgccccaaactactccactaggatttacgagtatattggattggtagaaaaaaaaactttcaggatctgctctacaatgtgtctgtgtgtatcaaaaggtttcggataacgtaatcagatgagagcatcttcaaaagacgctaaggctatctccagcaacctacttatctctataatagtttaaattccgctctgcgaacattacagcatacagtgcaaaacaatacttttgaataactttggatagactgctacaaacggtctaaacgacttatcaaactaaaatttagatattcaacagcaaaatagctctttaacgaactacccatctaactctacctcatcaaactaaccaactctttaaattaactctctcactagccagacttagctagtgatatgtgatgtgtactatacaggttcttatttattttgggcataatttctatacgattttttctgtccagaatttgcattaatctttgttcaatgtccttcacagatattggcaatccgagtacaagtggaagagattgatg

SEQ ID NO: 10451 - DNA, 1249 bp, Zea mays
aaagagcacacggaagaagagtagtgagcacggaaccccaccaggcagaggcagtaagccaccagctgcagccgccagcacagcgcagggcagagggagagggagggcacaccatggccgtggggggccttctgcggggcctcgtttcgccccccgcctggctgccctgccatgagctcttcgcctcctggcaccactggcttccctccctcccgcgcctccgcccgcccgcatccgacggcttcaagcttctcttggtgctgctgctcttctccgccgctctagccgaggtccgctacatcgcctcctcctccatggcgcccacgcttcgtccaggcgaccgagccgtcgccgataaggttacatacttgttccggaggccatctattggggatatagtgtttttcaaagtaccgactgctgtgcagaattatggtgtcaataaggatgttgtctttattaagagagtattggcaacaccaggagacttcattgaggtaaaataaaatgcatcactagctccattgaggtaaaaacgcatcctcctcctcttatgttgtttacaggtccgacaagggcagcttattgtaaatggtgtcgcactaaaggagcattacgcagcagcaacgtcattgtacacaatggaagcaatggtccagagatctttaaaggtcacaagaaagaagatgatcaaaaactggactggctgctccatgttgttgacttcttgagtgccccgttgtaatcaatcgatcaatgggcctcagatggtggatgatctttttcttattggatgaatgggtgggtacctggatcctcagtcagctgaaagtaagtattctcgtactcctgcagcgccttcctgaaggtcacgtatttgtcatgggtgacaaccgcaataacagctgtgattctcgtgcctgggggcctcttcccgttgccaacatcgttggaaggtacatgacatcctttacaagatcctctttccagtaactggggttccactcaatgttcgtcctcataaatcaatcatagttagagagttgtggagccaggcggctgctatcttgtcaatttgtagcgatgtttgttgtatatgattctcacttaatttggacatgcatgattgtgttgttataaagtaagcatgttttgttgttgtatatggtcgcacttaatttggacatgcatgattgtgtacttgtgttgttataaagtaagcatgttttgtacaaaaaaaaaaaaaaaa

SEQ ID NO: 10452 - DNA, 979 bp, Zea mays
gcacgagaggacgggcgccgggaggaagccgtcggttactaccggagcgctgcggacctgggacatcccattgggatgtgcaaccttggggtctcctacctcgaagctgatccacccaaggccgaggaagctattagatggttttatcccgcggccgcggcggccaatgctcgtgctcaatacaacctaggcctttgcttgcagaacgggaagggtgtcaagcggaatcagaaggaagctgcaaaatggtatttgcgagctgcagagggagggaatgtacgggccatgtataacatttccctgtgttacagctacggtgaagggcttgcacaggatccagtgcgtgctaagaggtggcttcaactagctgctgattgtggtcacaagaaagctctttatgagtgtggtattaagctttgtgcggcaggagacaaggtcaagtgtctcatgtatctagagctggcgacacggcgtggagaagctgctgctgctcacatgagggatgtaatacttgaatcgctctcggttgtgaatgcgcagcgtgccatgtcggatgctgataaatggaagcctaggacactccatcctagacctagaaggtgaggaaatgacgacgccaaagtgcagaagaaccatatcatcaagatgtccacaccctagtcatctgtggccagaattgaagcacagaaggtcgaagcaaacatgtatgcttcctcggcacccacagccacaggaatgtcagtagccatcctgtggctctctgtataaagccatccattggcagatgtaataccaggagaacttgtagtacagaaagttctgtagcaaatactacttcctcccttccaaattgctaccttaattctcgaatatttgtcaccactagttcatttttgaactaaaatgtgacaaatagaaataacggagcgagtataaaatactttggcttttctagataaaaaaaaaaaaaacaccggcc

SEQ ID NO: 10453 - DNA, 943 bp, Zea mays
aaagtcgtggatctagaatggtctatgcagttgcgacggaacggatggaggaaaaaatgaaccacgatttctcttcagttctttccttgcgtgcacggctgctcgtcaattcggctgccgaaattatcccgttgccttctggttcccacgacaaaagcggcattaccccggtcgctttataaattggactttcttactttcggcacggcgaccggacagctccccacaaaaccgtcagttctcttttcccctgtaaatcgcaaattcgtcttccctgcccatctatcgcttggacacctctgcaagggagcacatggctctcgagaaggccaaggagatcatcgcgtcctccccggtcgacctagctctccgaaaggccaaggagaccgtcgcctcccaccccgtcgtcgtcttcagcaaaacttactgtcctttctgcacccgagtgaaacaattgctagcaaagttgggggcaagttacaaggctattgagttggatgtggaaagtgatggcgctgagctgcagtcagctctcgctgaatggactggccagagaactgttcccaatgtcttcgtgaaaggggagcggattggtggctgtgacgcaaccatggcgatgcacgacggtgggaagctggtgcctctgctcaccgaggctggagcaattgtcactgccagggctactgcaactactaccactccgtctttgtagacatgttttacagcgctgttccgctcgcttcgtggctatatgcaagtgttgtacggagtactaaactcatacgtggtaaaagatgaataaagacttaaacatttctttcaaaaaaaaaaaaaaaaaaagcgggcccaaaaaaaaaaaattggcttggctgtattatatgctaattggttttttggtgataaaaaaaaaaaaaaaaaagggccctagggccgcggccgctct

SEQ ID NO: 10454 - DNA, 2110 bp, Zea mays
  misc_feature (4)..(4): n is a, c, g, or t
  misc_feature (22)..(22): n is a, c, g, or t
gggnacacgacctgacattggngagggatcaggggatgtctattcaatgtcgctgaggcaacagttacaagaatcctggaagaaaacccgtggcagctctacattacaataagggtgataaagatgtctcacccaatggaagtcgttgcacttctgtcgcatgggtgccagagcgtgaaggcattttcgttgttagccattctgatggaaatttgtacgtgtatgataaaaacaaggatgggaacacagactgtacgtttccagctgtcaaggatcagtctcagtttatggttgcacatgcaaagtcgagtaagagcaacccagtcgctaggtggcatatatgtcaaggttcgatcaatgcaatttccttttcaccagatggcgcatacttggcgactgttgggagagatggttatttgagagtattcgatttttcaaaggaacaactaatatttggtggaagaagttattatggtgcactgttgtgttgcacttggagctcagatggaaaatatctattaacaggtggtgaagatgatcttgtgcaggtatggggcatggatgatagaaagatagttgcttggggtgaaggacataattcatgggttagtggagttgcttttgattcatattggtccccaccaagttctgatggaaatggagaaaatgtatatcgctttggttctgttgggcaggacacccaactacttctgtgggacctggcactggatgagattgttgtcccactacggcatccttcaagtgcctcacctacgtttagcagcgggagcccttccacacactgggacaatgcatgccctccaacaggtgttcttcaaccttctcctagaatgcgagatgtcccaaaactatcgcccctagttgcccaccgagtacatgccgatcccctatctggtatggtgttcaccagtgaatctatcctcaccatctgccgcgagggcctcatcaaaatctgggttcgaccagagcagagcgaaaacaatcagcaatcgaattcttcagaatttgctttaggccctgcttcgaaggatagggcgatcacatcttccaataaagcaagtagctccagctttaagaagctgccgcctgttcttgtcacatgatgaatcaacgggatggttcttgtggatatttctgcttcacgtggcattagtggtggatatgaatcttactccatggttgatggggatgaaactctcatatggagtctgcagactgcaagtaatgagggtgagcatttgatggttgatgttcccaggaagcagggccagcgttgccagtttttttggcacgaaagagtaaatgggagctcttgtacagacacatacttaatgataaaattgtaaaaactcactgtccgtttcataatattcaatagccaccgaaagatgattggacgaccatgttatcgattttagctggtgggttgatagtatccttaaactttggtacttcggagacttgtaattatggaccataatatctgaggaatgcttcagtcttacctggtgtaagttgtgttactatttccttctgccttttgtccattattagatctagtttggcaactccatttttctccaaagtgattttcatttttccatcggaaaatgaattaagtacctgtttggaacctctagagctaatagttagccaactaataaattattacttgggttgagctagctaatgaactaactattagctgtgaggtaactaagatcgtgtctagtagtgtacccataggtcatacaagtagactgtattgtcttcagagtggagtttgaatatgcgtatgtggatagataagttgtcatagatagcgtaacaattagttatgatattatcttatggtgtttgtaggcctgctaatggcaaaaaaatccaacccatgtccacccatatatctattccacacccatccaaaaatataagggtttgttcgttttgttctcaatccatgtggattgggtgagattgggtgggtttcaatcccaaacaactcaaaatctttcataaaatttttcaatctcatccaatccacatgtggtaggaataatcggacaagacctaagaaggaaattaaacc

SEQ ID NO: 10455 - DNA, 899 bp, Zea mays
gcgaattgtttatagcgagactcatgcaggcacacaagggggccggccccactccacggctgcacacgtcgtcgcctcctctccactcgcaccctgcgtccgcctgccgcctaccccaggcgcccccctcccatcgccatgcctccgtccgtcgctgccaccgccaccgccgccgccttcctcttcccggccgtcgcgatcccctgccgcgtgttccctcaacggcgggcgaggagcctcgccgtccgtgccgtcgcctcccctccagccttcgcggtcaagcccgccccgctgccctccaagactggaaagtgggagtggaaattcgagaacaagccggtaaacatatactatgaggaacatgagcaggaggttgctgagaatatgaagaacattctcatgatccctacgatctctgatgtgagcactgtggaggagtggagggtggttgccaaagatattgttgggcggaaaggagaacttggctaccgtgttacaattgtcgattggcctggtcttggttattcagataggccatcactgaactacaatgctgatgtgatggagagctttctggttgaactaatgaattcaccaaacagtccagtcgcaaatgcagatgatgaactgatcattgttggaggtggtcatgcagcaaccatagctgttcgtgcagctggtaaagaccttataaaaccatctgctgttgctgctgttgcacctacttgggctggaccccttcccatcgtatttggccgcggttctgatatggaaactaggtacgggcttctacgaggaaccctcagggctccagccctgggctggatgatgtacaatgttctggtgagcaatgagaagtcgatccagtctcagtacaagtcccacgtctacgccaaccc

SEQ ID NO: 10456 - DNA, 4786 bp, Zea mays
  misc_feature (203)..(203): n is a, c, g, or t
  misc_feature (3348)..(3348): n is a, c, g, or t
  misc_feature (4675)..(4675): n is a, c, g, or t
gttgaaccactggtttttgggaaaaacagtaaaaagtgggtacaaagagctgctaagaaaccggtggagaggtggagttcacatgcgtggaccagaactgttcacgtgtagggagggaaatagagaaaaaagggctggtatgaggtctgaagatgagacttataggttggggagctcattccttagcactgcaccatgaaatncacttgtggctagtatgaaatctttgtttaattaaaccggttcagaccatcggtgcaactggttagaccaatcaaaccgtcaaccgagggcttcaccagcctaatccctagcccagtccaaataaccatggccacaaaatatcatctctggcacaagattcagaagtagttgagcagggttagttggataaacattcagagatagctcaagatttgctttgttaggagataagtttgtttagcaattgagttcatttacagattaagtttgttaagattgagttagttagaacttggttgttttcttgcgcgtggggtaaagacctccataaaaggtcttgatttaatctgaagcatgcaaacaactttaatctatttcctccacctgttttgtaccaagcgcagagcagtcatggcttgaccctggctctctgtcgcctcatcgtgtgccagccaacgccaaccccttcctattccatttaccactagttgtgctgcttgtttccattgttctgtaatgcattgcttttatgtgcactgcgtttccgaacaatggtgcatttgtttccattgtttagtagtgcattgctgttatatgtacagatatatttgtactttaccacctgtcacaccatttaggagtcctgatggctggggactgattgagaatgtttgtttgtattaatgagtgtgcattgatacatcgactattaggaggatttgacctttgttttcatttatgaaattatctatgttgttgtacagacagtggcattagcatgttccgggcacaccattttccaaattgatcccacggcttaatttggcagatggggtaataccccagtagtgaaggcggcgtggttcctttcaccaagtcacgggttcgttccctggctcgacataaaaaaatcccctcgctgttcctcgtcagctctcgggttgcgactcagctgtgcgccaccctcgggcctaggtgggcctttgcagagtgggtagcttgactcgccccgttagtcatgtgaggacagtttttgggggtttcttggttgggaccgttgccacggccttctattaatataataccgcgagggttgtcttatcctccccagccgagtttttttaatttgatgaatatcagttttactttcctgtgctatttttcattcatttcatgtgcaatattaccatttgtttaatatacacatattgacatatatgaacaactagctaacaaaacttgtaatagtggttttctagggttgaagcaatattcttgctttaatatgcgtgtatgaaatacctttatcccataatatttgtcagggagatacacttggggcctgttatattcttaacatttgggtggaagcacttgtcctgctaagagaactgaaataatgttgattgctgctagttttctgaacaacattttggatttgatgtgcctactttactataaagtgcatgcttcagtcacatgtctcatgcatgcctgtagcatatgttctcgactccttccattgagaacattctttttgcttgatgtgtgttgactgtcaccagtgcatacattcttaaagacgaccatgacatgcaatactgtgccacagatacatctggtgtagcatcctgataggcatgaaaggcatacagaattctgtaggttgcgaagccatcaagacaataatatgacccctggaagactggaagtcatcctgatagccacacaatgcatttgtgaattttattttgtgtacctcatattgctatttgttgtgcaatgtccatgtttttgctgattatactgcatgttctgattggcctatcacattcggtaaacaatgcatttgtttcctgtgtttagtagtgcagtgctgctatgaatacaaatggttttcatccatatacagcctaggttgccatgcaacaaagtgcagctctcatttcaatggatttatctgtattcttttgtagagaaagtggcaatagcatggttttgcaggcacttgcattaatggatcaggttccgtttggattgcagaatttttacaggaatcagttcattttcatagtaaaaaaacagtaaacagaagaaaaatccctagttctaaaggagcccttgatctgattagggagatcaccattcaccagttctgctgtccagcagttatatatctttcattttcatgtgcacactatcaagctatatcagtcattcagtactggggtttaagcagcaatgcagcatcctgaatcatgtgttaaatgataacaacaataatgatttaaaaaataagaccttgtcgtccccaccaggccacagacctgggttatcaatgcttaaccgcccttcccatcgcattcggccgcggttctgatatggaaactaggtacgggcttctacgaggaaccctcagggctccagccctgggctggatgatgtacaatgttctggtgagcaatgaaaagtcgatccagtctcagtacaagtcccacgtctacgccaaccctgacaacgtgacgccagctatcatcgagagccgatacgagttaaccaaaagaaaaggcgcacggttcgtccccgcggccttcctgacaggcctccttgatcctgtccaatcgagggaggagtttctgcagttgttcgccaagttagacggagacgtaccagttctggtagtgtcaacggtcaatgctcccaagagatccaaggccgagatggaggctctaaggggctctaaaggggtgacgaagtttgtggaggtcgcaggcgctcttctaccgcaggaagaataccccttggcagtcgcggaggaactctacagcttcctgcaggaatcattcgcagcaagaaggtgaatgtgcgtgcgtgcgtgcgcacaactgtgccagaagacaggttctcaagtcccacacatcgtgagtaaattcgttagcctgctacagtgtactggaggtttttagcaacaataaagcggcatcactcgttcacttccctaaaaaaaaaacccaagggcgtgcccctgcccagtcagcagacaatcgcatgacatcgccggtgtgcgcaaagcatgccgccgtgataccagatttcgatcaggcacgtcgtggttcgtgtctgatctgcatcagagcctaaccnttcggtccggtggagcccattcattgcacatggtcgcagcaggttcgtggtcgtaaaattttctcaggtcctggtcctggttcttggtaattgatggccgaagtacaaggcctcgacgacgccggtcagtggtctcctgaggtagacgtttctcccctctccctcccctcctccagtacatttcaacagctaggttggaggcgttgttgctttgagagtttgagtagtgacttgtgattgtgagcactcagctttcaccggggcatcaatgccacgagactgagaagtgtccccctccgctctgatgccgctagaatcaggcacagtagtacagtacagagtacgctgcggagcaacatgcggattctgatcaataacacgcgcacgattccagtggctggccgtgccgcggctatcaatgccacatttacggtccagggagggatggaaggggtgatcatgttttctataatgtttgatgagagtcacacggagatttgtgaatttttggtggcaacgtagttctaaaaaatcgaagggacgttgttggcctacctcatcctactttaacattaaaccagacacacccttaataaaacctctcacgccaggccaacggcggcctcgccggtgcatccagacagcggtccagccactgaagctcccgtcgggcatcccaggccgtgccctgcctgccacgtgtcccggcgttgagcttggcacgagcggcagggaagcgcattcaatggagggagagcgaagtctgcgtggcaagtaaataggtgtcccagttcggaggtggactttcttcccctggccgttgttctagaggatcggcgatggagcgggatcgacaccgccgcgtcgtcgcccgtcgatttaaatgctggggggaacggcccttgatttgcctgaacggatcggtaggatacagatacggggccgtatagtatacgtgtggtgaattgaattgtttaagattgcgtggtccagatggcacgcgcggcgttgccgtttgtgctgtgagtgagagcgttaagctggcgaaggttcagcatttcggctatatcaccattgcgatgtttctcgccaggggtacaacaactacaagcgctgaatcgcagaaaacaacatcgcggaaagccgttatgaaacgcatcccgagagagactggaaccaaaactattattattattatatataataaaaccccggcggtgacagcgatcgcttttatttggaacacttggtaggtaagataaggccccgtcctccgtttgaggtgtgggactcccctgctaccaagggcggtgatccgttgcagtanggttgtttgttgtagtaggccttcaaccttgtcatcttccatccccccgtcccttttgacgccagttgattcagtctcatctgcccaaaccgaacgggggggggggggggg

SEQ ID NO: 10457 - DNA, 1777 bp, Zea mays
  misc_feature (1742)..(1743): n is a, c, g, or t
  misc_feature (1761)..(1761): n is a, c, g, or t
  misc_feature (1777)..(1777): n is a, c, g, or t
ctcaagttttacatcatttgaaccacgaacttaagaactttcaagtttgttgtctccatttctattattctatattgtcttactgttagttatcatgaaaccttccataactgaaaaataaccagtttgactttggttaagatatttggcaggaagcctagtgtgagttaaagtatgatttgactgcttagctgaatgctactggagtctggatctcttaggctgtcattagagctgtggtataacatgcacttgaatggcagcattagcttccaacaaaaccacacaaagcattttttgtttccccctttgaattgtgggattgaagggcagcctctccgcatttgtagggggaaggcttgccttgatttatcccttacctagaccccaccattgtaggagcctccgacactaggtctgccttttcattgtttcaactgactccattgtgtatctatttgttaaactgttaatgttaatgtgaatacaattactctagtggaagataccctacattagacttaagaatgttagaatgatataccttgacaaaaaggtcatattaccaattttgtcatgtctctctgctgttacctgtgctataacattgtcgatgtgtttccagactggaaaccgcgaggccggccgcgagaacaagccggtaaacatatactatgaggaacatgagcaggaggttgctgagaatatgaagaacattctcatgatccctacgatctctgatgtgagcactgtggaggagtggagggtggttgccaaagatattgttgggcggaaaggagaacttggctaccgtgttacaattgtcgattggcctggtcttggttattcagataggccatcactgaactacaatgctgatgtgatggagagctttctggttgaactaatgaattcaccaaacagtccagtcgcaaatgcagatgatgaactgatcattgttggaggtggtcatgcagcaaccatagctgttcgtgcagctggtaaagaccttataaaaccatctgctgttgctgctgttgcacctacttgggctggaccccttcccatcgtatttggccgcggttctgatatggaaactaggtatgggcttctacgaggaaccctcagggctccagccctgggctggatgatgtacaatgttctggtgagcaatgaaaagtcgatccagtctcagtacaagtcccacgtctacgccaaccctgacaacgtgacgccagctatcatcgagagccgatacgagttaaccaaaagaaaaggcgcacggttcgtccccgcggccttcctgacaggcctccttgatcctgtccaatcgagggaggagtttctgcagttgttcgccaagttagacggagacgtaccagttctggtagtgtcaacggtcaatgctcccaagagatccaaggccgagatggaggctctaaggggctctaaaggggtgacgaagtttgtggaggtcgcaggcgctcttctaccgcaggaagaataccccttggcagtcgcggaggaactctacagcttcctgcaggaatcattcgcagcaagaaggtgaatgtgcgtgcgtgcgtgcgcacaactgtgccagaagacaggttctcaagtcccacacatcgtgagtaaattcgttagcctgctacagtgtactggaggtttttagcaacaataaagcggcatcactcgttcaaaaaaaaaaaaaaaaaaaaaaaaaagcggccaaaaaaaannaaaaaaaaaaaaaaaaanggaaaaaaaaaaaaan

SEQ ID NO: 10458 - DNA, 1428 bp, Zea mays
ctcgaggccggccggggaattgcgatagcgagactcatgcaggcacacaagggggggtccccgaggccgccggcccacacgtcgtcgcctcctctccactcgcacactcgcaccctgcgtccgcctgccgcctaccccaggcggccccctcccatcgccatgcctccgtccgccgccgccaccgccgccgccttcctcttcccggccgtcgcgatcccctgccgcgtgttccctcaacggcgggcgaggagcctcgccgtccgtgccgtcgcctcccctccagccttcgcggtcaagcccgccccgctgccctccaagactggaaagtgggagtggaaattcgagaacaagccggtaaacatatactatgaggaacatgagcaggaggttgctgagaatatgaagaacattctcatgatccctacgatctctgatgtgagcactgtggaggagtggagggtggttgccaaagatattgttgggcggaaaggagaacttggctaccgtgttacaattgtcgattggcctggtcttggttattcagataggccatcactgaactacaatgctgatgtgatggagagctttctggttgaactaatgaattcaccaaacagtccagtcgcaaatgcagatgatgaactgatcattgttggaggtggtcatgcagcaaccatagctgttcgtgcagctggtaaagaccttataaaaccatctgctgttgctgctgttgcacctacttgggctggaccccttcccatcgtatttggccgcggttctgatatggaaactaggtatgggcttctacgaggaaccctcagggctccagccctgggctggatgatgtacaatgttctggtgagcaatgaaaagtcgatccagtctcagtacaagtcccacgtctacgccaaccctgacaacgtgacgccagatatcatcgagagccgatacgagttaaccaaaagaaaaggcgcacggttcgtccccgcggccttcctgacaggcctccttgatcctgtccaatcgagggaggagtttctgcagttgttcgccaagttagacggagacgtaccagttctggtagtgtcaacggtcaatgctcccaagagatccaaggccgagatggaggctctaaggggctctaaaggggtgacgaagtttgtggaggtcgcaggcgctcttctaccgcaggaagaataccccttggcagtcgcggaggaactctacagcttcctgcaggaatcattcgcagcaagaaggtgaatgtgcgtgcgtgcgtgcgcacaactgtgccagaagacaggttctcaagtcccacacatcgtgagtaaattcgttagcctgctacagtgtactggaggtttttagcaacaataaagcggcatcactcgttcacttcaaaaaaaaaaaaactcgagactctcgtgc

SEQ ID NO: 10459 - DNA, 2260 bp, Zea mays
  misc_feature (1972)..(1972): n is a, c, g, or t
ccaagtctagaagtccagcctgagccgggccccgccgggactgaggcctgggcatcggcttcgtggcaccatctggacaacgtggatgtcgcagcgagtgctgactgacgcgtctcatgacttttttccatttgatccgtagttccataccgcatctctctcctcttgccgcttcaagattcccggtagatcccgggcttcccggcccgggacgccgggcagggaatggaggcgacgtcgtttaccgcggctaccgcctgggacctggcaccgcgcagttgtttcgccgggcccggggcttgagcagatgcaccatccattcatctgatcggttccttttgtgatggcttcacggtcacactgcgtccgcggcactccagcacgctgtgctgtagttttttctagtttgtcgcggcaaaggcaaagcaaagctacgtcatcctccactccagctttactcaacgcgacaactcctacgtacgactcgtgaacagatgtcccgtgcgcattatgctcctacttatgttatcatcgaccgagtgagtcacacacgtccaaatccaatctgagcccgttgcgttcccgcgtctcgcttgtggccctggcgactgacggcggatcggatcgaatcaacccgccccagctggtggtcccacactacccgcggatggccggcgcgttggcgagcgaacgccgacatctgtagactgtagccaatagcgatccaccaatccacccccaccccaacttcataaaccaagctgccactagccgactacaccaccagcagagagcagacccgccgtctccgctatcagcacgcgtgtagccctgcagcgaggaatcaccacacacacacacacgcagagagacagagaagaggagggagatgtcgccgcagtctcagcagcagacggcgatagtcggggaggagtactgcgagggcgaggacagggagctgacggtgcgcaagacgacgctcttcaccccgggggacgggctggaggcgtacgaccaccgcacgggcgcgctggcgttccgcgtcgagacgtacggccgcggcggggcgtgcgggggcggggccgccaggggggacctcgcgctgctgggcgcccagggggagcccgtcctcacggtgcgccgccgccgccccagcctgcacaaccgctgggacggcttcctcggcgacggcgccgcgcacggccagaagaagcccgtcttctccgcgcgccgctcctccatcctcggcgccggcacgggcgccgccgccgtcctcgtcgacctcctcgcccccggcgccgccggggagttccgcgtcgacggctccttcccgcgccgctgctgccgcgtcgtggcctccgccagggcctgggccgcgcccgtcgccaaggaggaggaggaggaggaggaggaggacgtggtggtggcggaggtcaggcggaaggtggacgaggacgcgcacgtcatgatgggccgggacgtcttcgtgctctgggtgcgcgccggcttcgacgccgccttcgccatggggatcgtgctcgtgctcgaccggatcaccggggatgacgtcgacggcgactgcgggaggacctgctcgaggccgctacatcccgccggcgtaagcacgcgggaccgacctcccgctcgcgtggggcgtggcttcagtacaattccacaaacaattttctcatggttcttcgatccgatgtactttaccttcgagcatgatgtgaattatcttctcaattccgtgcaaaatccccccttccaatctgatgcttgacattggatcaccacgaacaaattcgttgcattgccgttcactgccgtcatcggagggttgttttcggagtcaaaaaggtggaatttgccgtgtgtggcggtgaagcgaagctggctctttcaagccgagaaaatggacgtcatttacgtgggtggcaatggatgggcggtggcaaaaatctgttctccnttcggtatgaactgctgtggaggacagaacaaattaacgatgctcacagaggctgcatttatttttctgctcggtaggtaatatatcccaactaaccaaaaggcagatgatgctaatcactagttggttcgaggttcacaagttggttcgagctcgggactcggattagagcggctcgccagagtcgagccaggtttttagagtagctagcaagctgtaccaaattaattaaactatagaataataatggatatttaataaagttacttagaatttatatattattaa

SEQ ID NO: 10460 - DNA, 1319 bp, Zea mays
taaaccgactctgtccaccgagatatttttctcttctctcctgtgcggccactgccacccgccccgttcgttattatatatacaacaacaggctgccagtctccctcgttgacatcggttcaccgtccgcccaggtaccttccgtacgtacaagaggcggtcgcgacgctctagcttgcattgcaccagcgcgcagagcggaaggaggtggaaagcgcccagagagatctcgagagagaggctggtcggcacagactagttcattccgtttggatagagacgcacgcaacgcaggccaccacaacgtgaggagcgggaggagggagagggaggatgcaggcgcatcaccgtcagtcgtactacgcggtgctcggcgtgcagccgggcgccaccgctgccgagatccgcgcctcctaccaccgcctcgccatgaggtggcacccggacaagatcgccagcggcggcggcgccggcgccgatccggcgcgcgcggaggaggccaagagcaggttccagcagatacacgaggcgtaccaagtgctgtcggatgacaagaggagggcgctgtacgacgccggcatgtacgacccgctggacgacgacgacgaccaggaggacgtcgagggattccacgacttcgtgcaggagatggtctcgctcatggccagagaggagcccgtgtacagcttggccgagctgcaatccatgctggacgggatgatcaaggatttcaccgcgccacagccttggcctagcggcttcttctacactggtggtggcggtggcggtggcggtggggcgtcgtcgccgtcgccgctcggcaaaccaagcagccaagagcagagtacggcttcgtcacgcttgcatccctacgggttcggggacgcgccgtgcttcagccgcacggcgttctcacaatgatggcgatgatgaataaattgatacatggatcgagcttttattcttctggcagcaatgggggtttcctcgctcgtgctcgtggaggtggagggatagtaggaacccgtgaccgtgaaagccatcgtccgccagggccagactctgattggcagttgcaattgctttggactgtggggatgaaagaaggtgaggtgggaagatagaccacaaggagagcacgtagtcgcctagaatcgccacccatcagcaaaagaaggggtgtttgtttgtttgtactgtttggtttggtttggttttcgtctcttgcctgccatggtagagatgagttatgccagagcatttgtatacaagggtatgccatcaagaataagttacgtcaatacaatttgtacataaat

SEQ ID NO: 10461 - DNA, 912 bp, Zea mays
aggataactggcttccagtttgctcctggaagctcctcggaagttctgatgacttctgcggattcgagaatacgagttgtgaacggcgatgaatttgttcacaagtttaaagggtttcggaacacgagtagccaaatctcagcttctgtagctcagaacgggaaatacgtgatctgtgccagcgaggattctcacgtctatgtgtggagacatgacaacagttcccaccctagcaggagcaggagcacagttgacgtaaccaactcatacgaacatttccactgccatggtgtgaccgtggctgtcacatggcctggtgctgaagcccgatgttcgtttggacctggaagcagcaggcacagtgattcagatggggcagtgaactctggccgggacctcccagttgagaacactcggcacagctctgatgcagctgatatcagatgcaacgagagcccagcttgcgaaggcgtgaccagcagaagcaccagcagacatccaggcgacggagcgtccacgtcctggcctgacgaaaagttgccgtcagccaagagcagccctggtcactgttcctccgatctttgcattggagctatggatgtccaacgccggtctgcgtggggcttggtgattgtcaccgctggacggggaggcgagatcagggtgttccagaattttggcttcccagtccaagtgtaaagctagcgtgagagcatgcagatagggaggggtttgtttggttctttttactgtacatatatcggtagatcgtcgacagtttttttactgaaaagttctccctgtttccctgtgtcgttggatgcatcggattgtagtccagaaccacactaccaatatgcttaacactctcactccctcttgataaaaaaaaaaaaactcgagggggggccc

SEQ ID NO: 10462 - DNA, 3269 bp, Zea mays
gtcagtaaagttagaggtcgaaagtgtctatccttggcattggtctgcgtgatgtaaaatttgcagaaaacgagaaggatccggtggggagatggaaagacgagaggggcagccgggcaggcgttcctcgtgcccatggacgaagactctgtttggtttagggcgactcatttttaatcactaaataaccaaacaaggtaattaaattatcttaactaaagtttagtcttctagtcaatataatggggtgactacgacaggggcgaagctacgttgcacatgcacccctccaaaaatacagttataatagttaaattttcattatatatgtatcaccaacattttacctctatacacccataagaaatgtgcatgttcttatattttgctctagcttcgccattgaactacgagtagtcccaaccctcaacgtcatccaatttttatagaattaaatactctatcacataagcaaaaagatgacatgtcaacataattattgtgaagagataagaaaaatagaggatacaggttcctacatgccgaagacagggatgtcaatggagaattctccattgggaataacttcctatcatcatccccgcaatgaaaaaaattcttctacaaggatcctcatgaacgtttgcgggtgatgtttctttctcgtccctgtccctcgcggtcgcgggaataaatatccgacggggatcctcatccccgattaaattataattagtatgtacatcctttgttatcggtgcaaaacattgacacttacgcacattgtgagatgtaaaaaattattatgtgtgcatcaaaataaacacaattgtaccatgagtaatcgttgaccaaagtaattatttattttattattaagggctagtttgacaatactattttctccgtggattctcatttttcctaaggaaaaatgatctaatttccttagaaaatataaaacacttagaaaaatagggttgtcaaactaatcctagctattgcaaaaaaaacattgtcacgtgcaaatttaacgggtcccatgaacagagatatggaatgctccctttacctgtcagaagagaaaaattccctatttccatctccgtggaggaaaaacttctccatctatatcccctaatggatgaattccaagcggaaaattggagatttggtccccattcccatgccatctttagctgaagagaggcagaacgaagcggctgaaacacagtggtgtgatcaggatgacgaggaccgggatctgttgttttcgagttagcgatcaaggaagatggttttcagtagatcgtttttgtaagctctacgttgtttttttgcggcctgttctcgtgaggtacactttttatatgtataaatgtggtccacacttttttatacataaaccggtggagaaaccgtgccaaatatacctcgacatctgatgggtgtgttagtggcatgactcgtgagagagagggaaaaaaaaaagaaaatcaggcacctgatgactgttgcatagaaaccattcttctgtggctatggtgttttgcttgagctagcaaagttaattttatgggctcgcgtttttttttttttttttgacacaaacttaattttattgtcacgataaatcactgcacagatcttacactctggctctagctacagatcaagatgcactgatctaactagcagccccaccatttcattcgcagtaaggacgagaagaaacagtggaggcgacataggagaattgtgagagctctgcatgctaggaactgaactgaactgaacctgacgaggccgcactgctaaaaccggagcccctcaagacgcgcgacggcggctggcactcagttccccggcagtgtccagctgaggtcgaggccaccgatgtcgccccacgtgcccgccgttgctccgtcgtcccacggcgcgagcccgtcgtacaagtccgggaccagcaccgactgccacgaggaggagaaggccgggggtgcaagcgcaacgccgccgacgaggtcgagctgcgggaagaagctgccgtcgctgaggaacgggaaggcggacggcaggcacgcgtccgcgaccgacggcggcggggatgagggctcggcggagaccctgcgccgcttgccgccgctgccagtagtggcggcgcggcgcgaggcgccgccgacggggacgtcgcgcagcgtgcccccgtgcgtccagtagcggcggcacgcgcggcagaagtggcgcggctgcgccgtgctgtagttgttgtagtagcagaacttggtgttggtggagcggcagcgcgggcactcaagctgctgctgctgccgcggttgctggccctggccctgcatgcagtgccacccacgtgcaaccgcacgcgtagtacgtcagtgagctgagcgatcggcgtgggtaggtaggatcggtcagggtgcagctactgacctgcacctgctggtggggcgcggaggagtcgtcgtgcgggagctcatcagcgtcggaagtggcggggcgctttcgcttggcggaggcggtggccgagaggatggaaactgcaggcgccatctcgcaggcgagcagaaccgcgcatgccgaggacgagcggcggcgggttaatagacgtccggcgatgcggccgagagcgctagctagggcgcggcgcaatcagcttctcgctctctgggtgacctggctgggatatatgggatgggatcatgggaaggactaggagaggaagagaatgcgaccgagagggctgctagtgctagccgcctagccgccggccaggctatttgtagccggtggaatggaatggaatggaatgggatgggatgccatgccaatgccagtggcagcggccgcggcagcagcgagagagacgtagcagcagccgtcgctgtcaggtccgacctggacggcaatcagctcgcgcggcgttggttggccggtctggtgtctctcgagacgacggggtcgttggttgcattgcagattcgcagttgcagacatgggaggggcaggccgccgcgccgccggaccggacagcatgctgcattgcagtgcggcgtggagcccgcgggtgacgcggcagagatgctcttcttcggcgtgaagctacctcgcgtgacgatgaccgtgcgtggtctactattagtagtaaaaggagcaggagcaggagcagtcgttgcgctaggcacggggcacgacacgagcagacgacggtcgacgggcggaccggggtcgttgtcgtgcgcacgcgacgg

SEQ ID NO: 10463 - DNA, 1126 bp, Zea mays
  misc_feature (2)..(2): n is a, c, g, or t
  misc_feature (9)..(9): n is a, c, g, or t
cncacgagnccattacctagaacatcctaatcgaaaacttggccacctcgtacgcatcggcatcgcgtcgcgcccgccgctctcctctcctgccggcctgtccaacttcaaaagagcacgcgcttccgccccccgccctcctgcaccgctctccttccccgacgatggatcccgcagccatgttgagatccccgtgctctatcgtctcgccgggctccttattaaccgccccacttctcccagtacgcctcgccgtccagccacgccgccgagtgcctggttttattgcgccctccggcaggccgtccgtcgcgcggcgcgccgcggccggagacaagttcgaggccgagacgcccatagagaaaagtttccctcccttcccaactgtcatggacatcaaccagatccgtgacatcctgccacataggttcccgtttcttctggttgacagagttattgattacaaaccaggagaatatgctgttgcaatcaagaatgtgacaattaatgataacttcttcccagggcatttccctgaacgacccataatgcctggtgttctcatggtcgaggcaatggcccaggtcggaggaatagtgatgttgcagcctgaagtgggtggatctcgagagaacttcttttttgcggggatcgataaagtgaggttccggaagcccgtgatcgctggagacaccttgatcatgagaatgactctgatcaagctgcagaagagattcggaattgcaaagatggaagggaaagcttacgttggcgccgacctggtatgcgaaggggagttcttgatggctactggatcagaatgaaggcaggagacacatggattgatggatacataatatttcaagtttttactgtgaaatcagctttccagtctaataagttttgaactgtgtctgtaatagcggtgtaatgtcgttgccttgtagtcttagtgagtgttgctgtgttggtgtgtatgagtaacagggctctaaggttaacaaccactgccatggaatggaacaaatggaaactgacagcgcgtttggttgtttttagagcgtttttattcgagacggaatacaattgaatgatcgtgttcctcggtcgtgaccacgccgttgct

SEQ ID NO: 10464 - DNA, 464 bp, Zea mays
tggagtcgctcctggagctttgcgcgaagctcctggagcaggaaaggctcgacgagctcgccggcgttctccggccgttcggcgagggtgccgtgtcgtccagaaagacggcgatctggctgaccaagagcctgatgaccccacccaagttcggagagtccccgacgaagcttctgtaataacagtgattcgtttgagagtttttttttttttcgagtgccattttcgagagtgtacatagcttcaacagaatttgagttcaaggttgctgtgcttacctaggcctgagctttatttatcttggatgtatatggttttgcatgccaccaactgttgtgagcgatggctggttatttaccagccgccttgttttatttattgtgcaattgtagcgtgagcgtaatggctgctgctgcgagtgttcaggaaataatggaaatcaccccgagtccatttctgttttc

SEQ ID NO: 10465 - DNA, 964 bp, Zea mays
  misc_feature (917)..(917): n is a, c, g, or t
ctcgaggccggccgggcccccgcctgtcccctcgcccgccccccctccctccctctctctctcatttcctcacgcacgtctcgcaactgccgcagcacaccgcgccgcttcttctcctcctcctccttccgagccgagagaaaggctgctgccagagggacgaggccgagcgatggagcagtacgaggtggtggagcagatcggccggggcgcctacggctccgcctacctcgtcctccacaaggccgagcgcaagaggtacgtcatgaagaagatccgcctctccaagcagaacgacaagttccagcggaccgcttaccaggagatgtccctgatggcaagcctcagcaacccgtacatcgtcgagtacaaggacggatgggtggacgaggggacctccgtctgcatcgtcacaagctactgcgaaggaggggacatggccgagaggatcaagaaggcaaggggcatcctattctcagaagagagggtgtgtcggtggttcacgcaattgctcctcgccctcgactacctgcactgcaaccgtgtgctccaccgtgatctcaagtgttccaacattttattgacaagggataacaatatcagactcgctgactttgggctggcaaaactgctcatggaggaccttgcctcatcggttgtaggaaccccaaactatatgtgcccagaaatactagcagacataccttatggatacaaatccgatatatggtcacttggttgctgtatgtttgagattttagcacaccgacctgcatttaaagctacagacatggcagcattagtcaacaaaataaacagatcttcaatatctcccatgcccccaatatactcatcagcactgaagcagatcgtgaagagcatgctaaggaaaaatccagaacataggcctactgctngggagctgctgaggcatccacatcttcaaccatatctttctgaatcg

SEQ ID NO: 10466 - DNA, 3650 bp, Zea mays
gcccacgcgtccgcacaaacacaaagtttgtggctgtccgatattgctcggccgcgtttagctattgcgtgtattgttctcattgccggtcatatgtatcgaactaacttcggaattgggcacagtatcaaagatcttttagaagcacatactcctccggggggtcgattaggacgtgggcataaaggcctttatgatacaatcaataattcgattcattttcaattaggccttgctctagcttccttaggggttattacttccttagtagctcaacatatgtactctttacctgcttatgcattcatagcacaagactttactactcaagctgctttatatactcatcaccaatacattgcagggttcatcatgacaggggcttttgctcatggagctatttttttcattagggattacaatccggaacagaatgaagataatgtattggcaagaatgttagaccataaggaagctatcatatctcatttaagttgggctagcctcttcctaggattccataccttgggcctttatgttcataacgacgttatgcttgcttttggtactccagaaaagcaaatcttgattgaacctatatttgcccaatggatacaatctgctcatggtaagacgacatatgggttcgatatactcttatcttcaacgaatggccccgctttcaatgcaggtcgaaacatatggttgcccggatggttgaatgctgttaatgagaatagtaattcgcttttcttaacaataggacctggggatttcttggttcatcatgctattgctctaggtttgcatacaactacattgattttagtaaagggtgctttagatgcacgcggttccaaattaatgccggataaaaaggatttcgggtatagttttccttgcgacggcccagggcgcggcggtacttgtgatatttctgcttgggacgcgttttatttggcagttttctggatgttaaataccattggatgggttactttttattggcattggaaacacattacattatggcagggcaacgtttcacaatttaatgaatcctccacttatttgatgggatggttaagagattacctatggttaaactcttcacaacttattaatggatataatccttttgggatgaatagtttatcagtatgggcttggatgttcttatttggacatcttgtttgggctacaggatttatgttcttaatttcctggcgtggatattggcaggaattaattgagactttagcatgggctcatgaacggacacctttggctaatttaattcgctggagagataagcccgtggctctttccattgtgcaagcaagattggtcggattagcccacttttccgtgggttatatattcacttatgcagctttcttgattgcctcaacatcaggcaagtttggttaatttagttatttttttttgtactgtatcagaacccagttcattactcttgatggagagggaggatccgcctttttagatttttgctatttatttttctatctaggattagaaccatatacttggtaataataggaacggcacattatggcaaaaaaaagtttgattcagagggagaagaagcggcagaaattagaacaaaaatatcatttgattcgtcgatccttaaaaaaaaagataagaagcaaagtttcccctttgagtttgagcgaaaaaacaaaaatgcaacccgcggcccaatccctaccacgtaatagtgcacctacacgccttcatcgacgttgttttttaaccggaagacctagagctaactatcgagactttgggctatccggacacatacttcgagaaatggtttatgcatgtttgttaccgggtgcaacaagatccagttggtaaggataaaataccctttctttcatatttgtatggttttctcgaattgatgatcgtagaagagccctctttaccattctgtataaatggactattctatttgtatagatatggtagaggggcctatccaacccactagtttcccgctaagaaggtggagcagtttggtagctcacaaagctcataaccttggggttacgggttcgatactgactacctgctccatattccttctttatgatatatgtatcatccatttgtatatggtatatggatttgtttttctttcctaaaagagtttcggtctaacagttttttattatttctctgaaatataaaaaagaaagaataaaataagaaagagaagcgtccacccgcgtatggataggacagaggtcttctaaacctttggtataggttcaaatcctattggacgcaatcttttttctatctattctttaaataactatactaaaaacgaaaaaaaattttgcatgattcaaatgaaaaatctttgattcctcttctactaacacgagttatactaataagagtagacatgctatatttatgtttgttcctgaagggaaaaccgttcaagctgttcctgaatagcttccttcaaaagggtttctgcttgctcggtgaatgtcttactagaagatataatttcttggaattgaggtttagtatcttttaggtgtttacgtaactcatccagaaatttctttacctgttcaatttctaacgaatcaagatatcctctcgttccggtataaatagtagctacctgctcttccactgggagagggtttgattgggattgtttaagcaattcccgtaatcgtcgaccccttgccaattgattctgacttgttttatccagagcggaggcgaattgtgcaaaggcttgtaattctgcgaattgagctagttccaattttgatttgccagctacttgtttcatggctttaatttgagctgcggatcctactctggaaactgaaatacccacattaatagcaggtcgaattccggcattgaatagatccgcggataagaatatttgtccatctgtaattgaaattacattagtaggaatataggcggaaacgtctccagattgagtctccactattggtaaagcggtcatactcccttcgcctaaaagagaatttaattttgcggctctttctaaaaggcgtgaatgcaaataaaaaacatcccctggataagcttcgcggccgggaggtcttcttaatagaagggacatttggcgataagcttgtgcctgtttggagagatcatcataaattattaaggtatgccgttcgcggtacataaaatactcagccagggctgctcccgtataaggagcgagatattgtaatgtagcgggtgaatccgccatttcagctactacaatagtgtattccatggccccctcttcgtggaaagtagttactacttgagccacggaggatgctctttgaccgatagctacataaacacatattacatcttgacctttttgattgagaattgtatctgtggctactgctgttttgccagtctgtctgtccccaataattaactctcgctgaccgcgccctatggggatcatcgaatcgatagcaataagccctgtttgaaggggttcatatacggaacgcctagaaattatacccggagcaggagattcaattaagcgagattctgaagcgacaatttcgcctctcccatcaataggtttagcgagagcattt

SEQ ID NO: 10467 - DNA, 2103 bp, Zea mays
  misc_feature (2063)..(2098): n is a, c, g, or t
ccctcgcgtccgcgccccccgccgccgcgccaccattattccacttgcctgactcctctccctccctctctctctctctatctctcatttcctcacgcacgtctcgcaactgccgcggcacaccgcgccgcttcttctcctcctcctcctcctcctccttccgagccgagagaaaggctgctgccagagggacgaggacgagcgaggatccttccgagcgatggagcagtacgaggtggtggagcagatcggccggggcgcctacggctccgcctacctcgtcctccacaaggccgagcgcaagaggtacgtcatgaagaagatccgcctctccaagcagaacgacaagttccagcggaccgcttaccaggagatgtccctgatggcaagcctcagcaacccgtacatcgtcgagtacaaggacggatgggtggacgaggggacctccgtctgcatcgtcacaagctactgcgaaggaggggacatggccgagaggatcaagaaggcaaggggcatcctattctcagaagagagggtgtgtcggtggttcacgcaattgctcctcgccctcgactacctgcactgcaaccgtgtgctccaccgtgatctcaagtgttccaacattttattgacaagggataacaatatcagactcgctgactttgggctggcaaaactgctcatggaggaccttgcctcatcggttgtaggaaccccaaactatatgtgcccagaaatactagcagacataccttatggatacaaatccgatatatggtcacttggttgctgtatgtttgagattttagcacaccgacctgcatttaaagctacagacatggcagcattagtcaacaaaataaacagatcttcaatatctccaatgcccccaatatactcatcagcactgaagcagatcgtgaagagcatgctaaggaaaaatccagaacataggcctactgctggggagctgctgaggcatccacatctgcaaccatatctttctgaatcgtccaactgttcaccgatctatcttccggtgaaacccaccaaaggtaacctggtagacaagcagtcaaagaagccaagcagtggcagaaagcgagctgtcaaagccaatggatccaatggaacattagaaactgcagcagagcacgctgtggaagcaagagacagctccacaaacttctcagatgtatcaactataggtacccaggaagccttgatattgcaaatgccggtggatcctgatgccggaagcaaagaagagcagaacgttgatgttgtaccgtttcagcatgcggcagagaatctgatggcgacaaccgatagacaggtcgatgcgaccatacgtcttaaagccataagaaccagtaacgcaaaagaggcggccccggtcacagttgcagaccaaaagttcaacgaggcgccaataccaaatgaggaactgacaatcggggtagtgcaggaacaaaggaaggacgtgaagccacgctcttaccaggcaggaaaaccagagatgtgtgacacaaccgtaacggaggaatcgtcgcccatcagcacgctaaagctggcgcacacggagagcgcgcccgcggagtgggaccacctgaacatagtccagcagagggccgacgcgctggagtcgctcctggagctctgcgcgaagctcctggagcaggagaggctcgacgagctcgcgggcgttctccggccgttcggcgagggcgccgtgtcgtctagggagacggcgatctggctgaccaagagcctgatgacccccccacccaagttcggagagtccccgacgaagcttttgtaaaacagtgattcgtttgagagtttttgtttttttttcgagtgccattttcgagagtgtacatagcatcaacagaatttgagttcaagattgctgtgcttacctaggcctgagctttatttatcttggatgtatatggtttgcatggcaccgactgttgtgagcgatgactggttatttaccagccgccttgttttatttattgtgctggaaatccgtgagcgtaatggctgctgctgcgagnnnnnnnnnnnnnnnnnnnnnnnnnnnnnnnnnnnnttcta

SEQ ID NO: 10468 - DNA, 2428 bp, Zea mays
  misc_feature (1058)..(1058): n is a, c, g, or t
gtctgatcataaaggtttacattggaccttttgatcatacttacatctagggttcctattgcccaagaggggtttgctttagggttttgggaaattctccccttagatgtgcatgacaagctaaggtatgatatccaagatgggttgcacttgcttaggaccttgaactccaagtttgatgcactttgctcaactaacccacatgtgataataggttaaatggggtagccctgggtggacaccctgagtaacacctagggtattacaatatccatgctggcgcgcctggcgtaacagctcctggtgcaacaacaagtaccagcttaacgtggggaggcggcgagttagtagctataggtggcaaagtagctttgttacctattccattaggaaccgcagattttttagtccatcacattcacacatttaccatccatgtgattgtattaatacttttgaaaggtgttttatttgctcgcagttcccgtctaatacctgataaagcaaatcttggctttcgcttcccttgcgacatacctgggcgagggggaacatgtcaagtatccgcctgggatcatgttttcttaggtctattctagatgtacaattctatttcggtagtcattttccatttcagttggaaaatgcagtcggatgtttggggtactataagtgatcaagggatagtaactcatatcacagggggaaactttgcgcagagttccattacgattaatggttggcttcgagatttcttgtgggcacatgcatcccaagtaattcactcttatggttcttcattatctgcatatggtctttttttcttaggcgctcattttgtctgggctttcagtttaatgtttttattcagcggccgtggttattggcaagaactcattgaatctatcatttgggctcataacaaattaaaagttgctcctgctactcagcctagagccttgagcattatacaaggacgtgctgtaggagtaacccattaccttctgggtggaattgccacaacatgggcattcttcttagcgagaattattgcagtnggatagtggctaggaggatttgaaaggcattatggaattaagatttcccaggtttagccaaggcttagctcaggaccccactactcgtcgtatttggtttggtattgctaccgcacatgatttcgaaagtcatgatgatattactgaggaacgtctttatcagaacatttttgcttctcactttgggcagttagcaataatctttctatggacgtccggaaatctgtttcatgtagcttggcaaggaaattttgaatcatggatacaggatcctttacacgtaagacctattgctcatgccatttgggatcctcattttgggcaacccgctgtggaagcctttactcgaggaggtgctgccggtccagtgaatatcgcttattctggggtttatcagtggtggtatacaattggattgcgcaccaatgaagatctttatactggagctctttttctattatttctttctacgctatccttaatagggggttggttacatctacaacccaaatggaagccaagcctttcgtggttcaaaaacgccgaatctcgtctgaatcatcatttgtcaggacttttcggagtaagttctttggcttggacaggacatttagttcatgttgctattcccggatccaggggggagtacgttcgatggaataatttcttagatgtattaccctatccccaggggttgggtccccttctgacgggtcagtggaatctttatgcccaaaatcctgattcgagtaatcatttatttggtaccactcaaggagcgggaactgccattctgacccttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattaggacgtgggcataaaggcctttatgatacaatcaataattcgattcattttcaattaggccttgctctagcttccttaggggttattacttccttagtagctcaacatatgtactctttacctgcttatgcattcatagcacaagactttactactcaagctgctttatatactcatcaccaatacattgcagggttcatcatgacaggggcttttgctcatggagctatttttttcattagggattacaatccggaacagaatgaagataatgtattggccagaatgttagaccataaggaagctatcatatctcatttaagttgggctagcctcttcctaggattccataccttgggcctttatgttcataacgacgttatgcttgcttttg

SEQ ID NO: 10469 - DNA, 1376 bp, Zea mays
gggtgctttagcagcacgcggttccaaattaatgccggctaataaggattcagggtctagtttgtccttgcagacgggcccaggagcgcggcgcgcacttcgtgatatgttctagcttgtggacgcgtttttatctgggtcagtcttctctgggatgttaaaatacccatgtggcatggggtataccttttctattgcgcattgagaaacacattacattatggcagggcaacgtttcacaatttaatgaatcctccacttatttgatgggatggttaatagattacctatggttaaactcttcacaacttattaatggatataatccttttgggatgaatagtttatcagtatgggcttggcatgttcttatttggacatcttgtttgggctacaggatttatgttcttaatttcctggcgtggatattggcaggaattaattgagactttagcatgggctcatgaacggacacctttggctaatttaattcgctggagagataagcccgtggctctttccattgtgcaagcaagattggtcggattagcccacttttccgtgggttatatattcacttatgcagctttcttgattgcctcaacatcaggcaagtttggttaatttagttatttttttttgtactgtatcagaacccagttcattactcttgatggagagggaggatccgcctttttagatttttgctatttatttttctatctaggattagaaccatatacttggtaataataggaacggcacattatggcaaaaaaaagtttgattcagagggagaagaagcggcagaaattagaacaaaaatatcatttgattcgtcgatcctcaaaaaaaaagataagaagcaaagtttcccctttgagtttgagcgaaaaaacaaaaatgcaagaaaaattgcaatccctaccacgtaatagtgcacctacacgccttcatcgacgttgtttttttaaccggaagacctagagctaactatcgagactttgggctatccggacacatacttcgagaaatggtttatgcatgtttgttaccgggtgcaacaagatccagttggtaaggataaaataccctttctttcatatttgtatggttttctcgaattgatgatcgtagaagagccctctttaccattctgtataaatggactattctatttgtatagatatggtagaggggcctatccaacccactagtttcccgctaagaaggtgggggcagtttggtagctcacaaagctcataaccttggggttacggggttcgatactgactacctgctccatattccttctttatgatatatgtatcatccatttgtatatggtatatgggatttggtttttctttcctaaa

SEQ ID NO: 10470 - DNA, 2010 bp, Zea mays
  misc_feature (1275)..(1275): n is a, c, g, or t
gtgtaaaataagaaacgtaaaactgtagataacaatgtttaatttgtaaagagaagtctaaattataggatgagatagaggatacgatagagaatcagatggagttacccttggaccgttggccaaaagactctccttgcccgtacttacctgtagttcaagaaagagaacggcccattaaccccggccccggcaactccccaagtcgagcaacaggccaaacccccagccgccggaagccgctaccgctagcacctccgatcgagtcggcgccatggaagacgtcatcaccgacgtgccgccgccttcccgcttttcccctgacgacctcgacaacttcgccgctccgccagcgcagcccacccccatcttcgtcgtttccccgaaccctagcccaccggccccgcgcctcctcgtcgtattcatctcccccacctccctcgcgctcctcgcctccccgccgccgctcctcgcctccctgctcctcccggacctgcccctactcccgcacgcgcccatgcgcgtgtacctccacccctccggcgcgctcctcgccgcggcgcacggcgccttccccgcccaccgcgcgcgcgccgccgcgaaggctcttgtctccaggctccagccggaggaggtgctggttttggacgcggtccggagcgggacgtaccggggccgcctcgccgcggacgagcccgtggaagggaagttggagacccgcgcggcgcgcgcgcggggaggcgtgggggctgccaaggcagtccaggctctggtcccacccggcagcgtggtggacgggctcggcgccgccgtgctcgcggagtgcgagatccggggcaaggcggccagcatggtggtgacgtggccggcggactccaggcccgcggagttcggggtcatgcggcgcgtggcggcggagctcggcgtcgacaccggcaaggccgcggccagggtctccggccggcccgacctggattccttgtacacttgagatttctctgttactgctgctgaattgctgatttcgttggctgtggcgttgggttgtctgatgagtgagtgttttgttggtttgagacaatttggggtcaaatctggtctgacggacgagttggtttgcgtgatttcatatatgaacaaattctgatctcagttgtgtcattactgctgtaatgatcactgattgaatggattgccttcctcagaagccatgtgaaggccaattacaatgaagcgcagaaaggttcatgacaagctatatgcgctctgtttggntaaggcttaggggtgactaaagtttatttcgtgtcacatcgaatgtttgaatatcgaatgtttaaatatcaattatgagtattaaatataagcttattatatttaataaatctgtctcgttttttagccttcatatgtgtaattagtctatgtaatgatatcgaatgtttaaatatcaattatgagtattaaatataagtttattatatttaataaatctgtctcgttttttagcctttctatgtataattagtctatgtaattagttttatatttagactgtatttgatcgtaactatcgctcaaacatttgatgggctaaactttagtttggtgaaccaaacaccctctaatgctagtgaactgtaagtcataaaaccaccattgtactaatgacattgaatgcaaatacgccttccttaaaagtgaccgtggcaaaataatatactattgaatgtttcccttcggaatgccctatggctatgatagtcacacaaactcccgtcttttttatctttcttgtcaggataataataaaaagttatgccctctgctgttttccatgaatcaactccagttgttactacgatcatttacgtagttaacatgttcaatccatgtcaaagaaacaaccgaagtacttagcagagggctagctaaaagttaagtactacctctgttgtcgaatatttgtcgtccgctaatttattttaaactaaaccgtacaaataaaaa

SEQ ID NO: 10471 - DNA, 3914 bp, Zea mays
gtaaccaacacaacaactcaccttgttaatcaatagtataaatcatcatcttctattgttcgttatgacccatgggagatgacgatggttgcggtctctcctattcaagacaatcttgcctcggttctagagtgtgaatttgttttaattgtctccaaatattcggttctagagtattggatatttggatcccatctagagtggacatgttgaccttgcaccaacacatacacaccggcatagatgacttgaattggattgctgcggaacacatggcgcgtggctttgccccatccttgagtgcgcgggtggtcgagttggaggacgatgagccacaactataaccgatttcatcaaatgactttttagtttttaccactcagattacacagcttttttcacagctcataaatcacaacaactttttgatagcccccaacttaatcaaacatggtcattagaaaagaacttatagtcgaaactagacaaagttgtgacatatcatatagaaccatgttttagaatagagtcttaataaaactccaaaaaataacgttttattacttcaaaactataaaatctgttacatctaaatactctatggcgctcaaggctaaagattttacagccatagtgaaccggttggccaatcacgtcatggagaccgcaagcgagtattctggtgactagtgagtgttgggctggtggcgcccgaccgagctacgagaccccgacgcgtcgcaactgaccggcccgtcgacgttagcccgtgaaggccacgaacgcggcccgtgtgtgacgcacggctagtacggcacggtagccacgcacccacttcactcgtgatctactgtgatgcgtcaccgggcagcctctaggaagagtaacagggaggccggaatctttcgatcgagggcaccaccggcggcgggggtagtagcacaggaggggagccgtggagcgatccgtcgggcatctgcgcccgatgtgggcgtggggctgcgtcgagcgcgtggccgcgggcttcctcggcggccccctcgccgccggcggccgctggaacaccgccgtcgccgtcggggtcacggccgccgcgggcctcgtgctcgtcgccatcgtcgtctcttcccgcaggtcggtcggttcccgccccgcgtccccacaccctttggaatcgcttatgctcctaccccggcctgcctcaacgcgtgcttcgatgcagaggcgggctcaaatctccgtggtggcggcggcggaggaaggcgccacttacggcgcaagagtggtgcgacctgttcacaccgcaggggaagcttcaggacggcggagtgaagcttctgaagaaagttcggagcggagtaagttgcggcaactcatgaatgatgctgtaatgcaggttctgaagctgtgaggctgattcgtgtgcttctgtgacaggggattgaaccgagtatcagagcgcaagtctggccgttccttctgggagtgtaagtaatctggagtgttgatcacgaaaccgttgttttcatgcttggagatgtacaattagatccacacgatactttggaacaagatatgtgcatgctaattccttaattacttcataggaagagattatattgcaattataataacattaaccatggtccatggagatggatgaacctgcattttagggagacatgtactttatatcatcaagctgaacttaagaagttgtggactactaaatgggcacaacaaaattcataaattttcttgctagatgtacaaatgaacacgcaatatttgtttttttctttattttttccacagttcaaccagatttgcagttatagtaggaaacaacgtgctgtcagattttataagcactgcagaacgcatgtgtgtgtattcagtctgatagacttgactaatctgcatttgaactcatacagttatagccttgacagttctgaagcacatagagatgtggtcaaggcccagaacaggtacagtcttcatgtatattttatctctttatcatacatatgttcttcctgtctgaaataactgggtgaagttgattaaaacatgtttcccatgttttttccaccaattgtatatggcggtgtgtgtttttcttatttagtgcaggaatgttggttgttaaacgacactaaattagatgttatttttcctgactgacttaaggtgatgacacccagtggcgtatttcttgtaggaagggatatttgttattgaggaaacattgcctgcgtaaattagcatacatcatggaagagagcaagcagtcaactaaaacagttaaagtcaaccatgaagggagcaatagttctgaaaaaggtgatgaatctggttgtgttagtccttttgaatctgaagatgttcttgaaaattctggcatgggagaggctacaactgaggaaggaattccatgcctcagtacagagcaagaagtgcaggatgacacttctgaaacaaagccagagcagatgaatggaaaccagtcttcatctagctcctctgatgaggaagggagtgaaagaagtgttgtgactcaagtagaagcatctcataagaacttggcctcagtttgtgagtcctcatttgaggatggacaagaaagcatcccaagatattcgaacacaggaggaaatatggatgatgttgtgttatctaaggctgcccgccctgtgaagtctgcacgggcaactgaggattttgagacatggcaacggattatccgtttggacgcagtccgtgctaacgacgaatggatttcctactctccatcccaagctgcagtttccaaggagagggcaattgaatctgctaaagctgtttttctcaaagactatgaccacttagaaccatatcggatccatcatgcgtcacgccttgttgctattcttgaggcctacgcaatatatgaccaagaaattggatattgtcaaggaatgagtgacctgcttgcgcctctccttgctgttctagaggacgatgacgaggccttctggtgctttgctggttttatgaggaaagcccgccacaactttaggcttgatgaagtgggtatacgccggcaactcaatatggttgccaggataatcaaatacaaggacttccatctctacagacatttggagatgctccaagctgaagactgctttttcgtttacagaatggtggttgtgatgttccggagggaactcaccttcgagcagaccctatgtctctgggaggtgatgtgggctgatcaggcagcaaaccgcgccgagatcgcaaactcatcctggcgtaaattgcagttgggagcgcctccaacagatgatctgttactgtatgcgattgctgctagtgtgttgcagaagcggaaactgataatagaaagctacaacagcatggatgagatcataagggagtgtaacagcatggctgggcagctggacatttggaagctcctggacgatgcgcacgatcttgtggtgacccttcacgataggatcgagtagctgtggtgttcattgcttgcgctatttgtcacgttaccatacttccattatacccaaacactttgtatgaagtacgtaccaacagtgaatagaagcacgttgtggagttagctaggcagcaatggcagcatttgtttttaactgagcatgcatactggagaggtgggcaaagaccaaaggagcatgcatactggagaggtgggcaaaagatcaaagagccatttgaatctatcgttgtgacattgtctaccattctgatgcattgcaaccttctctttctgttgtatcctagttacatactgcactattatgtggatgttgtgttgggggctcggtgcaaattggtggatttcaggatctgttcttgttaggctgcacttgtttataaagtagcgtttg

SEQ ID NO: 10472 - DNA, 2032 bp, Zea mays
atctggatgggcccgcggtactggccctccccgcgcacggcgctcatgtcgcgctcgaacaccgtcacgtagtaccccctgcgccgcgccgccaggcgcgaacaccagcccgccgatgccgccgccggccaccagcacccggggcttcttcttccgccgcgcctcgcccgcgggcgcggacgcgggagcgacggacgcgtcgggcggccgcattgacgccgcgcacctgccccgcgcgcgccgcctggccttgccgccgccgaagcagcgcgggtgcgggaccgggagcgcgtgttggtgctgctgcggctcgtcgtggcaggagaggagcgccgagaggtgcgccttggcgggcgaagtggcggagagcaacgccatggtcgcgcgagcacggcggcctgcggctgggctgaacgggaagcttgcttgcgaagggaagtcgttacgcaagcggaactggatgatcggtggagggaggtgctatgccgttgccgtgctgcccgtgcactactctgcttagaactttgtcattgggctgagactgaaaggaggagcagagggggactggtggtgctgaggggaagaggaactggagccaatcacctgatcccatttggaagaacggatcttgctggaccaggattttatcttgccatgtcggcaccatcctctgcggacactacaacgttgtggcgacaactctgtagctcgccgtgtaacggtagatagcacaggccacaggcctgcaggggttaagaatataaatctccttctcaaaaagtcaaataatatccggtttaaccaaaaaaatattaaaatgtattaatatttatgaactacaataagtttcattagtatgagcttcgaacaaatgttcataaaaaagttatttaaaaatataattattgatgtttttataaacttaatcaaacctaagatctttttaactcatcataaacggaatttacattctttttaggatggtggaaatagtcaaatagaagttttgttcttatatagattgttcaaatagggttaacaagatggaccgtttaattattagctagtacattgtttcattttatgcaacttgatctgcataaatcatgcctgtttcgccacaaaaaaaaactgatatgccttgatcgatctgtgcgatgtcattcattattagttggctaacctcatgatcttgagtacatatggatctagattttagataatagacctgaagcttagtgcttgtttggatcctgagaattaattattagctagttaaaaattagataaaattagctcatccaaataagatggctaatagatggactattttttttatcaaatctttaactagcttttagccaactagttggacagattcacctaatttagacaaattttcattccaacctaatccaaacaccacttagttctgtagcatagttgatgttatcggtcttactacctatgttatcttgagaattaatgtggacacatattttgttgaccaaataggcaaatactaaaataatctagatggcatgtcaatgcttttatgttgtgacataaaaaacaattcattaagatgaaacatatgcacatcttctaatcagtggcatgtaggattcaaaatttgtggggtcaagcttgttaattttaagtcaattagcacaagttttggcaaaacttgtgagaccgggtgaccctacaggtaatacctagatctgccactgtttccattgtagcttcttttacgtgtactggctattagcttaggaaagaacaaaaaataaacagtgtgttgtatgtagcatactgaagtactgaacttaataggaaaatacaactcttttccctaaaaaatgcactgaccatggtcgaaacaagtggtttttctgttgagaaggcataaccaatacgaatttgaatggtatatgtctaaggaattaagcctaactcaatcgaccagggtggaatatgaatttaaatggtactccatctgtttatatatatgacacgattgaattttttc

SEQ ID NO: 10473 - DNA, 3443 bp, Zea mays
  misc_feature (583)..(583): n is a, c, g, or t
  misc_feature (594)..(594): n is a, c, g, or t
gacggggtagacagaggaagccgttgtgcatctcacgtggccgatgcgagtgtggccacggcagcggcagctcggatagcaatctcggccacggcagcggcatctcactagctcggccgcgcgagcaagaaaaccccgcccgttcgtggccgctctggtctcgtcgccgtgcccacggccacgggaagaaaaaaaaaacaagccgttaacctttctcagagacaacgcgggcttgttatttacggcccgcggggcggtgctctgcacgcctcgtgctctgctgtgtctgtgttctgttcgcttctgctccaccgcgtgcatgcgtggcgctgccccagcctgctagctagcctgcaacggaaggggccggataagatggcagatggtggggcggcgtcgcgcggccctcccgacggctcgccgccggccgcgctgctgctgctgcagcagcccctcctccacgcctacgaggcccgcaaggacccggcggcgtgcggccgggaggcgcacgggcacggcttcggcccggaccccgacggcgccggcgccggcggaggcgcgagcttcgtgcggacctgcttcnatggcctcaanggcctctccggtgagtgcggacacgtttcgtttgggagttacggtacaagccgggtgttggcatgccaacgctgtttgtttggtgttgttgtttttcttctctcggtctctcactttctctctctctctctctctctcaggcgtcgggctgctgtccatcccgtacgcgctgtcggagggcgggtggctgagcctggcgctgctgctcctcgtcgcggccgtctgctgctacacgggcctgctcctgcagcggtgcatggacgcgtccccggccgtgcgcgggtacccggacatcggcgccctggcgttcgggcgcggcggccgcctcgccgcgtccgcgttcctctacgccgagctctacctcgtcgccatcggcttcctcatcctggagggggacaacctggacaagctgttcccgggcaccagcctcagcctcggcctccgcggcgccgccctcgtggtctccgggaagcagctcttcgtcgtcctcgtcgccctcgtcatcctgcccaccacgtggctccggagcctcggcgtgctcgcctacgtgtccgccagcggcgtgctcgcgtcggccgtcgtcgtcgtctgcgtgctgtggaccgcgctggccgacggcgtcggcttccgggccagggggaggatgctcaacgtcagcggcctccccactgctctcggcctctacaccttctgctactgcggccatgccatcttcccaacgctctgcatctccatgaaagaaaagaaaaggttctccagggtgagtcgctgtgcattattcatcgaagagtaagacaaaaccaacgattccttctttttttaagttcattctaccacttcattttttgtgttgttaaaagtgaaaaaataagaggtagacagcatgcgagttcagctgacaaaagttctatatcataccaaaagagggaactgaaaatatcttcggcgtatttgtgtcaagtacttatgctcggtccttgattagaccctatgtcaagagaccctacttaacaaaggtcagctccactgttaaagcccacgcgaacagtttttttaagctaagctgttttaaaaaaatattatttgatgaaacagttttactaacagcttcatgcatatggttatgagagaaaactaagcgaaagatatgtgaaaagctatttttcagcttcatctccctttgtttatttgtgagagcatgaaaaagaaacttcatctgtaaagctattctagaaaaaagatgtttgacaaaagaaaacagtacacagtagtttactaagatactagttacagtactttactaagatactagttacgtagattttgcttaaataaaatatttattaaaacacgattatatattttttacaatatctctcctttatataacacaaacaaacatgagttgctgtgatggaaaccaaacactttattatactaaacgagtagaattcgaatcctccacaacctattttgtagagatttatttaaacacgattatatttttaatttcaaattctcagtatatttatatatttacaatacctctcctttgtataacataaacataacataaacatacatgagttggagtggtaaaagtcaagtgcttaatacaacgaaacaaggttcaaatccttcacacaccatttgttcaaattattagtctcaaactacaccctgactgactggctctgaaccaacgatcagttggtttcattcgaaaaacaaatagccttcagtcagtagcagctgtcctggccgagtatgatactgcaactggtacctcggagtcagctgcgccgtcacctctccattcctccaatgtgtggttccaaactgatgcgtcaaatgttttgctgtcttctattactgcaatggttcgcaattaaacaataatataggagtgtgaaagatctgattatgacatgacagtatgcttatcctatagagtctgcgacacattacagtattcattcgaggcttaaatccttttagtgccgctgactaaactgaaacaagtacgtgttcgtctgctgcatgcttgaaataggtgcttgtgatatgcttcgccgcatgcactctcaactacgcatccatggcgatcctcggctacctcatgtacggcgacgacgtcaagtcccaggtgacgctgaacctgcccgagggcaaggtcgtctcgaagctagcgatctacaccacgctgatcaaccccttctccaagtacgccctgatggtgacgccgctctcaacggcagtggaggagaagctgctcgccgccggccgcggcggcaagagtagtaggtccgtcagcgtgctggtcaggaccctgctggtcgtcaccacggtcgtcgtcgcgctcgcggtgcccttcttcggccacctgatggcgctcgtcggctcgctcctcagcgtcatggcctcgatgctgctcccctgcatcttctaccttaagatctttggcgcggcgcgctgcggcagggcggaagtcgcgcttgtcgccaccattattgttctgggttccgtggttcttgcgactgggacgtacgcctctgtgaagaagattgttcaggactactgaagaagagatgtctggaaatgtcggtggcagtgtcacagtcgttgttggcgttcttttgcggcgatcgacagtcccatatctcaacatcagcagattaggtaaaccaattagaaggtgttctttaaaaaatcagttagaagatgttcgtaggcaaggcaaggcaaggagacggaacgaacagtgatgtactgaaaacataatagtgtgatctgtttatatatggccgtgtgctactattttatcttgagcatcaaaaaaaaaaaaaaaa

SEQ ID NO: 10474 - DNA, 1382 bp, Zea mays
cccacgcgtccgcccacgcgtccgcaaattgtgagagcagacatgggagaattgtatgacatgaacctgaagggtcgcccgcttgcatatactccattctgtgataacaacaaggatatggatggttttcgattttggaagctcgcttgctggaaagatcatctgctagcgtggtcgcaccatatcagtgcgctttatgttgttgatttggccaaatttcggcaaactgcttctggggatactcttcgtgtcttctatgaacaactcagcaaggaccccaatagtctctccaatcttgatcaggatctcccgaattatgcccaacatacggtgcctatattctctcttcctcaagaatggctgtggtgtgaatcttggtgtggaaatgccacaaaagcaagagcaaagaccattgatctatgcaacaatccaatgacaaaggagccaaagcttcagggtgctagaagaatagttccggagtggactggtcttgacagtgaagcacggcagttcactgcacgaatcttgggtgatgatgtcgagcctgcagatgccacacctccgccatcggaggcaccgaagcctgaagatgatcaggatgtgaaagatgagctatgatcgcaagatgtttccaggcttggtcttactgaatgaaagtttggtgactcgacagtcatcagttcagaacacaggcacacagctagtggagcgcagagggatagtttaacgcaggtgcaaatttgtcaaaacactacacctggaatcctggactacattgattcaggtatttcgtttacagtaatagtttcaagacctttaaccaaatcatatggcggggaagctgcgtccagtaataggttaacaaggcagccagctggggtgtagaactctgtctgctctcagctgcatacacatagactgtaatggtcaacaatttaagatctccttgagacgctgtaaaatttatcggctgccagtcgaaaggcaacagcgaagctggcagctgaaatgcccgagaattttgtagcactcagcaaacggattttttaaacactcagtaagtcaataatgcgacaatgcctgtcgcatgtaacagcaggctattgtgggcatggcagctaaccgttatactaaaaaaaatgccaagtgctttatcagttgggtttaacacacgccgttgtctgtccagtgaagttcgaatttcgccatgacagcaggtgttgttgatcttgctgacattttggtgcggtgcagcagtaagaagacacaaagtgtttgttatctcgaggctccagccagcacaggcccatcggcacaaagcacgcacacccacatgctcctttcagaatttcagctcgtttgactagctgcatctggcaggc

SEQ ID NO: 10475 - DNA, 857 bp, Zea mays
  misc_feature (804)..(804): n is a, c, g, or t
gctcgaattcggctcgaggaaggaaccgacgaccccttctttatctcctatgggggctaggtccccccgcgaccgcccgggccgccctatcccatgcgccgcgccgcgccgcgttgcgttgcgttgcgttcgtccagaatccaaacagtacggtagatcacctcctcccttgacctctcgtctccgaataagagattctgccgagacaagatgatggagaagcagagcagggagcgccaggaaggctggcggcagcagccgcagcagcaggaggaggaggtggtgatggtgatgcacagccaggtgatgcggatcaagcaggaggaggacgagcgggccaaggtgcacgagacgtaccagcaccacgtctccgagatgcgccgaggcctgcgggacctcgacaggcagcgctcccgctccccgctcggccgcgccgcccgcaccgccatctccatcggcggcgactcctagggaatttactggagctggagctggagccgatcgatcccctcggggatgggttggtggggaaggcgtcctcggtcggcgatcgccgtcgtctcgccctcgccctcgccattccctcgctagggtcgattgatcgatcgttggtaggatccgtttcgtatcgtcgtcttcttggcacggtcggagtgctttttgagaagcacgcattttcattctatattggttttagggtgatataatggatcaatcatgtaaatatttttcttcatcattcgatcgatctacaggatgatgcaaaaatctgtttggtttgagaaatggggcggtcctctcagncttcatttttttatttgtgaaatataatgagtagatccctcaccacttcattc

SEQ ID NO: 10476 - DNA, 2216 bp, Zea mays
ccggccagtgaaaccagcaaacgaggaaggcgaggagacgtgctctgctgctgcagcctgcagcggctttccttcccccaccactcgcgtgtgagtccacggtgtgatgtcacggagcggtggcggctttcccgatccactgtgcgggagaaatccccgtgcagccttcttccagctcttcctactctttgctactcgtcttcgctgatttctgccttaattccatcccttccctgcctagaacttgctttgcttcaccccatcacagcttttggtgcctcgtcatcggcgacctaaccgccggcgaccggataaactaagccaggcccttcgctccgaaagtcgtctctcgtagagagcacttgctcacctgctcctcgccctcctctgctggcagtggacttgcgcggagtggagatccatccggacctggttcgatttcttcatctcggttgcttctctgtccagtgggtggatcactggattgtgggttgtgctaactgcaggctggcttgtcagcctatcataaggaaagtgaaaaagagacaacaaagcaatttgttgtctcattcttaggagctggcgagcactcggcatggcagatgctagttcgaggactgacacctcgactgttgtagacatggatgataagaatcaaaggattattttacgaaatttcaacttctctctgtgggacatctaatggtacaggtcttggagagatgcatgtaaagtgttagaaaacggacagagtggagccatggtcccggcttctaattcatctgaccggtctgacagatctgacaaacctatggaccagaaggttttacgacggcttgcccaaaatcgtgaggcagcaagaaaaagccggctgaggaaaaaggcatatgtgcaacagctagagagcagtaagctaaaacttgcaagcctggagcaagaactccagaaagctcgacagcagggaatcttcatttctagttctggagatcaaactcatactatgagtggaaatggagctatgaccttcgatttagaatattctcgatggcaagaggaacaaaataagcagataaatgagctgaggactgcagtaaatgctcatgcaagtgatagtgacctccgtcttatagtcgatgggataatggcacattatgacgagatattcaggctgaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggctgtccaatctgcagcaatcttctcagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaagttgtattaacatcttctggtctcatattgtgctccagtgttgtacaatttagggaaaagcttggattaacttgtaagttatcatgaatttgttattggcatattgtacaattgtattagcaataaaaatagaagtacataagtgctggaagcctggaaggatatccagaatctatattggttggaaacgagcagcagaagattgttatagattgttatgttgctttgaatattcggttgtaagtgccttttttggggtatatagaacaaagaaagattcaggagagatgtagggattcaccagaggctatcggggattgtgcttctaggagctccctggactatctctagcaagtctcatattaagctctactctgtaaacagtgatacattgaattgaacgtgctacggttatgatggtaacattt

SEQ ID NO: 10477 - DNA, 2184 bp, Zea mays
cattgggaccctcgaggccggccggaccccggggccggccgcgccgggacgtgctgcagagcctgcagaggcttttcttccccccaccccacccatcgcgtgtgagtccacggtgtgatgtcacggagcggtggcggctttcccgattcactgtgcgggagaaatccccgtgcagccttcttccacctcctcctactctccgctattcgtcttcgctgatttctgccgctccaattccatcgcttccctgctttagaaccttctctgctagcttctccccgtcacagcttttggtgcctcgtcatcggcgaccaaaccgccggcgaccggataaactaagccagctccttcgctccgaaagtcgtctctcgtagagagcacttgctcacctgctccccgccccccctctactggcgctggacttgctcggagtggagatccatccggacctcacctggttcgatttcttcatttcgggttcgattcggtttttctatcccagagcgaaagatcaatatcacctgacacaacataacgatttcgtggaagccgaggttgcttctctgctcagtgggtggataactggattgtggattttgctaactacatgctgggttatcagcctatcataaggaaagcaaagaagagacaacaaagcaatttgttgtctctttcttaggagctggcgagtactcggcatggcagatgctagttcgaggactgacacctcgactgttttagacatggatgataagaatcaaaggttagaaaatggacagagtggagctatggccctggcttcgaattcatctgatcggtctgacagatctgacaaacctatggaccaaaaggttttacgacggcttgcccaaaatcgtgaggcagcaaggaaaagtcggctgaggaaaaaggcatatgtgcaacaactagagagcagcaagctaaaacttgcaagcctggagcaagaactccagaaagctcgacaacagggaatcttcatatccagttctggagatcaaactcatgctatgagtggaaatggagctatgaccttcgatttagaatattctcgatggcaagaggaagaaaataagcagataaatgagctgaggactgcagtaaatgctcatgcaagtgaaagtgacctccgtcttatcgtcgatgggataatggcacattatgatgagatattcaggctgaagggtattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggctatccaatctccagcaatcctcccagcaggctgaggatgcattgtcacaaggcatggaagcattgcagcaatccttggcagaaacgctggctgggtcccttggtccatcaggatcttccggaaacgtcgcaaactatatgggtcaaatggctatggccatgggaaaacttggcacactcgagaatttccttcgtcaggctgacaatctacgacagcagaccttgcatcagatgcaacgcatcctgacaattcgacaagccgctcgcgcgcttcttgcaatacacgactacttttcacgtctacgcgccctgagttctctttggctcgctaggccgcgagagtagcatcacccacgttggagtcactccatgggccgatctgtgaatgtggggctgctggctgcaaactcgcaacgcatttgcagatggctggagggtcagttctctctgtacaagttgtattaacatcttctggtctcatattgcgcttcagtgttgtacaagttagggtaaagcttgcatttaacttgtaagttatcatggattcatgattgacatattgtacaattatattagcaataagaatagaagtacataaatgctggaaggactatccagcgtctatattggttggaaacgagcagcagaagcttgtcatgtcgattttgaatagtcggttgaagtgttcttttgggggtctatagagaacaaagaaagcttcaggagaaatgtataggtattcaccagtctaccatagagtgtgtgcttcggggagctccttgtgatggtaaaatttgataacgaggatgagttctgtgacatt

SEQ ID NO: 10478 - DNA, 1247 bp, Zea mays
ttggggacccccgggccggccggtgaaaccagcaaacgaggaaggcgaggagacgtgctctgctgctgcagcctgcagcggctttccttcccccaccatcgcgtgtgagtccacggtgtgatgtcacggagcggtggcggctttcccgatccactgtgcgggagaaatccccgtgcagccttcttccagctcttcctactctttgctactcgtcttcgctgatttctgccttaattccatcccttccctgcctagaacttgctttgcttcaccccatcacagcttttggtgcctcgtcatcggcgacctaaccgccggcgaccagataaactaagccaggcccttcgctccgaaagtcgtctctcgtagagagcacttgctcacctgctcctcgccctcctctgctggcagtggacttgcgcggagtggagatccatccggacctggttcgatttcttcatctcggttgcttctctgtccagtgggtggatcactggattgtgggttgtgctaactgcaggctggcttgtcagcctatcataaggaaagtgaaaaagagacaacaaagcaatttgttgtctcattcttaggagctggcgagcactcggcatggcagatgctagttcgaggactgacacctcgactgttgtagacatggatgataagaatcaaaggttagaaaacggacagagtggagccatggtcccggcttctaattcatctgaccggtctgacagatctgacaaacctatggaccagaaggttttacgacggcttgcccaaaatcgtgaggcagcaagaaaaagccggctgaggaaaaaggcatatgtgcaacagctagagagcagtaagctaaaacttgcaagcctggagcaagaactccagaaagctcgacagcagggaatcttcatttctagttctggagatcaaactcatactatgagtggaaatggagctatgaccttcgatttagaatattctcgatggcaagaggaacaaaataagcagataaatgagctgaggactgcagtaaatgctcatgcaagtgatagtgacctccgtcttatagtcgatggtataatggctcattatgacgagatattcaggctgaagggcattgttgcttaggctgttgtgttttcatattacattagggcctgttctatattcttgtttttattaccttttttttttttttatttcatcttttcttctttttttctttatctcatttttttttttttttt

SEQ ID NO: 10479 - DNA, 1711 bp, Zea mays
gcgcacggccgcctcgccggcttatgcctcaggcttgggatggttgagaaggcaaagacgcacttcacactggctggaagtgcaaaccagtctgatccggctgagtggcagaagctgcatgaggtagagatccatcaaggcagatgcatggatgcaaggaaaattggagactggaagagtgcactcagggaagccgacgcagccatcgctgttggagcggactcctctcgattgcttcttgccttgaggtcagaagcgttgctttggttgcacaaattagaggaagctgatttgactattacaagcttgttgaaactggatgacgcgtcgttgccttcgacgccaaccagagtctcaggcatgtcagctgactcttatgtccatatcgtccaagccaaggtcaacgtgacatttggaaggttcgattcagctgtcgcactggctgagaaggctaagcttattgatggcgtgagctcagaggttgaagtgatcctaaacaacgtgagattagtcgcattggctcgagcccgggggaatgacctttttaaggcaggcaagtttgctgaggcgtcgctagcctatggtgaagggctgaaatatgagccttctaatccagtgctatactgcaaccgggcagcttgctggtcaaagctgggtcggtgggcaaaagctgttgaggactgcagcgaggccctaagagtccagcctaactacacaaaggctctgctaaggcgtgcggcgtcatatgcaaagcttgagcgctgggcggactgtgtgcgggactacgaggtgcttcgcaaggatcttcctggtgacactgaggttgcagagtccttgttccatgcccaagttgcattaaagacagcccgtggagaggtggtatctaatatgaagtttggaggggtagttgaagaaattatcagcttagagcaactccaagatgttatccgttcacctggtgtatccgttctttacttcatggctacaatgaacaagcaatgtgcacaaattaccccgtctgtggactccctttgctccgagtgccctgcattgaatttcctgaaggtaaacgttgacgagcgccctctggtagcaagcgcggagaacgtgcgagtagtcccaagcttcaagatttacaaggacggcacgagagtgaaggagatggtctgccctagcttgcaggtcttgcgctattccgtgaggcactatgctgtctccagctcttgaggtccggcactcagttcgctggccctgttagtgtcaccacatgccaacatttcaccaacaaatctgtccctctatagtatcacagcatttcccccttcccatcgcgtcacttaggctcctcctaccgcaacatctctagaaccatttgatccaagcttaagcaattctcatgcctcgctttccaaagtgatgacttcaactcctgaagaaaggctccctgtggtggtgttcagggaataggtaaacacggctggctggttttctcattacatgtacatatattcccgtatagcaacacatcaaacccattgatagattggttcactgtggagaaaaggcggggttcggacttggatgaagagtacaggtctagttgccattgaatgtagagatggagaagatagatgggtcgtgttgttggtatggtacgtagagagacagaggagggaggtggctggtgtggttcaaaaaaaaaaaaaaaaaa

SEQ ID NO: 10480 - DNA, 880 bp, Zea mays
  misc_feature (870)..(870): n is a, c, g, or t
ttacctgatcccaccagcgtggtagagtctgctcaacaccaaacttcgacgactgcgccggccgtcggccgtcgctgccgccctattttgaccccatcgccggcgacgataatcgccagctgaaggacaataactatcatggatgctactgcaaattcagatgtgcaaagggctgaggaatttaaacttatggcgaatgatgccttcaaggcaaacaagttctcgcaggctatagagctttacagtcaagccattgagctgaatagttcaaatgcagtttactgggcaaaccgtgcatttgcacacacaaaattagaggaatacggaagtgctgtgcaggatgctacaaaagccatcgaaattgattctagatattcaaaaggttattatagacgaggcgcagcttatcttgccatgggaaagttcaaggaagccctgaaggattttcagcaggttaaaaaaatctgcccaaatgatccagatgctacaagaaagttgaaagagtgcgagaaagctgtccaaaagatccgttttgaagaagcaatatctgctggggatgatgagaggcggtccgtggcagactctattgactaccatatcatagaagtagagccacattatgcgggaccgagaattgatggggaagaaataacgatagagtttgtcaaagcaatgttggatgaatttaagaagcagaaatgcatacataaaagatatgcttaccagattgtgctaaaaaccttggatttgctgcgatcgatgccttcccttgttgatggggggatgtttccaaacgggggacattttacagtttgcggtgatgtgcatggccagtactttgatttgctcaacatatttgaccctcatggncttccatcaa

SEQ ID NO: 10481 - DNA, 2055 bp, Zea mays
actatacctgtacgcttcacgcggacccgtggactgatcccaccagcgtggtagagtctgctcaacaccaaacttcgacgactgcgccggccgtcggccgtcgctgccgccctattttgaccccatcgccggcgacgataatcgccagtttgtggataagggtcttttaagtcttcatatgaaactatccttttgatatacagctgaaggacaataactatcatggatgctactgcaaattcagatgtgcaaagggctgaggaatttaaacttaaggcgaatgatgccttcaaggcaaacaagttctcgcaggctatagagctttacagtcaagccattgagctgaatagttcaaatgcagtttactgggcaaaccgtgcatttgcacacacaaaattagaggaatacggaagtgctgtgcaggatgctacaaaagccatcgaaattgattctagatattcaaaaggttattatagacgaggcgcagcttatcttgccatgggaaagttcaaggaagccctgaaggattttcagcaggttaaaaaaatctgcccaaatgatccagatgctacaagaaagttgaaagagtgcgagaaagctgtccaaaagatccgttttgaagaagcaatatctgctggggatgatgagaggcggtccgtggcagactctattgactaccatatcatagaagtagagccacattatgcgggaccgagaattgatggggaagaaataacgatagagtttgtcaaagcaatgttggatgaatttaagaagcagaaatgcatacataaaagatatgcttaccagattgtgctaaaaaccttggatttgctgcgatcgatgccttcccttgttgatgtggatgttccaaacggtggacattttacagtttgcggtgatgtgcatggccagtactttgatttgctcaacatatttgacctcaatggccttccatcagaagaaaatccttacctcttcaatggcgattttgtggaccgaggatctttctccgttgaagtcatactcaccctttttgctttcaagtgcctctacccaaaagctatgtaccttgcaagaggaaatcatgaaagcaagagcatgaacaaaatatatggctttgagggggaagtgaggtcaaagctgggtgagaagtttgttgaactttttgctgaagtcttttgttggttacctcttgcccatgtcatcaacaacaaggtctttgtggttcatggagggctatttagtgttgatggggttaagctttcagacattaggtccattgatcgtttttgtgaaccacctgaagaaggtctaatgtgtgaattactatggagtgaccctcagcctcagcttggaagaggtccaagtaaacgtggtgttgctctttcctttggcgcagatgtgactaagaagtttttacaggaaaataacctggatcttattgtccggtctcatgaagtaaaggatgaaggccatgaaattgaacatgatggaaagcttataacagtcttctctgcgcctaattactgtgaccagatgggcaacaagggtgcatttattcgcttcacagctccagaaatgaaaccagatattgttactttctcagctgtgccacatcctgatgtgaagccgatggcatatgcaaataacttcctcaggatgtttcaatgacagaatataacaacattgtttagcaatttttatcagatgagtctgttgtttgtcagctcccaattcacatttcttgctaggtttaagtatatgctcccttgtacaacaaatcaaatgatgcaagggattcaactgtcgatttacttggatggtacatccatttttgtgcacgagttgtgattcttgtaactatccgtaaagtcttagatcattagattttagtttacttgtaaaattgctaaatcgtcatttcctgtcttgcttatcagtgagttacacacgtttagtgcttttatcaaattacatgtgtttcagcggtacagttcccaatatctgagtaatccttccattttaacccaaaaaaaaaaaaaaaaagcggcc

SEQ ID NO: 10482 - DNA, 3771 bp, Zea mays
  misc_feature (2681)..(2681): n is a, c, g, or t
ttcagctacaaattgtctcgtgggctacgggctacattccatctagccagcccaatccacatcaccagcccacctcgtcgaactcgtcgtcttccgtccatccatcgtcgtcggcggcggcggagagagagcagatgacgtcctcggggacggtcgcgcagcagctgccgcggacggaggcgcggtcgctgtcgggtcacgagggagcggtgttggccgtgcggttcaaccgggacggcaattactgcctgagttgcggcaaggaccgcactctccgcctctggaatcctcacacaggcgcccaggtcaagacctacaagtcccacgcccgcgaggtccgcgatgtgcactcttcctcggataacgccaaactggtgtcctgcggtgccgacagacaaatcttctattgggacgttgcctcgggccgcgtcatccgcaagttccgcggccacaacagcgaggtcaattcagtgaagtttaatgagtacaatgctgttgtagtctcagctggttatgaccgtacggtgcgtgcatttgactgcaggtctcaaaacaacgaccctattcagacaattgatacttttcaagatagtgtaatgtcagttaacctaacaaagacagaaataattgctggcagtgttgatggtactgtccgggcatttgacattcgcatgggtagggagactgttgataatctagggcatcctgtgaactgtgtatcattatcaaatgacaacaattgccttttagctaactgtttagattctactgtgcggcttctagacaagtcatctggagaactgttacaggagtataagggacatacgtgcaagtccttcaagatggattcctgtctgacgaatgatgatgcatttgttgttggcgggtctgaggatggttatattttcttctgggagttggtggatgcacctgttgttgcaagattcagggcacatagttctgtggtaactagcatcagttaccacccaacaaaggcctgcatgttgacgtcttctgtggatggctctattcgtgtttggacctgaagactcttgaatggttgatgtgctattcgtactgttcctccaaatcatccagttatctagcagcaaggattcgacagtatgaaagatgaacgcatgtctaacctaatgggattcatacacgccttgctgcagagagaagaaaatgcgctgctgttgggctgtgtagcacacagctctgaggccaaaaccttttgaagccggtattctgtcatctatgaagtttgtgagccttttagatgattttggattgtacctgaagacaacttgtgagttgcatgaaaagtaacatttgttacgaagtttcttactgcaagtgtcttgtctccatgttactgaagacaacttatgggggttgagaaatgtatcttctagttccttttttttagttttgatttggaatggaatgactaatgagttcatcgtccatcacatcatcctcacaagctaatactccatctgttctaaaatagttgttttaggtaattagtgggttcatacatttttttatgtatatgttttgtatacgtgtctagatttattattatctattagaatatagacataaaaaacaaaaattaaaacaactattattttgggttttgggacgcagaaagtaataattagtatatataagcacgagaaaaggagttcgctaaaatttatgggatgaatttatggcgaaccaatcacctcaattactgctttcctcttagcagtgtatggtagtcgtcattgatccggggaataaaagcatgaagaaaaatgaaataagtttggtctatgttctcatgtcagacagggtcatacaattgcttgtattcagcaccagccaaaatcttgagactgaatactcttgattgaactattgtattgactattgagcaccaaccaaactatcaaaattgaatactcttgcttgtggcaggacatgagatatcctcctccaagtttgagagcattgtcctaattcctttgccagaggccctgttatggcacacgccaaacctaaattgatttgcctggcccagcagagaaccctaactcctcgcttcccactcgcgcacgctacctcccctaccgctatcgagccagctagcctagcagtgtggccaggcggccaggcccaacccccaggcagcctcccgtgctcgagtagcgcctagctagcctccccgcgctcgagcagcgcccagcccccaggccagcacgcatgcttcaacgcctccacgcgctacatgtacctcggcctcgctctccacgtcgaggctgccgccgcggcctgtcatctcgaggcatgtatatctctcactactttaaactatactctgcaatatagtataaaatagtattttgtatgattatttacacagccgactgtagatgatgtgataaccaacagcgaggcaggagacatggacgctaggaatggcgatggttaaaactcatgggtacaagatttataaattcacacccacaaggttaatattatgcctacacatgttacctttgatggatacaatccacatgattggtttccctgctatccgcgctcatgtccttcatatgcgttgattgcgtctaaaccgttgattggttgcatgcacatacaaagactgatctgcacgcgcacgggtncaatgcagagcgctttttcaccaattggatgcatgagcggggacgggaggtttctagatcccagctcgtccaggtcgatgcgagtgtcaaccaatcatgcggaatatgtccgcggatatttgggattctatatggtaaatagctatatgacaccacatgcattatacgtgcatgcaagtcagtaaatagctatatgacaccacatacattataggtgcatgcaagttaattttttatgaattgtcgcgcacattatcttgcgactagtttaaatacttccaaataattatttactaaaccttgtattctaataagtatgcaaaataagtaggcacccatacgtacatgttttactgctccgtttaaaaaagtgatatctactaaactgaatgtcaaaattgaaaatcgatttcactattgtgttcgtcgcaacaaaagctttaaaactagatctcacttgacatatttatcttaaagtcaatttattgtattttctcagtgttggtaattttagttattagtgtcggtcattctataaatactcgattattccatcttttagtctcaatcatttatgagaattactaagagagaatttattttagtggaccagtcattttacaaaaaaatagaaattacattaaagaaagtgaacagactcagtcattcttgaataatcagtgttggtcatttgtttttaattgctgtatgaaataaaaaaaataaggcaacacaatgttaaaaagtagaaaacttcgtccttgaagtgttatctcttcgaggtaacagctcaaggacaaaggcagaatatgatcgaacggtatatataaagcatgacgaagtaagatatgagaacttatcttatgtgacttagcattttatttctcttctcacacaagataagtttgtaatcataccttcgcttcttgatgcaagatagcacaaagatgtttcagaggctgagctatacgaagctgtagcacctagctaaaggtactttatgcgaggtattgttcatctatttataggggagatgaactgacttagtacaggattacaattgtgcccttcactgtttacaaacgccacc

SEQ ID NO: 10483 - DNA, 1370 bp, Zea mays
  misc_feature (54)..(54): n is a, c, g, or t
  misc_feature (63)..(63): n is a, c, g, or t
  misc_feature (66)..(66): n is a, c, g, or t
gaaatcaacaagctgagatgacttctttgatgcttcacatatcatatactccanccgaagccntanatggtgttatggatgacccaagctcttgctgtccagcatctttgcttgtggactttgcctctgtcttaacctcaaccctttataggatttctccaccctgctttggataggtccgcaacagctttcgtctgggtagctgagaaaagcccaagtcctcctcaagctttggcaccattgaaagtatgaagttaatatgtttctggaatcccatatccaagagcctatcagcctcatctaggatcaaaatctcaagattcttgtactctagagcatcagtgtgcattatatcaaacagcttcccgggagtgcccaccaatatgtttgcgccctcttcctctaccttcttgagctctgctttgatatccagcccacccaccaggagcatggacgacacgccattcagggtcgcgaagaagggctgggccacattgaatatttgcgaggacaattctctcgtgggagagataatcagagcaaggacctcgtgtgacttgggcggggaggagcggcggcggaggatctcaacgacggggacgatgaaggcaagggtcttcccggagcctgtggcggcgtcgacggcgacgtccttgtgcgacagcaggtgcgggatggccgcggccggcatcggcgccagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacaataaaacaagtttcctcttattatcttttaaaaaaaaaaaaaaaaaaaaaaaggagggggggcccggctttactccctaagtcccaaaatattttagacctg

SEQ ID NO: 10484 - DNA, 560 bp, Zea mays
acccatattccagggcacttgcccccagtcatgccattgggtcccatgaacccatgcatgcagtactgcatgatgcaacaggggcttgccagcttgatggggtgtccgtccctgatgctgcagcaactgttggccttaccgcttcagacgatgccagtgatgatgccccaaatgatgacgcctaacacgatgtccccattgatgatcccgagcatgatgtccccaatggtcttgccgagcatgatgtcgcaaatgatgatgccccaatgtccctgcgaccccgtctcccagattatgctgcaacagcagttcccattcatgttcaacccaatggccatgacgattccccccatgttcttacagcaaccctttgttggggctgcattctagatagaaaaatttgtgttgtcccgaataatgagttgacatgccatcgggtgtgactcattattaccaataaaacaagtttcctcttaaaaaaaaaaaaaaaaaaaaaaaaaaaaaaaaaaaaaaaaaataaaaaaaaaataaaaaaaaaaaaaaaaaaaagcttgtactcg

SEQ ID NO: 10485 - DNA, 965 bp, Zea mays
  misc_feature (905)..(905): n is a, c, g, or t
  misc_feature (937)..(937): n is a, c, g, or t
attgggaccctcgaggccggccgggcttgtcctgctatgtttgtagaccagtgagcctagcagaaatcgattaaaataatacggagagcccggcccgctcgatcaatagaagtgacaactccatctctggtctcccagactcccacgcctataatctcattcccctccttcaaagccctctggcgatcgagattcttccccctccgtctccaggtatacccatcggagcagcacagacaagagttctcctgatatggcaaacaaaaggattcagaaggaactcatggatctgcaaaaggacccaccgacatcatgcagtgcagggccagctggagaggatctattccactggcaggccacaatcatgggtcctagcgacagcccctatgcaggaggggttttctttgttaatatccattttcctcctgactacccgtttaagcctccaaaagtgaacttccaaacaaaagtttatcacccgaacatcaactctaacgggagcatctgccttgatatcctcaaggagcagtggagccctgcactgaccatatcaaaggtcctcctctccatcagctcgcttctgactgaccccaacccagacgaccccctcgtccccgagatcgcccacatgtacaagaaccagaggccgcgctacgaggaaaccgcacgggcctggacccagaagtacgcgatgggctagctgattctgtctcgccgaacaatactgtcactggcaagaagatcatcatcacgatgttgtaagaattaagttgaaccggtttccccgtcgtgtgatggtattaagaccaaagttcttgtgcgtgtacagtacttttgaagctggatagtctgaatcctgtgccagaaccaaaggtcttcgctttgttccctgaagagcgtttgtngacatagaatctgcatgcgtaaccttgccagncaagaaacagtagctgcttgtatgatgt

SEQ ID NO: 10486 - DNA, 955 bp, Zea mays
  misc_feature (744)..(744): n is a, c, g, or t
  misc_feature (840)..(840): n is a, c, g, or t
cgggagtaagcctagcccggcccggtaaataatacggagcagccaattgcactcgatcaatatcaatagaagtgacaactccatctctggtctcccagactcccacgcctataatctcattcccctccttcaaagccctctggcgatcgagattcttccccctccgtctccagatatggcaaacaaaaggattcagaaggaactcatggatctgcaaaaggacccaccgacatcatgcagtgcagggccagctggagaggatctattccactggcaggccacaatcatgggtcctagcgacagcccctatgcaggaggggttttctttgttaatatccattttcctcctgactacccgtttaagcctccaaaagtgaacttccaaacaaaagtttatcacccgaacatcaactctaacgggagcatctgccttgatatcctcaaggagcagtggagccctgcactgaccatatcaaaggtcctcctctccatcagctcgctttctgactgaccccaacccagacgaccccctcgtccccgagatcgcccacatgtacaagaaccagaggccgcgctacgaggaaaccgcacgggcctggacccagaagtacgcgatgggctagctgattctgtgttgccgaacaatactgtcactgccaagaagatcatcatcacgacgttgtaagaaattaagttgaaccggtttccccgtcgtgtgatggtattaagagcccagatggctgntgcgtcagttatactagcttcgcagaccaaagttcttctgtgtgtacagtacttttgaagctggatagtctgaatcctgtgccagaacctaaggtnttcgctttgttccctgaagagcgtttgtgaccatagaatctgcatctgtaaccttgccagctaagaaaacagacagtagctgcttgtatgatgtcgagatgctatagttccgatg

SEQ ID NO: 10487 - DNA, 4266 bp, Zea mays
  misc_feature (1400)..(1400): n is a, c, g, or t
tagttttgaaatttaatatttatatacactgatttgtcataaaagtacttttataaaattataattatattaaaagtttatttatatttaaaaaatcattagtccgagttatattttgcagatggcggagtgagtagatgctatgaccaagccttcaactttgttacttaagccttcaactctgttacttagctcttgtcctgctatgttttgtagaccagtgagcctagcagaaatcgattaaaataatacggagcagccaattgcactcgatcaatatcaatagaagtgacaactccatctctggtctcccagactcctacgcctataatctcatttccctccttcaaagccctctggcgatcgagattcttccccctccgtctccaggtatacccatcggagcagcacagacaagagttctcctggtaatctgtgatttgtttcacatctctcttgattcattggtatctacttcttgcttgtcgggttcatgatgcagtgcgatctgacatgcttaagtttggctagctgcttaattgtgaggttcacttgggttcaggggctgcaagaattcatcgggttcgtgcctgagaacgttagtcaatagttgggttagtctagtattggggttgacttttaaggaaaatggggaaggaactgactaaaatctttttgctgaaacttaactgtttcttttctacctttatagaatcttgaaatttctgagagggggcccgcttttgagtatccagaaagatacctcaagattttttagaggaaaatttcagataaaagattaggaaatgtagcactgcactaactaattaggatgggggattaattgactgatctcttagtttctgaatgcacaggacataagtcctattctgtaaaatctaccttcaaaacttcgaattagtagtttccataactcctacctgaattttatgtaacaggtgtccatctcactctacattgagctttgacatagtgacattttgctgaaagaactcaaatcttttatgctaactgatgaaacagagatcgacgggatctcatggctctcgaactcactcaaacagagaacgaagagagcactgagagagactagttttggtgctgctaattcgtaacagcgttttctgaactctattaataccaggaaaacaaaacacagagatacatcaacgccacgatcacagccgtgtccatccccacgacccacacgatgcccactcttctccgtgtgactcgctcagctcgaacaacctccggctgaacgctaactgactgaatgacgcctaactgaacactagctaactgactaacttgactcagactgaaactcaaacgacagggattgactagccgtgtccagagttatctaacactaacancttacgggggaatgcaaacagcttgacttttgggggaaataatagaaaagcatatctgtcttttttttatttaccacaatgattgagttgttcctgcttagattggaatagctagagttggatatacatcgacaatcataatatgcaaagttgaaagttgcggtttgacattaacagtattgctaatcatttgtattcatgctatttgtgctaaaacaatctttctttgaacttgttttggtaatgtctgtattgaatgcaatggtatcatattgggcatgtgtaaatttagctagatgtcaaagtgataacagctactcacaagaatatgtttcagtctatctgcaatctaaaattagtacttcctcccttccaaattattggtcaccttgtggaaaacgcaggagagctgtgtttcattatattaagaagaagaataagggtctggaacatacatcttgtcgttagttaaacttctctaactttgaccaagtttttgaaaaaagatattaacatctacaattcaaataaatacaactatctagatttatttcatggagaagttaatgaaattaatttgatgtggtgttggtgtgtttttaaacttgaacaaggataaaagaagtttgacttaggacaaagctaaagtgacctatacttttggaagggggtggtattgagctggtttatgctttttgctaacagtgatcacttccaatggctgaaaatttgtaacatatttctcccataactcatgtgatccatgtgacactttgaacagccataaatgttgactgtccttacttctttgcaaaagataagaagtttgaaaggaagagatggtcattgatctcagtggcggacccaggaattactgacagcctaggcgaaattattaagcagcatgcagcagcagtgcaaaagcctgagctgacagagaaatggactgtaattttttggacttcttacatgcactctcgtggcgtggcaggctggcagcccaggcgacggcctgtactgcctgggcactcggtccgccactgattgatctctagatgttgaactttagttcagcattccttatactttgatggagtttgtggaagtcgttcatattaatatttttcggactttgtgataatgataccaacaaactcatttaaaccttcaagacaacagtggttgtgctacaaagtcatttctcaccatgttcatcattgtttacgatattcctttttctcagatatggcaaacaaaaggattcagaaggaactcatggatctgcaaaaggacccaccgacatcatgcagtgcagggccagctggagaggatctattccactggcaggccacaatcatgggtcctagcgacagcccctatgcaggaggggttttctttgttaatatccattttcctcctgactacccgtttaagcctccaaaagtgaacttccaaacaaaagtgagctggtcttattaatttgatttccttcgcttttgatattcctttattctgcaaaagtatttgaacctctattacgttgccaatagccatggttacggatgaccttttttttggcatactaggcaataggagtgatctgaagttcgtaatgaaaaggcccccattccaaaatcataccaaaattgttaaaacttgttctctgttatgcaaaataaaacatgctcaggttcttctctacatcaatcaccattttattttcaaaacttttgtttttcttcctgatgtgaagtaaatagttaagatcatgctgaatccctaagtacttgttcctcgtaataaacccatttcacttgcttcagcagtttcatagagttatttttcttcctgaaatttggttctagtgatgcttgaaaggcaatggataagttgtcatggggcagagctcaaacatgagtacttgctagcatcctgaagttcagacatgaaagtgtcagtcagtcagtctgttagcaattgctcaaagtctggttctgtcaaaccatttatccttctttgcaactaattcagctgaccgtctcactgaaaacgtacaggtttatcacccgaacatcaactctaacgggagcatctgccttgatatcctcaaggagcagtggagccctgcactgaccatatcaaaggtcctcctctccatcagctcgcttctgactgaccccaacccagacgaccccctcgtccccgagatcgcccacatgtacaagaaccagaggccgcgctacgaggaaaccgcacgggcctggacccagaagtacgcgatgggctagctgattctgtctcgccgaacaatactgtcactggcaagaagatcatcatcacgatgttgtaagaattaagttgaaccggtttccccgtcgtgtgatggtattaagaccaaagttcttgtgcgtgtacagtacttttgaagctggatagtctgaatcctgtgccagaaccaaaggtcttcgctttgttccctgaagagcgtttgtgaccatagaatctgcatgcgtaaccttgccagccaagaaaacagtagctgcttgtatgatgtcgagatgatatagttcagatgggtggaaccgtgcagatgaaacagtccagtggtcttgcgttcaaaaaaaaaaaaaaaaaccgcatggttcagatggagcgttccttgttgcctgccgaatgatctggcacacccaaatgattcattttctttcttcagctattacatattgttgcgaccactgtgttaaccacttcgaacactccagtatgattattgcagacctctgagataggaaacagagaggaaggtaggagaggaggggaagacttgagcaggaagaagatactcgtctgatacatgcatgcctac

SEQ ID NO: 10488 - DNA, 1045 bp, Zea mays
ttccggaaccagagtgggtaccccccggccggccggggtagagctagtgaacctagcagaaatcgattaaaataatacgcagcagccgattgcactcgaccaagagaagcaacgactgcatctctggtctcccacgcctataatcccattcccctccttcaaagccctgcggcgatttcgattcttcccctctatctccaggtatacccatcggagcagcactgacaaaaattctccagatatggcaagcaaaaggattcagaaggaactcatggatctgcaaaaggacccaccgacatcatgcagtgcagggcctgctggagaggatctattccactggcaggccacaatcatgggtcctagtgacagcccctatgcaggcggggttttctttattaatatccattttcctcctgactacccctttaagcctccaaaagtgaacttccaaacaaaagtttatcacccaaacatcaactctaatgggagcatttgccttgatatcctcaaggagcaatggagccctgcactgaccatatcaaaggtcctcctctccatcagctcgctcctcaccgaccccaacccggacgacccccttgtccctgagatcgcccacatgtacaaaaaccagaggcagcgctacgaggaaactgcacgggcctggacccagaagtacgcaatgggctgattctgtcccactggacagtacttcccctgcaaagatcgtcacggtgttgtaagaatcaagttgcaccgttttcctgtcgtgtgatggtattaagagcccagatggctgtgtcaattgtactcgcttctcagaacaaagtctctctgtgtgtacagtgcttttgaagctggatgatctgagttctgtgctaaaaccttggtttgcacttcactttgttccctgaaatgggtttgcgaccactgaatttgcatgtgtaacctttccaagaaaccagtagcagtttgtatgttgtcaagatgttaataattcagatgggtggcctgcatccatctgaaaaaaaaaaaaaaaaaaaaaaaa

SEQ ID NO: 10489 - DNA, 1825 bp, Zea mays
aggatggaaaattttgtctaagttcttagtttaaagaaccagccattttattatatcactttgatcggtactactgcatatataaactttgcatattgagacaagctgaactattggacaattctggttctgtttaaagttatttatccttgaaactaattcagttaactgtttcactgaaacaatacaggtttatcacccaaacatcaactctaatgggagcatttgccttgatatcctcaaggagcaatggagccctgcactgaccatatcaaaggtcctcctctccatcagctcgctcctcaccgaccccaacccggacgacccccttgtccctgagatcgcccacatgtacaaaaaccagaggcagcgctacgaggaaactgcacgggcctggacccagaagtacgcaatgggctgattctgtcccactggacagtacttcccctgcaaagatcgtcacggtgttgtaagaatcaagttgcaccgttttcctgtcgtgtgatggtattaagagcccagatggctgtgtcaattgtactcgcttctcagaacaaagtctctctgtgtgtacagtgcttttgaagctggatgatctgagttctgtgctaaaaccttggtttgcacttcactttgttccctgaaatgggtttgcgaccactgaatttgcatgtgtaacctttccaagaaaccagtagcagtttgtatgttgtcaagatgttaataattcagatgggtggcctgcatccatctgaaatggagcgctatttgttaaaaccgtgcagataacagttcagtgctcttgcatatggaacatgtcgtctgcaccacgtgattgaaatggagctttccttgttgcagccactgctttttgattttgaatggcagaagttattacagaagtggcttgcagatctgctgccttgcttcaacatttgctagtctcgtggaaactgtcaggtccatcgctgttggttgaatgtggccatactttctgcaacgctgctgtttaccctctcccagctttcatctgcacaagcagtagaaagtcatagcctgccctttcttcttcgagatggacaaaagaggttgcatctgatggccaaccggccagtttggtctttctgtaccaggtcacttgtgtccttgtgcctttacttccatgtctccatgataatattcatagctgttctttttttagtgtattaccgggcgaaaattttgaagtacaggtgctttctccccctttgctataaagtcatgtgcaggtcttcatttggtatacctgtagccacacgctgggaaaaggcctgacacttgtgtacatacttgtgtaaggttgtacatgcacatgtggcagttgttatctacacactacaggagatagctgctttgccgcgtggcaaagcccaaaaaaccgctaggcaagaaaacactcggcaaactctttatttagatgagggctggcaggatgcaggacaacatagcagaacctgcacaggcaattatgcttatatggaggacaaacataaacctaaaaaaagaacgaaagaaagaactatctagcaaacatatatagtagaaaattgcaaaacaaaaacgtcagttaaacaaacaacagcagagattgctaggcagagcacgaggcatggacatctgcaggtaaactgacgaccaattgcatctgcaggacggcacctcaaagaccaagttacttgagttgtgtcgtatgcaaatcttgtgtaaataaagaatgtataagcatccatataaaagtgaattagcttaattgatatatgtctaaattactattattagaatggaa

SEQ ID NO: 10490 - DNA, 916 bp, Zea mays
ggcccgagcagaaatcgattaaaataatacgcagcagccgattgcactcgaccaagagaagcaacgactgcctctctggtcccccacgcctacaatcccattcccctccttcaaagccctgcggcgatttcgattcttcccctctatctccaggtatacccatcggagcagcactgacaaaaattctccaggaactccaagaattcatctgatatggcaagcaaaaggattcagaaggaactcatggatctgcaaaaggacccaccgacatcatgcagtgcagggcctgctggagaggatctattccactggcaggccacaatcatgggtcctagtgacagcccctatgcaggcggggttttctttattaatatccattttcctcctgactacccctttaagcctccaaaagtgaacttccaaacaaaagtttatcacccaaacatcaactctaatgggagcatttgccttgatatcctcaaggagcaatggagccctgcactgaccatatcaaaggtcctcctctccatcagctcgctcctcaccgaccccaacccggacgacccccttgtccctgagatcgcccacatgtacaaaaaccagaggcagcgctacgaggaaactgcacgggcctggacccagaagtacgcaatgggctgattctgtcccactggacagtacttcccctgcaaagatcgtcacggtgttgtaagaatcaagttgcaccgttttcctgtcgtgtgatggtattaagagcccagatggctgtgtcaattgtactcgcttctcagaacaatgtctctctgtgtgtacagtgcttttgaagctggatgatctgagttctgtgctaaaaccttggtttgcacttcactttgttccctgaaatgggtttgcgaccaaaaaaaaaaaaaaaaaa

SEQ ID NO: 10491 - DNA, 1364 bp, Zea mays
cacgcctccccatccacctgtcactcttaccgccagccccacatcacggagcatcccccccttaataacagcaaactaccacacccatgtccacctccgtctccgtctccgtctccgtctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgctttcgatgccgggtccaagaagaagttgctcatctttgactccgaggaggatctctcggtttctctggcgaagtacactgcggagctgtcggagaagttcgcggccgagaggggtgcctttaccgccgtgctctctggcggatccctcatcgaggcactcaggaagctgacggagccgccgtacctggattcagtggactggagcaagtggcacgtcttctgggtggatgagagggtcgtgcccaaggaccatgtggatagcaactacaagctcgcctatgatgggtttctctccaaggtgccgattcctcctggacaagtttatgctataaacgatgcgttgtcagctgaaggagcggcagacgactacgaagcgtgcttgaagcagcttgttaagaacggtgtgatttctatgtcagcggcgactggatttcctaggtttgatctccagcttctgggaatgggacctgatggccacattgcgtctctcttccctggccaccctcttgttaacgagaaagagaggtgggtgacatacattaaggattctccaaagccacctccagagagaatcacattcacgtttccagtaatcaactcatccgcatacgttgcgatggtggtgactggagctggaaaggccgcagcggtgcagaaggcgctctcagacaagcaaacctcgtcagacctgctgcctgttgagatggctgtgctgcaagatggagaattcacctggttcactgataaggcagcggtgtccttgctgcagaacaagtagagtcccatggtaaccttggctcgaagccattttagctcataaaataaaagatccaggggcctgcgtgcatagctgcattcgtcctccaggatttcgtgtaacggagactcgatccttttatgtagtgtgtgttgttcggagtaatgttcaaaaactctattggcttccggcttttctgaaacattgctcgttaagtgtttggtttaaaaaaaaaaaacctgggccgtcctccaagcatggataggaaatgtggctgcattgaatttttccaggcttgtc

SEQ ID NO: 10492 - DNA, 1205 bp, Zea mays
cattgggtacctcgaggccggccgggacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggagaagttcgcggccgagaggggtgccttcaccgccgtgctctctggcggatccctcatcgaggcactcaggaagctgacggagccgccgtacctggattcagtggactggagcaagtggcacgtcttctgggtggatgagagggtcgtgcccaaggaccatgtggatagcaactacaagctcgcctatgatgggtttctctccaaggtgccgattcctcctggacaagtttatgctataaacgatgcgttgtcagctgaaggagcggcagacgactacgaagcgtgcctgaagcagcttgtcaagaacggtgtgatttctatgtcagcggcgactggatttcccaggtttgatctccagcttctgggaatgggacctgatggccacattgcgtctctcttccctggccaccctcttgttaacgagaaagagaggtgggtcacatacattaaggattctccaaagccacctccagagagaattacattcacgtttccagtaatcaactcatccgcatacgttgcgatggtggtgactggagctggaaaggcggcagcggtgcaaaaggcgctctcagacaagcaaacctcgtcagacctgctgcctgtttaaatggctgtgctacaaaatggagaattcccctgggttccctgataaggcaacggtgtcccttctgcagaacaagtaaagtctccatggtaaccttggctcggctcgaaaccattttagctcataaaataaaagatccaggggcctgcgtgcataactgcattcgtcctccaggatttcgtgtaacggagactcgatccttttatgtgtattgttcggagtaatgttcaaaaactctattgtcttccggctttttttaaacattgctcggtaagtgttgtgttttcc

SEQ ID NO: 10493 - DNA, 4356 bp, Zea mays
  misc_feature (2322)..(2322): n is a, c, g, or t
taccctgtcttgtgctctagcaatattagagtttacattagaatcacatggctggttcatgaactttggtgtttgtaggtagtcttttatgatcttttctcttttagttctctcaaaagctttcccccctcccatttctctctctttctccttttggtgacttcttgttgggtttcaactctagcctatcccaacttatttgggactaaaaggctcgcctgttgttgatgatgatttcgctgcagctctttacatgcagtctaagtctagtacagactcttgaaactgctttaatattttttttccagaatgatattaaaaaattagactaatattttcaggttgaccaatagtgtggccaacagtttagtgaaccattaataataataaaaactacaatttttggtttgggctttattcaacgataagttttatatgctaaaatttgtcaacactaaaatgctgcttgagctctaaacaatcttgtcagctaattcatgtttgtggaggcccagagggatccataacaggatcaattctgtgcaagttaaatgaaacatgcagtcattccactcagcagttttcatgttctatgtaatttgtaagggtaacttggtgcctatgatgggtttctctccaaggtgccgattcctcctggacaagtttatgctataaacgatgcgttgtcagctgaaggagcggcagacgactacgaagcgtgcctgaagcagcttgtcaagaacggtgtgatttctatgtcagcggcgactggatttcccaggtttgatctccagcttctgggaatgggacctgatggccacattgcgtctctcttccctggccaccctcttgttaacgagaaagagaggtgggtcacatacattaaggattctccaaagccacctccagagagaattacattcacgtttccagtaatcaactcatccgcatacgttgcgatggtggtgactggagctggaaaggcggcagcggtgcagaaggcgctctcagacaagcaaacctcgtcagacctgctgcctgttgagatggctgtgctacaagatggagaattcacctggttcactgataaggcagcggtgtccttgctgcagaacaagtagagtctccatggtaaccttggctcggctcgaagccattttagctcataaaataaaagatccatgggcctgcgtgcatagctgcattcgtcctccaggatttcgtgtaacggagactcgatccttttatgtgtattgttcggagtaatgttcaaaaactctattgtcttccggcttttctgaaacattgctcggtaagtgtttggtttagtacaaggtacactgttccgcgctagacgcatggataggaaatgtggctgcattgaattcttccaggcttgtcgatcctggcatgttccagtttccagtggttttcagtgctcgtgccatctcagatatgaagagtggtctgcattcccggtgatagattctttcattgaagctcccctacctcccctcaaagtttctagttgagcattaaagaagctcatttgaggggcaatttgcgctgaaaatatctgcataaggccattccagtggaagtttcgttgcacggtttctaaaactgatacgtcagcttttgtttatgaaaccgtgtatcttgagtttcatctggatgaaaccctctcttcttccataaaacactctccatctctcttattataaatattgtgctatattattaaatatggtgatgtgtatctcatttaatgagattgataaaagttcaactgagaatgacctaagctattcagctgtcaggagtctgggcctgcatatttatgagtccggtcctgcatatttatgggctgtttgtttgttttgccggcccaagctagctaggccaggattgcctacccttgcaaggcaaggcaaagcaagaaatggtatgtggtgtttggtcctttttcactaaaaagttatggcaaaaatcaccaccatcaccaaaacctttttggttgcaaggagtcaactatggctaggttaataaaaatgcactccatatgggatcatgagatcccgtttgcgtgacaagaacaagaaatgagtggggttaggcatcaaacattgagcttgtgaaagagaacatacttattaacgcaacttggaggctagctcaagatcttgactccatataattgaaatgatcattaaggctaagtactacttaccctaacgcttcattcagtactgcacccatatagcaatataggtgccaaatttgaccttattagcgtctttttgaaattagaaattacagttnggttcatcgatgcggacataactatagtctatctgaaaacaatcggaagtgttcttaccaccgaacaatgattaagcggagtggtgggcatagcatatacagatgatatcattaagatttgataacttttttccctcctgttacaatgtacgaagatatttgctactatttagctctagtttagaaacttagccttgttctcgtttgtgtaggattggtgggtcgggatgattcctagccgaattgtttctctaatttatataaactttgattagctggaacgattttgggtgcaatccgacgtaaacgaacaaggcctaaatcctctacaagaatcccggtgattgagtggaaaaatgagctaattttccattcaatctccggaaatcccgaaagatttaagctacaaactagccctaagtaatgagatccgtaacgtgtcagagcatcttcaagagttctctagaaaatgactccttaaaatcagttttaagggacatctaaaaaattagtgtgactatattttaatcatttctccaacagatctcttaaagtgtgagattgtttctggtgagctcaaaaaacctctcatttgtagttataaatgagtgagttttaagggctatgaaaaatttggaagtgttttaggagaactgttggagacacgtttttatgtttttcaaaaaaaattaatttaggagagacttctgagatgctctgaaaaagaaaaatctggacagtatttcggtgtcacaaactggcgaattcgctggcggtccaaccaatgtgcatgccgaggattcagatatgagatattccatgcatggacgtcgacaggtcataaccacgctcatgctgccacggtcttgctgcctggccggccggccgcccctgtctctggctggccactgcatgcattttgcagccacggtcttcctcatgcgtcggcagtcggcaccacctgccaatgcagccacagcaaacgtgcgatctatcgagtctgaacaccgaaactcgaacacatgcatgatgctgaatcgatcgagctaaactgctatatatccatcctctctggtctccaatcagctagctgggcatgagtgcctgatctaatcacctaacctgctacgggttcatgtggctctcgccaaggcctcacatgagctagcatatatggaccaagaacatgacacctagaaggaccaagaaccattgcactagcggcggcggcggcatagtcaggatcgcaatgttttaataaaattttatattcatcagcgacgaaaataatagcatctgcgtcatgttccggccggccagagattcttctgtttgctcatacagtataaaactgcatgcaggtcgcatgacctggtctttagaacaggagacacgtcgctgctgcgcgctgagggacctcggaaacactaatttgcttgctttatttgtctgcagccagcgatgcaaatttgtgtgtgggttaaacaaatgattaatgtatttaggaggaggttagcagcattttaacacagcagggtctatttggtcggctaaagccagccattcactcatccaagaaaccatctggcacacgactttttcatcggctcatgcatgtggcctgataattagctactaaaaaaattactttggtggacccaaacagacatgactaaagttagctacctcaaccaggtgtagattgcaacgtactctcccagtaataaatagaatagtaaaattattattatctatgcatctacttctttacctgatggctccaaacaatgaataattagttagccaaataactattagatgctagtggatctaaataggatctaaggctaattgttagttgaagctaaaaaatagcaactaactattatccaatacataattggacaatcctaacaatggattataagcggttattagctgtagttgttgtgtttaattaagggtggtaatggatcgcgatccaaatatttcttcacaattttgtttgagccattaattaattttagtttgaaa

SEQ ID NO: 10494 - DNA, 1333 bp, Zea mays
gtaccggtccggaattcccgggtcgacccacgcgtccgcacggatcccccccttaataacagcaaactaccacacccatgtccacctccgtctccgtcataaccgtagggcgaccgccaccgccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggagaagttcgcggccgagaggggtgccttcaccgccgtgctctctggcggatccctcatcgaggcactcaggaagctgacggagccgccgtacctggattcagtggactggagcaagtggcacgtcttctgggtggatgagagggtcgtgcccaaggaccatgtggatagcaactacaagctcgcctatgatgggtttctctccaaggtgccgattcctcctggacaagtttatgctataaacgatgcgttgtcagctgaaggagcggcagacgactacgaagcgtgcctgaagcagcttgtcaagaacggtgtgatttctatgtcagcggcgactggatttccaggtttgatctccagcttctgggaatgggacctgatggccacattgcgtctctcttccctggccaccctcttgttaacgagaaagagaggtgggtcacatacattaaggattctccaaagccacctccagagagaattacattcacgtttccagtaatcaactcatccgcatacgttgcgatggtggtgactggagctggaaaggcggcagcggtgcagaaggcgctctcagacaagcaaacctcgtcagacctgctgcctgttgagatggctgtgctacaagatggagaattcacctggttcactgataaggcagcggtgtccttgctgcagaacaagtagagtctccatggtaaccttggctcggctcgaagccattttagctcataaaataaaagatccatgggcctgcgtgcatagctgcattcgtcctccaggatttcgtgtaacggagactcgatccttttatgtgtattgttcggagtaatgttcaaaaactctattgtctgaaaaaaaaaaaaaaaaaagcggccggtaagtgtttggtttagtacatggttcgctgttccgcgctaaaaaaaaaaaaaaa

SEQ ID NO: 10495 - DNA, 1506 bp, Zea mays
  misc_feature (1506)..(1506): n is a, c, g, or t
cattgggtacctcgaggccggccgggacaaaaccctgcacgcctcccccgccaccgggcactcttaccgccagccccacatcacggagcatcccccttaataacagcaaactaccacacccatgtccacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggagaagttcgcggccgagaggggtgccttcaccgccgtgctctctggcggatccctcatcgaggcactcaggaagctgacggagccgccgtacctggattcagtggactggagcaagtggcacgtcttctgggtggatgagagggtcgtgcccaaggaccatgtggatagcaactacaagctcgcctatgatgggtttctctccaaggtgccgattcctcctggacaagtttatgctataaacgatgcgttgtcagctgaaggagcggcagacgactacgaagcgtgcctgaagcagcttgtcaagaacggtgtgatttctatgtcagcggcgactggatttcctaggtttgatctccagcttctgggaatgggacctgatggccacattgcgtctctcttccctggccaccctcttgttaacgagaaagagaggtgggtcacatacattaaggattctccaaagccacctccagagagaattacattcacgtttccagtaatcaactcatccgcatacgttgcgatggtggtgactggagctggaaaggcggcagcggtgcagaaggcgctctcagacaagcaaacctcgtcagacctgctgcctgttgagatggctgtgctacaagatggagagttcacctggttcactgataaggcagcggtgtccttgctgcagaacaagtagagtctccatggtaaccttggctcggctcgaagccattttagctcataaaataaaagatccaggggcctgcgtgcatagctgcattcgtcctccaggatttcgtgtaacggagactcgatccttttatgtgtgttgttcggagtaatgttcaaaaactctattggctccggcttttctgaaacattgctcgttaagtgtttggtttagtaaaaaaaaaaaaaaaaaaactcgagggggggcccggtaccccaatcccccaatagggaggcgtattacaatccccgggccgtcctcttaacacggcgcgaacgggcaaaacccctgtcgtaacccaacttaatcccccttgcacaaactcctctctttcccccgctggggataatacgcgaaaaggcccgcaacctcacacn

SEQ ID NO: 10496 - DNA, 866 bp, Zea mays
tcatcacaactcaagcacctatatagtagtacctcacaatggcaggcaaaaagctaataccgttggggctcattatcctcatgagcataggattagccaatgctgttagggtggttagatactctaatgccgatggtactggcacaggacagggagaaggtggtggatatgtgaatggcggaggatcaggatctgggtctggcaccggatcaggtgatagtggtccttatggtacacatgcaagcgctagtgggggtggtggagggggtggaactagccagtacggtgggtctggatatggttctgggtcggggtcagggtcaggatctagtacatatagtcaaggagggtattctggttatggagaatcttctagtgctggtggtaccggtgggggtggagctggaggacaagctggaggcgcatggaattccaatgctcaaggatccggtagtggaactggttctggctctagctatgctaacaggtattggtatggatcaaatgaagcaggtgcaagtgctaatggcaatggtggtggcacaggaaatagtcaaaacggtggaggtggtggtggctcaggtgctggatctgggtatggcaatgcctacccctagtttctatatctaagtcaacctatagttggggcccaacagtctttcttgtttcaagttgtgaaattagttagtttgttcgtacctctattacactttttgccagaactaaataaataaagggcccaactattctagtaatggcagcagtttagtgtgaggttcagcttgtaagaatctgttgtaaacatgtcagtctatgaatgaaataataacttccctttagctaaaaaaaaaaaaaaaaaagtccac

SEQ ID NO: 10497 - DNA, 3457 bp, Zea mays
ctttgcggcccgcccggacgcccccgccgggagcagcaacagtcaatcacagtccccgcttcccggcggccaccgctgcatcctcccctttccacgctccactctcctagcgcgcccgccttcatgggccccgttcgactcgccctcctcctttccgtcgccgccgtcctcgccgccgcgggcgcggtgtacatcccctacaacacgtcggcgggggtggtgccggggaagctcaacgtgcacgtcgtgccgcacacccacgacgacgtcggatggctcaagaccgtagaccagtactacgtcggatccaacaactccatccagggggcatgcgtgcagaacgtgctggattcgctcatcccggcgcttctcaaggacgagaaccgaaagttcatctatgttgagcaggcattcttccaaagatggtggaggaaccagaatgacatgatcaaggatacagtgaaggggctcatcagctctggacggctggaattaataaatggtggcatgtgcatgcacgatgaggcggctgtacactatattgacatgatcgatcagactacacttggacacaagtacatcaaggaggagtttggccagatcccacggattggctggcagattgatccgtttgggcactctgcggttcaggcttaccttcttggcgcagaagtaggattcgatgctttctatttcttccggattgattaccaagaccgtgatacacggaaaggaacaaaagaactcgaggttgtatggaggggctccaagaccttgggctcatcggctgatatctttgctggcatctttccaaaaaactatgaaccacctcctggtgatttttattttgaagttgatgataattcccctgttgtccaggatgatccccttcttttcgattataatgttgaagaacgagttaatgattttgttgctgcagctgtagcacaggcaaatatcacgaggacaaatcatatcatgtttacaatgggaacagacttcaaataccaatacgcagagagttggttcagaaatatggacaacctaattcactatgtgaacaaggatggccgtatcaacgctctttattccacaccttcgatttataccgatgcaaaatatgctgcaaatgagcagtggcctctcaagaccaatgatttcttcccatatgcagacaacccaaatgcctattggacgggttactttacaagcagacctgccttaaaacgatatgtccgcacaatgagtgggtattacctggcagctagacagctggagttctttaaagggagatatagctcaggtctctcaacggatagtctaggtgatgctctagctcttgcacagcaccatgatgctgttacaggaacagagaaacaacatgttgcaaatgattatgcaaagagattgtcaattggatatacacaagcccaggagctcgtttcaacttctcttgcttgcttgacagagtctggctcaaaatcacgttgtgcatccccagtgacaaaattttcacaatgtcttctgctaaatgttacatattgccctccttctgagatggacttaacgaaaggaaaaagcttggttgttcttgtatacaactcgcttgggtggaaacgagaagacgtcattcgtataccggttttcagtgattcgattgtcgttcatgattctgaaggacgagaaattgaatcacaacttctgcctatagctacagcctcgttgaacataagagaaaagcatgtcaaggcttacctgggcacaacgccaggtgcaaagcccaagttttggcttgcttttcctgtgtctgttccacctcttggtttcaatacttatttcgtctcaaacttgaagaaatcagcacatatttcttcgaagtccactcagtactcacctcaaggaagtgaaagtagtaatctacaagttggtcaaggcaacttgaaacttcaatataatgaagctggaaaattatccctgtactccgatagtaagactatggttcaagcaaactttgagcagaaatacaagtattatattggacaggatggaaatggaagtgatcctcaggcttctggagcatacatattccgccctaatggcacagttccaatcagtactgatgggcaggtttctctcacagttctgcgtgggcccatattggatgaagtgcaccagcagataaattcatggatttttcagattaccagggtttacaaggagaaggactttttggaaactgaatttatagttgggcccataccagtagatgatggaaatggaaaagaagtagcaactgaaattgttacaaacatggttacaaacaaaacattctacactgattccagtggacgtgatttcatcaaaaggataagagattatcgatcggagtggaagattgaagtgcaccagcctattgctggaaactattatcctgttaatcttggcatctatgtggaggatggcagcaaagagctgtctgtactggtagacaggtcaattggaggttccagtataaaggatggacaaatagagctaatgctacacaggaggctactccatgatgatgggaaaggcgtcgccgaggcgctaaatgaaacagtctgtctcgataagcaatgtgaaggactcattatacaaggaaaatactatgtcaaaatagacccacaaggagaaggagctcggtggcgtcggacatttggccaggaaatatactcccctctccttcttgctttcacagagcaggatggaggcaactgggcgaattcacatgttgcaaaattctctgcgatggattcaacttacagcttgcctgataatgttgcaatgcttacccttcaggagcttgaagatggaagtgttctccttcggtttgctcatctatatgaggccggggaggacaaggatctttcgtctttagcgagtatcgacctcaagagagtgttcccggagaagaagattggcaaggtcatcgagacaagcttatcggcaaaccaagaacgcgcagccatggagaagaagcgtttgaaatggaaggcgcaaggttctgcggcggacgagaaggtggttcggggtggccctgtggatccttcgaagctcgtcgttgagctggggccaatggagatccgcacattcatcgtcagctttgatcacatcagtgacaagcaacagctctaatcgtctccgactagacgactaggtctggatgaagttgtcgtgcggcttcgaaataaaaaataataatgtggcctgctgtgtacctgtggttcaacccatgatatggcctgctgtgggtcagcacggttctaaagctaaggacattttataaggcaaattttgctttagggtgtcactcctctcctcacgttgcaaaaatacagaaaaaaccagcgaaaacatgattgcaaacaggtaagcgcccgccccccccccgcaattttataaaaaaaaaaaaaaaaaa

SEQ ID NO: 10498 - DNA, 1950 bp, Zea mays
cactttttacctttttttccctccctccgaccaaagcatttctgttgtcctttgcatggacagttctttagaaatgattttgttagtgattcctgttctagtttagaacctgtaatggactaaataatagcataatagataactaatagtaaaaatacatggcaaaatggtgtaagattactcaagctttattcatgagtttttttttgtgtgcagataagagattatcgatcggagtggaagattgaagtgcaccagcctattgctggaaactattatcctgtgatatttcgtttgctcccatctctatgtttttttaatgaagttcaataacatcaataagatggtttactttttatctgagtcaacttccaaaaacagtcaagagtggcaatttccactcaattgatataatattgaattgtttattctttgttacttttcatatagaattttattggttattttggttcgatccaaacgctgttgattttaactgaaagatggcaacaccaacataaaatgttagctcaatcagctatttgtgcactgtggcaaaagaagttaggtttatcaatttattaaaaaaatctgcatagctgagttggatagacggtctaagtagtactccttggatcctgagttcgactcattgtgcgagtgaatttcaggttggagttaaaaaattccttcatttgtcccacgtaaaagcacaggtctaaggccgtaacatgttttagaacctgtttatttcatgttctcttattactctgtattttttctattgagaattgagatcactttgtgtttgtgagaaaagaggtagagatctttaagaaattagaatgctggtacaactcttacatgtaagttctgttgggaaaattagtaaaaagatgagggattatgtgtatcttttcaggttaatcttggcatctatgtggaggatggcagcaaagagctgtctgtactggtagacaggtcaattggaggttccagtataaaggatggacaaatagagctaatgctacacaggaggctactccatgatgatgggaaaggcgtcgccgaggcgctaaatgaaacagtctgtctcgataagcaatgtgaaggactcccgggaccggcccaacgcgtccgcccacgcgtccgcacaaggagaaggagctcggtggcgtcggacatttggccaggaaaatactcccctctccttcttgctttcacagagcaggatggaggcaactgggcgaattcacatgttgcaaaattctctgcgatggattcaacttacagcttgcctgataatgttgcaatgcttacccttcaggagcttgaagatggaagtgttctccttcggtttgctcatctatatgaggccggggaggacaaggatctttcgtctttagcgagtatcgacctcaagagagtgttcccggagaagaagattggcaaggtcatcgagacaagcttatcggcaaaccaagaacgcgcagccatggagaagaagcgtttgaaatggaaggcgcaaggttctgcggctgacgagaaggtggttcggggtggccctgtggatccttcgaagctcgtcgttgagctggggccaatggagatccgcacattcatcgtcagctttgatcacatcagtgacaagcaacagctataatcgtctccgactagacgactatgtctggatgaagttgtcttgcggcttccaaataaaaaaaataatgtggcctgctgtgtacctgtggttcaacccatgatatggcctgctgtgggtcagcacggttctaaagctaaggacgttttataaggccaaattttgctttagggtgtcacccctccggccgccccgcgagggggcgcaaaaaaccagcgaaaacatgattgcaaacaggtaaggggcaactcccccacctcaattttaaaaaaaaaaaaaaaaaagcggcc

SEQ ID NO: 10499 - DNA, 2200 bp, Zea mays
gggtaccctccgggctcggccggggccagagggaggagggagagaggaatcttcctgtttccttgcctgggactgggactccgtctccgtctccgtctccatccccttccctggcccccgcccggcccgcatccccgcgtcttttcctctcgactctcctctctctctctctctctctctctctctctctctgcgctgctctcggtttaggtcgaggagttgctagctagctagggggtttggatccctgctggtgctggctgctccgctgctgcgtgctagtcctactccagccccccagccccagcgaagcaggcaagcatagatagaggctggggtgggcagggaggtgcgcggacggagatccatcagatcagaatcagatcacatcatcggccctcggatgcgatgcagcaccggcgcaagcccgcttccgccgcggcgccgccggccgccaagcagccggccgcgcgcaggcccacggcgcggctgtcgctcgcgggcctcgtcgtctccatcttcctcgtcgccaccttcctgtacaacgaggacgtggtgaaggcggcctccggctcctccagctcagcaacaacagccgacgccgctgaggtaggcgtctccgggcgggcgaggtcacccgacctaagggtgctgcaggaggcggcgcaccagggggtggaagctgaggagcgggaggttggagatcgtacggaagcggagcagaagcagaagcccctgaccctccccatccccatccccgtggtggcgctggcggaggaggaactcgtggagaatactaagggaaggcagaagcagcagcagcaggaggaggagcaaacccagaagccaccgccaccgccgccgcctcctccccaggttgccgggtgcgacctgtaccggggtcggtggacgttcgacgcggccggcgagcaggcgccgctgtaccgcgagtcggagtgcgagttcctgacggagcaggtgacgtgcatgcgcaacggccgccgcgacgactcgtaccagaagtggcggtggcagcccgatggatgcgacctgcccaggtacgatgctcggttgctgcttgagcggctgcgcaacaagcggctcatgttcgtgggtgactcgctgaaccgcaaccagtgggagtccatggtgtgcctggtgcagtctgtggtgccctggggccacaagacgctgcacaagttcgtcaacaacggatcgctcaacgtgttcacggcgcatgattacaacgccaccgtggagttctactgggcgcccttcctggtggagtccaactcggatgacccgcaggcgcacagcgtcatgaaccgtgtcatcgcctggcgcgccatcgccaagcacgccaagaactggaagggcgtggactacctcgtcttcaactcatacatctggtggctcaacacattcgagatgaaagtcattcgccgtcatcagcatcagcttgaaaaggaggaggagggggtgaggtggagcaagtacgcccttgtggaccggccggtggcgtaccgggaggtgctcaagacgtgggccaggtgggtggaccgccacatcgaccccaaccgaacaagagtcttcttcatgggcatgtcgcccaaccacgtcacgccgtgggcgtggggtaacgacggcggcatcaagtgcgccatggagacgcagcccatcagcaacaaccggacggggcgactggacatcggcacggattggcgcctgcacggcgtggcgcgcggggtgctggcgcgctacctccgccgcgtgccggtgcacttcgtcgacatcacggggctgtcggagctgcgcaaggacgcgcacacctccgtgcacacgctgcggcaggggaagctgctcacaccggagcagcaggccgaccccaagacctacgccgactgcatccactggtgcctcccgggactccccgacacctggaaccacttcctctacgcgcacatcctctcgctctcctcgtccgcccaggatcactaaccatttttgcccagcctcacaatgtcaagcgcttcctttcaactcctctccctagaccacccacccaccctggatacctattactactgctgctgctgtagatcttcgtttcattttgacaaatgcatgcaggtcttctcttgtaatttctataaaaaacatccctgatttaattttgactagcagtaccaattactttttc

SEQ ID NO: 10500 - DNA, 2616 bp, Zea mays
cagccgcagccgccggaagcaagcaagcacgcatccgcagccgccggaagcaagcaagagctgcgactgcgagcaggctgtattaagcgaagcgacgacctccgttccattgcgaacaggctacatacagatcagagtgaggaagaagaggaagccgaatttcttttcactcttccgactgacctttcgcgggtgcgcacgccacctcgggtcgggagcgcgtcgatcgagtccgtggcggtggcggcgtgggacggtgaccggtaagtttgtacaatataaagcgcggcggccacacagtcacacacactgacacacacacaccagctgggagctccggagatgcagcagcggcgcaagtcggtgttcgcgtccgcgccgttcgcgatgaagcaggcggcgctgggagccggcgtggcggcgcgcaagaacggcgcgccgctgtcgctggccgcggtggtgttcgcgctcttcgtcttcgcgacgttcctctacaacgaggacatcaagtccatcaccgacttccagttcagctccggcgccatccgcgccaagtcccccgacctgcacctcctgcaggaggccgaggccgcggcgcacgccgccgtgaacaccctggccaagcgcggggaggaggtgatcgtgcgcgtcctcgaggtcgaggcgccgcccgtcgtcaacgctagcagcgtgctggcggccgccgcgaaggccagcgccaaggccaacgcggtggacgtggggcaggagaaggagcgggacgtgacgctcccgacggtgacggggggccgaggcggggccgacgaggcccggcggcgcgctgacgaggaggtcgctgagaaggccgcgtcggcgaaggcggcggcggccaccgccgctctgcgcggcgtggtgagcgtgccgcagacgtgcgacctgtaccggggcagctgggtgtacgacgaggtgagcgcgcctgtgtacaaggagggcgagtgcgagttcctgacggagcaggtgacctgcatgcgcaacgggcggcgcgacgactcgtaccagaagtggcggtggcagcctgcgggctgcgacctgccgcggttcgacgcgcggctgctgctggagcggctgcggaacaagcggctgatgttcgtgggggactcgctgaaccggaaccagtgggagtcgatggtgtgcctggtgcagtcggtgatccccgacagggggcagaagacgctgacaaagttcgtcaacggcgggtccagcaacgtgttctacgcgcacgagtacaacgcgacggtggagttctactgggcgcccttcctggtggagtccaactccgacaaccccaaggtgcacagcgtccccgaccgggtcatccagtggcacgccatcgccaagcacgcgcgcaactggatcggcgtcgactacctcgtcttcaacacgtacatctggtggctcaacacgctcgacatgaaagtcctgaagcaggggtcgtccttcgacgaccagggcggctccaccgagtacgtggaggtggaccggcccgtggcgtacaaggaggtgctcacgacgtgggcgaaatgggtggaccgcaacatcgaccccaacaggacgaccgtcttcttcatgggcatgtctcccaaccacatcacgcctgaggcttggggcaacaagggcgggatcaagtgcgccatggagacgctgccgatcgcgagcaaccgcagcgcggcgctggacgtgggcacggactggcgcctctacgcgggggcgcgggaggtgctgcccacgctgcgccgggtgcccgtccacttcgtcgacatcaccgcgctgtcggagctgcgcaaggacgcgcacacctcggtgcacacgctgcgccaggggaagctgctcaccccggagcagcaggccgaccccaagacctacgccgactgcatccactggtgcctcccgggcctgcccgacacctggaaccagttcctctacgcccgcatcgcatccagcccatggcccaacgacgcccaggcccagcagtagggaccctgcacctgctcctccttctatcttcctcattcgccgcgggccggcgcctcacgacacaaaagggaggcctgggctgcaacggcccgcccatcgacgagagctctggcgtttctgcttcaagctagctgatcagccaaaagggggcgaaagacggcgtttctgctcgccgtctttgttttctttccttttttttaaacgatttttctttctcttttcgttgcataaaaggaaactggtccgtgttgttcaccttcgattctttggtccaaacacaagtggatggtctggggtaaatgagggtgtgacgagcttagttgctcgctcatttggtttcttctcctaccaacgatgcctagggggaaagcaagagttgagcatgaagatgtgatgggggagaagcaaagctggggggagtacatgtaaagaagattttttgcgttgtatttttatatgctgctgcagtgcacccaaggttaagagaggtataaagagcatttgttcttcaatcatgacaaatcctgtgtcccctttttagcttaaaaaagaaggcgcgctcggactgggagtacgtgcggcgtccggggacctccccgtcag

SEQ ID NO: 10501 - DNA, 916 bp, Zea mays
actccatagggcgattgggttccgcccggccgggaagggatattcttcgggaacatccatccatccccaatccccaaaggcgaggagagaactagcaaagggaaaatggctgcttccacaaacaacactctcagggtgctgttcaccctaatggttgtatgcgccgcagtatgcacagcgaaaaggaccgtagcaaagacaggagacttggcgccagcccctgctccattaggagcaggaggcgccaccgcagccccagaaggtgcggctagagccagcaggacgttcgacatatcgaagttcggcgcgaccagcgacggcaagacggactcgacacaggtggtccaggacacgtggacgtcagcgtgcggagcgatgggagacgcaacgatgctcatccccaagggcgactacctggtgggccctctctacttcagaggcccgtgcatgggggacatcaccatccagctcgatggcatcctgctgggatccaacgacctggccaagtacacggcgagttggatccaggtgtcgcacgttaacaacatcgtcatcaacggctccggcacgctcgatggtcagggcaccgcagtatataccaagagcaagactgacgtcgtcaaggcgatgcccaacacactagtgttgttctacgtgaccaacggcactatttccggaattaaactactcaactccaaattcttccacatcaacatcgacacttctaaggacatcaccgtgaaggacgtgaacatcaccgcgcccgcggacgtcgagaacacggacggcgtccatgtcggcgggtccttcaatgtacgcatcaccaactcaaccattggcaccggcgacgactgcgtctccatcggccctgggagcgacggtgtcatggtgaacaacatcacctgtggccccgggc

SEQ ID NO: 10502 - DNA, 1118 bp, Zea mays
accgagaagctagcagaaaaaatatacgcaatactttagaataatagaaggtcacatatatacatatgtgtgtgcgcacattcattcatagaagaactaccataagagactcacattttagcacatcttgtttgtcagtatgtgtacatgcataggaatatcagattgtgaaagtgagatgtcggtgcaaactgaaatgataaagacattgtggacatgactgtggacatgactgtgatgcaactatttggattcctaattgattctgtggttggtactttccatacatagaattttactgaaaatttatcaagaaagcaaccaaccttttatgaacctagtggcaaagttttctcacaggaagagatgttatcaagctaatgcaacttcattagtagataaaaaaatgaaatcaaagcattggatacatttgacatggtcgattcacattttgatggatacattgattttgaagaataagttgactatgatacagaggtgaaaggacaatacggcaaagactataacagacttatagggaatttggttggttatgaagcagaaaaacatctctacttgggacattgaccgtgtgaacctagagaatgatgaaaatggaaatccaatatgctatgaaaaaacttaagaaagatcttcacttcgacaaccagtcacaacatctaatcataaaaagctataggaggaagcatataaaaaggatacaatgacaaaaggaaaactaaaacatgtaccaacaatattgtcagtttctacataattgagggggtaatctaaaatagctgatcacatgaaatgatagtatcaagatggccaacaaatgatacattgagggaagcattctatgaaagtagttattcatactcctatctgatgtgttgaagcttgtccctgagagaagagttctctgacctcagagcttcaacatgtagcccaagctcctcacgctcagcctagaataatcgaataagattagaaaagcactgaacaaaatcctcctaaaacatagaagatgaaattcaggaagcaggatattgtcaggatgagtgttgcacgacacctgttggtgcagccacgaaaaaaaaaaaaaaactctatta

SEQ ID NO: 10503 - DNA, 1219 bp, Zea mays
gtctctcttcaccatttggcttcgtctctcttcaccgttggtgccaagttcacaagtatcagatctggtgataaatgaccgggaaaaagaccacggcctcctctgccggccgcactcgaaagaaggccaaggtggtgttggaggatgaggaagaggcagggttggaagatgaggaagaggcgactgtgacactatccgtggagaaggacgcactggagtgtgacatctgctgcctacccttccagtccgaagtttttatgtgcaagaacggacattctgtatgtgcaaaatgctgcatccgcacgaacggtaagtgctggacctgctccgagcgcattggcgacatacgttgccgtccgctcgagaagctcctggcggcggcgaccacctcctgcatgttcaagagcaacggctgctacgacgtcatcagctacctggagaaggtgacccacgaggagacatgccagcgcgcgccgtacaagtgccccgtccacggctgcgcctatagcggcctgcggctcggctaccacgtcgcacaggaccacggccacgacgacgacggcctcgcctccgtcgtctttatctacggcaaggcggtggcgaccgtgcgcaaggacgagccgttccgcgtcctgctgcagcgcaacacggagcgcgtgttcctgctgctcaacggccacgatttgctacaggggcgctcgctgtccctgctctgccttggcccgcgcttccaggatggcgtggaggtggagctgaagtataagatggaggtgagcggcggtgcgccgggagcgctcacgctgtcggcgtctggcaccataccgttcgcccggcggctcgatgggttccaggccaaagggtttctcttcgtgccggatgcatactggggctccgccggctcgatttccgtcaccgtcagaatttacgtctgacgtcgcctcgtgctagctggtgtggtgtggataggttgattcctactggtcaaccgttcgttcgtctcgttggtacttaccctggttcagtggttgtttatgcactctacgtgctgatgctagtacttttgttaatcgcaacaacgtatgctagtacttttgttaatcgcaacaacgtatttcctgtcgttttacattctatgttattccctgggacctactaatgctaaaacgtacagttgcctgaattttagatttctttcaagtgctttaaaaaaaaaaaaaaa

SEQ ID NO: 10504 - DNA, 2284 bp, Zea mays
tgcagtcgaacgggtgcgccgcggcggccgcgcactgcgccggcgggcgctgcgccggcgcgccggggatgcagttccaggcgccgtcggcggtggccttggcgcagggcgggcgcgaggtgatgaagttgtcggcgtaggtgaagttcctgaggctggcgagcgcgcagacgccggccggcacggcgccctcgaggcggttgcgggcgacgtcgagctcctggaccgcggccatgttggcgatggcgctcgggagctgcccctgcaggcggttgtcgctgacgtcgaatacggtgagcttccggagcaggccgacctgcggcgggacgcagcccgtgagctggtcgtcgatgagcacgatctcgttgagcgtgtcggccatccgcccgatgctgggcgggatgcagccgccgagcgcgttgtgcgcgagcacgacgacggaggccggcgagttgccgaggttggccgggatcgggtcccggaggcggttggagttgaggaggatggcgtcgagcgggcggtcgaagagcgccggcgggatggggccctcgaagtcgttgaagcggaggtccaggtaccggagcgccggcagcgacagcaccacctcggggaacccgcccacgaagcggttgttgctgaggtcgagctcgtggaggagccgcaggtgcgcgaacgtgggcgggacgacgccgcagaagcggttggagttgatgtggaacagcgccaggtcggggacgcccagcggcagcgacgccgggaggtaccccgcgatgtcggcgtggttgaggtcgatcccggcgaccacgaggacgacgccgtcgtgggggccggtgccggggaggggcgcgcagtagacgccgttgtaggcgcagacgttgggccccgcccagttggcggtgaagttggacgggtcggagaagatggcggtgcgcttccacgcctgcagcgcggcgtaggacgcgcgcagccgcgggttcgggaaagcccacgacgccggcgccgcaaagcgggaggcgtccccgccgtcctgcgccgccgccgggatgacgagcagcagcagcagcgcgaacgacgccgccgccgcgctgcggaggatcatggctgcctgctgctcttgcgcggtggcgatccgggcggaggagagacggacagagagtgccggcggaacggcgggttggtcctgtgatctagagagaggctgagagggaaaggagcgtggagcgggcagtggcagtggcagtcacattcagagcgggcacatggggatgggagctgggagcggcgtgtgtgtgtgtgattgatgaaggcttgtcacaggctcacagtcacatgggggccagctgcacggctagctcagttcagctcatctcgctgattagtcatcagtgagtgtgtgctgggtgtgacggtggtgtgtctcttccgcgcctgcgcctgccagcgcgcttcgtcaccgtcacggacgagcaggcctgggcggggtgacggcggcgacgcggctggctcggttggttgacgggggctgcgcgtcacgtagcgagggcttggcatgcagcggcaggtgagctcgagatagggatcgagttcgttcggccgggctggcttgccgtgccgtctcgttttgcgtccggatggagttcggtttaacttttaaactagcctttgcatttgtttttgtctgcaggatttggaccgtacgcatgtgttggcgtcggcggtgccagcggctggctgcctctgcctgtgcctggccggcctccgtggctactttcctccttgtttgtttatgcatccccatgcatgcatggagccgagatccgtggccaagttcgaattcgaaaagcggcgctttcgttcgggcacgggcggcggctccgtcgccggcgagcggcatcaatgggcctcacgggctcctgcagggaaggcttggcctcggcggcgcgcgcgacacggcatggcatggccgcgctcgtgagtcgtctcgcatgctcgtcgcgttgccccagctcccaggtcgttcgtactgcacgaatggtcggatgaatcgctcgccaaagctccgcgtcgaggacctagcgtgagtaaaaagctacactgacattggcacactgctaattacgaataactacagtggcaagtgcgtgctaaaaatatttagtgaagcacaaggcaaaagtaagttggccaagcagcctctagaccagccggccaggctgattgtttgttactgggctagtcatagtgcacctaaggcatttttgctatctttttggatactatgggt

SEQ ID NO: 10505 - DNA, 2460 bp, Zea mays
cctcgaggccggcctagtcccccccccccccctcacgcaaccaccactgcctcacggcaaccacctcagcccggtccacctctaccaccggccacccactgcctccacccccgccctagatcaccaccgcactctcaggcgcaagaacgagctcaccaggcaaagtcacggcggcgacctccgccttccaggtctcgcccttgctggcgcgcgcctctgctcaccacccagcgccgcgtcttccttctccagtccggtcgctggccgaccgccagcgcggctccgggccctgctttccgcacgcccaagcctgcgcgctccggacgcacctctcctgctcttctgggcttgggaaagagaagaaaccagcataaaaacactagatctgtgaaggatttgaggaagaaaccaaaccgaaaccctagtgacgatgctagagttcggacctcgctctgagtcgaaacgaccagagaccgctgccttccctccccattttcctttcccatgaaccaagcagcgtatgagctttccatccctcctcatttacctatcccacctctcatatcccgttatccaaacggcacctcagggtactgcaatccagaagcaggggccctggcctcagcgcacctggatggcagggctggaggagttgaagaagaagctacaacccttgctgttcgatgacctggacagagttggcgccagtaccagggtgcccttaccagaagatacttgcgattcctacgcagtttctgatggtgggactgttaatttacttagtagatccttgggtgagtataaaatcaatgagcatggctttcataaacgaagtgctgggccagacgagttagattctgatgagaaggcttaccgttgtgcctctcatgagatgcatatatttggtcccatcggtaatggtgcaagcagtgtagtggagagagctatatttattccagttcatcgaatcttggccttgaagaagataaacatattcgagaaggagaagaggcaacaaattctgaatgagatgagaacattatgtgaagcatgttgttatcctggtttagttgaattccagggtgcattttacatgcctgattctggacaaataagtatcgctcttgaatacatggatggtggttccttggcagatgttataagggtcaagaagtctataccagaaccagttctttcacatatgctacagaaagtattgcttggtctgcgatacttgcatgaagtaaggcatctagtgcatagagatataaagccagcaaatttactggtaaatcttaagggcgaggcgaagattacagattttggtgtgagtgctggtttggacaatacaatggctatgtgtgctacctttgtaggcacagtcacatatatgtcacctgagagaattcgtaatgagaactattcttatgctgctgatatttggagtcttggactaacaatattggaatgtgctactggaaaattcccatatgacgtaaatgagggccctgcaaatctaatgttgcagatacttgatgatccatcaccaacaccaccagtagatacttgttcattagaattctgctcattcatcaatgattgcttgcagaaagatgctgatgcaaggcccacatgtgagcagcttctgtcacacccattcatcaagaggtatgcaggaactgaagtggacttggcagcatatgtcaaaagtgtagttgacccaacagaaaggctaaagcaaatagctgagatgcttgctatacattactacctcttgtttaatggacctgatgggatttggcatcatatgaagacattctacatggaacaatctactttcagtttctcagagaacgtgtatgttggccagaatgaaatttttgatattttgtcaaatataaggaaaaagctaaaaggtgataggcctcgagagaaaattgttcatgttgtcgagaagctacattgtcgtgcaaatggtgaaactggggttgcaattcgtgtgtctggatctttcattgtgggaaaccaatttcttgtatgtggcgaggggataaaagctgaagggatgcctagcttggatgagctctctattgacattccaagcaaacgcgtaggccagttcagagagcagtttatcatgcaaccgggaaacttaatgtcatgctattacatatcaaagcaagatctgtacattatccaatcctgattgaacatattatttgtaagattattctctgaagcacatgtatagaggatttagaagaattcctttcggacctggttttgaatcttatttactttgtggaactgaaattttgggccaaacctctgacaagaattgaaaagtttaagtcttcaactatattcatgtttagaactgtttttataaaaaaaaaaaaaaaaaaaaaaaaaaaaaaaaatatttggtaggtattgatatttttcgttttgtcgtaaaaa

SEQ ID NO: 10506 - DNA, 5522 bp, Zea mays
  misc_feature (677)..(677): n is a, c, g, or t
ggtggctaggtctaagccgccgaaagtaagagcttattttcgacgacttgtaagcttattttcgcaacatatgccatattttttcggctccgggccgccgaaagtgaattttgttcatgtagtgtagggcagagtttacgaaactcgctacatctgtttgactagaaaaaaacataccaattggtctaaattatattttattagtatcgattgttgttttcgaccgatgacttagcattagtaccggtcgaagacaacaaccgttactaatgtcctctaccggtttttaaaagcaaccgatattattgatatctttgtatgtaagtccttttgtacagtagtgcttgcaccttcggagttttgtttaggtaagtcaaataatttaaagtttaactaaatttgctaaaaaacacagctatttactattatctaaaaccgtatctatttatttttggatggaggtaatattattttcataataaatctatctagatacataaatgcttaatactattttctataaacttattgaacaaagttaatttaattttttggttcaaagctagtataaccgtactctctctctcttttgtacggagggaatgcaaagcgtacgtagcatatgtacgtatatacaggtgcgaacgtttattaatttcaattttcttctctcaacncagcatgcatgcatgcatgatactgatacgctagtacgtacctgcacgcgcacgacttcaactcgcgcgtgggttaatttacgtaaccctagccaaagcaagccatgcatgcagaggtacatgcatacgatctgacgaccttgcaatactgcggtgatagtactagtacgtatagtacaaggattagctaggtcaaacagttgttagatcaaaatcttttgtctaagtataatcctacgcatgcatgtacgacaggtagccgttatttaatttctcaagttgagattttttttctttctattttgtgttaaggcgggtttttagattagatcaagtcacacacgtactgacggaccatgccgagtttaattattagcggcccatgccatgcataaatacagcgcatgaatccgagatacgcgacgtacacgtcgtcgtttactggaaccactgcacgcagggacgacgtagcctacgcatagctagctatgaacatacataggtgattgcctaattggcaatgtgtacgtgcatcggactttgctcgatcgatcgatcgatagatcagaatcgtcgtcagattcatcctagctagctggtcatctcgaggcgggaaatgtttattgatgactcactgaccagtgccctgtcagtctgtgtgacggctgctagctagctgatctctactactgtgtagctgaagaactgaagaaatgagatcgctgaccttgactgtgctagtatatatgtgttgttaatttagcagtacatacatgcatcagtgaccaatctgttaggatgtgtcctctagcaggttaacagtaactaggttagggttaatcctaaccgtctaactgcgtccctgatcgatcggagggctatcctaaccgttgattgcagtccccgatcacacgacgccatataaatagattaagggggccgacgggtttagccaacgctaatcgctcgaccacaaaaccctaattgacactttgagaggaatcggtcccctagtcgctcggagtgactggaattgctgtgactatgtctcagatcctatcatcccatcgggatctgagattccccctgcatgcaacactggaggagttgatccaccatcgatcaataacgggaaccaatctcctcgacacccgcagggagatcgagaaggaggatgaggcggatcctcgctgtaagacgccgccgtaatgatggctaggaacaacaacgacgatatgtatacctataccccttagtagaatgaatctactcatcatcgaggtattttagacaggaatggtattgtagggacttagtaatcgatcatacgcaccaaaagaatctaacacaatgaacaccgtacttttgataattctgagcagcagtagttttatttgtttctcaacaatttaatttctctctctatatatatagcgcgccatcgatctctgctggcccggccgcatttaatctggctgctattgatttctgcaaaagagttaatgatacagtagcagcatacagttccagtttggtcgcagctaaataggctgctagtcctggttggtggcttggtggaggccggacggtgggcggagaagttattgttccatcgattaggtgacgagagcgagcagccgagcccgagccgagcacacactgcatggctgacggtgggcggagatggtgatctatggataagcattgtttggtttacgagtaataagtagttacatatatatctctagcaggagaatgtttggtttattatattaatgattatttgctcttaattaccagttaccagttaccacccccgtctctcccatctctctcactgtcttcccatcttttatataaaccaccacgaccacgagcagcggcaccagtgagtagtagccaaccttggtctccacttcctgctgccaagtgccgacgcgagtccgtccctcttctcctccgcatccaaagaaaccagaccacaagacatcgagagaacagttgcggccttgctggcacggggatagatcttctccactccaatggcgggcttctcacggccgaacaactcgctcctcctcaagatgcctgcgactttggccagtagccacaccccgaacctctcaagcctcctgttctacgaccagaaccatggccaagctgtaaatgcaaatgcagcagcgatgacgatggtggaggacgacgcctcactccagagctcatctgcagtgctcgacacctccccgcagccacagggcagtgctgctgctgcgtctccgatggagaggaagaggaagcctgcagaagacagtgctacactcagctctgctcaatccaaggtagtagcagcaaagcaacttattacatacacagccaccatttgccattttttcctgcaacattgattgattgttccgtgattttactttttttgaaaccattttttttttgcgttttggtttataggaggattgcaagcagcagcaggagagcaagagcaggcggggaaagaggccccacaacaaggaggctaatactgaggagaagagcgctactgaagacgaggccaccagggggtacatccatgtgagggcgaggaggggtcaggcaacggacagccacagccttgcagagagggtacagtacacctctcactctaatccttgtagcattaatttgacagttagtcgtgtgtaatagtttggtctcagtacttcctgcctcccctctttttcgttatcttctcttgcatgaactgatgaacacctcccgatggcaattttttttgttggttggccttattaggtgaggagagagaggatcagtgagaggatgaggatgctgcaagcactggtccctggttgtgacaaggtcagattagttacttggattaactatatttgatatactgatatctgcttataagttatagtaggccgtttaagtagtaaactttgagaaggaacaaatgtgcttttttttggacaggttactggaaaggccctgattctggatgagattatcaactatgtgcagtccctgcagaaccaagttgaggtaaaaaaagaaaaaaaaagcaggagccatgaagaattaatactcagtgctaaaaatgtggcacttctagctgacaacaatttgcaaatcatatactcctgcctgttttttcagttcctttccatgaggattgcctccatgagcccagtgctatatgggttcggactggatagtgatggcctccatgaccacgcacaagtatggaacagcaaaatcatttttttgtcagctaaaaatacggtcaataagctgatgtttaaatgtgaactgtaaaattgcgctgatgtgtttcagaagatgggagtcatgttccaggaagcccttgcaatggcaggtccagtgctgagccaagccagcccagcagctccatctgaagccatcatggacaccaccacaccttactcactgcatggccatggccagggttccatctctttttcccaggttggcatgtgttccacttcctctctcgtatatacactacatgcgagtctctccaaacacatcagcatccatcatgttttaaccaacgtcaggtcactcttttccaggacaatggcagcagcacttacctgatgcagcatcagcaagcagcgggggagccaacaaggcagcaggagctgctcagccagttggtgttcaacaacatgtgctctttccagtaggggtggggagcatttgggtgagaggaagcgaggaatggaccccacattgacaataggtacggtactattgcaagctaagttcattgattgggaggaggcctacatcctactaaaagtttcctctgtcatgcacctctggtgtctggtctcatgtctctgaaaattacacttcacctactctgattgaattatcaggccatcatgctaatgcccccgtttaataacattttgctttgctggtctctggacaggaaggaaataatgctgcgagtagcgtggtcgcggccgaggtaccagatgagtttgagatgttggatctagtccatccccttgtctggatttggagagagcagtagcaagtagatcgagcctgctgtttgtttacacattttgagagactttgtagtatttgtaactcctttattgggcattgtccatgaggattttctcagcggctgcaccttccatctcaccgtgttgttgtagttcttgagcaatcggttgttagtacatacgagagctattttgttctttgccaaacagtgattgactgttccatccattcagtcttgtctagctccaagcatctgcaaatcgctacgttgttttctttaacccaagaatcgaacaaagtgagtgcatgcatggtacttcttatatctgcaggtcgaccgctgcgctcccagtgggtccgggacgaccagtttgttcccatgctctctctcttgcaggtaccaggtatgggcagagctgctgactgacttcgtgtccttggctctctttttgactagattgagagttgagacggtctttgtactgtttgctcctgtgagaaataaactcagtcataaaaataacatttcatcggcatctttgtagtatgataggatgtgtttgcactttgctccaggtatgggtagagctattagatgtctctctctctctgcactctgcttgcatgcatacacagtgtatccaagcaacatgagcattgaacaatggcaagccaagccccatcgacacaatcctacttgctaactttaggctatctccaacaaccttcatggcccatccctatcctactttctatttcgatcaacttcactctgaagataatacatag

SEQ ID NO: 10507 - DNA, 1577 bp, Zea mays
cattgggacctcgagccggccgggccggaccagtgagtagtagccaaccttggtctccacttcctgctgccaagtgccgacgcgagtccgtccctcttctcctccgcatccaaagaaaccagaccacaagacatcgagagaacagttgcggccttgctggcacggggatagatcttctccactccaatggcgggcttctcacggccgaacaactcgctcctcctcaagatgcctgcgactttggccagtagccacaccccgaacctctcaagcctcctgttctacgaccagaaccatggccaagctgtaaatgcaaatgcagcagcgatgacgatggtggaggacgacgcctcactccagagctcatctgcagtgctcgacacctccccgcagccacagggcagtgctgctgctgcgtctccgatggagaggaagaggaagcctgcagaagacagtgctacactcagctctgctcaatccaaggaggattgcaagcagcagcaggagagcaagagcaggcggggaaagaggccccacaacaaggaggctaatactgaggagaagagcgctactgaagacgaggccaccagggggtacatccatgtgagggcgaggaggggtcaggcaacggacagccacagccttgcagagagggtaaggagagagaggatcagtgagaggatgaggatgctgcaagcactggtccctggttgtgacaaggttactggaaaggccctgattctggatgagattatcaactatgtgcagtccctgcagaaccaagttgagttcctttccatgaggattgcctccatgagcccagtgctatatgggttcggactggatagtgatggcctccatgaccacgcacaaaagatgggagtcatgttccaggaagcccttgcaatggcaggtccagtgctgagccaagccagcccagcagctccatctgaagccatcatggacaccaccacaccttactcactgcatggccatggccagggttccatctctttttcccaggacaatggcagcagcacttacctgatgcagcatcagcaagcagcgggggagccaacaagacagcaggagctgctcagccagttggtgttcaacaacatgtgctctttccagtaggggtggggagcatttgggtgagaggaagcgaggaatggaccccacattgacaataggaaggaaataatgctgcgagatttggtaggagcatgcacgtaccagatgagtttgagatgttggatctagtccatccccttgtctggatttggagagagcagtagcaagtagatcgagcctgctgtttgtttacacattttgagagactttgtagtatttgtaactcctttattgggcattgtccatgaggattttctcagcggctgcaccttccatctcaccgtgttgttgtagttcttgagcaatcggttgttagtacatacgagagctattttgttctttgccaaacagtgattgactgttccatccattcagtcttgtctagctccaagcatctgcaaatcgctacgttgttttctttaacccaaaaaaaaaaaaaaaaa

SEQ ID NO: 10508 - DNA, 1929 bp, Zea mays
tgacattagtaaatttccacagtcctaaacaaagtttcctatgttgtggtgttgtagattcccccaacacgtgccaggtcaccaaggctcggccggcacaaggcagccagttctgctactgctcctgctcctgcagatggttctgtatcatgtgggagcccacggagcactgcaaattcgggcaaggtaaatgaaatcatggagaacatcaaacctcgtgtccctgctagaaaatctattcagaggccagtcacgaaaactccattgcaagtgtctgccaccacaaaggctgaaccaagacccatagctacaaagccgaaaatcgcaaactcgaaacctaaggtttcaagggcaaaggttgcgcaggcgcaaggaaactcagctgaagtccctccttcagaaccttctgcctcggaagagctagtagtcgaacatggcgttggagaagctacaggtcctgatctggcttcacaattggttgcttcgaatgaagtcccagtccatggttgatcaattgcgcattttgcctatttatttccttcttgcagttctgtgaatagtgagggtgtgtgcttcattgaaagttgaatcgctcaaagtgccatggtttatcgtttctggagtaggcatccaaatttttttttcagcttgtcattgagcatgccatgtatattgcttgatattgtgttcatgtttaaaattcccaatcttgtgtatattggatttatatgtctttggacatcctaggattgttgcaatacgtcaatgcaatttgtgcattattttgtagtcgttttacgcggccccttttccctcattcttgttagttttacaccaactctacctattctagaacctgctccaacttctcagccctcaccaatagtagtagctcctccttacgttaactccaacattatatgcaaaaattggaattcaaatactcatttgggttacgcactccgtcggaaagaagagacccagatgttatggtatctaacagggctaaatacacgtttgagaaaatggtcatccatatatagacactctttcacatcacatctaaaatgagtataggtaacctataggagatgctaccacgtcatttagatatctataatggttttaggtgtcctgatagatacttcattgaagtcagccttcgtcctttagcaccacaagctctagcacccacaccaaagacaccccaagaacaaggatagcaatggagaggggcaaacaaggttgacaagaatccaagataagtaaccagaaggtaaatactaaattgaaagcacgaatatgagaaatcaacattgcccaccaaaacactttgaaatgcatgagcttaaccttagaaactccacaaacccgaaaatgatctatttaggcccaaaccctccaaaaatatattgctctaacaactacaacatctcccattgaaaactctcttgtagattttggtagtttggataacaacccatttaaaggactaacagatgtgttaagtggtggacaggtacttagtgcaaagctcgtaaagttcaacacaagtgttcaagagtgatggtccaaaggttgagttgattatgagtgtggacatcacaagtgaaggagaagattgcttatgtgagacttggtgtgcatatcttggagacaactggtcaagccaaggatggaggcaagaagagcttcgaggtaccaagtgcacgggagaaggtcaaggaggctgaggaacccaaagccaggggtgaagaagaagacttgcaatgtcaaggattgatcgagagaaaagatatgatgcatcgagaatcactatctaaggacgttgtaagtcataaggctccagatcaagctcaagacatagagcaaggttctctagaagtagtagtgtcaaagccagaacctggaagcaacccaaaagagcta

SEQ ID NO: 10509 - DNA, 1031 bp, Zea mays
  misc_feature (13)..(13): n is a, c, g, or t
  misc_feature (16)..(16): n is a, c, g, or t
ccgccacgcgtcnctnggtggatctctggggccccacgaaggcgaggctgcagaacggcagggtccccgccggaacttccgccgccgccgccgccgccgggccgagggtgaagaagcccggggtcctctcacagagcgcctccttcccggcgcggggcgcggtggcggtcgcggccaagaaggccgcggcggcggttgctacgcccaagcaggccaagggcgccgtgcccattggatcagagacggcggcagcgcttgcaggccgggcggtggagaagaaggcgagtttggcgcggacacctgttgctcgccggccgatgcttgttaagtctggatcagtggatgcggctgccccaaatgacacagttgttgctgtccaagagtcagatgaaaatacggacaaaccattgaaacaaacacagccagggaaaacagaggatgatgtgcactccaccacatcaagtaccaatactccccgtgcagcagctcgtaagagtgctgctgctgctgctgctggttttagtttcagattggaggagcgtgctgagaagagaaaggagttcttccaaaagcttgaagaaaaaatccatgcgaaggagctggaaaaaacaaatttgcaggagaaatctaaggagagccaagaggctgagatcaaactactgaggaagagcctaacatttaaagccacacctatgccaagcttttacaaggagcagccacccaaagttgagttgaaaaagattcccccaacacgtgccaggtcaccaaggctcggccggcacaaggcagccagttctgctactgctcctgctcctgcagatggttttgtatccatgtgggagcccacggagcactgcaaattcgggcaaggtaaatgaaatcatggagaacatcaaacctcgtgtccctgctagaaaatctattcagaggccagtcacgaaaactccattgcaagtgtctgccaccacaaaggctgaaccaagacccatagctacaaagccgaaaatcgcaaactcgaaacctaaggtttc

SEQ ID NO: 10510 - DNA, 2814 bp, Zea mays
gccggccgggctggaccgcactcggcactccactctcctccccctgaccccgagttgagtccactctgctgtccgctcacaccaactcctccgctccccctccacccaccccgccccgcgccgcccatcagtgggtgggtgggtggttcgcctcctcatcctctcctccccgcacgtccacggcgatggcgcccgcgcccccgcactgctgacccacccccgccgcgcactctcatgaccgtggtttggtaggtggggcggaggttggtaggccgggacgtgccggcaggcggttacgggaggcgcggccgcgatcccgggccggatctggacgccgcgatggaggacgccgttgccgctgagaatgggatcgagggggagggctacgtcgtcgtcaaggcggcggcggccgcggaggcggagggggactccggcgccagcgatcgtggggatctcgccgcccccgctgaggacgcggcgccggccggatctgaggacgccccggccccggcggtgacgccggacgagaccgcggcacctgccaaggcgccggccaagaagggtggatccggggacgccgccggggtccggaaggcgaggccgcagaacggcagggtgcccgccgccgccgccaccgccgcgccgagggtgaagaagcccggggtcctctcgcagagcgcctccttcccggcgcggggtgccgccgccaagaaggcctcggcggttgctactcccaagcaggccaagggcgtcgtgaccaatggatcagaggcggcagcaggccgggcagccgagaagaaggcgaattcagcgcggacacctgtcgctcgccggtcgatgcctgtcaagtctggatcagcggatgcggccgccccaaatgacgcaattcccgctgtccaagagccacatgaaaacaccgacaagccattgaaacaaatgcagccagggaaaacagaggatgatgtgcgctccaccacatcaagtaccaatactccgcgtgcagcagctcgcaagagtgctgctgttgctgctggttttagtttcagattggaggagcgtgctgagaagagaaaggagttcttccaaaagcttgaagagaaaatccacgcaaaggagctggaaaaaacaaatctgcaggagaaatctaaggagagccaagaggctgagatcaaactgctgaggaagagcctaacatttaaagccacacctatgccaagcttttacaaggagcagccacccaaagttgagttgaaaaagattcccccaacacgcgctaggtcgccaaagctcggccggcacaagccagccaattctgccactgctgcttctgcggatggttctgtatcatgtgagagcccacggagcactgcaaattcgagcaaggtaaatgaagcgatggaaaacaacaaacctcatgcccctgctagaaaacctgttcagaggccagtcgtgaaagctccatcacaggcgtctgcgaccacaaaggctgaagcaagacccgtggtcacaaggccaaagatctcaaactcgaaacctaaggcttcaagggcaaaggttgcgcgagcgcaagaaaccccagctgaagcccctccttcagaacctgctgctccagaagatttcacggttgaacatggcgttggagacgccacaggtcctgatctgaccgcgcaattggttgcttcgaacgaagtcccagtccatggttgatcagctgagcattttgcatatttattcccttcttgcagttctgtgaatagcgagggtgtgtgcttcattggaagttgaatcgctcgaagtgtcatggtttatcgtttccggagtagacatccattttgtttttcagcttgtcatcgggcatgccatgtatattgcttggtattgtgttcttgtttaaaatttccagtcttgtgtatattggatttgtttgtcgctggagatcctaggattgttgcaatacgctgaggcaaattgtggattgttttgtggctgttttacttttagccccgccgccattcttgttggttgtacatacttaggggctgtttcgttgtatacttgaggtgccagagaattttgccacactaccacatgtcattcatgagtgaggtctccatagctggagaaaatcttgccacaattgtggttacaaaccatacacgtgtctaaattgaccaaacctatctaatcttaggcaactttagtctttttgctctaagaccataaatggctagggcctgcttggatccatacacttttagctgaactttagcacttagagaaccaaacatgagtgctaaaagtgatgtgctaaattttagcactcattggcctgttagctcttccaagtgtgctaaaatgagttaaaagttgtctagtaggagaaaaagacatttatcttcctcaccctactctctctcccttatccatgtgctaaattttaactctccatttgagagggctaaattttagcacatatgatccaaacatgtccttattataaaaaggtgccttttgtgatgacatcacgaactagttcccaaccaattatcccaagaccacaaatgtttgatatggttagtacttgatgttttgcattaataagaggttgatgatggtgttggtgagggtttacaagagatgatttgttgttagtcttatgccctatttggattcatggtgctaaagtttagcactacacttttagatagattttagcatttataaattcaaatgtgagtgctaaaagtgaagtgttaaactttagctccccttagcaattcatgttctctaagggggtgtttggatcccatgtgc

SEQ ID NO: 10511 - DNA, 2703 bp, Zea mays
gcccccccggctccttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcaacggattttgaggttgatggcatcgacaacctcagcgagaacgatgtcagcgactaggagatcgatgctgacgagctcgcccgacgaatgtggaaggacaaggtcaagctaaagaggatcagggagaggcagcagaagcttgccctgcagcggctggagctggagaagaccaagacaaagaagatttcagaccaagccctccggaagaagatgacgagggcccaggacgggatcctcaagtacatgctcaagctgatggaggtgtgcaatgcccgagggttcgtgtacgggatcattcctgagaaaggtaagcctgtcagtggtgcgtccgataacatcagggcctggtggaaggacaaggtgaagtttgacaagaatgggccagcagcgatcgtgaaatacgagcttgagaactcgatgctgagcaaccctaagggcggcggagccatggaccagcatagcttgatggacctccaagacggcactctgggctcattgctttcagcgctgatgcaacactgcagcccgcagcagcgaagctatccattggataagggtgtcccgcccccttggtggccaacagggaacgagtcgtggtggcctgcgttgggcctcccaaagggagaagcgcctccgtacaggaaaccgcatgacctgaagaaggtttggaaagttggtgtcctgacgggcgtgatcaagcacatggccccaaacttcgataagatcaggaaccgtgtaaggaagtcgaagtgtctgcaggacaaaatgactgcaaaggagagcctcatctggcttggtgttctacaacgcgaggagaagtctgttcacggctttggcagtgctttactacagaatgctcggcatagtagcacttcagaggacagaaacgagggcatatatagcagcagtgacgagtatgatgtcgaccgcctcgagcagcctcctcgttccacatcatccaaagaggacgagggagacgctcagcctgtcttgcagattagaggggagcagacctcaactagaggaactaataagagaaggcgccatgacacatcctccaaccaactagctattagcaaggaagagatgagtaaatctaaatctcaacagcggaaaggcccctcaacccgccctcctgttgccgaggttgaggttgaagtgacacaaagaaacgacaagacgccagaagtagtgtgcagtgcagctggtggtgatatgaactttatcgacccaattgatgcggtgggcattactaacctgccaatgagccctaaacatgtcccccctacaattggagctttgcagcagcacggagattgtcgagggaattttctatctcctgctgctgccatcaactacaacagcagcaacagcaaccaggcagcaagtgctgctcaatcaaacacttatctgggaggccatcctctggcttgtgaaggcagtgatattgccaactcatggtccggacactcatttcagcaggatgttggtcttgggcctcctattggttttgatccttcaccagttgctcaccagggttcggcagtgcagcagccactgccactgccacttccacttcctatggatcaccaagcgcctatcacgggatcaggagctctcgccacgaacggctcttacagtctcccgacagcaggcggtgtgagttctgggacaatcgtcagcgagacccaccagcagctcatggacaaccctttcttcggcgacgccggagacagctcttttggcggtcttcctttcagcctccttcctttcagtagtccgatgcttaacttcgatgaattggatgagttggtggacgacgacgacttgatgcagtacctcggcacataacacaggtagtttgtcttcaaatagccacttctttggttgcctacaacctctcttgtgtggatttgcaagtaaaatgtagtgtttctttttttgcttcgtgtcatatacctgtgtctgaacctacctaccgggccggttctcatgtttgcagtgtgtccaatgaatgtgctcggtgcagcctgttaggctttttcggggagagtttggtaacatgctgatggagcggcgggatgttgatgtagctgcagctcgtgacccattcatttgtggcaccgtcctgagaaggccattgcttttgtaatataccaacccccgaataatgtagtttagggtgctctcttgcctggactggatgttaaatggcattgccgtcgtaagcagggaacttgtagcctgtagagcaagttagcaattcgtggcctcgtgggcatcatgatgttggcggagaattaccgcacccgtttaaaggattttattttttttatttattgccgtatacccggatttttagatataggtgatttaacgagtctggtatcag

SEQ ID NO: 10512 - DNA, 5700 bp, Zea mays
tggcttcatcattgattcctgaataatgggcaagaaatcatcaatgactgcactcacaatatcacaaatgaaacaaaaacagccttctcagatattttttgccttttggtactgatttgtacacccaagaagtgtgctaataattccgtcatctaaatagatatacgtaggtagaagaaaactttgatgtactcttctactatataatcatgtgtgtttttaggtttagaacttgcatattatgacaaactgtaacgaaaactacatcacaaaagaagaaaacatataaggagaagaaaaaagcatgaataacaaatgaaagtagtgaggaaatcaagatatgagaaaatttcagtgaatcgcggtgagagtctgaccaccgaatgctcccatctttattaggattccatttatctgtttcttaccattgctaccaagtttatcattttttttgtcccgtgaattctcaagataccaacctgctctgttggaccagcacaaccaaccaaccaatttagaatatgtagaattaatgaactcctagtacagtacttcgcatcaaccgatattcataacacaaacagaacactgaactacatcgtgcagtgaaacagaaaacataccagtagttgtgactaagagtgtgccatctgcaaagcagatagaaaccacataagacaaaggaagatgaacgaaaaacaagaattactccatttctgttgtccaagtcattgtcagttgtcactcaaaagttggtactccatctgaagattcatttaaaactatggccgttaaggacagtgtaagtaaagaacatttgaccaccttaccatcgaacaatctttaattctggatgtattaacattattataaacgaatgtcaagtcgtaatcactaatcgcattgatctggacgagcaggtgagcatcacagtgatcacataccccatctctctacgggaatctcacgcgccagggcgtcgagctccaggaactcctccagtttgctccccacccccgtgtccgaaactgcgatagtccaccaaatgtttgcgttaaactaatgttacacggcaacgtaataatcggaattaaggatggaacgccgccgcagactttgttaccggagacgcgcagcggcggggagctggcgggttcggcggggcgcttgagggagaccgtgagccggcacggcaactccgacatccggcagcgctgcaccgcccagtacaccagctgaaacagaggcgcggaaaattctgttaggaggtgtagtttggaattgagatcggaaatgggaggggtttatcgggtgcggggcagagagaggtttacggagtggagcaacttccggtggggagaggaggttgacgccatggttaggttgagcgacaacgcccggtgcttcggctggcggagcagattacaaaaagaaagctatggatcgttgagccggtcgccggaattccgccgccgtatcggcgcgcgccaacctcgccgctcccgtctccccggaatttctccccctggaagaggacggacaccaggatgggccgtgaacgtctgaacgaattgcggtagatgggctgacagaaaagcccaatgcatggaaggtcggcccagtataattggcgagctcggcaggtggaccgtggatcttgtgctccaatccaactgagaggtatgtgtagcccaagagtcgtttaggaccgctagagaacacagtaattttgtatggatatcagaatttctggaatttcacaaaaacataaggtaaaaaaattctcgcgtttcaaaccggatatgggccggatagacgtgatcggacgtcacatgggccggccgcgaataaaaaaaagaacgggacaagtcgacgttataataaaaaaaatactaataagaggttgacatgtgggctcgggacatgcggggtctacgtgtcagcgtcccggtcacagaatcacatcttcctggccgccatccgccggacggagcaccggacccgccgtacgcctccgtgctctcgctcgccgaggcctctccgcgggccgcagcgcggttccgcctcggtggccgccggagctgctgcctggccacaagaagccgtcgctctcccagctttgaaccggttccgatccgcaccacggagaagcccccgcctcgggagtctcgcgtcgccccgatgaaggtggagctcgccgcgcagcctcccagacgagcacgcccctgccgccgtcccctgaagccgcttctgcgtcgcccctggcggaggatgcgctgctccttcccgacgcgggcgtgcggcgccgggcggcgtgcgggcggttcgcgcagcgcagcggctccttccgccgcgaagtcggccgggccgccgccgagaccttcctcctcacgaggctcaccctgatcctcctccgctacctcgggtacgcatcaactccgctgctctgaaactagtgtactgcaacctctacttggacttggacagtttcgcctgtgcattgcttgctctcctggtacacctacgtgctcaatgtcatttgcaaatttgtatgcgcagaaagaatgtatgtgttgaaaaaaaaacgggacaatttgtgtgaccttccatatttatcatcaatctaagtgatatattctagatataagttgattggaagcgtgttcagacggccttgtacgagactacatgcttttggtcagtttattgtaataacttgttaaatttatgcaggataggctacagatggattcggcagttcctagccctctgctgttataccctcttgctgatgccaggttttattcaaggttggcgttgctccagatttgccattgttttcttatctgcttagaattgtactcatacactgcacctgactgtgctactaccttaatggattttgctctactccagttgtatattattatttcttctctagccaagttcatagaagtgttgtatatggagatcagccaagaaacaggtactttatttgattctactaccattaactaatatttctgcttgataaaccatgcaattaagttttattgcagattggacctgtatatgcccactagtacaacagggttaaagccggtcgttgcgtttgtgactggtggagcgtggatcatagggtgagtggaagtatgtactatcttgaacccctaaccattttttgatattcttgctattgcaaagtctgattctgccttgactcaatgactctgcatatcaaattgtatatttctcagttacaaagggtggggagcccttttaggcagacgcttagcagaaaggggcatcatagttgcatgcattgattacaggtactctgaatgtatttccaattatgcaaagcagcataatcattcaggccattgtcactgaggatgtaaatgctttgttttcagaaactttcctcaagggactattggtgacatggtagaagatgcttctcaaggaatagcttttgtctgcaagaatataacaagttatggaggtgatcctagcaggtttatagcctatccttgtgtgcatatttgcttacaataaaaaactgaaatagttcttggctcttgctttttttccaaaatatttatgttcctaaaagaaacatgcagtgtataaaaaaaactgaatgcaaaatacctctgttctgagatgatatatttaaagtacttgttcttacatatgcaggatatatcttgttggacaatcagctggtgcacatattgctgcttgtgctctcttaaatcaggccattagagaatccggtgaaggagatacttccccttggagtgtatcacagctaaaagcttactttggtatttctggcgggtaaaacattcatgtctcttaatattatatagcttacagaacaaaaaaaatgctatttctatttgaatttgtgcatagtgtcagttgtcacgggtctaaatagcattggtgggtcactgaggtgttgggcccaaaacggaccaggcctaatgtgaaccctgaaccatacccatggctcatgggtacaatagatcagcataaaacccatctaggtctaggattagggaaagtccaggagataggattgcttgtaagtcaagtcgagtcaggttggatcctccctataagtataacggaagatgtatgtgtgttgagattaagcaagaataatctagaggaaaccttcaacctctctcccctcttctctctcaagccccgacggccacaccacccaccatgacagcctccccctgctgctgccccctccctttaatctccctaattcccctaattgtacctccaatccttctcccaagtgcctcaatagtagatctgttacatcagtagatttttctaatatttgcagccctgccaattagagtaggtttctagctgtaatctatatgtcattgtgaagtggagagactatatgactactctacattcagttgatgaatttagccttttcagtagtgagtgggatgacaacttataagatccttttatacaatgctataaattatggacctttaagcactgtactttagcatttattcatgtgccgctcattagattgaatagaagacagtgttctgtacagacaaaaaatgaatcagttggtgaaacgggcttcaactttttgtgtatgatctttacaggtacaacctccttaacttggttgatcattttcatagacgtggcctttaccggtctatctttctcaggttcactgttagtatttgttcatgtcttgtaataaaatcgtgatcctgtgagtgtattatgacttcattttgatcatatccttgcagtatcatggaaggtgaagtatcactccagaaattctctccacaaatgatgattatggagtcatctgctaggtctgcagtttctttattgcctcgcatcatccttttccacggaacaagtgattattcaatacctccagctgaaaggtgtgtcacaaagtttacatttatttaacattgtgtattgtagatccattttgtttctgttttacacggttaaggtactgttaggatattaaataaaataaaataaaaggggacatttgtgtgtgcaagcagtagaggtagaggacagttaactagttaactcttgcttcttatgtttatcccacttttaaagctgtccttttcaaatccattgtttggaatcacttcaatatgtaaaccttttgtcataaggtacgctgtattaatttgatttttaattcaaaaatgcagccaagcatttgctgatgctttacaacagcaaggcgcaagggcagatctatttctgtacgaagggaagacgcatactgatttgttccttcaggtagccatcgtgcagaagtgctattcgggttttctttattttcaaaatcgatagtaatggtaattttgaactcagcacagtcttgctttgtggaggacccttcctttttcttggccccaagtgattgtaagttgctttcgtcactgtttttgcagcaactaattaatgttgtgcgcaggatcctcttcggggcggcagagataaaatgctggaagagatcgcccgtgtgatacacagtgaggatccagacgctgctgcccccccccccgtcgttgtgcctgttgcaaggcgccttgtagccgagttcatgctgaagcttgctgggagagtaagccctttctgaaggtgcttctaagtttg

SEQ ID NO: 10513 - DNA, 1447 bp, Zea mays
  misc_feature (39)..(40): n is a, c, g, or t
actcatttagggattgctggtgcgcctggcccgcgcagnnccggaagaaccaagccgtccgggccgcgcagacctccctgacgagcacgcccctgccgccgtcccctgaagccgcttctgcgtcgcccccggcggaagatgcgccgctcctccccgacgccggcgtgcggcgccgggcggcgtgcgggcggttcgcgcagcgcagcggctccttccgccgcgaagtcggccgggccgccgccgagaccttcctcctcacgaggctcaccctgatcctcctccgctacctcgggctacagatggattcggcagttcctagccctctgctgttataccctcttgctgatgccaggttttattcaagttgtatattattatttcttctctagccaagttcatagaagtgttgtatatggagatcagccaagaaacagattggacctgtatatgcccactagtacaacagggttaaagccggtcgttgcgtttgtgactggtggagcgtggatcataggttacaaagggtggggagcccttttaggcagacgcttagcagaaaggggcatcatagttgcatgcattgattacagaaactttcctcaagggactattggtgacatggtagaagatgcttctcaaggaatagcttttgtctgcaagaatataacaagttatggaggtgatcctagcaggatatatcttggtggacaatcagctggtgcacatattgctgcttgtgctctcttaaatcaggccgtcccagcgtccggtgaaggagatacttcctcttggagtgtatcacagctaaaagcttactttggtatttctggcgggtacaacctccttaacttggttgatcattttcatagacggggccgtgaccgctctttgttcctcagcttccagtatcatggaaggtgaagtatcactccagaaattctctccacaaatgatgattatggagtcatctgctaggtctgcagtttctttattgcctcgcatcatccttttccacggaacaagtgattattcaatacctccagctgaaagccaagcatttgctgatgctttacaacagcaaggcgcaagggcagatctatttctgtacgaagggaagacgcatactgatttgttccttcaggatcctcttcggggcggcagagataaaatgctggaagagatcgcccgtgtgatacacagtgaggatccagacgctgctgcccagcacctcgtcgttgtgcctgttgcaaggcgccttgtacccgagttcatgctgaagcttgctgggagagtaagccctttctgaaggtgcttctaagtttgattgcgaccacgactgactagtatttgtgaattttctttttttatcttaagacaaacatggatgtacatgtacttgtgatcggagaaagtactcataattttctagacaaaaaaaaaaaaaaaa

SEQ ID NO: 10514 - DNA, 1167 bp, Zea mays
caggggcccccccggggccgcccggaagtgaaaatacccgttgggctcggctcgcgcggcgccgtcctctcccactctctacgcacgaacacagcacgcgccgcaccccgctctctctctcctgcgttcccatctgccatctgcggcggcggggagtgagcacattgaggacggtctactcctcgttcgcgtgcggttcgtcccgagcgatccggcaaccatgaacatcttcaagaagaaggtcgaccccaaagaggctctcaggaccagcaaacgtgaaatggcggtcgccacgcggggagttgagagagagattggttccctgcaaatggaggagaaaaggctggttgcagagataaagaagactgccaagactggaaatgaggctgcaaccaaaatattagctcggcaacttgtcaggctgaggcaacaaatcctcaatttgcaaggcacacgggcacagattcgtggagtagctactcacacacaggcaatgtatgctggcacttcaatctctgctggaatgaaaggtgcaagcaaagctatgtcagcaatgaacaagcaaatggaaccggcaaaacagataaaggtcatgaaagaattccagaaacaatcaacacagttggacatgacgcttgagatgatgtctgatgctattgatgaaacacttgacaaagatgaggcggaggaggaaacagaagagcttacaaaccaggtccttgacgagattggcgtcgatgtggcttctcagctctcttcggctcctaaagggcgcatcggagctactaacaagaaagtcgataacggtcaagcacgtcctgcaaggaacgtggcggctcctgctctagaaccctcctctgctgaagttgaggatctggagaggcgactggcatctctgcgccgtatctgagtctgagctgttgaagaaagaacttgtttgtaatactagcagttattcatctatatatgtaaagttggtttatatgtgtagggaaaacagcgagctgcacatgatacggttgaacctacctaatgttttatttaatttggaagttgactgcacagtaaccctagtcgctagtcccattagccgacggaactaggcgaagccagggctgatcaacaatacgaagggtgtttcgtatgttttttatactaattttcagc

SEQ ID NO: 10515 - DNA, 1055 bp, Zea mays
ccggccggggacaagtgaaaatacccgttgggctcggctcgcgcggcgccgtcctctcccactctctacgcacgaacacagcacgcgccgcaccccgctctctctctcctgcgttcccatctgcggcggggagtgagcacattgaggacggtctactcctcgttcgcgtgcggttcgtcccgagcgatccggcaaccatgaacatcttcaagaagaaggtcgaccccaaagaggctctcaggaccagcaaacgtgaaatggcggtcgccacgcggggagttgagagagagattggttccctgcaaatggaggagaaaaagctggttgcagagataaagaagactgccaagactggaaatgaggctgcaaccaaaatattagctcggcaacttgtcaggctgaggcaacaaatcctcaatttgcaaggcacacgggcacagattcgtggagtagctactcacacacaggcaatgtatgctggcacttcaatctctgctggaatgaaaggtgcaagcaaagctatgtcagcaatgaacaagcaaatggaaccggcgaaacagataaaggtcatgaaagaattccagaaacaatcaacacagttggacatgacgcttgagatgatgtctgatgctattgatgaaacacttgacaaagatgaggcggaggaggaaacagaagagcttacaaaccaggtccttgacgagattggcgtcgatgtggcttctcagctctcttcggctcctaaagggcgcatcggagctactaacaagaaagtcgataacggtcaagcacgtcctgcaaggaacgtggcggctcctgctctagaaccctcctctgctgaagttgaggatctggagaggcgactggcatctctgcgccgtacctgagtctgagctgttgaagaaagaacttgtttgtaatactagcagttattcatctatatatgtaaaggtggtttatatgtgtagggaaaacagcgagctgcacatgatacggttgaacctacctaatgttttattcaaaaaaaaaaaaaaagtacctgcccgggcggccgg

SEQ ID NO: 10516 - DNA, 2058 bp, Zea mays
cactcagatcattagaatcaaagtcacttgggatgcaattcagctagacttatcaatttgtaacatacaagcaattgatttgtaggagccaatcaatagcctcattaaaacaatcaacttgaaaatgatgctggttggcaattccattttttttggtatagtcggatcaatataagcctcctccgtttactacttggaaatatcatgtttgctacaaaatacatacacttccccaagtactttttccccgccatcggcaatctcttattaaaatggctccaagtagatctcacaattttgggattcgtggagcacccgtacttatggttagtttgggaactccatttttccaattagatttctatttttctaaagaaaaatgaactaattttccttaagaaaatagaaatcctttggaaaaatatggttcccaaattagtacttattgtttgattttctagtctgggtttttctttctaaaacacttcacggacacttggtttagttccctcttgataaaaatcacactaaagcttttgccatcttttattaggaaaaataattacctatgtgttgtaattatgttattgctttagggcttatttgttttacctttaatacatgtggattgactgatattgagtcggtttaaaaccatagcaagtcaaaatctatctcaactcattctaatacacttcaatccatatggaattggaataatcgaacaaggtcttaggccttgttcgtttgtgccggattagtgagtcggaacgattcctaaccggattgcttctctaatttatataaacttcgattagctggaacgatttcgggtccaatccgacacaaacgagcaagaccttaaccttaaatgggtgaccggatttaccctgaaatgatgaatatgaagttgattagacacttgccactaaataaggcacataattatcaaagtttagagcctgtttaagggatgtttggtttctaagaactaatttttagtatctctattttattttattttattttagttcctaaattatcaaatacgaaaactaaaaaattattttagttcttatatttagtaatttagggattaaaataaaataaaataatttagagcctaaaataaaataaaatgaagaaatcaaaaattagtttatagaaactaaacaccctttaaaatgttcacatttttcacgcgcccaaaaaaaccagagatgttttcagtcaatttaaaaacaaaaaacaaaaacaaaatacgagagtatggataggacttcgaaggtaaacccccgctccacctccacctcagtttcccactcagagctccaatggccgccgctctcccgcactcccgcctccacctcccgctccacacgcccagtcccacctcccgccgccgcccctgcccccgttcccgccgccgccttccctccttcgtcgccgtctcgcgcctccagaacaccaccgccgcgacccacccggtcctcccgcccccggctccgcccccctccgccgcgctcctcgccgccgagggcgcctccctcgcgccgcgccgagagcaccgcttcccaggctcggtctcctccccaacaagcaccgcctctgcctctaacgaggcggagtacgccgtcctgcttcgcgccctccaggtgcgccgcgccgtcgccgccgaggtgctcgttgccgcgctcggcggcgggaaggtcggcggcctgacctacatcaagaacctcacggggcggatggggccgtttgtggaccgcgttgttgtcgaggccgcagcggatgcaggcgggaccgccctgagctcgcccacatgtccttcaacgcccgtgcaaaggcgtacattccaggagtccgggcctttgtggagctttggtcaaagtgttgcccgcccctttgcttcttccatatatttcttcgaattatgtctgttcagtatgcagtatgcacaataattgtgattattcaaccatcagaaacattgcaaatcataaaactgtggctagttacctgatcagtattgaggttactacattgcctacttcaggt

SEQ ID NO: 10517 - DNA, 4144 bp, Zea mays
  misc_feature (44)..(44): n is a, c, g, or t
  misc_feature (3227)..(3227): n is a, c, g, or t
ggaatagagtagtgctgggagtttaatttagtgggtcgaggtangtagctgaagaccaaacaaacacgctggagagagcatggaggcaggggcagggaggagagggatcccctcgctgctgaaaccgccggcggcgcgggctgatgaatccggaggagccacttcgccgcagcaggagcacatcgcctccgatattacccagcttgtaggatggacgccactggtagagctgaagagaatagcccagaaggacaacgtcgacgcccgagtcgtcggcaagctggagtgctaccagcccctctgctccgtcaaggaccgcagcgctctgagaatgatcgaggacgcagaggagagagggctgatctcgcctggcgccacgacgctggtcgagccgacgagcggcaacatgggcatagccctggcgtacatcgctctggcccgaggctacaggttcgtcgcggtcatgcccgccgagtactcgctcgacaagcagatcctgctgcggtacctgggggcagatttggtgttaaccgatcctgcgcttggcttccagggacagctcgacaagctggagcagctcaggaaagaaatacccaacgcgcacgttcttgaccagttcgcaaacgcggcgaaccctgaagcgcactttagatggactggtagtaccgatctttgcacaggagcatctgatctcatgcctgagatctggaaggatacggcaggcaaagtcgacatcttcgtggccggctccggcacgggaggcacggtctctggcgtcggcaggctcacgggctcacggtcaccgcgtggtcggcggctggacaacgaccagtcggcggctggacaacaacgagtcgacggtcggcggctggacaacgacgagtcggcggccggcggctggacaacctgcgagtcggcgagtcggcggctggacttcgggcgccggtggggcgaggggcctgcgacctacggcagtgctccggccgtccggcggtccggcctccgtgctccgggcgagcggcgctgcgagctccagcggtgctccggggtctgggcgtgggcggctccacctccacggctggcggcggctggagctggagggtataggatagaggaaggatgttcacggggctgggcgcggctggagtgggctgtcgcgcggcgatggacctattcgttttagtgggccgcgaccgggctgcagcccaggcagccccggtcggagatccgccactgtacttgaagacgaagaacccggcggtgaaggtcgtctgcgttgagcctgctgagagcccagtcatttcaggcggcaagccttctcggcacaagatccagggcgtcgggccgggattcgtgcccaagaacctggacacctctgtcaccgacgagatcgttacggtgaccgcagaagatgcgatggcgaacgccaggaggttggccagggaagagggtctgctagtgggcatatcgtctggggcgaatctggcagcttgcctcaaggtggcgtcgagacaggagaaccgagggaagatgatcgtcaccgtgtttcctagcggtggcgagaggtacatgagctccgatctcttcgcggatgcaagggaggagtgcgtcgccatgaccttctgatcttctggacgctctgtgcggatctgcagcggcaaactgctatttctcagcgtggaatggatttttagtatcgtcgatccaatccagcagcttgcggaggcagaagatttggaatccttctggcagaaaatttactgcgcatttgcgttccattggcaggaaagactctgtacatgctcttgggctcttggctaaggacctttacagctttccttatttcttcttggcacagaaatttcagcagagaattgtaccacgagctataaactgagagatgccaatcagtatctcgttgagaaataaccacctggcctctgaataaacaaccatttcatttcctcttcttcttctaaaagtgctgcgggccacgctgtcgacgagcaacggaagcctacttccgagttccgagcaactattctatgacgatccgtctagcgtttctttagtttcttaaccacacttgttcagttagcaaagtagctctttgacgtgaacactagtgaagcatagccatttgtccaaacaagattatagagtagccacggcccacggagctttttgctgtgggcgcactccacgggcgtgacttcgccacaatcggatcccgccgtcggacttcgctacaaccggacggagacagccatacgctcgctcgtttcgaactgtttacacgtgaggcaaacaaacgcggacgctgctcacggcacatgacttttctacccctgctcggcattctcacttttctgccctgctcctagcgacagggcctgtctgttctccttccgccgcaccacaaaacctccatggatgagccgtctcccctagagttggccgacggagatgcagtcctatggctcccagagccggccgccgtagatctagctccgcagctcccagatgaggtggatgtggaaccagacggagtggatccggcatccccgctgctcgtcgttagccccagcctcgtcgtggatcctgccccaccactccctctcgattgcaaggtggatcgacacagagatgaccccttccagcccgccgtggagacgacgcttgccttccagtctgacacggagaggatcctgctactgcgttctctgtccatccccaggacacaggtgagtttcgagtttcgtttatgtagtcttacattattgatagagataaaatgccaattgatagagaaaattgaaatcgaacctagatgggatgaggaaggaacagagggagttgctagtgaacatgggttgtatgttaaactaggactgcaaaaggaggatgaaaaggggaaaaaggttagagaatctagagctaaaaagagaggtgtcggcacctttgaaaatgaatatattgacgatcatgaagggatggcttatcttgagcatataccagaagacagggctatcgtgtatgactggacgaatccagtgatgaaagttggtgccttgtatccaaatatgtcagtgtttcgacttgctgtgcgacactatgcaattatgaaagagtttgagctaggcatcgagactacttctacctctcgatatagagggttatgtatgggtgatgattgtccctggagacttcatgcagtgttggaagtnccaggatcagcaactatcattgtatttaatttcttcctatattatctatatctccctttcatactccttttttagtacgttgagctatttgatttacttgatttggttattctttccaggtgacagcgatgacagatcggcatacttgtacttcaagtgccaggagaaggaccaccactcccactagctcgtgggttgctggactagctcttccaatcttgatgaagaaaccaaacatgggtgccaaagagttacaaaaagagttgcaagacaaatggaaatgtaccatttcctatgacaccgtttggaagggaagagaaaaggcctttcttgatttgcatggtgcttgggaggacagctttcgactattatttagttggaaggaggcggttttggaaaaaatgccagatagtgttattgagattgatgttcaagaagaggatggaaaggtgtttttcagtaggtttttctgtgcttttggaccatgcataaaagggtttcttcaaggatgcagaccatatctgagtgttgattcgacagctttgaacggtaacagacaccactcgccttgtctcatgcattggaagacgccggttcatcgcagccttctgcaagggtagctgagtcccctccaaggcaaactaggatagctgtacgcaaaatgacaccgaagaagaagaaaatttcgtccatgatttaaattgtagttgtatgatttggaatgtagttgtacggtttgaattattgttctatggtcactttgaatactgtgtgatttcaatatccaaactgcagccagacaaaactgcaattgtggacagaaatgttcttcttcttgctcactgtttggacaaaactgctatgttttttctaataatctagattcattcatggttgggcaaaaaaaaaaaaaaaaa

SEQ ID NO: 10518 - DNA, 1583 bp, Zea mays
tccctcctggctcggctcctgctgccagcttcacacgtgccgtacgcacgcacgcacgcaacagttcgatgtgtttatcgatctgctgcttgctctctctgcatttatgtacgtgcatatgtttaggaacagaagaagatccatggaaaccgtatccagccaatcctccattcccgccgccgatttgctcttgattttattcccttttttttgcgaagccaaacaccccaccccccccccccccccaacagagtctattcattcacagtaacagaaaaacagcacatgatatacaaaggattatcaaagatgacgcgataagtctgcaatcttccccaccttttcagttccatgccgtgtcgctgtcgatcgtctgtgtctctccgggctccggtcccaggatgagatagatcttctggtcatggtggccgcagccagcccacacccttttccccccctgaccactacccctgggggcacgcccagcgtgattcccctgttctcctcccggtttcgctcgcccccttgttcctcttccagctgctcatctgtcagccgttgcttgctcccgcgatcttcctctaccacacccacacacactccctagccctagcgaaagcatcaaacacgctgttcggcgctgtcgttgcaaggtttggggttcttgctcgaaacgcagccctacccggcgacctattaatccctccctccttcccctgtatcggtctgtttcctttctcctcctcctcctccaaaagcagctcctttctcgggggtccggccacttccaggagttcttgcctgcgaagcttgctccgttctttcgcctgcttgccctcactcctctatcgccttggcctgcttattgcccagacagtttctgcttgaccccacgattcttcactgatgattcacagaaagcttggcgagcacgtacataacttgccgatcggacagttgatggacggcacgagcccaaaccgtacaagtccacaataatttctccctccggctccggctccgcctagactcactcgtccatgtcgcgcgccggccgctccctgcccctgcccgtggcggcgctcctgctcgcggtggtggcgctgtgcgcggcgcggcgcgcgcgcgcgatcggcgtgaactggggcacgcagctgagccacccgctgccggcgagcacggtggtgcggatgctgcaggacaacggcttcgacagggtgaagctgttcgaggccgaggacgccatcctgggcgcgctcaggggctccggcctccaggtcatggtgggcatccccaacgacatgctcgccggcctggccgccggcggcaaggccgccgccgactgggtcgccaagaacgtctccgggcacgtccgcgacggcgtcgacataaggtgggtcacgccgcgcgccactgctgctgctgctgcttcgttacattattacatacttctccggttctgccttattatatcaattactaggagtattacatctgcttcagatacgcatcctactactaatttgaaaatctttgatcataaatctatacctttatatatatcattcatcaggttaaacttt

SEQ ID NO: 10519 - DNA, 519 bp, Zea mays
gattattgatttacacccttctcttctcatcaaatggcgcaggcggcgtggtctacgtgttctggactcccctccgaccccctgacgatagcgtctaagatggccacaaccagatccgcgtccctgctcgcgctgctcctcctggtctctgcgaccgccgccgctgccgggacgagcaagggccgcgcgggggtgcggccgtgccaggatctggcgacgcggggccagtgcgcggcgagcggcgggtgccggtggtgccgcagcgaggcgctcgacgacatgtgcttcgaggccatcgaggcgtggcgccttccgcgccaggtgttctcctgcgacccaccctccggcgccgcccacgcccgcttcaactgaagtaatgccgcggccggccgccggcgaagctctgctatcgccttggtcgggatcgctcgatctgatctcgtttgtcgccgggcctcggttgttttcttcgctggatctgagatatacaatagcgtgtttcctgctactgcctgcctc

SEQ ID NO: 10520 - DNA, 656 bp, Zea mays
gtggaagatatcagaagaaacataacagaataatatgatagcggcggcgcggtctacgcgttctggactcccctctgaccccctgacgatagcgtcgaagatgtccacaaccagatccgcgtccctgctcgcgctgctcctcctggtctctgcgaccgccgccgctgccgggacgagcaagggccgcgcgggggtgcggccgtgccaggatctggcgacgcggggccagtgcgcggcgagcggcgggtgccggtggtgccgcagcgaggcgctcgacgacatgtgcttcgaggccatcgaggcgtggcgccttccgcgccaggtgttctcctgcgacccaccctccggtgccgcccacgcccgcttgaactgaagtaatgccgcggccggccgccggcgaagctatgttatgctatcgccttggtcgggatcgctcgatctgatctcgtttgtcgccaggcctccgttgttttctttgctggatctgagatatacaatagcgtgtttcatgctgctgcctgtctggtctgcggttctttcattcattgattgtgctgcccatcatactctcgattctcaaagtccaatggcctgtcatttgtattctcaaaattatgttaatgagcacgatcgtaccattccagaaaaaaaaaaaa

SEQ ID NO: 10521 - DNA, 927 bp, Zea mays
  misc_feature (12)..(12): n is a, c, g, or t
gcgccgacgcangctcgagaaatctcctaatttgaatgggtcaaaaaacacaaggccttgagccttccgttgtgctccgcgaggaaagcgaggaggcggccggctcggtgctgagtgctgacttgttgaccaacgggaagtccagtacccaagcggagccaccaaggaaaggaggaatggaagccaccggcgcagcctcgcagccctcggcgccgcagacaactcacccggcggtggcgccgctggccttcctactggggaagtggcgcggggaaggcgagggcagcttccccaccatatcctccttccggtacggcgaggagctcctcttctcgcatcatccctccaagccagtgatctcgtacacgcagaagacgtggaagacggcgtctggcgagccgatgcacgccgagagcgggtactggcggccccgccctgacggctccgtcgacgtggtcatcgctcagagcactggcctcgccgaggtccagaagggttcatttgatgctgaaaagaaaacagtgacactccaaagcgaactcgtagggaatgcatcaaaggtgaagcagatcacgagaacttttcaggtggcagatggggagctctcgtacgtcgttcagatggcaacgatcacaactagcctacagccacatctcaaggcccttcttaggaggatttgaagttgaccggcaaaatctcctacaacgacgtcgctgcggctaaccacaaccgagggacacctgtaatacagagcatacttctggtgattactacgtagttattagtgaatgaacttacaggttaaataaagctcattttcaaaaacagaggttccgctgataggaactaccgtatatgtaaacggcttaccattcagcccatgctccacaaatcgagattattatttttacaaaaaaaaaaaaaaaa

SEQ ID NO: 10522 - DNA, 1687 bp, Zea mays
tgccctgattttgtgctgatttgacgccaaccaccgacccacgcgacccacgggctgacgggccacaacaccggcgcagcgccagcgcatgcatttatacctctacactctacagacaccattgcgagccgcccgcgacgactttatacatccgcttcctccagtcatcaaagaaacagagcgagcctagactgtgaggaagaaaggactaccatgggcgacgtcgctgccggcgctgccgccctgagtccacccccgatgaccaaggagaccaacctcttcatgcaaatcgtcggcaacccggacggcacggtcacgcgccccgaggtccccctcgtcccggcctcagccgaagccactggcggcgtcatctccagggacgtgcccctcgacgcctccgccggcacgtacctccgcctctacctgcccgacccatcctccgcgccagccgccaagcttcccgtcgtcctctacttccacggcggcggcttcgtgatcctctccgccgccaccgtattctaccacggccactgcgaggcgatggccgccgcggtgcccgccatcgtggcgtccctcgagtaccgcctcgcgccggagcaccgcctgcccgcggcctacgaggacgccgccgcggccgtggcgtggctccgcgacggcgcgccgggggacccctgggtcgcggcgcacggcgacctctcccgctgcttcctcatgggcagcagctcgggcggcaacatggctttcttcgcggcgctccggaccggaggcctcgacctgggccccgccacggtgcgcggcctcctgctgcaccagccctacctcggcggcgtcgaccggacgccctcggaggccaggtccgtcgacgacgccatgctgccgctggaggccaacgacaggctctggagcctcgcgctgcccgtgggcgccgaccgggaccacgagttctgcaaccccgtcaaggccatggcgccggaagcccttgccggcctgccgcgctgcctggtcaccgcaacttgggcgacccgctgatcgacaggcagcgggagttcgctcggtggctgcaggaccgcggcggcgcggaggcggaggtcgtcgtgaagttggacgtcgcggggttccacgcgtcggagctgttcgtgccggagatcgccgaggtgctgttcgccgcgatgcgcgagttcgtgtacaccggcgacgcttgacacgttgaatttcgtgccggccggtgacaagtggacatacgtgttgcatcgttgtggattgtgtgaccgtgcgcaataattctcggccgtgttgaatttgaatcttgacaaactggcaccagccaccaggcggcgactactatgtaacacgtgagcactgtagcagctaccgcaacgcacctgacgtccggacgtgtagttttcgcgacgcgtgcagctatcggccacggcaacgaaaataggagatgttttgttcggatttttttttggcccgcgaccattcacagcgctatctgaaactatcttcatcacatctcttatcaaatcatctatctcatcctctatttcaaaaaaaaaaaaaaaatataaagttacatattttgtattttcacactgtactggagacagtctaatagcgttattcaacccccacactaatcccatcgtcaccccgcctccaaatccggtcaaatcagatcttccag

SEQ ID NO: 10523 - DNA, 1618 bp, Zea mays
caacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggtgagggtctggatctagcaatggcggaaaacacccacggtagtggtcgccacgtgcttggggacttgacaaatgttatttgcaagcgagcagccacatcagatctggagaagagtacaggtgggataaagatcagacggattgaaaagactgggactaggaaagagtacgatgcaaatgcaaaagctagcagtattgggaaaggaattgtatttggccatttgtttgatgatgttgccagagagaaatttcaaagccattctatctttcagaatagtagggttcaacacatagctgccgaagcagctggactcttatccaaggaagccaatgactcgaagaaccactatgcatcaatcggtccattagatctcagtgataaggagcaggattcttcacttgaatctgaagacgactatgatgatgaagataatgatgagacgaatggtgaattgctgcaccattttttcagctcagagctagctaataaaatgtcaacaaatgatggtgagtgcttgactcaggaggagatagttgggtcatctggaaatcagaaacctctgtcttcattggatgctacgacaggtggtgacttgccaatttctagtgctcagcatgcttctgtgagaactggtggtttggaagaagctgttgccccaaaatcttgtgcttgttctttctgtctcaaggctgcttttatgtggatggatctccattatcaggatgcaagaagccggctttctgtattgaagaaaagcatcaagtttgccaggtcattggaggaaaaatgtagaggaaatgaatatgcggccaatgtagctggatatgaatcaaagcgagctgtgggagtggagtttgaactatctcaacaacagagatcactctttctttatacagaaaatgcccttgtccgtgagtcaacgcagcttcattctgcttttgtgaaactgaaagaattgagagagaactgcaagacagatcttgagacgctcagcaattcttcaatgagaaaatgagtgctgcatgttgcgttgctgaactgttagtttcctgagacttagtatgatcagctggcttgtcttgaagcaagatgtgctgagattgaaccacaacttaggaattatggtgcttaccatcaatttgggacttcaatttggctgtagtgattattcctatcataaagcgttggtctagtatgcttgtagctgatgtaaaaataaccatggtaaggtaggaactgtatgtttgtctcgttgaggcatcgtcatcttcacttgtaccttgcagtgagcttccttcatatgaacattctttccacgttctccaaacaaaagggaaaaccatatcgtttcgtgctgaaaaaaaaaaaaaaaagtgcgtgccgaaatatgtattattcggcttctgagtcttcacgcttcgtatactcgtgcctgcatcaa

SEQ ID NO: 10524 - DNA, 1134 bp, Zea mays
ccggccgggctgccgcccgccttggccgcgcccgtctgccgctttcccttccactttcgtcgccggttctacgcgtgcgaagtcaccgggtcaacagcggcacctaccccgcgtcccctcctccttctacctccaaaacccaagtaggcttgccctcgcggtcgcagctagcgaaccctaatggagatcgctgaggccctgcaggcctacacgggcctcacacccgcggccgccgccaccatcctcgccctcgccctgcccgcctacctcctcgtctcctccctcttcgtcgcccccgcccccgcccccgcccccgccccactttccaagccgccccagcagcagcgcgagggggagaaggcacaggaggaggaggaggaagaaccgatgcctttcgtgtatccggaccccgtggaggtgggcgagctcacgctcgagcagctcagtgcgtatgacggcaaggacccagccaagcagatcctcattgccatccggggccaggtctacgacgtctcccgcgggaggctcttttatggccctcagggaccatattccttgtttgccgggagggatgcaacccgggccctggcattgatgtcatttgacccaaacgacctcaccggggatctggacggcctaagcgccgatgagctggaggtgttgcaagattgggaggaaaaattcaaggagaggtatccgagggtgggccaccttgcctgtcaagacgcgacagacagtggtcagaccaccgctgggcttcatcacgaggaaggggacgcctaaaactccactggtttgcctcgtcgtcctctcctctgtttttttttttttacttgctggatttcaccctgtagatctgatgtgcgcacttgtgggtgacgcagctgtcgtcgtcgtttgctgtatatgtatgtacgtgtgcggtgtgcctactgactaatgcacgcacctgctgtcccatttcttttggatctgtagcggctataaggaaattttgagcctaaaaaaaactggaggctttaggaacagcccatgttcgactcttggttgtatacgcgtgatttgtgtcatgatttgtggctttgttgttcatcaaaaaaatgaaaaaaggtcggccgtcgcgatctaaactag

SEQ ID NO: 10525 - DNA, 1616 bp, Zea mays
tgggaccctcgggccggccggtgccttagagtttagagtggcaaaaaaacatatgaaggccctctgccaattcgcttcctttcttccgcaaaatggcggacaatgccctagcaaatccaatcccctccgtcgccgccgcccacgacgacgatgaggaccccgatcttatcagcctcctaccggattgcatcctcgccaccatcctctcccttctccccctccctgccgccgggcgaacccaaatcctatcccaccgctggcgccgcctatggccctccgcgccactccacctcctcgactcccacctccccgtccccacctcctccctctgcgttgccatgtcccggatcctcgcctcccactgcgtcagcgctgtgaggttccatatcctcctcgcccgtccctccgcctccgacctcgactcctggttccgctccctcgccgccaaaagcctccaggaactcgtcctccggctgccctccgacgacacccttcgcctccctccatcattcctctccttccggtccctcagcaccgcggagctcaccaactgccgcctccccgaggacggcgaagtctatttcccgcacctcggcgagctgaccctccgccttgccatcgccccatccgccgccgcgctccatggcctcctgatcggctgccccaagcttggcagcctatcgctcgaccgcgtcttcggctgccggaccctccgcgtgcggtcctggagcctccgcagcctcacagtgtcggtctccctgacgccgtggcgcgtccaggagaggggcgccattgagctggagcatctcgtcgtcgaggatgcgcccgccctggagaggctgctggcacacgacatcaactggggcccatcgataaatgtagcgcgtgcgccgaggctgcagatgctcggctaccttgggatcggtatcccggagctgcagctcggctcggcgttgtttcgttccatgtgcgctgttagactggcggcggacctccggtctgtgaggacgctggcgctggagatgtcagatccgcagctgaagtttgtggccgacttcctgatgtgtttcccctgcttggagacgctccatgtcacggtacctgaaatcgattgtttgttcatatatctggttaaagcttgtgctcatgaattttgctattgttgtgttgcagtctcacatggttattcctcagggcatgagaatattgaattatgagatgggtgatgatcgcatagagtgcctcagccatcacctcaagaaagtagtgctgaaaggttacttggggcgaaagcatgagatgcagcttgccatttcccttgttcgtcatgctagggttctacaggttttcaaattcttgtgtgaaaatgagtgcaacagcaaatgggtgacaaaccagaaaagacagttacaggtggacagccgggcatctttgctggctcaatttgtttttgagaaattcagcaagggctacatcaggttttcgaagtcagcaagtaacatatctttagttgatccatttgatacttaataaccctgaactattaaataaatgttctctctattttcatgccattaatttaatcacagatagaaaaaacaaaaaaaaaaaaaaaa

SEQ ID NO: 10526 - DNA, 1798 bp, Zea mays
ccggccggggggtcgacaacaatttgccgggcacacccaagacccgcggaagccacgacgacaagcctccatcgcctcttgttgtttgcgggccccatacgtcagagaccacaagcccgaggcttaactctccctgccgctaatccctcgcgccgccggagggaagcaagagatagatctgtccgcggccatggcggcggcggcggcggcggcggagcaaggcgtggacgccgcgaggaaagaggaggaggaggagcaggtagtgaatccgtgggaggtgtcggcggggaagggcggcatcgactacgacaagctcgtggaccagttcggctgccagcgcatcgacgacgcgctcgtggaccgcatcgcacgcctcaccgcccgaccaccgcactgcttcctccgccgaggcctcttcttcgcccaccgtgatttgaacgagatactggatttgtatgagaacgggcagaagttctacctctacacggggagggggccctcgtcggaggccctgcacctcggccacctcatccccttcatgttcacaaaatacttgcaggaggcttttaaggtgcccctagttatacaactgactgacgatgagaagtacttgtggaaaaacttgactattcaggaaagtaaaaggcttgcccgtgaaaatgctaaagatattatagcatgtggttttgacattgaaagaacattcattttctctgatttttcttttgttggaggtgctttttatgaaaacatgatgcaagttgccagatgtgtaactatgaataaggctattggaatatttgggttcaatcttgaggatcacataggaaaggttagctttcctccagtgcaggcagtcccatcattcccttcttcatttccccatctcttcgctggcaaggaccaactgcggtgtcttatcccatgtgcaatagatcaggatccatattttaggatgactcgtgatgttgctcctagaattggttatcagaaaccatcactgattgaatctagattttttcctgctcttcagggggagaacacaaaaatgtcagctagtgacgcaaattcggcgatatacgtgacagatagtgctaaagaaataaagacaaaggtgaataaatatgccttctcaggtggccaggactcaatagagctccatagaaaacttggcgctaaccttgatgtggatgtcccaatcaaatacctgaacttcttccttgaagatgatgacgagcttgcgcacataaaaaaggagtacaaggagggaaggatgttgactggtgaagtgaagcaacggcttattgcagttctatctgagattgttgctagacaccagagagctagagctcaagtgaccgaagagatggtcgatgcattcatggcagtgaggcctcttcccaatatgtttggctgagcatcacggcgacaacttgaacaaacatttttgttatcagggagaattttaagagtctttagaattgtcgtgccaccataagtatcccctgtgttttacttcttcgggatttaggcaaacctggccaaacatcccatgtggtggctgtggttgattttgtaaactcatacttgatatggtatcaatgattcaattcagacattttttttcaagcatatgcatgccattgtaatagagagcacctcttttttagttataaacggatgttgcttttgttcaattcaataaccactgtgtttgaatgggaaaaaaaaaaaaaagagaaaaaagccctgcccgggcggccgataaaaagggcgatttccaaaacactggcggccg

SEQ ID NO: 10527 - DNA, 1508 bp, Zea mays
cattgggtacctcgaggccggccggggcccgcccgcccgaccgaccgctgtctcgctcgcctcgtctcgtctcgtctcgcttcgtctccgtttcctccgcacaccaccacagccgcgtcaaggccgtcaaccaaccaaaccctagaaggctctcgcccccgtccccaatccttcgccgctccccgatcctcgccgcccgcaggccaaaaccccacgcctctccctcgacgccgggtatatccagtgtaatcactttgtcagaaatgccttctgcatccaagtccaagtcaaaagatagatcagctgcaaaagttgcaaaagagcaacccaaggtttctgcaaagccactgggaaatggtacgcttgcaagttcttataacaacctctctggaaagttccatgttctggaaccatcagcttctttgttgggtagccaaggcatcaataaattcaggaataccgatgagatagatgaacattctcgcagctcccatggtacaggggatttcgattgtgcctccaacaacggtagctgctctgacgagtcagaagatccaaaggaaaaaccaactagtagtgtgtctcgagtagagtctgttcctggatgtgatattgataaacgagagaaaatcagacagaaaaatgagaagaagcatcaaagacagaaggagaggcgtgcccaagaattgcacgagcgttgtaagggttatcttatgtctagaaaattggaggcacttgcgcagaagcttgttgcgatgggtttctcagcagatcaagcaacgatggcccttatacagaatgagggttgcgttgaggagtctgttacctggctctgcaactttgatggcagtgaggaagctaagcaacaacttgcagctgatcaacagtccggtgttaacttgaagattgatatagctgatgagctttcaaagattgtgagcttggaggtaaaatataagtgtacaaagcaagaagttgaaagagcagttgtttcctgtgaaggtgatctagaaagggctgatgaggccttgaagacacacaagcaagaatcaactgcagtcccaccaaagcctgagggatctagtgactcaagtgccttgcctaacaagcagcaagttgtacttgcacagaaccctgcaagggctcaaacaaatggattttcatcagtaggatctcagcagacgagaagagaggaggagataagctataagcttttgatgaatggtagtggtccaaaggatcctgcaattaaagggtttcagccaatggcagcaccaactaagccagatttgggccgtcagcaatttgttcaacctgagaagagacgtctcaatcccaactcgattccatcaattccttatgtggcatcatctcctttgcctgttgcagtgccacaactgaagtcagacatgcggcatgtggcaggaactaatgaggttaaaagttcgatgcccaatggaagcttgcgagagtcggtaattgtaatgcagcgtcctcaatctgcaggt

SEQ ID NO: 10528 - DNA, 1379 bp, Zea mays
  misc_feature (1316)..(1316): n is a, c, g, or t
  misc_feature (1325)..(1325): n is a, c, g, or t
  misc_feature (1329)..(1332): n is a, c, g, or t
  misc_feature (1356)..(1357): n is a, c, g, or t
gcacgaggcgaccgcgcggccggccggcccggcaaagaactccaaattccacgccgatccgcccccaccactactccaccgcgcgcctcccctcccgaatcccgatccatctccatccagccgccgccggcatccgcgagaggccatggacgtgagcaggaagaagaagtgggtggcctgggcggtggcggccgccatcttcgtcgtcctcatgctcgtcacgcccgccatcccgcaggacgaagcctaccacgacttcgcggaccagcgcacccttttcttagggattcccaacaccttgaatgtgatctcaaacatccctttcttctttgttggcgtcacggggctcatcctgtgccacttcaacaactatttcaggctaagctcgcagggggagctctggagttggacgctgttctttgctggtgtcacggctgttggatttggttcttcctattatcatctcaacccgaatgacgccaccctagtttgggacagactgccaatgacgattgctttcacttctgtcatggctatattcattattgaaagggttgatgatagagcaggggcaaaatcccttgcaccacttgtgattgcgggtgccttgagcatcatgtattggagacactttgatgatcttcgcccgtacgcagtagttcagtttgttccatgcattgctttacctgtgatggctatagtaattccaccgatgtatacacattcaagctactggttgtgggcagcaggattttacctccttgctaaagtggaagaggctgctgacaaaactatctacaattggactcatcagattgttagtggtcatactcttaagcatctatgtgctgcgatggtaccggttttcctggctctcatgctagctaaaaggactaccgaaccagaaaggataagcttgctccagaagtggaagaccagttgggttgcggtgagagagaggcgtttcaaagatagcagtacagttgatgtggattgcggctacgctgttgtttcaagtatatctgaacagtaaattgtcatgcatctaattaacatgcacgttgtttcaagtattagcatgcatgctgcgcatgtgtatgagagaagatccctgtgaagtattaagaaaccaacctacctagttgagtttgctggtcggagttagctgtgcctgtgggtgacatatcttgtacatagcagaaagcaatacaagtaacggaagcatgtattacaagatttgcgtatatcatttcaatttttttcctcgaaaaaaaaaaaaaaaaaaaaaacgaacaaaaaaaagatctagaacaaanaaaaaaaanaaannnnaaaaaaaaaaaaaaaaaaaaaaannactttgctttgttaccactgct

SEQ ID NO: 10529 - DNA, 3232 bp, Zea mays
tggagccctaaatacgttgtaataccagcgacgttggtgctcaaaatctggtttagaggtgtttagttccagtgaataaaatataatttatgtcacatcaaatgtttatatcaattaagagtattgaatatagacttaattatgtttattaatttcttttcatcttttagataaaattaatatttatatgtgtaattaattgtataattatattttacttagaatttgtttggaacaactctaattaaaaaattggtgtgattagtggaacagatcattagatgctatagaaaattatagagcaaaagttgtaagcctctataaaacatttagaaatatcattttgtttattatatagatttaaaatatttttaaaactaattaaattgatattataaattaccgaagctggaaagctatccaaactctcccttaatattcataggtatcgataaatactaaactttgaggaattgatgcattactcctcgaggccggcctggccgggattactcgaaaagaaaactagccgggcacgttacgctcaccaccataccgtcccacgcggcctccccaactaaccctatcccccggcgaccgggaactgcaaccgatggaccgcctcgtcgtcttctcccgccgccgccgccgctggatcctcctcgctgcggccggtgcggcggcggccgtcggcgcgtacaagatctaccaccaccctgccgtcgcggaacgtcgccgccgcctcgtgcgcctagccgccgccatcgcggccttcgctgatgccgccgcatcatccgccgacgccgtggccctggtgacatccgatctcgccgactttgtccgttccgacgcggacgaggtcccccgcagcgtcaagcagctggccaagctcgccgcctcccctgaggtatccgccaccgtctccaccctatccgaggcagtaacctccgggatccttcgcgggtcgggatcctctagctccgggcccgcatccggcggtaccgtggccctctccgatcgtctcgtagacaggctcttctctgactcaggcgagcgcctcgcgtccgcggttgccggcagcttcgcccgccatctcgtcctcgccttttactccgctccttcaccacaaggggaggcgtcctcctccccgacgatgtgggtcaacgtggttgcgactggaaagtgccggaaggcgataagcaactgggttgaggtcttcgtggggactgctgtgagggagttcattgacaagaccatccacatcaacacctacgagcagctcttcgaagggctcaccaatccgagacatgacgctaaggtcaaggaattgcttgtttcagtgtgcaatgctgcggttgagactttggtgaagaccactcaccatgccctgtacagtactaatggcaacttgggtgcaaatggtagtgtcagtggcaatgccaatggagctggggaagggtgggtggagacggtgtcgagcacgttggcagttcctagcaacaggaagtttgtgcttgatgttacagggagggtcacatttgagacagtgcggtcatttctggagtttgttctttggaagctgcaggatggggcaaggaagggcggtggctccgtggttgacagtggcctgcgcgtcgtgaggtatatgagcgataagtcgatggttatcgccacgatctgcattacgttgtgcttgcatgtgttgaatgggactaggctcttggtaacagcttgagagtgtacttgtttggttttcctattttttgcacattgtttgtgtaaaactgtaggactcatactgaaactgtaaatccaaaaggaatggaaataatagaaataagatcaattgtgctgtacaattctgttttatgcctatatacttgaggtctgaacgactttagtgagagagttgttgatctgtagcactacctgtttgcaaccatatttgtgggattaagtagcatttacatgcctgctgtcattgaagctattttttttaccagtatagcattactaatattgtgggggtcaagttgatccactaaaatgactaaattctgtgcttttgtatctcttgtcatcaatgatgtaaatcggagcttgtccgtgtgattattgaattatgtaagaactcaactttggtttctattatttgagttatttactcactataggatggtatccaatcatcttgtcttgatcttgatttttgaaatattaacaatcctagtcataccaacttgatattcttctctgggttttctttttataagggaagcaggagtagtgcttcatcctttacttgttacttgtcttgatattgattttgcaacattcagaaatcctaattcctaatcacctaagccatcatttatacggtgcgatatacaaatctggactccggtgacttgttggtgaatctgatgctcacttgctctacatgtgtattccagatagcgtcactcacttgagcttatatattcagacttactttggtttgttggtgcttctcatttgcttatacaagtaaacgtaagctgctatgttctcttggttgatccagatgtcttttgcaactgttcacccttcatacttcgccagaacatttcctgttttttccccgcaaaagcttggaacattttaggcttaaataaatgccataactattattagtgccatgtttatgatttgatctggaaatgtatagattaatttattctatctgagctcacccgtgttgggaagttcctttgaattttgaatggcagtagcttgctgaacatggttctgtttcgctgtgcgtctttaccgagcacatctactttccttcatcttgctgctgtgcctgtgcgcgatgtgtggatcttggggtatgggccaaatagatacggtggttttggtgggccaaggcaaaaacagactcgggccaggcttaattctcctatttccaggccatccattgtagatatttataccgcatgcttggaaatggggtcctgttctgatcagaaacttatttttaggatgtgcttggaaatgggcctccaaaaaggcaatgagggcccctgctccgttcagaaactttaggcctcaggcatcgacattgacttatcgactggcactgccggtcgtgtgagagttgctgtatattttccttctaatatttggggttagctacttagagcatctccaagagtagggatgaaaacggtcggaaacggtatttattcgg

SEQ ID NO: 10530 - DNA, 3543 bp, Zea mays
  misc_feature (2826)..(2826): n is a, c, g, or t
catttttatccgcaaaacccgccacccggcgcgatacgatgagtcctggatttttcggacacgggcacacggcttcacagttcacacggcgcggagcacaaccgccgcgggccccagcgcgctcccataaaaaaacccgccgcaccgcgccaccgtcccacctcccacgtggcctcgccaatcgccatctaccctattccccgggcatcggagaccgggacgcccaaggatggaccgcctcgtcctcttctcccgccgccgccgccgctggatcctcctcaccgcggccggtgcagcggcggctgtcggcgcgtacaagatctaccaccatccggtcgtcgcggagcgccgccaccgcctcgtgcgccttgccgccgccgtcgcggccatcgccgacgccgccacgtcgtccgccgacgcggcggccctggtggtctccgatctcgccgacttcgtccggtccgacgcggacgaggtcccccgcagcgtcaagcagctggccaagctcgctgcctcccccgaggtctccgccaccgtctccaccctatccgaggcagtaacctccgggatgttccgcggggcgggatcctctagctccgggcccggatccggcggtaccgtggccctctccgatcgtttcgtagacaagctcttctctgattcaggcgagcgtctcgcgtccgcggttgccggaagcttcgctcgccatctcgtgctcgcctattactccgctccttcacctcagggggaggcgtcctcctccccgacggtgtgggtcaacgtggtcgcgactggaaagtgccggaaggcgataagcacctgggttgaggtcttcgtgggcaccgcggttagggagttcattgacaagaccatccacatcaacacctacgaacagatcttcgaagggctcaccaatccgaaacatgatgccaaggtcaaggaattgcttgtttcagtgtgcaatagtgcggttgagactttggtgaagaccactcaccatgccctgtacaatactaatgacaacttggatgcaaatgatagttgtagtggcagtggcaatggcaatggagttggggaaggttgggtggagagggtgtcgagcacattggcagttcctagcaacaggaagtttgtgcttgatgttacagggagggtcacatttgagacggtgaggtcatttctggagtttgttctttggaagctacaagatggggcaaggaagggtggtgactctatggttgacagtgggctgcgtgtcgtgaggtatatgagcgataagtcaatggttatcgctacgatctgcattacattgtgcttgcatgtgttgaatgggactaggctcttggtagcagcttaaagagcgtaatcgtttgcctttcctatttttgcacattgtttgtataaaactgtaggaaccatacttaaactgtaaatcagaaaagagtggaaagaagatcaattatgcagcataagtctgttatgcatgtatacttgagattggtctgcacgactttagtgagcgagatgttgatctgtagtactgcctgggattaattggcatttagatgcctgctgttattgaagcctttttttttaaaaaaaaacaagtatagcattactaatattgtggggggtcaagttggaccactaaattatgtgcttttgtatcttgtcaccaatgatgtaaaaagcttgccttttcacgccattattgaattatgtaagatctcaagtttgttttcaatgatacgagttatttactcgcttggggtttaaaaaaaacaaaaaaaaaaaaaaaaatatcttattatcttgaatcttgatcttgaattttgaaatattcacaaatcctagtcataccaggttgacattttcatccctttcttttgtctttataagtgaagcaggcgcactggtcctttctttacttgtacttctctgatcttgattttgcaacattcagaaatcctagtcacctaaggcatcatttatatggtggatataccgatctagacttccggtgaggcggtgaattgttggtgaatctattgtcagttgctctacttgtgtattgcagatagtgtcactcacttgagcaacattcagacttactttggtttgttggtgcctctcatagtctcatttgcttatataagtaaacataagctgccattttctcttcgtattgacaaggagttcacggtctgttggtagatccacatgtcttctgcaactgttcatgctccatacatcgccagagcacttcctgttctgttttccgcaaaatctaaataaatgtagcaactaaactagcgtcatatttatgatttgatctgacaatatataattcgatctgagctcatctgtcttggcaagtcacttggattttgaatgccagtagcttgcttacatgtttctgtttcactgtgcatctttacctggctacccataagccatctgctttccttcctcctgctattcgtggtggtggtgcttggatctttgggtccactagacaactacatatgcgcggatgggccaaatagatacggtggtttttgtggaggggccaaggcaaaagcagcctcgggccagccttatttccagtccatccattgcagatatttgtagggcatgcttggaaatgggcctccacaaaggcaatggggccctgttctggtcagaaactttttttacggtgtgcttggaaatgggcctccaaaaagccaatggggccctattctaatcagaaactttaggcctccagcattgacattgacttatcgactggcactgcttgccgaagagcgaagacatcgtgaacgnttgaacaccaacatttgctctctctctcgctttatgtacataactgtggtatatttagattagtttttttagccagattcaccgtcaacaaattggaattccaactaaagccttgtttggatacttttgtattcatcttaatccacatgtattgatgtggattgtgatgtaaattctaatccagttcaatacatgtggattaaggtgaataccattatcgaaacaaaacctaaatagattgaataattcttttgaaaatctacaaattcaactagctcaatccagaattttctcctaccttagatttttagattctcgtcgtccatattttcaaaaatattattcagttgccactaaatgtatagaaaaatattattcagttgccactaaatgtatagaatcaaatcattttattttctatccgaaggtctccacccgaccggatgctcgattcttatccgacaacaccttctaaggagagataattggatttttgccactcacaatgttgtcttcttgttataattaccattgtgtctatgaattgtgggtccagctgggtctatgaaatgtgggcctgatggcaattttacgaacctgtttcttactgatggcaaatatcagaatctctcttctaaggacgatcagagttgtcacagcctctctgtacccatgacatggcttaattagccttccctaaaccaccatactcttcca

SEQ ID NO: 10531 - DNA, 1519 bp, Zea mays
caggggcccccgcgcggccggccgccttcgcaccgcgccaccgtcccaccgtcccacctggcctcgccatctaccctattccccgggcatcggcgaccgggacgcccaaggatggaccgcctcgtcctcttctcccgccgccgccgccgctggatcctcctcgccgcggccggtgcagcggcggccgtcggcgcgtacaagatctaccaccatccggccgtcgcggagcgccgccaccgcctcgtgcgccttgccgccgccctcgcggccatcgctgacgccgccacgtcgtccgccgacgccgcggccctggtggtctccgatctcgccgacttcgtccggtccgacgcggacgaggtcccccgcagcgtcaagcagctggccaagcttgctgcctcccccgaggtctccgccaccgtctccaccctatccgaggcagtaacctccgggatgcttcgcggggcgggatcctctagctccgggcccggatctggcggtaccgtggccctctccgatcgtttcgtagacaagctcttctctgattcaggcgagcgtctcgcgtccgcggttgccggaagcttcgctcgccatctcgtgctcgcctattactccgctccttcacctcaggggggaggcgtcctcctccccgacggtgtgggtcaacgtggtcgcgactggaaagtgccggaaggcgataagcacctgggttgaggtcttcgtgggcaccgcggttagggagttcattgacaagaccatccacatcaacacctacgagcagatcttcgaagggctcaccaatccgaaacatgatgccaaggtcaaggaattgcttgtttcagtgtgcaatagtgcggttgagactttggtgaagaccactcaccatgccctgtacaatactaatggcaacttggatgcaaatgatagttgtagtggcagtggcaatgacaatggagttggggaaggttgggtggagagggtgtcgagcacattggcagttcctagcaacaggaagtttgtgcttgatgttacagggagggtcacatttgagacggtgaggtcatttctggagtttgttctttggaagctacaggatggggcaaggaagggtggtgactctatggttgacagtgggctgcgtgtcgtgaggtatatgagcgataagtcgatggttatcgctacgatctgcattacattgtgcttgcatgtgttgaatgggactaggctcttggtaacagcttaaagagcgtaatcgtttgcctttcctatttttgcacattgtttgtataaaactgtaggaaccatacttaaactgtagatcagaaaagagtggaaagaagatcaattatgcagcataagtctgttatgcatgtatacttgagattggtctgcacgactttagtgagcgagatgtggatctgtagtactgcctctttgcaaccctatttgtgggattaattggcatttagatgcctgctgttattgaagccttttttttaaaaaaaaacagtatagccctccg

SEQ ID NO: 10532 - DNA, 895 bp, Zea mays
taaagcactactgtcttcatcagctagagagccgccccccgagccgagcgttcccctcgttgccgcgggccggccggaggtaggattccttcaaattcccgctgcgtgcgacggcacgccggcggtcgccgctatgtccccctctctcgtgctggtgcactcactcccgctcccttctcgccgcgcgctccccatccagctgccccgccgcctcgcccccaaacacccgtcccagtggtcgctccgcacgcctcgacgtctcgctgtctttgccagggcttcggcgtccgttgtggtgtcgccgcacggcgagggaggtggtggcacggcggcggggcggaagagcacggggtataggaaccggttcctggacctggcgcggctgggggccgtggcggagggcgcggcggaggccttcttccgcagcgagatccggcggcggctggccgtcactgccgcgctcatcgtgctcagccgcgtggggtacttcatcccgctccccgggttcgatcgccgcctcatcccagactcttacctcagcttctccgcgctccctgcagatgaccttggcgatttctcctcagaattgaagctttcttttttccagctggggatcagtcatcaaatttcagcatctattgtcatgcaggttctctgtcatgttcttccatcacttgaaaagctccgcaaggaaggattagatggccatgagaagtaaaaggctatatatggtggcttttctttgtggtttgcaactgtggctgcttttactgtgtcatgcttttccctgcagtattcagtatatgctgcaagttacagggtcaagcatgtaattataacaagtcttctgcttgttcttggtgcatgtcaatgacatggatttgtgcaccattac

SEQ ID NO: 10533 - DNA, 1713 bp, Zea mays
gaaaagctcgcccggccgcccggggtgaggatgactgccactcccaccgggctcctccggctccacatctgccgtcgaccaaacccgccctgctaaatactcgctccctacagctcccctcgcaattgacacctcccgacctccgttagcacgagctgcagggagggagttgggaggagaaacagagctaccggggcgatgggcaccgtgctcgattcgcacttcctggcgctcaccgccatcgttactgtggggtaccagctgctgttcttcatcatcacagctctcctccggttcgataaggtcaccgatttcgcaggcagtacaaattttatcataatcgccatcctaacattagctttgaagggagcatggcatttccgtcagattgtgctgacagtgcttgtcaccatttggggtcttcgtctaggattatttttattgatgaggattttgcaatggggcccgtaccgaagctttgacaaaatgcgtgataatttggggaaattagcagttttttggattttccaggctgtgtgggtttggtctgtcagcttgcccgtcactgttgtgaatgcaagtgacagaaacccctcgattgaagccagggatataatcggttggataatatggttggtcgggatatgtgtagaagcagcagctgatcagcagaagcttgtgttcaaaaattctccaagtaacaggggaaagtggtgcgacgccggtctttggaagtactctcgccacccgaactactttggggagatattcctttggtggggagtatttgtagcatcgaccccagttatctcagatgccgaatggcttgtgattcttggacctatattcctgactcttctgcttcttttcgttagtggaatcccactcctcgagtcatctgctgataagcgctatggacgattggaggaataccgtgcatacaagaacactacaagccctcttatcccattgccacctgctgtgtatggttccctgcctgcgtggttcaaggttgccttcctccttgagctcccgctctacaatcctgggccgggaggtgatccaatcagttgagtggtgcttgcaaactgttctgctgcccttcagtgatgaacttgtatagaatatccctgcagtatgtttacgttttttgtttttgttttggtttgacagaaccagaatgagcccattgatgggtcagcctgatgtttatgttgctattgtgtgcgtggcagttattccaccttcgattccaaggggttacagtggagtttggcccctgatttatcgctcgcgaggctcaaacatgtatcttgttggttgaaagttagatttcttttgcggccctccctgcctccatgtgcagatgaatagatgcttagaaacctgaacgtggaacgtgttcaccttcctcgctccaaaaaagtgggaacggaacaatcttgtccatatagtgttaaagtatttttttttaagtacggtaccacgttcctgtttctggttcccatcaatccgagaactgattagatgatcacgcgaactgaactctgagccgatacttgtcccaatttggtagtatttgttatgcaatgtattttcgtattttacattctcggttagtactgggactgaaccttttaaactcttgtttatgtgtgtgttggttagaccttggggcaggggttcagggaaacaagaggcttaaagaaagtc

SEQ ID NO: 10534 - DNA, 1432 bp, Zea mays
gcacgacgtcggccgcccggggtgaggatgactgccactcccaccgggctcctccggctccacatctcccgtcgaccaaacccgccctgctaaatactcccttcggtacctcgagcccgcccggaacacctccgttagcacgagctgcagggagggagttgggaggagaaacagagctaccggggcgatgggcaccgtgctcgattcgcacttcctggcgctcaccgccatcgttactgtggggtaccagctgctgttcttcatcatcacagctctcctccggttcgataaggtcaccgatttcgcaggcagtacaaattttatcataatctccatcctaacattagctttgaagggagcatggcatttccgtcagattgtgctgacagtgcttgtcaccatttggggtcttcgtctaggattatttttattgatgaggattttgcaatggggtgaagaccgaaggtttgacaaaatgcgtgataatttggggaaattagcagttttttggattttccaggctgtgtgggtttggtctgtcagcttgcccgtcactgttgtgaatgcaagtgacagaaacccctcgattgaagccagggatataatcggttggataatatggttggtcgggatatgtgtagaagcagcagctgatcagcagaagcttgtgttcaaaaattctccaagcaataggggaaaatggtgtgacgtcggtctttggaagtactctcgccacccgaactactttggagagatattcctttggtggggagtatttgtagcatcgaccccagttatctcagatgctgaatggcttgtgattcttggacctatattcctgactctcctgcttcttttcgttagtggaatcccactccttgagtcatctgctgataagcgctatggacgattggaggaataccgtgcatacaagaacactacaagccctcttatcccattgccacctgctgtgtatggttccctgcctgcgtggttcaaggttgccttcctccttgagctcccgctctacaatcctgggccgggaggtgatccaatcaaaccagaatgagcccattgatgggtcagcctgatgtttatgttgctattgtgtgcgtggcagttattccaccttcgattccaaggggttacagtggagtttggcccctgatttatcgctcgcgaggctcaaacatgtatcttgttggttgaaagttagatttcttttgttgccctccctgcctccatgtgcagatgaatagatgcttagaaacctgaacgtggaacgtgttcaccttcctcgctccaaaaaagtgggaacggaacaatcttgtccatatagtgttaaagtatattttttttaagtacggtaccacgttcctgtttctggttcccatcaatccgagaactgattagatgatcaaaaaactcgtgc

SEQ ID NO: 10535 - DNA, 1249 bp, Zea mays
  misc_feature (2)..(2): n is a, c, g, or t
  misc_feature (816)..(816): n is a, c, g, or t
  misc_feature (1086)..(1086): n is a, c, g, or t
  misc_feature (1091)..(1091): n is a, c, g, or t
antccaacacctgcctccctgtttcgatgctggccacaagctcgcccggccgcccggggtgaggatgactgccactcccaccgggctcctccggctccacatctgccgtcgaccaaacccgccctgctaaatactcgctccctacagctctcctcgcaattgacacctcccgacctccgttagcacgagctgcagggagggagttgggaggagaaacagagctaccggggcgatgggcaccgtgctcgattcgcacttcctggcgctcaccgccatcgttactgtggggtaccagctgctgttcttcatcatcacagctctcctccggttcgataaggtcaccgatttcgcaggcagtacaaattttatcataatcgccatcctaacattagctttgaagggagcatggcatttccgtcagattgtgctgacagtgcttgtcaccatttggggtcttcgtctaggattatttttattgatgaggattttgcaatggggtgaagaccgaaggtttgacaaaatgcgtgataatttggggaaattagcagttttttggattttccaggctgtgtgggtttggtctgtcagcttgcccgtcactgttgtgaatgcaagtgacagaaacccctcgattgaagccagggatataatcggttggataatatggttggtcgggatatgtgtagaagcagcagctgatcagcagaagcttgtgttcaaaagttctccaagtaacagggggaaagtggtgcgacgccggtctttgggagtactctcgccacccgaactactttggggagatattcctttgggggngggagtatttgtggcatcaacgccagttatctcagatgccgaatggcttgtgattcttggacctatattcctgactctcctgcttcttttcgttagtggaatcccactcctcgagtcatctgctgataagcgctatggacgattggaggaataccgtgtatacaagaacactacaagccctcttatcccattgccacctgctgtgtatggttccctgcctgcgtggttcaaggttgccttcctccttgagctcccgctctacaatcctgngccgngaggtgacccaatcagttgagtggtgcttgcaaactgttctgctgcccttcagtgatgaacttgtatagaatacccctgcagtatatttaccgtttttgttttgctttgacagaactagaatgagcccattgatgggtcagcctgatgtttatgttgc

SEQ ID NO: 10536 - DNA, 1031 bp, Zea mays
ttttttttttttttttggggagaggcgcacgtgacttgtgcgtgcataagaatttattataaagatgcatatgtatatgtattgaaatcttaactaaatttatagattttgtatatttttgggtgcatttgcacctctaagaataatgtagcttcgccccggctcccgcctcggcaggccctcacgccggcgcgatggacaccttgtcgacctgcacgacgtactcgagcgtcgcgccgggcgggatctggacgtgctcctccccgaagtcggcgccgccgtcgccgaacgcgaggcccggcgggacgaccacccgccgcttgccgcctggcctcatggagcgcaccacgtgctcaacaccctcgcacatgcccctggtgtacggccgggagcccatcaccagcgccagcggccgcttgccgtcgccgaacgtgtccacaaacgcctccccgccgctgccggccacccggccctgcaggtcggtcaccaccaggtcgcccggccgcgggacgtccccgccaccgacgcgcatctcgtagtaccggatcccgttgggcaacacgacctcgtgctcctgctccacgtccttggtgttggcctgctgctgcgcgacctcgaagcgtgtcttgagctgctccgacacgacgccgacggccaggaagccggcccacgccagccccgcaccgattccggaccgccgcgtcaacgacgaggctatccagtcagtggagtccgcgacgcccgcgtgcttcggcctcgccgccgccgcctgctgtggctgcgcttgcacggagtgccgctgtttctgtggttccggctgctcgctggacggcgtctggttctgggcaattgccgggcgcggggtctgcgcgcaggagatgtgcggcttggcgatgggacgagcgaggagcgccggtgagcttcccaggaacgtggccattgtggttcggtgggtcgtggatgaactgcgagtccaggacgacgggagtggatatttaggttgattttctaatgttctgagatattgtttt

SEQ ID NO: 10537 - DNA, 1965 bp, Zea mays
tatctacgttttttttttgttttggtttgcacagaactagaatgagcccattgatgggtcagcctcatatttatgttgctattgtatgcgtggcagttattcccccttcgattccaaggggttacagtggagtttggcccctgatgtatcttgttggttgaaagttagatttctttttgttgccctccctgcctccatgtgcagatcaatagatgcttagaaacctgaacgtggaacgtgttcaccttcctcgttccaaaaaagtgggaacggaacaatcttgtccatatagtgttaaagtcttttttttagtacggtaccacgttcctgtttttggttcccatcgatccaaaaactgattaaatgatcacccaaactgaactctgagccgatactagtgtcccaatttggttagtatttgttatgcaatgtattttcgtattttacattctcggttagtaataggactgaaccttttaaactcttgtttatgtcattatgtgtgtgttggttaggccttggggcaggggttcagggaaacaaaagggcttgaaggcaataaatttggaagaacgaaagtaattaagaacaaaccgagaatgtgaccagttcacggcgtaccagtgcggaagctcaaaacgagcttggtttgcaagctccagaaatctctctgctcttttgggagatcttgcttgaaaaaacgagaatgaacctgtcccatggctcatggcagctagaacaattgtggtcacgctattttttttttttttttgtttacagaaagaaccgagccgagccataaaataatgatcagaacaccacaggactgcgatctatctactgccgcctcacgccggcgcgatggacaccctgtcgacctgcacgatgtactcgagcgtcgcgccgggtgggacctggacgtgctcctccccgaagtcggcgccgtcgtcgccgaacccgaggcccggcgggacgacaacccgccgcttgccgccggccctcatggagcgcagcgcgtactcgacgccctcgcacatgcccctggtgtacggccgggagcccatcaccagcgccagcggccgcttgccgtcgccgaacgtgtccacgaacgcctccccgccgccgccactgcccgccacccggccctgcaggtcgatcaccaccaggtcgcccggccgcgggacgtcgccgccgccgacgcgcatctcgtagtaccggaccccgttgggcaggacgacctcctgctcctgttccacgtccttggtgttggcctgctgctgcgcgacctcgaagcgggtcttgagctgctcggacacgacgccgacggccagaaagccggcccacgccagccccgcgccgatcccgaaccgccgcgtcagcgacgaggccacccagtccgtggagtccgcgccgcccgcgcgcttcggcctcgccgccgcctgctgtggctgcgcttgcacggactgctgctgtgtttgtgcttgcggttgctcgctggacggcggctggttctgggcgcttggcgggcgcggtgtctgcgcgcaggagatgtggggcttggcgatgggacgggcgaggagcgccggtgagcttcccaggaacgtggccattgctggtcggtgcgtcgtggatgaactacgagtccaggacgacggaagtggatgttctggtgccggccggctatgtttctgagatattatctatttcgttcaattctcgtgagctttttgcgagtgaaatgtggccacatgtgtaggagtgcttgaaggcttatccgactgcacaacactagctatccaccaagtcttttgtccgaccgtccgcgccgacacgttgaggggtaggagcaatccaacgttctagctataaatcctagctaaatttaggctatgtttagaaccaactcagtttttaagaaaccagattttatcttttagctagaagatgccagtttctttaattttt

SEQ ID NO: 10538 - DNA, 2378 bp, Zea mays
gggtgtgaatattggaaccaacaactaatgttcaaacactcactttatacataatttcatcttattttttacataaactttcctagtagtagagaaaaaaacataggagtacgagttgattctaaagaaaggtagagtatttttttgaaaaatattgacgcgagacgaccgttggaactgatgctttaatatagtagagatttatatctaaaaccaaataaaaaagtttatattttaaggtccaagaaattaacaaaaaattaggcctaagaatagtaatggatttatttcctttataggtcattccaattctcatatcactaaaccaacttataccggtgtcaaatccaaataatggcttattcggctattcaaattctgtggattgaagtatattagaatggattgaaatgaattttgatttgctatagatttaaactaactcaatactatttaatccaactcaataccatcaaatgaaaaacctaagggctaatttggtgatctgggatctcggaaggattggaggggattgaggaggaaattaattcatttccctctcaatccactacaatcctcccgggattcccttgtcaccaaatcaacccaggaattgtctcctgtacgaacgagacgaccttttcctccgtgttggcctcctcgcggccggccggccaagcattcgcatagcccgcgccgcaagtattcgcggtcgcacaggctggtccagtccaacaccggcctccctgtttcgatgctggccacaagctcgcccggccgcccggggtgaggatgactgccactcccaccgggctcctccggctccacatctgccgtcgaccaaacccgccctgctaaatactcgctccatacagttctcctcgcaattaacacctccgttagcacgagctgcagggagggagttgggaggagaaacagagctaccggggcgatgggcaccgtgctcgattcgcacttcctggcgctcaccgccatcgttactgtggggtaccagctgctgttcttcatcatcacagctctcctccggttcgataaggtcaccgatttcgcaggcagtacaaattttatcataatcgccatcctaacattagctttgaagggagcatggcatttccgtcagattgtgctgacagtgcttgtcaccatttggggtcttcgtctaggattatttttattgatgaggattttgcaatggggtgaagaccgaaggtttgacaaaatgcgtgataatttggggaaattggcagttttttggattttccaggctgtgtgggtttggtctgtcagcttgcccgtcactgttgtgaatgcaagtgacagaaacccctcgattgaagccagggatataatcggctggataatatggttggtcgggatatgtgtagaagcaacagctgatcagcagaagcttgtgttaaaaaattctccaagtaacaggggaaagtggtgcgacgccggtctttggaagtactctcgccacccgaactactttggggagatattcctttggtggggagtatttgtagcatcgaccccagttatctcagatgccgaatggcttgtgattcttggacctatattcctgactcttctgcttcttttcgttagtggaatcccactcctcgagtcatctgctgataagcgctatggacgattggaggaataccgtgcatacaagaacactacaaggttgccttcctccttgagctcccgctctacaatcctgggccgggaggtgatccaatcagttgagtggtgcttgcaaactgttctgctgcccttcagtgatgaacttgtatagaatatccctgcagtatgtttacgttttttgtttttgttttggtttgacagaactagaatgagcccattgatgggtcagcctgatgtttatgttgctattgtgtgcgtggcagttattccaccttcgattccaaggggttacagtggagtttggcccctgattaaaaaaaaaaaaaaaacaaacatgtatcttgttggttgaaagttagatttcttttgttgccctccctgcctccatgtgcagatgaatagatgcttagaaacctgaacgtggaacgtgttcaccttcctcgctccaaaaaagtgggaacggaacaatcttgtccatatagtgttaaagtatttttttttaagtacggtaccacgttcctgtttctggttcccatcaatccgagaactgattagatgatcacgcgaactgaactctgagccgatacttgtcccaatttggtagtatttgttatgcaatgtattttcgtattttacattctcggttagtactgggactgaaccttttaaactctagtttatgtgttgtgttggctagaccttggggc

SEQ ID NO: 10539 - DNA, 1826 bp, Zea mays
cggcctacctagaaaaataattggaccctaaggtctagtttgatagccacagaagcggaaatggttggaggggctaaaatctcctcgttattcaattttaaataataaggggattttagctcctttagccactctgttttttggacttctaaactagccctaaaagaattttgattcccaggctgaccatctagcagatcgatcaccttgtgagaacacatgggtccttttagggattttggttcgcaaactagccatatagcagatggaatttcatgggcgccgcaccggtccgcggatcccatgtccgtgaagcaaacatcgaccgaaagttaggcaggccatggctgatggcagcatggcgcggagatgctgtggataaggaggcatccattgtttgtcgtcctaattttcactttcttccggcgtcccagcaactgataccgtgatagtggcgtgggtgcccaccgcctgcgtcgatcggacgccgtcgtccatcccacggccgccatcgcccggaatcgcggcatctctctctcgcccggccgcccgctttaaaatgcccgtgcgcgaggaatgaccacgcggcagagctcgagcactcgacaccagcgtccaacgggatggcgagcctgaccatgccgccggtgccggcgtggccgcggcaggacgccatcgacctccacaaagcattcagagggttcggttgcgacagcacgacggtgaccaacatcctggcgcaccgcgacgcgacgcagcgcgcgctgatccagcaggagtaccgggccgtgttcaaccaggacctggcccggcgcatcgcgtccgagctgagcggccaccacaagcgggcgatgctgctgtggatcctggacccggccacccgcgacgccaccatcctgaagcaggcgctcacgggcgacatcaccaacctgcgggcggccacggagatcgtctgctcccggacgccgtcgcagctgcagatcatgcgccagacgtaccgcgccaggttcggctgctacgtcgagcacgacgtcaccgaacgcacgtccggcgaccaccagcgcctcctgctcgcgtacctggccatcccgcgcgccgagggccacgaggtcgacccgtcgacggtgacgctggacgcgcgcgacctctacaaggccggcgagcggcggctgggcaccgacgagcgcgccttcatccgaatcttcagccagcggagctgggcgcacatggcggctgttgcccgggcgtaccaccacatgtacgaccgccccctggagcgcgccgtcaagagcgagacgtcgggcaacttcggtttcggcctcctcaccgtgctccgctgcgccgacagcccagccaggtacttcgccaaggagctgcacagggccatgaaggggctgggcaccagcgactcggtgctcatccgggtggtggtcaccagggcggagatcgacatgcagtacatcaaggcggagtaccacagcatgtacaagcgctcgctcgccgacgccatccacgccgagacgtccggcaactaccgcaccttcctcctctccctcgtcggccgcgaccgcacctagtgatgacgatgatcgctgtttcgtctctcatctatgcctctagtagcaacaacgtacgaggcgacactgggcgccattgccactcgcgtgtgcttgctattcctgttatctccatggaaatcttcctccttgtaaatactcctacttgttttcttgggatagttgttcgaataatggtgtactggttgcattgacaactcaaaaccttccaacagtatgtgtatgccgcatatctgcgcaatgtaacac

SEQ ID NO: 10540 - DNA, 2740 bp, Zea mays
aaaaatatcagcgagaaccctcgttttcttttttgtttagcagggggcacaagagcaagctgcaagcagattacagggccacgaagctcgcccctgctctgctctctatcttattagtccttcaattgggctttcctctgctgcggggttctgttctcgtctgggtttcagacgccagatttggagcagaacacaccggtccttggtttccttgccggctgcaatgttatggcgcttcgggggtatgtagagcctgaattctgtgatgacgggggagttagcggcgtggggagattttttctgtgctttgtcttttcttagctgagaaatctggtgctatttggtgctcgccgacgccgagccggagggcgtcatcgttgctgtgtcctctgtagctggatttgtggtcattggtagagagaagcgttcttcctcggggaatccgtgggaagaagcggtctccggtgcaatcccatggcttctagggatttcctgggagggttcggccgggatggagggcaagcgcctgtgggtggcgctggcgccgccccggggcccggcggggagtcggacgagatcgagctcagcctcggcctgtccctcggcggctgcttcggcgccgagccttcgcaggaggggaggagcgccgaccctcggctccagcgctcgtcctccgtcgcgtcgatctgctccttgcctgctgccaccaccggcaccagctgcggggcgcaggacgccggcccaggccccgccgccgcgcctccgccggacctgctccgcacctcctccctgcccgcggagtacatggaggaccggctccgccgccgcgcgatgcagagccagcggcgcctcgaggccaagcgcaagcgcctcgagcgccgcaactccatgagctcgggaaggccggttccggcggccggtggccgcgacgacggcctcgagcacaccgtgcccagcggcttccagctccgccgttcggtcgccttgacgacggcggggtcgccgacgcccagccggccgcagcaaggtatgcagcgtggtatctgtttatgactgtttgattgcggtcatccgtttcgttcgcttctttgtgctggttgcttgcttgctattgacggttttgccagagcagattttgctgggctgtttgggtaggagatgcatgggcagcagagagatctagatctcgtcgacacatggatcttggctatagctgtgggtttgtgggttcggctgctgcctgtgttcatgacggtcgtttctgatttctggattcgcgacgcagactcgcataggcctgatttggcattgcagggtcctagtcagtcggtctccttccaccagtttgaggaaacgttggcttgcttgtgctgtcgcgacgcccagctatctttgtgacaaagaaaagatgcatgtcatgcatgcatgtatgatgatgatgcatcgaaacatcaggtcctggtcctgcatcatgatgcatcgtaacatttgtatcattgatgtgcacgcagcaccaccaccgtactactcgttcgcagtgatgcttgcgccagggctggatctggatgttagatcagtactacaatgataggcagtagagtcattaggtagcattacgtgtgattgtgggactaatcactgtctgggctggtgtgtatactttatcacgcactgtccatcagccaaaaaaaagagttcagttgtgcgatggaacatcatcatgacattgcatgccaatagccagtgctcaacgcaacgcagccactggactctgaaacgccgtcgtgcctctgtcgtcgacgcagggccggcggaccgccgtgcggcggaggcgaccgggccggacggcgcggcctgccacgacgagccgcagccgctgccgctgcgcctgcgcacgctgcggtcgctgacgatgcggacggcgagcacgggcgacctccggagcgccatggcggaggacatgcccatggtgtcgtacaaggcggagggccccggcgggcgcaagacggacgggttcctgtacaagtacaggaagggggaggaggtgcggatcgtgtgcgtctgccacggcagcttcctcacgccggccgagttcgtggagcacgccggagggggcgaggtccccaacccgctgcgccacatcgtcgtcaacccgcagcagtcggtgttcttgtagcgtccggccgcctcgcgatggagatatggaggtggtggctgtaccgtcggagcttcagctttttaacgagggactgcagaagctggaaaccttctcttttttttttttgggttttgctttgtttcttttctgtttgttttggtactcatgtagtcatgtggttactattattattacaattattattaacagcaacagtagtaattaattatgctatcgattccctgcgttcttccactatctcgccgtcgtcgttgaagagtggcctgacgaggactggccactggggatgtccctgtgaattgtgtgcgaaaggtggcagccctccgtggtttgccgtgggacgacgcgatcgtggaaaaggttggacagcacatcgggtgcgaaggtgggcatcacacagtccatctccggcacgttgattctttggacgcacaggctcagccggcatcactgctttcggcatccaggtccagcgtccagccccagcgatgatatttttcggaccgaacggaacagacgcgaagggcggacgcgtggttcgcccccgcggcctcgccacag

SEQ ID NO: 10541 - DNA, 1816 bp, Zea mays
ctcgagcccggccccggccgggtctcccagaagcggtccctctccgcagaactgcagaagcagcgcggcgcggccgttaactcggctccctcaccttgctgccccctccgcaggcgcaggcgctcgcttccgaattggaggtgccatttgccaggggcgtactccattgattccggctgagttgtgcaaattgtgatagaactttcccgagattcaagcccatacaatgcagggcatctctatatgcggttcagttgcctcaccccatggagcaaactgcagaagggcttgtgttgcaaggaacgatgtgaggctgccttgtgaagctaatgcagtaagccaggggttgcactctctgcattggtgtgcgcacaaaccgcaaatgaagaacaatggaagaagaatgaatgccgcagtgaaaactaatgctagatggttgtttggaggagatgggcgtagcaatgatgcaaggctggagcgcagtgagtctgctaatgaagatattttgatcttctacttccagatggatctacagacccggatacagtatgcattgaatatagaacagtttgatgtggcaaagcaattgagggaaaaactaaccgagattgaaacagaaattattaggcagcgtgaagctagaaggggttcaccaaagactgaagcccaagacaaagctctaaatcttatacgtgtgcgtgcagacttgcagaaagctattgacagtgaaaactatgctttggcagctggtctccgtgatgacattgccaaacttgaggttgagtctcttgcagtatctgctaaagctcttgcttatcaaaatgtgaaatatgcatttcgattagggcagaaagtacgtcacaatatacatggatatagaggcgtgatatgtggcatggacccggtgtgctgtgaatccaagtcatggatggagacagcaaacgtggataagctgtctaagggtccaaatcaacctttttatcaggtcctggttgatgtatatgttgatccagaactgctggttgcatatgtcgcagaagaaaatctttctgcagctgaagaatcagaaaagggaaggtttgatcacccctacattgagtttctcttttacggtgaggacacagctggggatttcattcctatcaagcagctccgtgagaagtatgaccagccacgctatgaagcttctggagatgaaagtgacaacgatggcaacacaaatagctgaaggtcaagtgccttcgtgttgctagagttgttttggaaccattttgattcacctccaccaactcagatgtgaagtgctgaactatctggtacagatgcagatgtaagacaaggcaaccattggcgaactgggcatcctcagtaacctgcagttattctctgcatatgccgtccaaccttgcagatcgaaaattactcttttagagttttaccgtcaccaatcgattaagccatgcttgagagaagctacgtgtgccttgcttttacattataataccatcgataaatataaacgaaggaaagaaaggaagaaagaaagaaagaaaaaaatatatatccctatggatgttctgtgtatagttctctgagatctatctagttctgtactgtaccctctggtggacaattgtgcatatgtaacactggcaacttgtgtggagtctcgaataaattacgcgaagacttcacatgcagttgtttggactctgcattcatgggatcaatcatgtggaaataacattttttggtgactgctaaaaaaaaaaaaaaaaaaaaaaaaaaaaaaaactcgagaaggggcgccggtacc

SEQ ID NO: 10542 - DNA, 2276 bp, Zea mays
ctgctttctgcggcagaggacccgtgggctgaagtggctaaggatgccaagaccacaaaagatccaaattactgtaaagtattgagctcaacattaagctcaataatgggctggacagagaaaagacttctggcatatcatgaaaccttcaatacaagtaatattgagtctatgcaaggcattgtctccattggagtgtcagctgcaagggttcttgttgaagatatatcccatgaataccgccgtagaagaaaagaagagactgatgtagctcgaagcagggtagagacatacataaggtcttcactacggacagcttttgctcaaagaatggaagaagcagattcaaaacgatcatcaagaaaccctactccagttctttctatccttgcgaaggacattagtgacctagctacgaaggagaaaaaattgtacagtccaatactgaagacatggcatcctcttgcttctggtgttgctgttgcaacccttcattcttgttatggaaatgagctgaagcagtttgtagctgggcttacagagctgacccctgatacagttgaagtacttaaatcagcagacaaattagagaaggaccttgttaatatcgctgtagaagattctgtggatagtgatgatggaggcaagtcactaatcagagagatgccgccatatgaagctgaaaatgcaattgctaatctggtgaaagtgtgggataaaggagagagtcgacgcccgccggggatgggttgaccggagtttgaagcaagagacctggaatccaggtgccaacagggataattttgctccctcttccgtggagatgcttcgagttattggtgaaacgttggatgcatttttccaattgcctataccaatgcatccggctcttcttcctgatctgacagttgggctcgacagaagcctacagctttatgttgctaaagcaaaatctggctgcggagcacgaaattcttttatgccccaactacccccactaacgcgatgcgaggttggctccaagttattattcaagaaaaaggagaagccacaaaatctgcaggttcgtgtatcacaaaatggagcatcaaacggaaatgatcccttgggccttcctcaactctgtgtgcgcctgaatactcttcagtacatccgtggtgagtttgagaatctagagaagaaaattaaaacgagcttacgaaatgttgagtcagctcaggcagatatcactgatggattgaacatcaagtttgagctttgccaggcagcctgtcaagaaggcattcagcagatttgtgagacgactgcatataaggtgatgttttatgacttgggacatgtcctctgggacaccctttatgttggtgatactgcatcaaacagggttgaggtactgttgagggaacttgaccctgtccttgagacggtatctagtatggtgcacaacaaagtgcggaaccgtgctattactgcactgatgaaagcaacttttgatggtttcttgctggtgcttcttgctggtgggcctttgcgtactttcacccgtcaagactctcagataatagaagatgacttcagggccctcagagatctgtacttagcagatggggatggtttgccagaggaattagttgacaaggcatcctcccaggtcaagaatgtcctgcccctctttcgagcagactctgaaagtctcattgagcgattcaaacgcatgatggttgaatcgaatcggcctgcgtccaagaacaggttaccattgcctccaacaacagggcattggagtccaaatgagcctaacacagtcctgcgagttctgtgctaccggaatgatgagacagctacaaagttcctcaagaaaacttacaacctaccgaagaagatttgacttgtgggatagatcacaaaccacatgtacattttcctgtcagtataaaaaggtttctctatgcctgtcacaatctctggctgaggacgcgcctcctcaagtgattgtcaacaagaaggtttattctgtggtgctggagagatgtgactgggtgttttcggtggttcgtatcatggataggttttgggttggagggtggattacttacagcttgatttgttcattataatatatatgtttgcttaatctagttcttttgctgaccttgcgctcatgtaatttgattcattctagtttgcgacagctatacccagcgtgtgaataagttgtgtactcgcgtgatactgtctggtgcctttgatgtgacaatatgaggagcatttgtatt

SEQ ID NO: 10543 - DNA, 2540 bp, Zea mays
gtttgtagctgggcttacagagctgacccctgatacagttcaagtacttaaatcggcagataaattagagaaggaccttgttaatatcgctgtagaagattctgtggatagtgatgatggaggcaagtcacttatcagagagatgccgccatatgaagctgaaaatgcaattgctaatctggtgaaagtgtggataaaagaaagagtagacagactaaagggatgggttgaccggaatttgaagcaagagacctggaatccaggtgccaacagggataattttgctccctcttccgtggagatgcttcgagttattggtgaaacgttggatgcatttttccaattgcctataccaatgcatccggctcttcttcctgatctgacagttgggctcgacagaagcctacagctttatgttgctaaagcaaaatctggctgcggagcacgaaattcttttatgccccaactacccccactaacgcgatgcgaggttggctccaagttattattcaagaaaaaggagaagccacaaaatctgcaggttcgtgtatcacaaaatggagcatcaaacggaaatgatcccttgggccttcctcaactctgtgtgcgcctgaatactcttcagtacatccgtggtgagtttgagaatctagagaagaaaattaaaacgagcttacgaaatgttgagtcagctcaggcagatatcactgatggattgaacatcaagtttgagctttgccaggcagcctgtcaagaaggcattcagcagatttgtgagacgactgcatataaggtgatgttttatgacttgggacatgtcctctgggacaccctttatgttggtgatactgcatcaaacagggttgaggtactgttgagggaacttgaccctgtccttgagacggtatctagtatggtgcacaacaaagtgcggaaccgtgctattactgcactgatgaaagcaacttttgatggtttcttgctggtgcttcttgctggtgggcctttgcgtactttcacccgtcaagactctcagataatagaagatgacttcagggccctcagagatctgtacttagcagatggggatggtttgccagaggaattagttgacaaggcatcctcccaggtcaagaatgtcctgcccctctttcgagcagactctgaaagtctcattgagcgattcaaacgcatgatggttgaatcgaatcggcctgcgtccaagaacaggttaccattgcctccaacaacagggcattggagtccaaatgagcctaacacagtcctgcgagttctgtgctaccggaatgatgagacagctacaaagttcctcaagaaaacttacaacctaccgaagaagatttgacttgtgggatagatcacaaaccatatgtacatgttcctgtcactacaaaaaggtttctctatgcctgtcacattctctggctgaggaccccgaggaaataccccctgtaaagtttccacatcaaaggtttcaagtgatcatcagcaagaaggtttattctgtggtgctgtagagatgtgactgggtgttttcggtggttcgtgtcattgataggttttgcggtgaagggtggatttacttacagctcgatttgttcattatattatatgtttgcctaatccagttcttttgctgaccttgcgctcgtgtaatttggttcattctagtctgcaacagctaaatccagcgtgtgaataagttgtgtactcgcgtgacactgtccggtgcttttgctgtgacaatatgcggggagcatttgtatattttactgcatcgtgcactccatctctctccatatcctcgttggatccgttcttcagtcaatcgatcctgttcaaagtgaaaaaaaaaaaagaaagagatgatgaaatgagtgattgttaacacatggttgagattagggatgaaagtggtaatctgaactgttaggacaaatttaatattttaaaatagatatgtacattatttgatggtgatcatgtgttatgttctcaagcatattattaaaaaaagaataaaatattacataaattgttttatttattatttgctccctaaaacaaaaaaaatgaaaaaattatcgaatttgttttcgaatccataccgaattttatatctatcatttaagaaaatatatgatgaatttaaggattaacttttatgaatctttacaagctcaatgttataaacaagaatacaaatttatatattgcaatatatatcctatttattcgcaatcaaagaaaaacgataaaaaactaattaccgaataaataccgttttcgatcgtttttatccctagttgagatacgtctatggtgttgaagggatgatagacttaggtttagtgttaactaatttaacgtaagttgtggcatatgtaatgtgtctcttaacttgtgtatatatgtagggcataggtgaacttgtgtatagatgtgggagcataggtgatagaacttagatggtgaacttgtgtatagatgtgaagcatatgtgatagagcttagatggt

SEQ ID NO: 10544 - DNA, 2853 bp, Zea mays
  misc_feature (1173)..(1173): n is a, c, g, or t
  misc_feature (2836)..(2837): n is a, c, g, or t
accggccggacctgcccggcgtgcccgaacagagcgcctcaccgcgccgcacgccgccgtcggtcgccgaccccagtcaccggtccacgcccgcctccccctttctcctccgccctttcttgtgaccgccgccgcgggccctagcccgccgttccctctccggcgccccgctcccgcacccgcaccggatcagtccgggccgcgtggtcgcccccacctaccgcctcgggtccactcgctcgcggttgcgtgtcccgcggggtggcccctcgggcctcggcagctccggtttcgaatggggctctcgtcggccgccactggcgacggggtgcagctctgcgtgttcgacctccagagggggcaacaggagggccaggagctcgacaagatcctctacttctaccccgccgactgccccatcctgctccagctctctgtcatcggcctctgcgaggggatcgtcactttcactaggttgccttcgctctcactcatttttattgtgcagttggtcgcaatttgaaggtcttgatctgctcgtgctcctcgccaacaacagcagcagcatcttctgcgtttaggaaaagaattgcacccagctttctagagggctacaacagcatctaagcttatagcatcacttcagtatttcaaatccgtagattgctcgagtatgcaagtttgggtgaatcgattttgttgcatgtgatccagcttaggttttttcaagcaagaacaattctggacttgattagtttttttggcagcgggccaatggcgttggttcctaagttcacctgtatgacagtggcagatctagaaacatctagccttttaatagtaataacatttgtaattttgtatagtggtttattttcacatagtgttcacagttcacatattcatgtagatctctagacaactgcaaatactaatggatgattactcagactgacatgggggttaacatcagtaattggggcccttcataagcaacatctcttttgtggtcacattatgacttccgtttgctctttgatagtgtattctccccaaattgccatccaagtatttcctgactctatacttttgataattcatttattgcctaatattgctgggttccacatcttatttctcaatgttagttatatgcagaattttttcccccgnaagaggattgcgaggttatagattcagagaaacactcccatgttttttaccaagccgaaacggatatttggatggttctggttgtggaaaaaaacaaggaaaatgaattgacttggcgttgtggtgcactacaagggattcttaaagaggctcattctctctttgcaatgtttcatggaccaatccgaactttgcttcacaaacaacccagtgcagagcttgctcgtggtcacctccgcacatttcttacagattatttgagcgattttaatgttggaaagaagttacaatttccaacctaccgtgacagcctaaaggagaggggaacagtccaaatgcttacggtatcacgagaagtggcacttgacgttcagtcactcgccacagtacttggatcatgtcttggaaatgttacctgccaatcacttgtactatttgaagacctcttggtgtcaacgacactgcccccggatgatactttaaacctatatacatatgctgttctgaggttaactccgcgtgctttatattccaatgcaagttcttggtcctatttgcggaaaggaacttctgttagtgctggccaaacatcaagttcatcaaatggaacaactgcaggagaaaggcctctcctacgtgagaaattgtcaaagggaaaggatggctttgttgctgctgatttcacagctacagaagctcgttgtgctgtaccctcgactccaatactttggttccagcaggcagatgagtgcatgcacctatgcatttatcagcacaaaagtctcactatcttactgctggttcctgcttcctcagtgataaatggagaagagggcattactcatgtgaagaaggcgatccttgaaaatgcatcacagaagattgtcactgttgagcagaaattgacacgaggatggggaggagaaaatgcgtatcatgttagtggatatcgttatttgcttgttgatccggagagaagagtatcaagagcctccccacctgggaaagtcaccaccctagcaaaggattctctacttgccctcaacatgctaagacaagaagtagatctagagaagtcaagatacaagagaggcgacccttgtcatgataaggatttcgaagtatgtatcagaacaaaaaacaatgcgtgggttattgctaaaatcagtcaaggaagggagctttacatggctctagagaagggtggtgaaacgcttctatatgcatccacagctgtagagaaattcagcaacaggtactgtgagggagcattctctacagattagaagcaccagagggagatcttagcttttccatacattacctattatgtacatcctgtttttttcccagctgtatcgttgccccctattgttgagagactcggaccactctttgcgaagggaataaggagttcgtatcagttgtacagctgctctgctgtcgtgtgctatctgcaaaagaatagcctagtctgggaataacgcagagcgggatagagtttgtttgttcacttatgcccttccttaacgcagagcattgtgcgtgttttcattttgctgtaacagccggcgatttacctgcagactgggaaagtaacttagcgtttaatttggtattctgaaaaaaaaaaaaggaaacccggtacccaaaaaaaaaaaannaaaaaaaaaaaaaaaa

SEQ ID NO: 10545 - DNA, 1049 bp, Zea mays
  misc_feature (1026)..(1026): n is a, c, g, or t
  misc_feature (1031)..(1031): n is a, c, g, or t
  misc_feature (1035)..(1035): n is a, c, g, or t
cattgggtacctcgaggccggccgggtacctcgaggccggcagcgcctcaccgcgccgcacgcctgcgtcggtcgccgaccccagtcaccggtccacgcccgcctccccctttctcctccgccctttcttgtgaccgccgccgcgggccctagcccgccgttccctctccggcgccccgctcccgcacccgcaccggatcagtccgggccgcgtggtcgcccccacctaccgcctcgggtccactcgctcgcggttgcgtgtcccgcggggtggcccctcgggcctcggcagctccggtttcgaatggggctctcgtcggccgccactggcgacggggtgcagctctgcgtgttcgacctccagagggggcagcaggagggccaggagctcgacaagatcctctacttctaccccgccgactgccccatcctgctccagctctctgtcatcggcctctgcgaggggatcgtcactttcactagaatattttccccagaagaggattgcgaggttatagaatcagagaaacactcccatgttttttaccaagccgaaacggatatttggatggttctggttgtggaaaaaaacaaggaaaatgaattgacttggcgttgtggtgcactacaagggattcttaaagaggctcattctctctttgcaatgtttcatggaccaatccgaactttgcttcacaaacaacccagtgcagagcttgctcgtggtcacctccgcacatttcttacagattatttgagcgattttaatgttggaaagaagttacaattcccaacctaccgtgacagcctaaaggagaggggaacagtccaaatgcttacggtatcacgagaagtggcactttgacgttcagtcactcgctacaagtaccttgggaatccaatggtcctttgggaaaaatggttacccttggccaaatccaactttggtaactaaattttggaaaggaccctcctttggggtggtccaaacggaccaacttggcccccccggggaatggaataccnttttnaaanccctaattaatacc

SEQ ID NO: 10546 - DNA, 1100 bp, Zea mays
  misc_feature (1067)..(1067): n is a, c, g, or t
  misc_feature (1075)..(1075): n is a, c, g, or t
attgggtacctcgaggccggccgggaacagcgtttcaccgcgccgcacgcctgcgtcggtcgccgaccccagtcaccggtccacgcccgcctccccctttctcctccgccctttcttgtgaccgccgccgcgggccctagcccgccgttccctctccggcgccccgctcccgcacccgcaccggatcagtccgggccgcgtggtcgcccccacctaccgcctcgggtccactcgctcgcggccgcggcccgcggggtggcccctcgggcctcggcagctcccggtttcgaatggggctctcgtcggccgccactggcgacggggtgcagctctgcgtgttcgacctccagagggggcaacaggagggccaggagctcgacaagatcctctacttctaccccgccgactgccccatcctgctccagctctctgtcatcggcctctgcgaggggatcgtcactttcactagaatattttccccagaagaggattgcgaggttatagaatcagagaaacactcccatgttttttaccaagccgaaacggatatttggatggttctggttgtggaaaaaaacaaggaaaatgaattgacttggcgttgtggtgcactacaagggattcttaaagaggctcattctctctttgcaatgtttcatggaccaatccgaactttgcttcacaaacaacccagtgcagagcttgctcgtggtcacctccgcacatttcttacagattatttgagcgattttaatgttggaaagaagttacaatttccaacctaccgtgacagcctaaaggagaggggaacagtccaaatgcttacggtatcacgagaagtggcacttgacgttcagtcactcgccacagtacttggatcatgtcttggaaatgttacctgccaatcacttgtactatttgaagacctcttggtgtcaacgacactgcccccggatgatactttaaacctatatacatatgctgttctgaggttaactccgcgtgctttatattccaatgcaagttcttggtcctatttgcgggaaggaacttctgttagtgctggnccaacatncaagttcatcaaatggaacaactgc

SEQ ID NO: 10547 - DNA, 1340 bp, Zea mays
cctcacacacttccgtcttcacactcactctttacacgaccacgctagcacgccctctccgtctctccccttccggttccggttccagtggctgcatccgctgcgccaccccccgtctgctcacccaagtcccaatcccgcagcccggcggcatggcggtgagcaacaacatcacggcatgcatcaacttcctggtgcttctctgcaccatccccatcgccgcgacggggctgtggctggcctcgaggcacggcggcgaggactgcgccaggctggcccgctggcccatcgccgtgctgggcgcgctcctcctgctggtcgcgctggcgggtttcgcgggcgcctactggaaccgcaggggcctgctcgcctgctacctcttcgcgatggccgccctcatcacgctcctcctcgccctcctcgtcttcgccttcgccgtcgcgcacgactccggcgcctacccggctcccggcagggcctaccaggactaccgcctccagggctactcctcgtggctgcgggggtacgtcgccgacgacccccgcaggtgggagggggtccgggcctgcgtcgccgcctccggcacctgcaggaagctcgccatggatagatcattcatcgtgccggagcagttctacatgtcgcacctctcgcccatcgagtccgggtgctgcaagccaccgacggtgtgcgggtacgcgtacgcgaacccgacggcgtggacgggcccggcggcgagcccggcggcggacgcggactgcgcggcgtggagcaacgaccccggccagctctgctacgcctgcgcctcctgcaaggccggcgtgctgggcggcctgcgcgagcagtggcgcagggccaccgtcccgctgctcgtcgccaccgtcgcgctcatcttcgtctacgtcgtcggctgcagcgccttccgcaacgcgcagaccgaggacctcttccgccgctacaaatggggaaattattaacgatctctcccactgatctacatctactacgtacgtacacgccgatttggatcgggccacaggattttcacatgcgcctcggagagaccgagaatggactctgcgttaccgtacattttcagcaatccggttcaccaagatttgggcccaatggcccatcacggatatcccatccgtggcgtgtgctcgccaaattggagcacgccgtccgcgctcttcgcgtccttttgtttgggatggttgccagttatattaaggtcgctcagcaattatgtgttacatgcaaaataaacataaaaataaactgtaacactgggtgtatttaaatctaaaaacaaaaaaaagcgacaaacaaaaaaaaaa

SEQ ID NO: 10548 - DNA, 2546 bp, Zea mays
ggcccttgaaggggaacagcccgtagtgctgctgcgggtaggacggcgtggtggtgcagctgaactccacctcccgcgggtggccgtagaacgaggccagcgtggatgacgacgacgacgacgacgcgcgggacgcgccgccgccgtaggtggtgaggtggccgtggccgtggccgtggcggtggtggctcgacgggtgcgcgaggtggccgcgcagcgtcctcccggccagcttgccacggccgaggaggaggtggacgtccatcatgatgcgcttcggggagaggccccgccgcagcatgtggcacacggccagcaccacgtgccacacacgacgcgccacgccaggctccatggcccgccgcgccggggtcgtcgcgagatccatggctagcaagctgctggaagctagcgcaagtctttgtggcaaagcactagcttgcaaggatcaacgatgtgtctgcacagttggagagatcaatgcaatctggcaggcaggaagagatcaccgggaggagctgccagttgttctttggtgatgcatgatcttagccagggaagggatgggatggtttgggaggagcgggagaggtatttaacggagggaaaggtggcaaggatcggtcccacaaaaacacaacttaatttggaaggaagggttacttaattagcggtagttatttacttatttcctgctttgaacctatttaatttgtggggtttcttactaactagtactaattcatgttctcaatatctcaacgctggaacagtattatgcaatttctaatacaaatgctacatacaagttaactactactactctggtgtcgagttagctctgtgtgttgaattgttggcaggggtgacgccgattgccggtaataagtatgaacagctaaaggttgctccttttattccggtggcatgtgtgaagtcgaaacaataaatcagaatgaggcggttggtggagataatttttctaaagcccttataagtcaagtccaaaaggatcactttggaaaggaaagaaaaaaaaaacatataaatcaccgcgacaaagttggtggaagttcgttcgaaggtgatgtagactagctaggtcgaaaaaaaaaagaaagaaacgatcaaattaattaaatttttacttatattctttgttttttccccaaggatattcatggtcagcgaactttgtttgagtggtgcaaaacataggtctattcttgtctgattgactgttgatgaactgggagtctgggatggccaaaagatcacagctgctttggtttcttgttcatgtggtgcgtgtgaagcattcattgtacacgatttcataagcatattgtcgtcactctaagatcggtcggtatacattgtcaaaaaagacgcatacaagacgcctgtttcgtgctcccaatgcacaccaaattaatgccaagcagctgatgtattccttagtgagcaagtgaggaatttctttaacgcagtttctttttcctgcttggtacggtggttgctctcttgctggctggctttggctaaagcagccggtcgtcatggattcagctcggagctcaagactcaaggaacatagcttttccacacccaaatgctgatcgaggccactttttgtacatgctcttgctagctaacagcatctaaacaaacttgaagtagacgccttaccctggcttcttttttttcaaataaaaacagcacagttactggaaaaccggaagtttctcttaagcatttgcatggtatttagtctaggtgatagaccatgagatccattatcctagacgatgattagcactatacacaccctctctctctctcccagaaacagtacttataagattttaattgactcagaaacagtactttctgtatcagaaaccaataacacaaaaaaatctaaccgttacatcagatttcatatatagatttatattagtttatacggcccatcttacagattagaaagacataatatgattatatattgggagctggagactaaacggccagatcagacgcgtggggcatataatagctagggtctcgagagcaagtgggctggtgctcccccaaacatggtgtcccctctgatggtggtagaaatttaaaaaagacatcacacaaacaaaaggcaaaccacaatctccacgtttatgaacttttcccaaaccaggcccctttgcttttctaccctttgtggcctgcccctgtttcgattagctagatcctacgatgctcggtattatttcatttactagtatattatatacggttagtgctagtttgagaatcctattttctcaaggtaaattagttcattttttcttagaaaaatagaaaacacttgaaaaaatagagttcctaaactaacccttagtgtgaaataacgaagaggagttcaactacggcctatgtgtggtatagcccaaaaaatcttatgccaaataattggtttagattggatgtgttggggacttgttctcaaaatactatgaattaagaacaaggcaacacgagatata

SEQ ID NO: 10549 - DNA, 1211 bp, Zea mays
gcacgagaccattacctagaacatcctaatcgaaaaacccaaacgaatattatagaagctggctgaaaagctgagtgtttggcagtccgcagtagcttttggtggcctaccgcgtggccgggtgggatccattgtcggttgtcgcctctgaccgtaccacctctgttacctgcaccgccgctccgttaaatcgcggcccgatcgccgatgcctccccgccccgtcccactattctctcgcctgcgcttccgcctcccgagttgcgccgccgtctccatctccacccctccatcctccgcggcgcccctgcactacggccatcgcactcccctcgctagcccttttcctctgtccccaccttgcccgcgcatcctccgtgcggccgtcgcggtttcttcgctggatctgcgcccgatcaccggcgggttcgcgctattcagcatggctgctgcctcctccgccacctccgtccacgacttcaccgtcaaggatgctagcgggaaagatgtggaccttagcacctataaggggaaggttctgctcatagtcaatgttgcatctcagtgtggcttaaccaattccaactacacagagctgagccagttgtatgagaagtacaaggaccagggttttgagatccttgcattcccatgcaaccagttcggtgggcaggagcctggcactaatgaggagattgtccagtttgcttgtactcgcttcaaggctgagtatccaattttcgacaaggttgatgtcaatggtgacaatactgcacccatttacaagttcctgaagtccagcaaaggtagtctctttggcgataacataaaatggaacttctccaaattcttggttgacaaagaggggcatgttgtggagcggtatgcaccaacaacttccccactgagcatcgagaaggacatcaagaaactactagggagttcttaaaccttgtaattggattcagtagccctaccaaactgctgctttgcatcgagcacctgatgcctcagtagcgttttaataaagttgtttttataaccgagatgttttgtatttcttctgtattccctgctttgtggtaaatgtcatgtaataaaaatgatgcaatccacgatttatcttgaaaggttatgtatccaggttggttgttatgagataaaaaaaaaaaaaaaaaaaaaaagggggcatatcttgcgtacctgcctacc

SEQ ID NO: 10550 - DNA, 326 bp, Zea mays
agcagtggtaacaacgcagagtacgcgggtatgcaccaacaacttccccactgagcatcgagaaggacatcaagaaactactagggagttcttaaaccttgtaattggattcagtagccctaccaaactgctgctttgcatcgagcccctgatgcctcagtagcgttttaataaagttgtttttataaccgagatgttttgtatttcttctgtattccctgctttgtggtaaatgtcatgtaataaaaatgatgcaatccacgatttatctcgaaaaaaaaaaaaaaaaaaaaaaaaaaagtactctgcgttgttaccactgcttc

SEQ ID NO: 10551 - DNA, 1217 bp, Zea mays
ctcggggccggccccagcaagcagcaagcctctctccattttcttcgccggcggcaggtgcacacatcggggaatggcgacctacgaccatgccgccaccccgacaccgcagtctccgggcgtcggcggcgtacccttctcgtcctgcatcggcgacctcctccgcttcgtcctctcctcccacgccgccgcctaccccggtgacgacacggtcgctttccccctctcgccctcctactgcgcccgcctcctcaacgacggcgaactgttcgagaagctggaggcctgtattcagcagtgcctcgaggaggggcggctcccggggccgcccgcggtggttgggattccggctgaggaggaggggccggaggagagagggtggaagctgctgctgccggagaaaggcgctgagttgaagcggatgtacgatgctgttgagtttgagctgcatgttcaggaaccctacttcactcaactcagagccggagtcaagaaggttgaagggagattagcgactggtaactacaaccggattacacaaggttctttgctgctattcaataaatgcctcttgcttaacgttgaggcagttaggaagtacaattcattctctgagatgctgcaaggagagaaaatctcaaatgttcttcctggtatttcatcaattgtagaaggtgtgaaagtatataggaaattctatgcagaggaaaaggagaactcttatggagttttagcgatatcagtttcaaagccaacatctcaaccttacataaccatgaataatatccttgctgtgagtgcgactcttcagaattttacccaaaattattcgaaaaaaggtcaaaggcgtgtcgcgcacatgctagtagattcatagaattattcgaataaataatgctagtagattcgttcttctcttttagctaggtccatgtaccaccaagaggcaaggctggctcactttgttttgttccattgcggccgggaatcagagaaaacagaggcaattaatgctacgtttggaagtctttgtttaatgaagcactagtccttgcttgtatctgatttctgcttgaccgtggtggacaagctatatgctagctacgttgggatgggcgcaatgatctggagggagagccaagtcacctgacttgtattatccccgccaaacaaaaaaaaaaaaaaaaggagtgatgatgtgatgacacagagccaat

SEQ ID NO: 10552 - DNA, 1975 bp, Zea mays
aaaataacgcaaacggtaccagcaagcagcaagcctctctccattttcttcgccggcggcaggtgcacacatcggggaatggcgacctacgaccatgccgccaccccgacaccgcagtctccgggcgtcggcggcgtacccttctcgtcctgcatcggcgacctcctccgcttcgtcctctcctcccacgccgccgcctaccccggtgacgacacggtcgctttccccctctcgccctcctactgcgcccgcctcctcaacgacggcgaactgttcgagaagctggaggcctgtattcagcagtgcctcgaggaggggcggctcccggggccgcccgcggtggttgggattccggctgaggaggaggggccggaggagagagggtggaagctgctgctgccggagaaaggcgctgagttgaagcggatgtacgatgctgttgagtttgagctgcatgttcaggaaccctacttcactcaactcagagccggagtcaagaaggttgaagggagattagcgactggtaactacaaccggattacacaaggttctttgctgctattcaataaatgcctcttgcttaacgttgaggtaatattattttctaaataactaactcttctcgggataatttattatgctttttacatcatcatctcttgttactgtttgcgtttgacattgatatttagacatcttcttcaaaagaaattgtatttattttgtaatactccattatgcaaaattattaatcaaatcaggcattcattacattttttttttctgtaaatttgccagtctcctttgcttatgcttttttttcaggcagttaggaagtacaattcattctctgagatgctgaaaggagagaaaatctcaaatgttcttcctggtatttcatcaattgtagaaggtgtgaaagtatataggaaattctatgcagaggaaaaggagaactcttatggagttttagcgatatcagtttcaaagccaacatctcaaccttacataaccatgaataatatccttgctggattggggtatgatggactgggtagactccttggtatggcgaaaacaactggaactgttccagatggactacctcctccaagatctgcactgctgtcatcttgtatgggactggttcaaccaaatgagtaggaaaggatggtggggcagctttaatgggagtggtaaagataaagtccaccttgatacgccggagtccagagttcgagacttctgtcgtgatctatttcattgttgtgttgcttgtcttcagattcaagcaagaaccaagctgcatctgaaaccattgagtctttgctgcgtgtgtgttgttggatgaatgttcatctgactcaaccctatggtcctgtttttgaaatccgcgtgcatgaaggttatggtgccagatggtctcaagatggttcaaagttcattggattcttggagccctacaccccagaaggctatgctaagggatggaaacactagcaccagctgcctagtagatcttgatctgtattagcgactctatcagggttcatctgcatatcttctgaaggcctacatgttctgttgaatcgaaagagacgatcatgtgttacgtcagctgcctgcctaagatcatgtgttgcatgaccactgttttatttctgaatatgttcttttttttttgcaaggcgtatatcgacaccaagtactgatatatgcgtctgaatatgttctacttttattcaaacacacccgccaagatcagttcatagttttgcacaaagacatgcaaatgcaattggacacaacccaaatagaaaggtattttttgtttcaatccaaactattcctctactgcgactaagtactgatgtcatttctggcatctgactaacaaaaagcatacaaccatgaatgtcgctgatgctagttattttgtggatttggccgtataaataatcaaataaattcgaag

SEQ ID NO: 10553 - DNA, 1084 bp, Zea mays
gcacgagaccattacctagaacatcctaatcgaataatcttatcatttttactgaaaattaaaaaacttgaaaacgaagttgtgctaaattaacgatgttatatataattaacttattaatgtaatgatatatgtaagtcgttcaaattaattcttcgtgatagtatgtgatactataggtgtgattagctcaacgactttttcacatttttcacatctgaatcaacgcaccctgtgcccggtgccgccgacccaaatggcatccacctcgccggaacccgccgccgccgacgaaactatcgacaccatccacatccgtcgcctagagtgttccgaccacgagaggggcttcgtcgcccttctctcccagctctccccctgcccggacctcaccacatccgtgttcgccacgcgcttcgccgagctcgcggcgcagggcgacgaccacatcatcctcgtggccgaggacccctccgcctcggaccggcggatcctcgcgacagggtgcctcttcgtggagcgtaagttcctgcgaggctgcggcaaggtggggcacgtggaggacgtggtggtcgatgccgccgcgcgcggcaggggtctcgggctccgcatcgtgcgccgcctcgtggagatctccagggacgccggctgctacaaggtcatcctcgactgcacccccgagctgcgtgcctactatgccaagtgcggattcgtggagaagggtgtccagatggccgtctacttctgagttctgatctagagattcattgctaaggagtgatggcatatgcgctcgttctgcttaaagaccccatctaaatttgccgtgaattttggcaattgagaagcttccttagaactgtattaatcctttataagaaccgatagatgttcatttttgtcttctaattatgtttggcgaggccattatgaataatgttccccacttctgttcccgtttgcatcatcaaacgagatattagcctgtttgttccggattccaaacgcttcggctgaactcgcttatttgaatcatttaaatcaatgtgaatataaaatttgctgaacaaaaaaaaaaaaaaaa

SEQ ID NO: 10554 - DNA, 934 bp, Zea mays
cattgggtacctcgaggccggccggggtcactcggtccaccacctcagctccgccgcttgcccgcttttgctctctccctcccggctctcggcttcttctacacgctaccgtaaacgcccccctcccggatcccgctagttcgccacttcgccccagcatggccgcctcgtcgaccgccacctccgtccacgacttcatcgtcaaggatgcgagcggcaaagacgttgacctcagcacctacaaggggaaggttcttctcattgttaacgttgcatcccagtgtggcttaactaactccaactacactgagctggcccagctctacgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgacgtcaacggtaacaatgctgcgcccatctacaagttcctgaaatctagcaaaggtggccttttcggcgacagcatcaagtggaacttttccaagttcttggttgacaaggagggacgtgttgtggatcgctatgctccaaccacctcacctctgagcattgagaaggatatcaagaagctgcttgggagctcttaaacaatatctgggtgcaaaactgtagaaaaacatgtatcaacaatgccctgagcgataaaatatatgataagctgtattaataaagtattgccgtacttgagaggttgcagtatctgctctatttcccttgcatacactctgtacttgtatatccccttcgaatgaattccaatgctgtatcagtttgctaccccaaaaaaaaaaaaaaaacccgataatagcatatttgggagaagaggaatggagaggctaaaatccctttactattt

SEQ ID NO: 10555 - DNA, 904 bp, Zea mays
ttgggtacctcgaggccggccgggatgaagattcttgcccataacagacagcgtgcccccggcccggccaggcgctcgtcgctcggtccaccacctcagctccgccgcttgcccgcttttgctctctccctcccggctctcggcttcttctacacgctaccgtaaacgcccccctcccggatcccgctagttcgccccagcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgatgtcaacggtagcaatgctgcgcccatctacaagttcttgaaatctagcaaaggtggccttttcggcgacagcatcaagtggaacttttccaagttcttggttgacaaggagggacgtgttgtggatcgctatgctccaaccacttcacccctgagcattgagaaggatatcaagaagctgcttgggagctcttaatcagtatctgggtgcaaagctgtagaaaaacatgtatcaacaatgccctgagcgataaaatatatgataagttgtattaataaagtattgtcgtacttgagaggttgcagtatctgctctatttcccttgcatacaaaaaaaaaaaagcggcccccgccgcgaatgaattccaatgctgtatcagtttgctacccc

SEQ ID NO: 10556 - DNA, 1194 bp, Zea mays
acctcccgtccgcgagaattgcattcgtacaaccgcagccgagacggttgaccaacgctgccacgattccgtccacacgccgacgcggcgggctcctggccgacgagcactcccctccgaacgccgcgttggccggccccgccccacgaggccacgatgcagtagcagcgttcacaccatctgtctgtctcaagtgtcacggcgtccgtcattcgattcaacccccaaccccccatgggcctggccgtataaatcaaccgccggtgaagtctagtcgtctcgtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgatgtcaacggtagcaatgctgcgcccatctacaagttcttgaaatctagcaaaggtggccttttcggcgacagcatcaagtggaacttttccaagttcttggttgacaaggagggacgtgttgtggatcgctatgctccaaccacttcacccctgagcattgagaaggatatcaagaagctgcttgggagctcttaatcagtatctgggtgcaaagctgtagaaaaacatgtatcaacaatgccctgagcgataaaatatatgataagttgtattaataagtattgtcgtacttgagaggttgcagtatctgctctatttcccttgcatacactctgtacttgtatatccccttccaatgaattccaatgctgtatcagtttgctaccccaaaaaaaaaaaaacataccgaaattagctgatttcccccttaatccccttca

SEQ ID NO: 10557 - DNA, 767 bp, Zea mays
tcgtggcggccccggagggaccggacacttttacccctgatgaaaatcgccgctcacatctcatctggcatactatggcggcgcctctcctcggtcggacctcggcttccaccggcggtgcctagatcggcggcgcccggaccttggcctctgtcggcggtgcccggctcccctcggcatccaccgacgccggccgactcactatctccctccccccgttgatgcccgacatcaatggcggagcaccatcctgatctcatcatatgccggaagcagcctggcatcgtgattggtcgcgtgtgcgagaaatgtgatggcaagtgtgtcgtctgcgacgagtgcaattatggttcgttccagggaaggtgtgtgatatgtggaggagtcggcatctcggacgcttactactacaagaagtatggttttaagaagagatgatcgagatgatttgggctgtgtgtggttctctttggctgtgtgttctgttctatcgcactgaatactgagagtaggcagctgaggcagcagctttgtattcctattatggtttgatagttgttaccgttgtgaaaatgtagctccgatatgttttttaataactagttctaattgtagggtgcaagagactgcatatgtaatctgtgcttgatggtaatggctatgaatgaacttgaaacgttggcatgatatttgtcaacaaatgacatgttactgctcaaagaatctagttgtcatttagaacggaaaaaaaaaaaaaaaaagcggcc

SEQ ID NO: 10558 - DNA, 1522 bp, Zea mays
  misc_feature (971)..(971): n is a, c, g, or t
  misc_feature (991)..(991): n is a, c, g, or t
attgacaccaccaacgcacgcacgacccttcttcctcctcccggcggcggctaggctaccgctattgatttctccttgcatcgcctttattgcgctcacctgctctgccaagtgccaacgtcgtacacttccagcagtggagggagccggagcacgagctgcccgctggacgagccgtcgccgccacagaaatctacatataattgcagccccaaccacctcgttcctcttccccttcccccctccccagccaaatccgctttcctagctctaatcgccgccgatctcgccggaggaactgctagctagctgctcccttcacttctcaggagtcaggattaaaagttgcctcaagaagaagatccctctgcgccgctgcatgttgagcgagcctaccgtagcgacgagcgcggatatgaattggtgttgtgttcctagggccaagagagaagagaacccttactccaacagcatcggcggcatctactccgagaagaacataaggctcttctcctatgccgagttaagatctgctaccgacaacttcaaccgcaccaacaaagtgggacgaggcggattcgggacagtttataagggaaccatccgaagcgggcgagaggtcgcggtgaaggtcctctccgccgagtccaggcagggcatcagggagttcctgacggagatcgacgtcatcagcaacgtcaagcaccccaacctcgtcgaactcatcggctgctgcgtcgagggaagcaaccggattctggtgtatgagtacctcaagaacagcagccttgaccgtgcgctgctggcttctaacagtgagcctgccgacttcacctggagcgtcaggtctgctatatgcctcggagtcgctcggggccttgcgtacctgcacgaggagatcgcggcgccgatcgtgcacagagacatcaaggccagcaacatactgctcgacaggaactacgtccccaagnatcggggatttcggtctggnccgagctgtttcctgacaatgtcacccacgtcagcacccgcgtcgcgggaacaccggctgccccgcccccggcgacggcctagtttttttttttttttttgcacttctgccgcttgccttttaccgtatgttcttgcagaggctaccttgcgcctgagtacgcctggcatggccagctcaccaagaaagcggacatctacagctttggtgtccttgtcctggagatagtgagcggcactagtagctccaggagcatactcatggatgacaagattctcctagagaaggcatgggagctgtacgaagcgaagaggctcaaggaactggtggatccagcccttgtagactgccctgaggaagaagccatcaggtacatcatggtggccctcttctgcctacaggcggccgccgcgcgccggccgacgatgccccaggtcgtcaccatgctgtccaagcccgtccggatcaacgagagcgagctgacggcgccggggtacctccaggagtacagcaggcggagccccttgtcca

SEQ ID NO: 10559 - DNA, 1783 bp, Zea mays
attgggacctcgagccggccgacatcacactcgcttcaatattgacaccaccaacgcacgcacgacccttcttcctcctcccggcggcggctaggctaccgctattgatttctccttgcatcgcctttattgcgctcacctgctctgccaagtgccaacgtcgtacacttccagcagtggagggagccggagcacgagctgcccgctggacgagccgtcgccgccacagaaatctacatataattgcagccccaaccacctcgttcctcttccccttccccctccccagccaaatccgctttcctagctctaatcgccgccgatctcgccggaggaactgctagctcgctgctcccttcacttctcagattaaaagttgcctcaagaagaagatccctctgcgccgctgcatgttgagcgagcctaccgtagcgacgagcgcggatatgaattggtgttgtgttcctagggccaagagagaagagaacccttactccaacagcatcggcggcatctactccgagaagaacataaggctcttctcctatgccgagttaagatctgctaccgacaacttcaaccgcaccaacaaagtgggacgaggcggattcgggacagtctataagggaaccatccgaagcgggcgagaggtcgcggtgaaggtcctctccgccgagtccaggcagggcatcagggagttcctgacggagatcgacgtcatcagcaacgtcaagcaccccaacctcgtcgaactcatcggctgctgcgtcgagggaagcaaccggattctggtgtatgagtacctcaagaacagcagccttgaccgtgcgctgctggcttctaacagtgagcctgccgacttcacctggagcgtcaggtctgctatatgcctcggagtcgctcggggccttgcgtacctgcacgaggagatcgcggcgccgatcgtgcacagagacatcaaggccagcaacatactgctcgacaggaactacgtccccaagatcggggatttcggtctggccaagctgtttcctgacaatgtcacccacatcagcacccgcgtcgcgggaacaacaggctaccttgcgcctgagtacgcctggcatggccagctcaccaagaaagcggacatctacagctttggtgtccttgtcctggagatagtgagcggcactagtagctccaggagcatactcatggatgacaagattctcctagagaaggcatgggagctgtacgaagcgaagaggctcaaggaactggtggatccagcccttgtagactgccctgaggaagaagccatcaggtacatcatggtggccctcttctgcctacaggcggccgccgcgcgccggccgacgatgccccaggtcgtcaccatgctgtccaagcccgtccggatcaacgagagcgagctgacggcgccggggtacctccaggagtacagcaggcggagccccttgtccaaggccaccacttccaccgactccaggttcaagaacctggcgtcccaggaggactccaacatgttcagcacggtggtgccacccacggtgaccgagatgagccccaggtgaagcaaccgccatgtaattttgactgattccttccttgcgttttgtcaaccggcgactatatgatgtagtgccaagtgtgttttcctcctgcaaatgcggcaactagatcttgtacatatagattagtgaatccatgccagacccagagcaatgcaagattgctgtttgttgcaaaaaaaaaaaaacaaaaaaaaaaaaaaaaccta

SEQ ID NO: 10560 - DNA, 1167 bp, Zea mays
  misc_feature (9)..(9): n is a, c, g, or t
  misc_feature (12)..(13): n is a, c, g, or t
ctgtaggtnggnngcctgctgttagccgcagcacacacagaagatatttgcggaggaaggcaaggcgtgatgccctcaaagaatctggacaaagttttgagacgagttctgttgctgcatcaattgatagcgataaagttctctctgaaaatggagggttggagcctcgtctgccttcccctggtcgcccctcttttgtccctgagaaaatcagtgcaagttctgatggttttgaacttcaagcagaccctgaaattgctggagaacagttgcattctgaccagctatcttatggtgatgatactgatgcatgtaccaaagaattggacaaactagatataaaaggtgaggatgagggaggtgatgatgcacattccgtagactatgagagcagcgaacagagttgggccctgaggtccttatctgaatcaactatagcatgtgttactagtgattacgcgatgcaaaacgtcatcctgcagattggcctccggctcatagcaccaggtggcatgcagatacgccagatgcataggtgggttttgaggtgccatgcttgctataaggtgacccaagaggttggcaaaatattttgtccgaagtgtggcaatggtgggaccttaaggaaggtctcagtgacagttggtgaaaatgggatcactatggcttcacggcgcccacgtgttacacttcgaggcacaaaattttcgctcccaatgcctcaaggtggaagagatgccataactaagaaccccattctacgtgaggaccagcttcctcagaaggttcttcatcctaaattgaagaagtccagcaaggcggatgatttcttgggcgttgaggacatattttcgcacagtggtgataagaaggcgtcactgaaacctccagttggcaaggcactggcaatgttcagcgggaaaaggaatccgaacgacaaccacttctctcgcaagaagcactaagctgtccccttttcatgcacacctaatggtaccctagtttgtaagcaagaagagtggctgagagggggagtctatcgtattcatgtacgaacacatatataagcatgttaagctatgcagttttgcagcaaaaaaaaaaaaaaaacgtgcctggtgtttctaattccaatggatttgaatttttttatcttgaatattcaca

SEQ ID NO: 10561 - DNA, 1268 bp, Zea mays
cacgacgttgcatgggaagaggatgagaataatgtaggttggatcccactcttccggcctgctgttagccgcagcacacacagaagatatttgcgaaggaaggcaaggcgtgatgccctcaaagaatctggacaaagttttgagacgagttctgttgctgcatcaattgatagcgataaagttctctctgaaaatggagggttggagcatggtctgacttcaacaggtggcctctcttctgtccctgagaaaatcagtgcaagttctgatggtcttgaacttcaagcagatgatgaccctgaaattgttggagaacagttgcattctgaccagctatcttatggtgatgatactgatacatgcaccaaagaattggataaactagatataaaaagtgaggatgagggaggtgacgatgcacattccgtagactatgagagcagcgagcagagttgggccctgaggtctttatctgaatcaactatagcatgtgttactagtgattacgcgatgcaaaatgtcatcctgcagattggcctccggctcatagcaccaggtggcatgcagatacgccagatgcataggtgggttttgaggtgccatgcttgctataaggtgacccaagaggttggcaaaatattttgtccgaagtgtggcaatggtgggaccttaaggaaggtctcagtgacagttggtgaaaacgggatcactatggcatcacggcgcccacgtgttacacttcgaggcacaaaattttcgctcccaatgcctcaaggtggaagagatgccataactaagaaccccattctacgtgaggaccagcttcctcagaaggttcttcatcctaaattgaagaagtccagcaaggcggatgatttcttgggcgttgaggacatattctcgcacagtggtgataagaaggcgtcactgaaacctccagttggcaaggcactggcaatgttcagcgggaaaaggaatccgaacgacaaccacttctctcgcaagaagcactaagctgtgctgtctccttttcatgcacacacctaatggtaccctagtttgtaagcaagcagagtggctgagagggagagtctatctgtattcatgtacgcacacagatataagcatgttaagctatgcagttttgcagcatccatgcatggtttccgtgctggtgtttctaattccaatggatttgaattttttttaatcttgaatattcacatggatctaaaaaaaaaaaaaaaaaaaaagtcgacgcgggccgc

SEQ ID NO: 10562 - DNA, 546 bp, Zea mays
acactatacaagagctatgacgtcgcatgcacgcgtacgtaagctcggaattcggctcgagcgctcgtatataacgcatgcacgtacacaccatgctcgacgagcagatgcgcgtggtggtcaagatgtactggggtgatccgagggagaaggtgtgcgacgcggtggaggagctccagatggagtcgctcgtcatgggcagccgtggcctcggccagatccaaaggattctgctgggaagtgtgacgaactacgtgctgtccaatgcgtcatgccccgtgaccgtcgtcaagtcgaagtagtggctctggcctttcatttccagaaagatgaatctgcagctaacctatacgcaaaccgaaacaactaaatccgatatattgcaccttacgtttcagctgttttcactccatgatttgtttttctttttctagatgtacctggacactgttgttttcgtcaaaaaggctgccagataaactgcccagcttgtatcactacatgagaaagtcactggacagcatcactataccatttctttttaac

SEQ ID NO: 10563 - DNA, 583 bp, Zea mays
ccggtcatttctaatagaggacaaggcacctggcgtcttctcctacgaggagtttctcgtgcatgtccccaggcagatccaaagcaagatgacctgagggccaggcgaatgcaaaggcaacatgaactgagggtcaggctggcaaatgcaaaagcaagatgacctgagggcccagatcctgtctgtagcatttcggtcagtagatggattgtaggtaccaaaacgagttcgatttctgcataaggagacagcgaagtggcgattccacatcactatggagcataatgtttgctcggacagtagaactcaggaatagaggcaccgtttttggagtggggtggtatatgtgttgtatacagagatgagaggcgttagtttttgtgttgtcattgtcgctgtgcatccttattgttttaccccttgtccaaaaagggatgcattattatgttgagaggaaggttatagaggtttcgcaataaaatgcacctagccaattgatagtatgaatcagatatataatctaatttatgactgcctatgcgccgtcggtcccctattgagcttggtcacccggaattaattt

SEQ ID NO: 10564 - DNA, 2276 bp, Zea mays
ccacgcgtccggtctagaggaacagttgaatttgttgctacgaaggaatttctggttcgtgatccaatgcctgctgtatacttcttccttattgatgtctctatgaatgctatacaaactggtgcaactgctgcagcttgcagtgctatttctcaggctatttcagatctgccggaaggtcctcggacaatggttggaattgcaacatttgattctgctattcacttctacagtcttaaacgtgctcagcagcagcctttgatgctcatcgttcctgatgttcaagatgtatatacacctcttcagactgaccttattcttccagtttctgagtgccgggagaatctggagcagttgctagaaagtatcccaaacatgtttgagaataatagggttgctgattctgcttttggagcagcaatgaaggctggcttcctggcgatgaaatctactggcggaaaacttcttgttttccaatcagtgctgccatcacttgggattggttctttatctgctagagaagccgaaggcagagcaaacattacaactggtgacaaggaagcccataaacttttgcagcctgttgacaacaccctcaagacaatggcactagaatttgctgagtatcaggtctgtgtggatgtattcctcaccacacaatcctatgttgatattgcttctatatccgttgtgcctcaaactacaggtggccgggtctactactactatccgttttctgctctttcagatccagcccaagctcttcaatgatctcagatggaatatcagtagaccccagggttttgaggctgttatgcgtgtaaggtgcagtcagggtctccaagttcaggactattatggcaatttctgcaagcgtgttcccaccgatattgatcttccagcgattgattctgacaaaactgtgatggtcacgtttaagcatgatgacaagttacctgaaaatgtggaatgtggcttccagtgtgcacttctctatactactgtatatggacaaaggaggatccgagtcataaacctttcactttcatgcacaaatttgcttgccaatcttttccggtatgctgatttggagacacagttttcatgcttcctgaagcaagctgctaatggcatcccgacatctccattacctcgtattcgggatgaagcaacaaatacatgcataaatattcttcaatcttaccgcaaacactgtgcatctgtaacttcatcagggcagttgattctcccagaggctctaaaactgctgcccttatatactttggcactggtcaaaagcttaggcttgagaaccgatgggcgattggatgaccgttcctactggatatctgtagcctcgtcagtttctgtagtactagctgttcctttggtgttccctagattgattcctatccacgatctcacatcaagggatgacgatgattctcttatacccagtccccttatgctcaatagtgagaatgtacaagaggatggagtttatttattggaaaatggtgaggatggtttaatttatgtaggaaacatggtaaatccggctaccctggaacaaatattcggtgtctcttctttggctgcattaccagcccagttggcgttggagcaatttgacaacgaactctcgaggaaggttaacgaagttgtaaatgaaataagacgccagaggtgctcatacttgaggttaagacaatgcagaaggggtgaaccatctggtgattttttccggtcatttttagtggaggacaaggcgcctggcgtcttctcctacgtcgagttccttgtgcatgtccacaggcaaatccaaagcaagatgacctgagggcccaagatcctggttgtaacatttcggtcagtagatggattgtatgtaccccgggagtttgatttctgcataaggagacagcaaagtggcgattccatatcaatgtggagcataaagagtgctcggataatagaactcaggaatagaggcttgtggtgtttacagcaccgtttttggagtgggtggtatatgtgttgtatacagagatgagaggggtggagctttagtttttgtgttgtcttttatcatcgtgcatccttgtttatctcatgtgcaaaaagtgttggattatgttggttggaaggttatagaggtttcgtaataaaatgcacctagctaatcgatagtatgaatcagatatactataatttaactattatgtttgcctaaaaaaaaaaaaaaaaaaaaaagcggacgcgtgggtagatcgcga

SEQ ID NO: 10565 - DNA, 3125 bp, Zea mays
gtacccccgggcccgcccgctccggggggtcaacccttttcccctccccacccatccgaggaacctattcagcttgtggacttcggagagatgggacccattcggtgttctcgttgcaaagcgtacataaaccctttcatgaaatttgttgaccaagggaggcatttcatctgtaacttatgtggattcagaaatgatactcctagagactacatgtgcaacttagggcctgatggtaggcgacgtgatgctgatgacaggcctgaattgtctagaggaactgttgaatttgttgctacgaaggaatttctggttcgtgatccaatgcctgctgtatacttcttccttattgatgtctccatgaatgctatacaaactggtgcaactgctgcagcttgcagtgctatttcccagtctatttcagatctaccagaaggtcctcggacaatggttggaattgcaacatttgattctgctattcacttctacagtcttaaacgtgctcagcagcagcctttgatgctcatcgttcctgatgttcaagatgtatatacacctcttcagactgaccttattcttccagtttctgagtgccgggagaatctggagcagttgctagaaagtatcccaaacatgtttgagaataatagggttgctgattctgcttttggagcagcaatgaaggctggcttcctggcgatgaaatctactggcggaaaacttcttgttttccaatcagtgctgccatcacttgggattggttctttatctgctagagaagccgaaggcagagcaaacattacaactggtgacaaggaagcccataaacttttgcagcctgttgacaataccctccagacaatggcactagaatttgctgaatatcaggtctgtgtggacgtattcctcacaacacaatcctacgttgatattgcttctatatccgttgtgcctcagactacaggtggccgggtctactactactatccattttctgctctttcagatccagccaagctcttcaatgatctcagatggaatatcagtagaccccagggttttgaggctgttatgcgtgtaaggtgcagtcagggtctccaagttcaggactattttggcaatttctgcaagcgtgttcccactgacattgatcttccagcgattgattccgacaaaactgtgatggtcacgtttaagcatgatgacaagttaccagaaaatgtggaatgtggcttccagtgtgcacttctctatactactgtatatggacaaaggaggatccgagtcataaacctctcactttcatgtacaaatttgcttgccaatcttttccggtatgctgatttggagacacagtttgcatgcttcctgaagcaagctgctaatggcatcccgacctcttcattacctcgtattcgggatgaagcaacaaacacatgcataaatattcttcaatcttaccgcaaacactgtgcatctgtaacctcatcggggcagttgattctcccagaggctctaaaactgctgcctttatatactctggcactggtaaaaagtgtaggcttgagaactgatgggcgattagatgaccgttcctattggatatctctggtctcgtcagtttctgtagtactagctgttcctctggtgttccctagattgattcctatccatgatctcacgtccagggatgatgatgattcccttgtaccaagtccacttatgctcaaaagtgaaaatgtacaagaggatggggtctatttattggaaaacggtgaggatggtctagtctacgtaggaaacatggtaaatccggctaccctggaacaaatattcggtgtctcttctttggctgcattaccagcccagttagcattggagcagtttgacaacgaactctcgaggaagattaacgaagttgtaaatgaaattaggcgccagaggtgctcatacttgaggttaagactatgcagaaggggcgaaccatctggagattttttccggtcatttctaatagaggacaaggcacctggcgtcttctcctacgaggagtttctcgtgcatgtccacaggcagatccaaagcaagatgacctgagggccaggcgaatgcaaaggcaacatgaactgagggtcaggctggcaaatgcaaaagcaagatgacctgagggcccagatcctgtctgtagcatttcggtcagtagatggattgtaggtaccaaaacgagttcgatttctgcataaggagacagcgaagtggcgattccacatcactatggagcataatgtttgctcggacagtagaactcaggaatagaggcaccgtttttggagtggggtggtatatgtgttgtatacagagatgagaggcgtggagcattagtttttgtgttgtcattgtcgctgtgcatccttattgttttaccccttgtccaaaaagggatgcattattatgttgagaggaaggttatagaggtttcgcaataaaatgcacctagccaattgatagtatgaatcagatatataatctaatttatgactgcctattcgccttgtaccctgtccggccgttttgtctgcctattcgcctggagacttggggctttggtttaaacgggctgacggatctatgtggtgtagtctagactctagactacgaggggtttgtctgactcgacaagattttagaaactcaaatcagtgatgaacatatatacttgcaagagtttctggaaacaaaataatgaagcatgcacatttgtgaaagtaataccaaataattacagcatgcaggtcagtgcagccggagatcgggattgcaattttccagcacaatatttttttaccaacgcaaggcaagcgataatctagagtacatcaactatgacggaaccttccaagtcattaggtccacctacagttgttcttatccaacggacttcagacaaccctgcagatgcatctgatcacttgacaagttcggtatctgaattccttaccttttccaagagcgtttcacctgtcacgcagacattacaattcatcggagatacgaaattgcggaagcagttacaataacttacttttattgaaaagtaagacataattatatagttacagaccaag

SEQ ID NO: 10566 - DNA, 1171 bp, Zea mays
gcacgagctgggcactggtgaatgaacgagagtgacctgacccccgtgcggccgtccgccgtcaccgaccgagcgccgggtcccaccactccccgtccccaacccctcgcgctcgctccagcctccagcaaccgcgctccctgttcctttccttcccaggcggccaggcccagcagcgtgaagtgaggccagctagcctattatcagcctatggcggctcggattggagcggacgggaaggcgatggcacgccgcggccgcgtggagctgcggcggatcgaggaccgggtgagccggcaggtgcgcttctccaagcgccgctcggggctcttcaagaaggccttcgagctctccctgctctgcgacgccgaggtcgccctcatcgtcttctcccccgccggcaagctctacgagtacgcctccaccagcatagaggatacatataaccgctatcagcaattttctggagaaggaaggaatataaatgacgatcgaaatagaaacgataacaaggatgaagcttcttcagatttgcagttgatgctgagcaagattgccacctggtctccccagagcaatgctgacgaatcagatgtagatgagctggagaagctggaaaatcttctgagaaatgctttgaaggatacgagatccaggaagattcagatgttggcgaaacaaaacagtggagctagtacaagcggccagaaaagtccggagcaaggaacggcgtgagcacggatctgtccagcgtccacctacctgggattgctcttgcttccccttgccgatggatgcttgtactgattatgaccttgtgggttgcgagaccctgtgctagctttgggcctgccaacctgcagtgtccctggaggggacggagctagtgtatgtagtttgatgttccctttgtgtgttgtgatatgcagcctacctaatggccagagcttggtgctgcaaatcctgcagctgatctggttgcgtttcatgcttgacagtatatacagcatactactgtgttttaattccttacaaacacttgctcagatgaaacaactgggctaggaaaatctatcgagcaaaatgatggtattgcataatagttcttgggtgttcactaggtttgtgaaaaaaaaaaaaaaaaaaaaaaaaaaaaaaaaaaaaaaaaaaa

SEQ ID NO: 10567 - DNA, 1567 bp, Zea mays
cggacgcgtgggacgcgcgcacgcacgtatggtcgaacaatattaggagagaagctcagagaccggttcctggccttccaaaaaagaagtagacataagatagatctctccgcctctcctcgcccaaccccctccaacaagtaacattgaccgcaaacggatcatcgtccggtgcggtcaatgtaattaactaagcttctcaatcatacatagcttggcaaatgcctgagggctagctagacaaggtccgttgagctagcccctttgggaagaagggagaggaatggcgctggtggcccgttgagcgaggaagaggctattgagaacccgttaacaagaattgccagcagcatctggacaatcttgttaacagagttccaaaggttcaattccaagcggatacaatttccgagttggatcgagaagagtgcgtgcatccgtccgtccacgttcgtggttcgtataagctaggtttcatcaaccatgggcacaaagatgaagaaggggatcctgaagccgttccgctatatctcgaacatgatggacggtaaggagcctgaaatgcaaattgggctccccacggatgtaaaacatgtggcgcacatcggttgggatggtcctggatccaccaacagcggcagcagcaacaacaataatgccggaggagctcctagctggatgaaggattaccactcggcgccgctcgactcgtcctcctttaggagcgagagtgggggcacggctgctgcgaatccctgggcttctcaagagatagtcatggacggagcaagcatcggagagacctccttcagggacacgaaaagcgaggcgggcgggggcgacgactccccgccgtcccccgccacgcgccggacgagacgacagcaccgctctcgcggctcggccacctcctccatggacgacaccaccggcggcgagggcggcgccgaggagaaggagaagaggaaggagaagggcaagaagggcgcccgcaagaaccgcaagaaggacaagccggccgcggccgccgccgccgacgacgcctcggccacctgccaggacctccccgccgtccccaagaagtccaaccgccggaagaacaagggcagctccgaggccaacggcggcgccgcgcccaaggacaccgccacggccgcgccggaggagggggcggcggcgacgaccccacccgccgtggacgacgactaggggggatacgcgggtgatgatccaagaggctgcggcctcgtataccaactttcggagatcaaactaacatgccgaaaagtagtctgagctcaattcgcgtaagatcaagcggcggtcgatccatgtatacgtatatgaactcagaaagggcacatgcatgcattggggagtgtcacgtacattagcattctcaggagtgggtgtgcacgcacaaacgccattcgtttctctgtttctttctctaatactgttatactgagctgcatttttttcacctgttatcttgttcaagatttcatatataatataaagtatacgttgtgggggatatatctgtccctcgcgtatatatgtaact

SEQ ID NO: 10568 - DNA, 4816 bp, Zea mays
tcgtgtggggagggtttgagtttgttcgtcgccctggggtttgtgcttgctctttctcgcctaggcctaactattgcggcgggtccgataggggtgtttgtcattagaagttcatgttccctctttttctctgttctctattattagcggcaatgcttgtaaattggggataagaggattagctattgcggcgtgatggttccccacttccctggtgtgtgtggcactgctttcaatgtgtacctatgatgtgggcatgtggttgtaattgagagaatgagagccccaactgtctgtggttgatgatgttaagaacaggaaggccgacaggttaggtggcacgaaatttaggggttttttaagagcaggacaaaaccgagaaaaatcatgactaaaggtaaaaatatgagagcatcagcttaaaaaaccttttttatttctagtgaataatttttatttcctccatttcattttattttaatacataaattttttaatatggaaactaaaactatattttagttgttgcatttaataatttagaggctaaaataaaatataatagagagactaaaaattagttactagaaaccaaataccccttagttgtttattgctaatgcaactcctgccctttttacgcggcaatgcctggcgattatcagtatcaaggggaaagttgtttggtcaactgatgagaattagatgtaataataatgtggcgtaatatgtctgattgtgttattatttctctgtatggtactgaaccctgatgatcctaaacgtgtgcatctgactcgtgtttcctcaggggcatcgagtgaggacgaggcacggccctctatcggtttctgtatacggagacgaggacaagcccgcgctcgtaacttatccggatttagccttgaatcgtgagtgcgtttgttgcctctagatttatttgtaaagaacgcaatcgtttttcatagatacagtacaacagcttaatacgctgggaaaactcttcctgttcggtagacatgtcttgcttccaaggattgttcttctgtccagaggctgcgtcgctgttgcttcacaatttctgtgtgtaccacatcacacctcaagggcacgaggtcagttatgatgtgtgtgtgtgttttcttgctttgattaatccagtcaacctaccatttgtcattctttttcatgttaggttgggttcttacatggttgttgttattattgtgcatgttaagtattgcagttaggagcggctccaatttcagctgatgtgcatgtgccgtctgtcgatgaccttgcagatcaggtcgctgatgtcctcgattttttcaggtagcatttcatatcaggacatttgctgaattctgtgttgctacttcggttttggtagaggtggtcttgtaatctcaatttcctctttgcagtttgggttcggtcatgtgcttgggtgtcaccgctggtgcctatgtgctcaccctctttgcggtaagtgtgacctcgagacgactagctcttgtattgtttccctgttgagcgcttgctaagaacgatatgtgtttttaccttcgcagacgaagtatcgggagagggttcttggcctaatgttggtttcacctgtatgcaaagccccctcttggagcgagtggttgtacaataaggttgtaaccacctacttcagttatttcagatgccgtatgtcctttcaattattcatttcaccgtgcaatgtttcagagtgttaacctcagaatccggtgtcccaggtattgttaaacttgctttattactatgggacgcgtgggatagtcaaggaaagtttgcttcagcggtatttcagcatggtacttctgaattctgatccccctcttcaactttcgtcttcgctttctcgagttctcgcccatattcggagggagtagggtgcttgttacccagattcactcaggactgatgcattgtgcaggacgtccttggtaacggacaggatccagaatcagagattgtccaagcctgcagaagtgttagtatcaacctccttcattttctctagtgctgttaaaacaggatgggctattatatttatatcacctgctatttggaaatgaaattgaaaacatggtaatcttctgtgcagttacttgacgataggcaggggactaatgtctggcggttccttcaggcaattaataggtaacaagaatgtatctttgttttgcatggcctgaacagacaaaggaatggtgatctgaatgataaaaaaactgactactctgttcatcaggcgacatgatctaacagaatcgttggagaagcttcagtgccagacgctgatttttgttggggaaaactcacagttccatgctgacgctgtccacatgaccacaaagctagaccggagatactgcgccctagtcgaggtaacatacagttcaaaaaattgacgttacagtttgatctctacggcacacagaggagtataaggaggatggctgagggttttttttttgtgtgtgtggtgttaaaatcgtgcaggttcaggcatgtggttcacttgtcacagaagagcaaccccatgcgatggtgatcccgatggagtacttccttatgggatacgggctttacaggccatcgcagcaggaaagcagcccccggagcacactgagcccgttctgcatctcgcccgagcttctgtcgccggagagcatgggagtgaagctgaagcccatcaagacgcgcatctcacgtaacgtttagtgtggggtggatgtcggttggccatggcatattggcatggcaaccacaactcatcaaagtgaaggactcccttgggctgagctgtgcaaccacgaagttttgatgcctttcaggcatctagcgtgagaagatttacagggtgaaggcaatttttgtcgatgcagggaggttgtagataatgagggggaatggttgtttgttcatatacatatatgtgtaagttagtacacatgtacacctaaacacggcatcgttccatacagtacagaatacagagaaagaaaatgggaaagctgaatcgtcgtccgatactgacatgaactctcaagcccgaggacattgtgttaaaatatagcagttgaagcttcaaacaaaaaatgcgtctttcagattcatgattaaggttctgtttaaaagcaacccagtatataagatatcagtttttatcttttagctagggagaatctagtttcttggttttttaagaaactatgaatctaatttatataaactgagacataaactggtatgtttggaaccaccttaatttctataaatcggttcttaaaaaattttataaaccaatttcttaaaaactgggtgcttcaaagcggtccctaattaatggccatatgaactcgagtgctcagcatccattcacagccaacacaacattacaaaaggctaaagcacaacggtagttgtaaagcccaaaattttgattaaaaaataataaaaataataacaaaataaataaatagaaatattatgtaaggttttaagattatggagctattggagattacttgattttgtgcatatttaattaatggaattttattagtcaaataacaaataaataaaaacaagaatatgcatctcatgctgaagttttcttgtatgttgcaattgcattcaaatccatgagacaagtttaagttaaagattagactttgaaattggaaataggaaagaaaaaaggggaaggaaaagaatatatatatatatatatatgtatatgtatgtgtgtatatataaaaatataaatatataaatgcatctctacaggttggaactttatagggacatttaacccatgagtggacctctcaaacaaattggagttcaaattctaaatttgaaatgatgaaagaaatccaaatcagaatgaataaataaaaagggaataaacagccttgggccgaaatcacccattcggcccactatcccaagctacgcgccagccctcctcctccccacctccttggcgtctatggcatgtgggccccattttccagtccgtggacgcgcgctaatcaactcgcccagcccaaccaacaaccgcgtgtgctccctccccgttgtcactgacatgcggaacccacacgctggtccgcgctctggcaccgccaggtggggcccattcgtcagatccatccccatccacgggttgttgagatcaaccgtagcagactcctggccgctgcgcaaatctcgttgggcaggtgcaatggcccagccgaagatcccctcatccatgctgggcgcttgccctgcccctgtaaagattggcgcgaccctcgtcctccagcacagaagctccaggtgggggagggagtttgccgccgcgggctctgctcacctgcatcgccgctcctggtcagacgagcagactccgagagtctctagaacacaccggatacgttcgtgaacaagcgaagccgggggatcaggcatgggtcgagcaattgctcgtcgttgtggcgatccgccatggggccgccgtgcgccgtgaatcaaccagggaattgcgtaaccaaaggtgataacctccccttcctgctttacctcgttctccccatcgtatagcgccttgaggatctggtgaccatgcaccagtgctttgtatcacctatcaccggcgatggcgccaccgtcgggcgtatgcgccgctacacggtggctcgggataggagaagacacgccagtcgtcagatgtagaacctgtggctaggattagatctagggggtaaacatcttgtgccgttgatctggtatt

SEQ ID NO: 10569 - DNA, 1441 bp, Zea mays
gaagagttcaggggggagccagcgaagacaagacaagccaggccagcggcggaggagagggagagagagagagagagagcacgcgacagtaggcaggagggcgaggaggagcttgtagagggttaaggaaggcgaccgccatgggggactccagcggctccgtgtcggtcgacgtcgagcggatcttcttcggcggcaaggagcatcgagtaagaacgaggcatggctctctttcggtttctgtgtatggagacgaggacaagcccgcgctcgtaacttatccggatgtagccttaaatcacatgtcttgcttccaaggattgttcttctgtccggaggctgcgtccctgttgcttcacagtttctgcgtgtaccacatcacacctcaaggacacgagttgggagcagctccgatttcagctgatgtgcctgtgccatctgtcgacgaccttgcagatcaggttgctgatgtcctcgattttttcagtttagggtctgtcatgtgcttgggtgtcactgctggtgcctatgttctcaccctctttgcaactaagtatcgggagagggttcttggcctcatgttggtttcacctgtatgcaaagccccctcctggagcgagtggctgtataataaggtattatcaaacttgctttattactacgggacacgtgggttagtcaaggaaagtttgcttcagcggtacttcagcatggacgttcgtggtaacgggcaagatcctgagtcagagattgtccaagcctgcagaagtttacttgacgagaggcagggagctaacgtctggcggttccttcaggcaattagcaggcggcatgacttaacggaatcgctgaagaagctcaagtgccggacgctgatctttgttggagaaaactcacagttccatgcggacgctgtccacatgaccacaaagctggaccggagatactgcgctctagtcgaggttcaggcttgtggttcacttgtcacagaagagcagccccatgcgatggtgatcccgatggaatacttcctcatggggtacgggctctacaggccatcgcagcaggaaagcagcccccggagcacactgagcccgttctgcatatcacccgagcttctgtcaccggagagcatgggagtgaagctgaagcccatcaagacgcgcatctcgcttaacgtttagcatgggtggatctcggatggccatggcttgacaaccacagctcagctcatgaaagtgaagactccttgggctgagttgtgcagacacagttttgatgcctttcggcacctagcgttcgaagatctacaggtagaaggcagatttgttgttaatggctgtttttgttcatatatataatatatgatatgtaacttagtacacatgtatatctcaacacgtcatcgtttcacaaaaaaaaaaaaaaaaaaatgtgaaag

SEQ ID NO: 10570 - DNA, 1608 bp, Zea mays
caagttatgcacacatacacataattataaatgtacaaattaataattaaacatgacatgagtatatgacacatgaaagttcgggtatttcgggtacccgattgtgatacccaaattacccgaactaaattcgggttttgcaagctactacccaaaattcccgaacaaaatttgggttccgggtattttagatccgggttcgggtttcgggttatgagttttttgcccagccctagccaagagtagggcccagcccttagtggccataggctcagctccgccactcggcacacatggcaaacacaaacactggaccagattcatgcgccaccaaaagacagccgttacatgccaatgccgtaccattgggcacgtcatcattcaccgaattcgccacactttgcagagcgcgagccagtctggtgtcctcctttctgtccgggaagtctggtttactcctcatggctcacggtataaagttcagagcgatcgaccccccgggccatcagccactccgtgagaagttctagtcatcacacacaccaatggcgccctccgctccccggctggtcgccggagctctcgtgatcctggctgctgtagctctggcccgtccaaacgccgagcaacggagccccggtcgctacaatgtcgccgacgcgatcgcgatgggctcaggtcagcatcgtcatcatcaggggcggacaccaccatgccatgtgtcgcctccgcccgtgttgccgccgccgtgtcctggtcaccaagatcggcgtagagaagcaccggtgccgccgccaattgttcttggtgtgcagaggaccgcgccggctccgccctcgccgcagcacgcgcaggtggagcattatagggcgctattcccgccacctccagcttgctcattctaggcgatggctcttgttgttactgtacttcctaagcgtctagtagccgtctagtgtttggagttcatttactcagcaagcaacgtaaaagctatcagttttttcattctcacccatttctgttgacacaaaaaattgaacaatttgtttaacgtttgtgtttatggcagtactattcgcctattcgcccccctgggccaatatataatccaccattttaaactttacaaaaacctaactaattaaccaaatcaccacatacccataaacttcactaaatccacctaataaattgcattcagacttaatacaacaataaaatcaacagttcagatcgatggataactttctctcttaatcactcaaatctaattaacaatattatttagaccatccctcgtctcttccacaacctagcgtcccctgcctctccctcccctaacccccccaccccttcactcgcgccgccgctggtgtcaatccctcctctcacgctatcaccactgatgtctctcctctctagaatcgcagcgttatcacatgctatatgtagttctagtgagaggtgggttttccggggcacactgacagactcgcatgtttggtttgctggtcatcgagctgtcgggtctagcaacttactcagacgtcggattttggcaggcaaagacaaacaggtaactcacgcattcagcatgtttggcta

SEQ ID NO: 10571 - DNA, 1868 bp, Zea mays
acggaagacgccactagctctccgcagtccgctctcgcctctcggccttctccttgtgccgccgaacaccctcacaagagtcggcctctcgatttctcagtccagcctcagcagtccccttccctccctccatcaggtgttgcctcccgcagatccaaatcggaattcggtccttcgtccccaaaccaccaatccggttgcattctttgggtttgctcacagcgcacacaaagccattttactgctgggaatggtggctggcactattagcgtctccggctcttgagtgatctccaagtcctttggaatgctacagggaagtgaagtgatgggggagtgcgaggacggcaaggagtacaggtgctgggaggagctgctgccggacgcgctgggcctcatcttccgcaacctgccgctgcaggaggtgctcaccgtcctgccgcgggtgtgcaagtcctgggggcgggtggtggccggcccctactgctggcaggagatcgacatcgaggagtggagccagcagcagggcaagccggagcagatcgcccgcatggtcgagctactcgtgggccgcagcgccggctcgtgccgccggatcagcgtctccggcctgccctgcgatccgcgcttctccttcatcggagacaacgcacgagctctccggaccttggagatccccaggagcgagatcagcgactccatggtggaatccgtggcgccgcggctgccgaacgtcactttcctcgacatcagcagctgcacgaagatgggggcccgcggcctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgccgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccggcagcgacgacgacgacgacgaggccgtctgggacgacgacggccagggcctggagaacctggaggtcaggttctacggcggtggcttcggcgagaccttcgccggcttcgactggccgccgtcgccgtgacatgacacctgctgcctgcgcttgcgttgcttgcgtgggtgggtgagcctttgtgtgttgtccccaagctttggaagcttgctgtgctgctgtagtactgtgcctgcgacatcactcgatcttcctctacctcgcagatatgccatatgtgaagcgaactgctagtggtgcaatctaaaatgtagacgctggtgtttacatgaagcaatccccatcagcatgcaccggtgagattccaccggtgccaatccccatccatcctacctactactagtcatagagagcggggcagggtacccctgtctcctgatggcttctttaatgtcatgcgagcaaacatggcagtgcaagggtctcctgagctgtatagtgtcagcaatatcaacgcagtgcgaaagatggcacgggcacggcgtggatcgaggtgcagcagagcagagaagagtaccctgccccccgctcgctttgggatgcagcacagcgcatcacccagccacccaacccaacaggccagcacatgtcgaatgcagcggagggcgcc

SEQ ID NO: 10572 - DNA, 1482 bp, Zea mays
acggaagctactagcccgcagccttcttcagtctcccgtcttcttctggtgccaacacatcctcattctcagggtcgccctctcgattctccctcaagtccagtccagccggatcagtccccttcccctcctccacaaggcgccgcctcccgcagatccgaattggaatctgggccttcgtctccgcaccacaaatccgggaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcagagcaagcccgagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggagcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgacgactactactacgccgtcggcagcgacgacgacgaggctatctgggacgacgcgcagggcctggagaacctcgaggtgaggttctacggcggcggtggcttcggcgagagcttcgccggcttcgactggccgccgtcgccgtgacgtggcccgcgagagccgctgctgcgcttgcgttgcgcggaccgtttgcggctcttgcttatataccgcgtgcgtgcctgagtcgttgtttgttgttcgtcccaagctttgtttgcagatgtgtgctttcaatctttaagctctagcttgcagatatgtgaagtggactgctagtagtagtacactctagctgtaaaactccggtgtttacctgaagcaaaccagcatgcactggtgagatttcaccggcgccatccc

SEQ ID NO: 10573 - DNA, 1921 bp, Zea mays
gcacgagaccattacctagaacatcctaatcgaaaaaatgatagatagctgcttgcctgctccggagtttcttccgctgttctctctcgcgcaaatttttatgctgggcaaagacggtgttcttcttcttcgacccccaaaaagggcgaagctttcgcgtccttccccacacacacaaattacctgggagccgtagcttctgtttggtgcggccacggggtggaagaaatggtatgcgggatgctcgccaattggcatgctgcgctttccgtccctgcagccgcaagaggccttctcttttagatctgtgccgcgccttcctcttcctggtaccctgtgattggagccagtattgttagcgtttaatgaagctgcttttttctagccggcttttggatggtgcttactactacatcgtatcagttgccaccactctcgcgtgcttttgccttctttaggtttgctcgcagggcacacaaagccatttttactgctggaagactgccgcttttagtatctctgggctctggctcttgagtgatctccaaggaaagggaagggaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcaaagcaagccggagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggggcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggagcagtgcagcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgacgactactactacgccgtcggcagcgacgacgacgaggctatctgggacgacgcgcagggcctggagaacctcgaggtgaggttctacggcggtggcggcttcggcgagagcttcgccggcttcgactggccgccgtcgccgtgacgcgtggcccgcgagagccgccgctgcgcttgcgttgcgcggaccgttttcggctcttgcttatataccgcgtgcgtgcctgagtcgttgtttgttgttcgtccccaagctttgcttgcagatgtaagctttcaatctttaagctctagcttgcagatatgtgaagtggactgctagtagtacactctagctgtaaactccggtgtttacctgaagcaaaccagcatgcaccggtgagatttcaccggcgccatccccatcctaaaaaaaaaaaaaaaaaaaaaccagaaaaaaaaaaaaaaagagaataccccctgatctttgcgtcgtgtctcct

SEQ ID NO: 10574 - DNA, 1547 bp, Zea mays
ctcgttttttttcccttcgcgaggacgaggacacacgcacacacggaagaagccactagctctccgctctcgcctctcggccttctccttgtgccgccgaacaccctcacaagagtcggcctctcgatttctcagtccagccgcagcagcccccttccctccctcctccatcaggtgttgcctcccgcagatccaagtcggaattcggtccttcgtccccaaaccaccaatccggttgcattctttgggtttgctcacagcgcacacaaagccattttactgctgggaatggtggctggcacttagcgtctccggctcttgagtgatctccaagggaagtgaagtgatgggggagtgcgaggacggcaaggagtacaggtgctgggaggagctgctgccggacgcgctgggcctcatcttccgcaacctgccgctgcaggaggtgctcaccgtcctgccgcgggtgtgcaagtcctgggggcgggtggtggccggcccctactgctggcaggagatcgacatcgaggagtggagccagcagcagggcaagccggagcagatcgcccgcatggtcgagctactcgtgggccgcagcgccggctcgtgccgccggatcagcgtctccggcctgccctgcgatccgcgcttctccttcatcggagacaacgcacgagctctccggaccttggagatccccaggagcgagatcagcgactccatggtggaatccgtggcgccgcggctgccgaacgtcactttcctcgacatcagcagctgcacgaagatgggggcccgcggcctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgccgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccggcagcgacgacgacgacgacgaggccgtctgggacgacgacggccagggcctggagaacctggaggtcaggttctacggcggtggcttcggcgagaccttcgccggcttcgactggccgccgtcgccgtgacatgacacctgctgcctgcgcttgcgttgcttgcgtgggtgggtgagcctttgtgtgttgtccccaagctttggaagcttgctgtgctgctgtagtactgtgcctgcgacatcactcgatcttcctctacctcgcagatatgccatatgtgaagcgaactgctagtggtgcaatctaaaatgtagacgctggtgtttacatg

SEQ ID NO: 10575 - DNA, 1564 bp, Zea mays
cattgggtacctcgaggccggccgggatcgtcaaactgcccgcggtccaaaatccaaaccctgcgagtgtatagaagaagaaccccccaccccatcgcaacccgcaatggtcgcggcggaagatccggaacacttcttcgccgcctcgccgccgctgcgcgacgctgccgttgtcgccgccagcctgcaggagttcgtcgcgcgcaattcgcacgcatcatcagacggcgtcgggcggcggcgcatcgtctgcgtcacgtcgggcgggaccacggtgccgctggagcagcgatgcgtgcgctacatcgacaacttcagctccggccaccgcggcgccgcgtccaccgagtatttcttaaaggctggctatgcggtcattttcgtccatcggcgagggagttgccagcctttctccaggttcctgcctgatgactcgtttctccacttctttgatgtcacaacagattcgaaggttcaagtggccgagtcccaggcaacggtggtaaagagagcaattggggattatcgcaaggctactgaaggaggctctctgctgaaactcccattcaccacgatatttgagtatcttcagttactgaagatggttgctacatccatgagctgtgtgggtctccacgggatgttctatctcgctgcagctgtgtctgacttctatgttccatgggatagcatggcaaaacataagatccagtcagccggaggcccactggatatgaagctcagccaggttccaaaaatgctccccgttctgcgcaaccattgggcccccttggccttctgcgtatccttcaagctggagacggatccagacattctagttcagaaagcagagacggctctgagcaagtacaggatggacgttgttgtggccaatctacttgcaacgtacaaggaggaggtcgtcatcatctcgaatggcaaaagcaacaccattcgaaggtgcagcaaaggcgaggatctggaggagcatatcatcaagctcctagagaagagccactccaagtttatttacagcagcacggaagggtgcagtaagaacgactacgaaaagcttataccgttaggcatcaaaagtctggcttaagggaaacattgatcggttctggagctcaaattaatagggaagccccatcagcactcttgtagtgtttggatggatggacgaggaaggatgaagagggatgggataggatcattctaagttgacccatgtttggtttggaggtctagagtcacggtcaaggaatatttttcaaaaatagtggatggggccatcccttaaaaaataagggacggagtcaactcagagttgatcccatcccatctctcgttgacaccgaaccaaacacatcataaagctctacatgcagtgtgtacatttgctggtaatgtatatgtaagcaggactaataggattgttctgttctcacacgcacacaaacacgccaccaaaaaagatggtccaaagttgtatgtatcgtttgctattcacctgttaattaatggctttgtaatcagaaatgattattgttcaaattgtttc

SEQ ID NO: 10576 - DNA, 3466 bp, Zea mays
  misc_feature (1)..(1): n is a, c, g, or t
  misc_feature (2596)..(2596): n is a, c, g, or t
ngacctccgcaccgcaccgcaccacccaaacggctataattaccccgccccggggcaggccccgcgctctcgctcttgcgccggcgaccccgcggtttcgagccaatcaccgccaagtcctcgactccagcgcccttgccttgccaccccggccccagctaccacggggagctgcaaataacctgcggccccgaggaccggacagcaaaagcgcccaaccgctggagctccgccccggcgatcacccgccgggaacgtagcgcccggctccacagccgcgccattcgagctgctgctcgcgcgcggctggttcttctcggggggattttctttttgcgggcaccctccgctccccctcaccgccctgccgtcagccgtctcgttttcggattcgtttgctccggcggtggccgacctgccgtgcggggcgcggtgatgccggaggtggggcagtacgggtacaagaagaccgacggcatctgcgacagcgtgtgcggcgagcctgtgtcaaagacagctctgacgatgtcaaggctaaagtgcgctctccggggatttgatttaagggcacttatggtcctcttgattggtgtgccaattctaatcctaatgatatatgcgcatggtcagaaggtcacatacttcctgcggcccatctgggaatctcctcccaagcccttcaagacaatccctcactactaccatgagaacgtcaccatggagaacctgtgcaagttacatggttggaaagtccgtgacttcccgcgtcgtgtctttgatgctgtactcttcagcaatgagcttgatatcctggagatccgctggaatgagcttagtccctatgtgtccgagtttgtgcttcttgaatccaactcaacctttactggcataaaaaagcccctccacttcaaggaaaacaagcaccgttttgggttcgctaaatcacggctgacatatggtaatattgggggaaggttcgtgaagggggagaacccatttgttgaggagtcatatcagagggttgccctggaccggcttcttaagcttgcaagaatagaagacgatgacctgctgatcatgtcggacgttgatgaaatcccgagcggccacacaatcgatctcttaaggtggtgcgacggcattccagacatacttcaccttcagctcaggaattatctctactcgttcgagtttttcctggacgacaagagctggagggcatcgatacacaagtaccaagctggaaagacgaggtacgcgcacttccggcaggcagacgagctcctcgccgattcagggtggcattgcagcttctgcttccgctacataagcgatttcgcattcaagatgcaagcgtatagccacgtcgaccggatcaggttcaagtacttcctgaaccctgagaggatccaagatgtcatctgcagaggggcggaccttttcgatatgcttccagaagagtacacgttccaagagatcatcgccaagctggggccgatcccgagcacgtattctggcgttcatcttcctagctatctgctaaggaatgtcgaccggtttagataccttctaccgggcaactgcaggagagaaagtggctaggttttatggcccactaccctgcaacctgttgtgcgtgggtgggtgggtgccagtgccacactgccccgctgcaaagctgctgtccatgggatatctgtggcagttcacctggtacggttgcctaacgtagttgaacaaatgctttggggaagaattggttcatggatgggggtgagcacatgattctctaatgtgtaatagaacatgggaggaggatctaacggcatagcgcacgcttggtcctggctgggtgtgcatgagctgagcggtttgtcattgtcattcattacttccctgattgatatatataaactcaaaaaggctgttgtagattgcaatccaagtggtatttcagaattacatattgtagaaccggacctgccgcctcagatgattgatactccctcagttcttttttatttgtgcgtataaatattcgagaacagagggagtataatttgcatatggatttgttcttacttgatgttttgttttgtccgtagaaccggtccttgcttcagccttgtatttgtatgcatcgtttgccacagccttagcttgacctcatatccgaactttgtatggtaaaaccaaggacttatttatacgtacatagacaggccaattgctccactgtacaaatttccaaggtagaaatacctaagggtctgtttgaaagtagatattggagatgttaaaattggattagacccaataccaaatctgtctaatattgaaaatgagtttcatataaatctattgtttggatgtatctaggattgcaattacatccaatacctagattcttagctctgaattgggagggacactttttagttgaagtccaatttcatgaaattgaactttaattccagctctgaatttaatagacaaccaaacaacagaattcagaaatcctgattacaatttccaattccagtcttgaatatctacgtccaaacaggaccataaggtctaaaccaaataagcgccngtttggagttcaaatttatccaaaaataaacgccgatatagggtgtcatctgtaatctgtactgagaatatccacgcatttagaatcaaaatttgtcctaaaataaacatcgatatagggtgtcatctagtgtaatttgtactgctctggcagctgtaacccggtggcgtggctgcgaatcaccttggaaccaagcaaagaaaaagaaagaaaaacttgtaggggtagtatcgttctattatccttcatcacgcttttcgtgctagatactaaaaatgctactctttctactttaaattataaagttgttttagaagactaaactatttcaaggttaattagaattataaagagaattacaaaaaatgtaatactgtaaaaatataattgatataaaaaatgtaatgatctctttatatcataaatgctattagtttattgtataaatttggttaaatttaatattttaaattttaaaagaaaaatagaataactaccaacggaagaagtaacttttttttgacggatgggttactgattgtttttaagctgaattctgtgtacacaactcttgttagttgttactgtagtccgaacattctgtgcgctctcttctttccatccgggatgtcccctgtcagcttgccatgccatgtctagtctagcacccgagcgaaatctcaagccagacagggtttctgcgactcggcgggtacgctggcttgagagtaccatgcctttgctccgcgtccgttgacttgactggcctggtgcatgaacctgacgggatttttgcgttaataaccaggcaggcatgagcaaagctagtctgcaccaggcttttgtatgggcctttaagcgtcgtgacag

SEQ ID NO: 10577 - DNA, 2007 bp, Zea mays
ctctcgctcttgcgccggcgaccccgcggattcgagccaatcaccgccaagtcctcgactccagcgccctttccttgccagcccggcccccgctaccacggagctgcaaataacctgcggtcccgaggaccggacagcaaaagtgcccaaccgctggagctccgccccggcgatcagccgccgggaacgtcgcgcccggctccacagccacagccgcgccattcgagctgctgctcgcgcgcggctggttcttctcggggggattttctttttgcgggcaccctcccctccccctcaccgccctgccgtcagccgtctcgttttcggattcgtttgctccggcggtgggcgttcctgccgtgcggggcgcagtgatgccggaggtggtgcagtacgggtacaagaagaccgacggcatctgcgacagcgtgtgcggcgagcctgtgtcaaagacagttctgacgatgtcaaggctaaagtgcgcgctccggggatttgatttaagggcacttatggtcctcttgattggtgtgccaattgctaatcctaatgatatatgcgcatggtcagaaggtcacatacttcctgcggcccatctgggaatctcctcccaagcccttcaagacaattcctcactactaccatgagaacgtcaccatggataacctgtgcaagttacatggttggaaagtccgtgacttcccgcgtcgtgtctttgatgctgtactcttcagcaatgagcttgatatcctggagatccgctggaatgagcttagtccctatgtgtccgagtttgtgcttcttgaatccaactcaacctttactggcataaaaaagccccttcacttcaaggaaaacaagcaccgatttgggttcgctaaatcacggctgacatacggtaatattgggggaaggttcgtgaagggggagaacccatttgttgaggagtcatatcagagggttgcccttgaccggcttcttaagcttgcaagaatagaagacgatgacctgctgatcatgtcggacgttgatgaaatcccgagcggccacacaattgatctcttaaggtggtgcgacggcattccagacatacttcaccttcagctcaggaattatctctactcgttcgagtttttcctggacgacaagagctggagggcatcgatacacaagtaccaagctggaaagacgaggtacgcgcacttccggcaggcagacgagctcctcgccgattcagggtggcattgcagcttttgcttccgctacataagcgatttcgcattcaagatgcaagcgtatagccacgtcgaccggatcaggttcaagtacttcctgaaccctgagaggatccaagatgtcatctgcagaggggcggaccttttcgatatgcttccagaagagtacacgttccaagagatcatcgccaagctgggggccgatcccggagcacgtattctggcgttcatcttcctagctatctgctaaggaatgtcgaccggtttagataccttctaccgggcaactgcaggagagaaagtggctaggttttatggcctactaccctgcaacctgttgtgcgtgcgtgggtgggtgccagtgccacaactgcccgctgcaaagctgctgtccatgggatatctgtggcagttcacctggtacggttgcctaacgtagttgaacaaatgctttggtgaagaattggttcatggataggggtgagcacatgattctctaatgtgtaatagaatatgggaggaggatctaacggcatagcgcacgcttggtcctggctgggtgtgcctgcctgatgagctgagcggtttgtgctttacatccgggatgtcatcgtcatccattacttccctgattgatatatataaactcaaaagggctgttgtagattgcaattcaagtggtatttcagaatcaaaaaaaaaaaaaaaagtccttgctcgtcagatgattgatactccctctgttctattttatttgtcgcgctttagttta

SEQ ID NO: 10578 - DNA, 2685 bp, Zea mays
cccacgcgctgttttcgcaccagcgccggcacaggcaacgcagcaccgcaccgagccgagccacttagcgagcgagggaacagcctccacggcgaggagagaatggggagaggagggatcggaggcgcggcggccatggccatggccatggagaccgccgatcctgcccgtgcattcgtgaaggacgtcaagcgaatcattatcaaggtgggcacggctgttgtcactggcatgaatggccgattggccatggggaggctcggttctctctgtgaacaggtgaagcaactgaattttcaagggtatgaggtgattctggtaacctcaggagctgttggtgttgggaggcagaggctccaataccgtaaacttatccatagcagcttcgcagatctgcaaaatcctcagatgaactttgatggaaaggcctgtgctgctgttggtcaaagtgtcctgatggcgatctatgacacattatttagccaacttgatgtaacgtcatctcaacttcttgtgacggatcgtgatttcaaggatccaagttttggggaccagctccgtgagactgttttttcactgttagatcttaaagtagtacccttatttaatgagaatgatgccatcagtacccggagacagccatatgaggattcatctggtatattctgggataatgacagtctagcagctctgttggcagcagaacttaatgctgatcttcttatcatgcttagtgatgtggaaggactctatagtggtccaccaagcgatcctcagtcaaagattatccacacatatgtcaatgaaaagcatgggaagctaattagttttggagagaagtctagtgttggaagaggtggcatgcaagctaaagtgtctgctgctgctaatgctgcatcaaaaggtgtacctgttgtcattgcaagtgggtttgcaacggatagcatcattacagttctcaaaggcgaaaagatcggtacacttttccacaacgaagcaaatttgtgggcatgttccaaggaagctacagcccgagagatggcagttgcggcaagagactgttcgaggcgtctacagaagttgtcatcagaggaacgcaaacagattttgctagatattgctgatgctctggaagcaaatgaggatgcaattaggtctgaaaatgatgccgatgttgaggcagcacaagttgctggttatgaaaagtcgttggttgctaggatgaccctaaagccaggaaagataacaaatcttgcaagatccattcgtaaaactgctgacatggaggaccctatttcccatacattgaaaagaacagaggttgctaaagatctggtttttgagaaagcatattgcccattgggtgttcttctcattatttttgagtctcgtcctgatgcattggtccagattgcatctctagcgatccgaagtggtaatggtctccttttgaaaggagggaaagaagttatgagatcaaatgcaatattacacaaggtcataactggagttattcccgatactgttggcaaaaagctcataggccttgtgactagcaaagaggaaattgctgatctactagcgcttgatgatgtaattgatcttgtcattccgagaggtagtaagtctctagtttcccaaatcaaagcaacaactaagattccagttttaggtcatgctgatggtatctgccatgtttacattgacaaatcagccgacatggatatggcaaaacggatagtattggatgctaagattgattatccagcagcatgtaatgcaatggaaacactacttgttcataaagatcttaacaagagtgagggacttgatgatctattagtggaacttgaaaaggaaggagtagttatttatggtggacctgttgcacatgacaagttgaaagtaccaaaggtagactcatttcgtcatgagtatagctcaatggcatgcacagtcgaatttgttgatgatgtgcagtcagctatcgatcacataaatcgttatggaagtgcacacacagactgcatcatcacaactgatagaagtgctgcagaggcctttctgcagcaagttgatagtgccgctgtgtttcataatgcaagcacaaggttttgtgatgggacgcgttttgggctaggtgctgaggttggcataagtacagagcgcatacatgcccgcggacctgttggagttgatggacttctaactactcgctgcattttgcgcggtagtggacaagtggtgaatggtgacaagggagtggtttacacccacaaggatcttcctttgcaatgaggcaaataacctccgttgtggtcgtaacgaatggctggacttccccttttaagtacccttttcttttattccatgctacaaagtttggtgtcgtaacaagcagaatgcctatttagtaggcattgatgtaatcagaccattttgtcgtggtgttccttgtcgtataaaacatccgagacatctgtattagaggcgcggtagctagttgatacgcgattgttttggatgaaatttggatctgttccaatgcaatgataatgcatgtgtgatgaggtcctaaaaaaaaaaaaaaaaaaaaaaaaaaaaaaaaaaaaaaaaaaaaaaaaaaaaaaaaaaaaaaaagaaagctaacaaaaaaaaaaagaaaatataataacataatatgct

SEQ ID NO: 10579 - DNA, 3075 bp, Zea mays
  misc_feature (916)..(916): n is a, c, g, or t
tcctgtgaacgctcatgagggagttttttcttccatccccgtccccatcagggaatttatccccgcgagaaatatgtccccgctaggaagtacaatatttagagatagatttaaattcatcaacataaccttttagtcccaagaaagttggggtaggctagagatagatttaaattgattataacaaattaatacaaatttaacaaacaagatttaaaattataagagacatctactttaggtggtgatctacatttcttttttgattatgattagtttcaagacatgagaagtaacttatgttcttaagatcttagaaacaatacaatacaaaacgtcaaaaatagagaaggcaaaaacacagaaaaaggcaactagagaactcataagtattaggcagatatatgtggtcgatctgggtctaggccttgcggccagcacatgtagctgccctgcgttgggtacctatgataccgatgcatttgtaggaaaggtataccagagaaggaatcgccaggaacaaaggaaacagcagacaaggaataaaagagacagcagataagtttctatatttagtcagtcagcatataaggaataaaagagacagcacataagtttctatatttagtcagtttgttttctagcaagttgagagtgatatgatttgtttctatattaacctgggctcagtctataagagaccaggggtagcttgtactagggattatcaaaagaagaaataaatctcctagtcttaggaggttacctggggcgcactggaggaactctccagcgtccagaacgccaccaggaatcctcctcccccttcccactcctatttcctgcgttcttgtccacaacctcctactgagcctccatcgaaagcagggagtccgcatcatttggtatcagaganagccagcgccatgacttccgagtccggcactggacagaatcctgatgggcgtggactcgcttgactccctacgccaaatccttgatcaccaaacccaaaagtccggcactggacagaatcctgatgggcgtggactcgctgactccctacgccaaatccttgatcaccaaacccaaatgctagcccaaatcaccaccatcaacacacgcctcgaatctcatgatcgtcgccttgcccgcgtggaaattccacccacggaggaagcatcttcaggggttccaaaatcccccaacgacggcggccgcttcaaggaggggctgcgcggcggcggcggcggggatggccccttccgtcgggaggacagctcacattggcccaggcccaattttccgtcctatgacggtgaatcggaccccctggcgtggctgacaaaatgtgatatctacttccgcggcatgaggacactgcgcgaggaacgggtctggatggcgtccctgcacctcgacggagttgccgctgaatggtactacaccatcgagcgcgactacggcgacattacctggggccgtttctccgaattgatcaatcttaggttcggccccccactgcgcatgaatggcctcgctgacctcaaggatctctatcgcactggaacagtggatgattatacacgtcaattttccttgttgcttgccgttgtgacaatctttcacagcgtcaacagaccaacctcttcaccgctggcttgggtgagccattgaggacagacgtcgaactccaagggccaactaatttgcagtcagcaatcaaccttgctcgagcatatgagcgtcgcatggagctggctgtaagcacacactccacggcgcgccctgcagcccgtggcgtgagtacgcctattaaatcagttgttggcaaccaacgccctcggttcaagcgtctttccagtgaagaattagcagcaaagcgggctagtggtgagtgctaccattgtactgaaaagtatactgccgatcacagatgtgcaaacaaaggggttttcttgctggaattaacagaagatgatgagggtggtgaaacattggatgatgttggcatctctctccatgctctcaccggtattgatattggcactaccatgaaactttctgtttgtttgtatggccgtcagttagtggccctcgtggacactggttcgacacattccttcatcaatgattctgtggtcagccagctgcagcttcaagttgaacctcgtccaggtctgacggtgaaggtggccaacggagatcgggtaactactgcgggtgtgtgcactcaactgcctctggttattggagaagctgatttctcgatatccttctataccctaccactggatggatttgacattgtattaggtgtccattggcttcgcactctcggaccaattttgtggaattttgaggccctctccatgtcattcttatatcgaggcagtaacattcagtggactggaattggtgctctgccaccacagtgtgcagctttagcatcaggaggtgatctcatggaggctttgctccattcctttgaggatattttcagggaacctcacggcctccctccatctcgccgccatgaccacaagatcagattactgcccggtactccacctgtggcagtacgaccatatcggtaccctcaattgttgaaggatgaaatagagcagcagtgtgacgctatgttacagcaaggtatcattagagaatgcacctccgctttttcatccccagtgcttcttgtgaaaaagtttgatggttcctggaggttttgtgtggattatcgcgcccttaatgacaaaacagtaaaggacaaatttccaatcccagtggtcgatgaattattggatgaactccgtggtgctgtattctttaccaagttagatttaagaagtggctaccatcaagtacgcatgtacccagcagatgtggaaaaaacagcgttccgcacccatcgtggccattttgagttccttgtcatgccctttgggctcactaacgccccatctacatttcagagcttgatgaatgacatattgaaaccatttatcagaaagttcgtgctggtattttttgatgatatcctcatttacagtaatagctggacagcccatgtgc

SEQ ID NO: 10580 - DNA, 4175 bp, Zea mays
tgtcaagactaccacgtcaattgacacgcggagtccgggacactttttgtttctaacggccaaggaataaataatcaagactgccctccctagtccctcctcgaggctccagctttgcgtctgttgccaaccaggcgcctcccttccaccacccggctctccacgccgccgccgacgtcgacacaagcgaccgcgcatccgctcttctccctcccttagctctcggcgggcggcgatgggggagaccgtacgggcgggcgacgttgcaatcacgactcacgaggtacgcccactggccccgtccccccttccttccttccgtccttccttccttccttctctgacgagcggcctccgatctgacgcgaccggcggcgacttcgtttccgggtgggtagacggtgttgtacgggagactgcgcgcggccgcgacgacggatcaaaaaactaaaaacaaaaccaaacgaatcttccgtcccctcgatccgacaaagtgcgtgggcgccgcggcgtggcgtagttggcgcccccgcgcgcgcgcgcgcatagcctgccttgccatgccacagtcgctttccccccctcccttatcagttatcacccagccaaaagcgaggccagggaggggtggtggggactcggtcttgttcgtttccgccgtcgggtttattcgccgggaccgcggttccattgctctctgcttctctagacaccggcggccgtcgccgtcctcgccagccagtcctactcctaccactcgcccgctcgtccgcgagcgagctgatgggttgcgtcggtcggctcggctgattgggttccgtcttccgtcctctcaatcattcggttccgcgacctggggtcctaagacctaagcgtcgcgtccgtccaaggccacggagagtcctggtggccgtgcgggcactgtgcgcccgtggaggtgtcgtgtctcggtgcccacacgacaacgacgctcctctgcacccccgtctctacaagggccccctggctgactcccgtctcccgacgccattccacgtatctcttgtttaggccgggctcgagagagttgggctccgaatcctgggtgggtttggagttggagaatcgccttcgtcgctcgacccagaaagattcggtaccgcatcctcttttcccataccgaccttcaggaatctactttttcttcttcttttgtgtgtttgtgcgctttcgggataacagacgatgcctgaggaatctactttgttgttcttgtgccttcgggataacagatgccttcagccatcttgatcctgcctgcctgcgcgtgcctatctggtgatggtatacgaatctgtttatgaggttttacttgccttggcctttgttccattggtttgcttcgatcggggagactgtaatgtagctttgtccgagggcataaataatctgtgtggatattcggttcctgtccatttttaagggcgctgcttgaatcttgtatccgtttttttcatgcacttgtctgcactcagagatggtggaaataggaagggaaggaaaagacaaatggattttttttacttgtctgctgttctgctatcttctgaactccctcacttgaatactcttcttttttttagttttgttcctttagtgacacacatattgctcgcctgatcttcattcccacactagctttgggaggaactggaacgcgtataacaagtttttctagactctatgtcatttcagctgtgcatctacatcatctttgttgttgtgtattgattcccacgctagctttttgcaggaattggaacgcgtgtaacaagttgttattccattgtgcatctacataatctttgtagtcgtgtactgactgtcccagtatcctattttcagatggagagccacaacccatcgcactctcagatcgccgaagtgacgatggacatcgcagcgtcagcttctggagcggcagggagcaagttctgcaagggcgcagcctgcgacttctccgacgccagcaactcctcgaaggacgccagggagaggtcggcgtcgatgaggaagctgatagtcgcggtggtcctctgcgtcgtattcatggcggtggaggtggtggggggcatcaaggcgaacagcctggccatcctgaccgacgcggcgcacctcctgtcggacgtggcggcgttcgccatctcgctgttctcgctctgggccgccgggtgggaggcgacgccgcggcagtcgtacgggttcttccgggtggagatcctcggcgccctcgtctccatccagctcatctggctgctcgccggcatactggtgtacgaggccgtcgtgaggctcgtcggcgagagcggcgacgtgcgggggtcgctcatgttcgccgtgtcggcgttcgggctggccgtcaacgttctcatggccgtgttgctgggccatgaccacgggcacggccacggccatggacatggacattcgcatgaccatggccacggccatggggattcggacgatggccattcccaccacgacgacgaggagcaagaacagggccgtgtccatcaccacgagcacggccatggaggcgctatcactgtcacaacccaccaccaccaccatcatcacgatcacgatgttgaggaggcgctgatcaagcatgagggtacccagtctgctggcagagctggtaagaagcctcggcggaacatcaacgtgcacagcgcatacctccacgtgctcggggactccgtccagagcgtcggggtcatggtgggcggggcgatcatctggtacaagccggagtggaaggtcatcgacctcatctgcacgctcgtcttctcggtggtggtgctgttcaccacgatccggatgctgcgcagcatcctcgaagtgttgatggagagcacgccccgcgagatcgacgccaccaggctggagagcgggctctgcgggatggagggcgtggtggccgtccacgagctgcacatctgggccatcacggtgggcaaggtgctgctggcgtgccatgtgaccatcgccagggatgcggacgctgatgagatccttgacaaggtgatcgggtacatcaagacggagtacaacatcagccatgtgaccatccaggtcgagcgcgagtagggagctctgtctttggctgctgtcttgggcataaatggctggcgccattcgagctctggtgtgctcggtggtgttgtctattgctagtctattaggcaggccgggggaattatttgcgtggtggtcgtcagtcagtcagtcggtgcataaacaaggatgaaattttcggtaatgctattgacagcatcgtggttcatcgaactgcatattctagtacgctgtgccgtcacatcttgtgtaaggtcacgtttctgtgctgcggtatggaagatgtgaagttcgtggttggcatgttgctatttgttctgagcatgccttgtcgtttcagtcgaatggacttgtgggaaaaaaaactcggccagatggtggcgtggaggtacgcctgtggatgggttatatctatatttattacttttattattaagggcctgtttggttggactgtgagtgcgaaaaaagctgctgtgagccggccaaaaagctattgtgggttgtgaactgctaaaaagctaaaaaccgtttggtggaaaccactaaaagtcgctaaaaattcttctatatatattttcacagttccatctaaaagctgctaaaagcagatccagaggtgctttcagttttgtacttaaaaaaagtcggcttttagaaaaagctgctttccagatttagccctttggtttgacttttgaacttttaggaggcaaaagccaaagccaaaagctaaaccaaacacaccctaagaaacctaatatacacatgctacaatcacttcatcctctccacatccatcgccatataaaaaataccctctgtaccagaaatttaagactaactaccagagcaatcaaacctacgtcccttgcttcaaaaactattagaccacacgtacctcattatttaaaaataaacaataattatatttacagcctagacatcgcttctattccctgtcttgtggcaactcaggtgcacacacatacctagtaaactcataagcagaaagggactctaaattcacggactaataaatttgagttcattttaga

SEQ ID NO: 10581 - DNA, 834 bp, Zea mays
  misc_feature (737)..(738): n is a, c, g, or t
  misc_feature (782)..(782): n is a, c, g, or t
gcggacactctctgatccgaacggccaagtaataaatcatcgggcccgacaaaacaaaacaaggccccagctttgcgtctgtggccaaccaggcgcctccctcccaccacccggctctccacgccgccgccgccgccgccacaagcgaccgcgcatccgctcttctccctcccttcgctctcggcggccggcgatgggggagaccgtacgggcgggcgacgttgcaatcacgactcacgagatggagagccacaacccatcgcactctcagatcgccgaagtgacgatggacatcgcagcgtcagcttctggagcggcagggagcaagttctgcaagggcgcagcctgcgacttctccgacgccagcaactcctcgaaggacgccagggagaggtcggcgtcgatgaggaagctgatagtcgcggtggtcctctgcgtcgtattcatggcggtggaggtggtggggggcatcaaggcgaacagcctggccatcctgaccgacgcggcgcacctcctgtcggacgtggcggcgttcgccatctcgctgttctcgctctgggccgccgggtgggaggcgacgccgcggcagtcgtacgggttcttccgggtggagatcctcggcgccctcgtctccatccagctcatctggctgctcgccggcatactggtgtacgaggccgtcgtgaggctcgtcggcgagagcggcgacgtgccgggggtcgctcatgttcgccgtnngtcgcgtcgggctggtcgtcacgttctcatgggccgtgtgctgngcccatgacacgggcacggacacggacacgggcatggacatggacattcgca

SEQ ID NO: 10582 - DNA, 1794 bp, Zea mays
  misc_feature (1628)..(1630): n is a, c, g, or t
  misc_feature (1632)..(1632): n is a, c, g, or t
  misc_feature (1638)..(1639): n is a, c, g, or t
  misc_feature (1641)..(1641): n is a, c, g, or t
  misc_feature (1689)..(1689): n is a, c, g, or t
  misc_feature (1706)..(1707): n is a, c, g, or t
  misc_feature (1747)..(1748): n is a, c, g, or t
  misc_feature (1769)..(1769): n is a, c, g, or t
tcgagggcattgggtacctcgaggccggccggggacgccattccacgtatctcttgtttaggccgggctcgagagagttgggctccgaatcctgggtgggtttggagttggagaatcgccttcgtcgctcgacccagaaagattcgatggagagccacaacccatcgcactctcagatcgccgaagtgacgatggacatcgcagcgtcagcttctggagcggcagggagcaagttctgcaagggcgcagcctgcgacttctccgacgccagcaactcctcgaaggacgccagggagaggtcggcgtcgatgaggaagctgatagtcgcggtggtcctctgcgtcgtattcatggcggtggaggtggtggggggcatcaaggcgaacagcctggccatcctgaccgacgcggcgcacctcctgtcggacgtggcggcgttcgccatctcgctgttctcgctctgggccgccgggtgggaggcgacgccgcggcagtcgtacgggttcttccgggtggagatcctcggcgccctcgtctccatccagctcatctggctgctcgccggcatactggtgtacgaggccgtcgtgaggctcgtcggcgagagcggcgaccgtgcgggggtcgctcatgttcgccgtgtcggcgttcgggctggtcgtcaacgttctcatggccgtgttgctgggccatgaccacgggcacggacacggacacggccatggacatggacattcgcatgaccatggccacggtcatgggggattcggacgatggccattcccaccacgacgacgaggagcaagaacagggccgtgtccatcaccacgagcacggccatggaggcgctatcactgtcacaacccaccaccaccaccatcatcacgatcacgatgttgaggaggcgctgatcaagcatgagggtacccagtctgctggcagagctggtaagaagcctcggcggaacatcaacgtgcacagcgcatacctccacgtgctcggggactccgtccagagcgtcggggtcatggtgggcggggcgatcatctggtacaagccggagtggaaggtcatcgacctcatctgcacgctcgtcttctcggtggtggtgctgttcaccacgatccggatgctgcgcagcatcctcgaagtgttgatggagagcacgccccgcgagatcgacgccaccaggctggagagcgggctctgcgggatggagggcgtggtggccgtccacgagctgcacatctgggccatcacggtgggcaaggtgctgctggcgtgccatgtgaccatcgccagggatgcggacgctgatgagatccttgacaaggtgatcgggtacctctggtcgcagcgcagcgtccgccgggtgaccatccaggtcgagcgcgagtagggagctctgtctttggctgctgtcttgggcataaatggctggcgccattcgagctctggtgtgctcggtggtgttgtctattgctagtctattaggcaggccgggggaattgtttgcgtggtggtcgtcagtcagtcagtcggtgcataaacaaggatgaaattttcggtaatgctattgatagcatcgtggttcatcgaaaaaaaaaaaaaaaaaaaaaaaaaaaaannnanaaaaannanaaaaaaaaaaaaaaaaaaaaaaaaaaaaggattttgggttgttatcantgtttaagggggaattnnagaaattggggggggttgttaggggatttgggtttggttnnaagtttggggtaattatggtnatagttgttttttgggtgaaattgt

SEQ ID NO: 10583 - DNA, 2030 bp, Zea mays
cctcgaggccccccccggcgcttaccgccaccagaagtaagagaaaccacgcgtgtcagccagccattggatcaccaccattcgcgctgttcggcgtgcgcacccgatcccgtctccgtgcggctttgtgagtagagaagggaaggggaagcaggagcaggaggggttcgtcatcgcgtggtggccgcgccgctctgttcctccgtcccctcctccttccggctctcgctgtcacatgtcgtgtggtgtgggggcgctctgatccggatggtgcagcgccgcgggatcgcccacggccatgattgatcgcgaacgagcagaggaaatgcaagttaataatgaggcaccactagggtgcctcaagccaaatatttctcagtataactctccagagcagataggtggtgttgaagggtttcctgagaataatgaaaaaaggaatgatattgttgctgcggaaaaaatctgggaggcgactccaaaccaaggccttagcaggcccatctaccgacaagaattttatgcctggccatatatttattcagattatcaaatcgtgcgtcagccactaccttatggttttgacaaccaattttatcagataaatagggaccacggtttccctattgagaacagggttcaatatcttccattcaagatgctccctcaaggtcacccccatgatgcacagcttcaggaatttcagtattttgtggttattgactttgaagcaacctgtgacaaggtgaacaatccatttccacaagaaatcatcgagtttccatctgtcttggttaacagtgcaactggaaaactcgaagaatgcttccaaacatatgttcggccgacgtatcatcaatttttgactgatttttgcaaggagcttactggcatacaacagattcaggtggacagaggtgtgcctctaggtgaagccttactcatgcacgataaatggctagaggacaagggcatcaagaacacaaactttgctattgtgacctggtctaactgggactgccgtataatgctggagtcggaatgcagatttaagagaatcaggaagcccccttattttaacaggtggatcaacttgagggtaccgttccaggaagtgtacggggacgtccgctgcaacctgaaggaggcagtccagctggccgggctcacatgggaggggcgcgctcactgcgggctcgacgacgcccgcaacaccgctcgcctcctggcacttctgatgcaccggggcttcaagttctccatcaccaactcactggtgtggcaacctgccgccgctccgcagtcaaccgccgccacctgccacttctccccggaccgctctccggacccagtcgtcgtccagctccagcaccagcaccagcagcacaagccgaaggaggcgctggggtctcccgcgtcgcaggtgaacccgtcgtacgccgccacccccgcgggagggaaggacagagccatgtactgctactgcggggtgctgagccggtggagcgtcgtgcgcaagccgggacccatgcaggggcgctacttcttcgggtgcgggaactggaccgccaccaggcgcgccatctgcccgtacttcgcatgggcctcgtgaatagcaaagcaagcagagatctgggctggtgctttaaccgagggaggcgcgccatgttgctgcggctggctgctgcgcctcccagttccgtatatattattgttattattattatggtataataactttgctcgcgagacaaatggaggttctctaggtagtgtctctaacctgtcgtactgacttctgtcgatagaagagaatggggccagatgctgcttaggtgtgatctatcctatccatccatggataataaagaagtttgtggattgctgttttattaacttgatggaactccgtaggtgtggtttgtgcaacttggattttgaaggcttgtgcgtctgtgagtgtttgatcaaatcgaaggtggtgtttgtttgctgaatgaaaaaaaaaaaaaaaatgcctattattcctg

SEQ ID NO: 10584 - DNA, 792 bp, Zea mays
  misc_feature (375)..(375): n is a, c, g, or t
  misc_feature (383)..(383): n is a, c, g, or t
  misc_feature (781)..(781): n is a, c, g, or t
attggatcaccaccattcgcgctgttcggcgtgcgcacccgatcccgtctccgtgcggctttgtgagtagagaagggaaggggaagcaggagcaggaggggttcgtcatcgcgtggtggccgcgccgctctgttcctccgtcccctcctccttccggctctcgctgtcacatgtcgtgtggtgtgggggcgctctgatccggatggtgcagcgccgcgggatcgcccacggccatgattgatcgcgaacgagcagtttatttgatgcagaggaaatgcaagttaataatgaggcaccactagggtgcctcaagccaaatatttctcagtataactctccagagcagataggtggtgttgaagggtttcctgaganataatganaaaaaggaatgatattgttgctgcggaaaaaatctgggaggcgactccaaaccaaggccttagcaggcccatctaccgacaagaattttatgcctggccatatatttattcagattatcaaatcgtgcgtcagccactaccttatgggttttgacaaccaattttatcagataaatagggaccacggtttccctattgagaaccgggttcaatatcttccattcaagatgctccctcaaggtcacccccatgatgcacagcttcaggaatttcagtattttgtggttattgactttgaagcaacctgtgacaaggtgaacaatccatttccacaagaaatcatcgagtttccatctgtcttggttaacagtgcaactggaaaactcgaagaatgcttncaaactatgtt

SEQ ID NO: 10585 - DNA, 2671 bp, Zea mays
ccaaacggttgagataggatttcagacttgcaagcaagtggtacctgacttccttctttttttcaccagaaaaaatgttccttcctgtttaacaaaaaaatgaaaaatgaaaaaaaagcctcaaacaggaacaaccaagcagacacaaactgaagatttagatcatttgctgccaccaaggacttattatctcaccgtttcaatgagtttggtgtagtgctgaaggtactcattgttaataatgccgcaacggaccagccaacagggtcattttaattttaaaattttagtgcttattatagctgagccaagatttgtatcatgctattcattttacccctttttggaatataacttgtttattgagacattcataagacttcaatgacacatatgtatatctgcaggttataggtgcttaacattagataattgctcaatggctaaaaatgtgaatacaataattcagggcattttataccattctacactaagcttgtgagtgtttcgaattttcaatgaacattatatttataataattggtcatattacataagcccctccatctggttgctctttgctgatgtaatctgtgcatggtaagtttgaattcttgaattgatgtttttagttgaattatggtcgaatgtcactgcacttgatgcagcaaaaacatagggtcatgtgtacatgttttatatgtacatatgggttttggagaagttccgtctcgctgtcattaccctcccaaaaaaaactaaactgtcgagctaggtgctgcaaaacacgtatgtttatcctgatatgttcgtaccctcacctggaataaattcttactgttctcagtcttgtatgctatttgtttggagcctaacatctctatctccatgaccacagatgggagacggagtagttgctgggctgttgattggggactgcagtgaccggctgaccgcctccgtgtccatgcctctagaatatgggactactatgatcttaaagatgagacaaggctgctgcatagtgacctggtgttgcttgaagagtacgttgtgtagcgtttttactcataatacagtgatcaagtaattacatagagcacaatgtttacaccctctgtagaatataatgcaaaggttgcaacagctatgaatatagttagacggactgcagctattacataaataggactagcaaatcccagataagttgtttcgaaacattattttccatagggcgccgtctgttctagtatactaatttattatcatcttatttcttacaagttaataatcagtactaatattctaatatataatagaatataattgtttcttataacttggtctgacttgtgatgctcgaagaggagacttatccatatatctagcacctgcgcgcagtgagtacacgtctctccagacgatcctggggcccggcgtcactattgcattcaaagtgtagtggtgtagactggtagctccatgtacctactacgaccacgaccaggaggcacgccaactacatactactagcatcttgtgaacagacagaggtaggagtaggaatcggcgcagcacgactataggcatggacgtggaagcgagccatgagtctccgcccttgcgcagcaagacgatgcgccgcctcctggtggcgaccaactgcgtgatgctcgcgcttggcgtcaccggcgggcagctcctcagccgcctctacttcagcaagggcggccaccggcagtggctctccggatggctccagaccggtggctggccgctgctgctcccgccagtggcggcttcctacgtccgccgccgagcgcgcgaccggagcgccccggcgctgctcacccagacccagccgcgcatactgctggccgccgcggggctcgggctcatcgcgggcgtggacaacttgctctacgcctggggcctcgagttcctgcccgtctccacctccgcgatcctcatctccacgcagctggccttcacggtgctgttcgcgttcctgatcgtgcggcagcggctgacgatggcgacggtgaacgccgtggcgctgctgacggtgggcgccgtcgtgctgggcctgcacgtctcctccgaccgccccgcgggcgtcaccaggagccagtactggctgggcttcacgctcaccctgggcgccgcggtgctgtacgggctgttcctgccgctggtcgagctcacctacaagtgcgccgcggggggcggacgcgccgtgacgtacgcgctggtggtggagttgcagctggtgatggggttcgtcgccaccgcgttctgcaccgtcggcatgatcgtcaacaaggacttccaggtgcgtgatgccccacatatacgtgtcgcttatatacgtacgttccacttcaattctccactagctggccttcagcctcttgccatatacgccgagcgctaagaaatgtttgcttgaaggtgccatctcagtttaagatgaggtgatgcatgataacttcatttatcaaatttagggtttaaaggttgttcagtttttagggaccaaatttaactcactctattttattctattcttagttcctaaataggcaaatacagaggtaagttttagtttccgtatttagcaatttaggataaataaataaaatagatgaaaactaaaatatagttttaa

SEQ ID NO: 10586 - DNA, 891 bp, Zea mays
ctcgaggccggccgggccgggggatatagacgttgtcagttgtcattgctaccaacctcaggtcaccagcaccttctccccacacccccgagttcgagtgcaaccgaagagccaagaggagctgtccgcgtcgtttcgactcccgccgccgaaaggccgagcccgtgcccgtgctcgcaaccctaatcccctttccccgttgcctctcgccgggaagaagagggagccgcgtggcgtcgccagccagcacgcgccccctcccttcccggctccctccgcgccgtgggcgaggcgcatccaacccgatccgccctcaccgcgaggcggaggacctggaggggagggagacaggtctggtgcaccctctctcgtccgcgccggcgagcgccaagtgtcccccacaggcttggctgaggaagacccgtgctctgtgggtcttggacactgcttcaccatttaccaagtcttgagttattgctccgttgttagacaagaaatcaaactctctggccaaacacaatgatggcacaagcctgtaagaagaggagaggagtttatataagcactgaattgggaggctctgatacagattctgatgttgagggaagcaaaccctctaaaaaatctggggtgacatcaatttctacatgcgagcatcagtcatcttataatctcaaggctgcaagtatgaaaagtagcaggatgataaggctgtgtggaaatattgtaaggaagctcatcgatcacaaaggtggttggcttttcaaagatcctgttgatccagatctatataagattcctgactactttgatgttatccgcaacccaatggatttgggtactgttaagaataaactcacaaaaaagaagtatgtaagcattgaggagttc

SEQ ID NO: 10587 - DNA, 2797 bp, Zea mays
aattcggcacgagggtccggcgcgggcaaagaggagctggccgcgtcgtatcgactcctgccgccgaaaggccgagcccgagcccgtgtcccggtgcccgttcccgcaaccctaatcccctaccaccgtcggctctcgccggcgaagaagagggagccgcgcggcgtcgccagggagcacgcgccccctcccttcccggctccctccgcgccgtggggaggcgcgtccacccggatccgccctcaccgcgaggcagaggggaggagagggagccaggtccggcgcacccgctgtcgtccgcgccgaagagcgttaagagtctccccacaggcttggctgagggaaacttgtgctctgcgcatcttggacactacttcaccatttaccaagtcttgagttattgctccggtgccagacaaaaaaccaaactctctggccgaacacagtgatggcgcaagcctgtaagaagaggagaggagtttatataagcagtgaatcaggagactctgatacagattctgatgttgagggaagcaaacactctcaaaagtctggggtgacatcaatttctacatgcgagcaccagtcatcttataacctcaaggctgcaagtatgaaaagtagcaggatgataaggctgtgtggaaatatcgtaaggaagctcatcgatcacaaatgtggctggcttttcaaagaacctgttgatccagatctatatgggattccagactactttgatgttatccgcagtccaatggatttgggcactattaagaataaactcacaaaaaagaaatatgtaagcattgaggagtttgcagcagatgtgaggctaacattttcaaatgctatgaagtataatcctccaggcaatgatgtgcatatttttgctaaagaattgaatgaaatgtttgattcagaatgggaatcagtagaaaggaaatttagaggccgaaaccttggtcaagaccagcagacaatgaaggccataaaagttcgagctatgatggattcaaagtctacagttgctagagggccggttgcatgctcaaaccctaaaactttggttgctagaggtccagtagcttgctcaaattcgattgcaaagaagacactgacagatgcattatcctccaaagtaaaaatcaaattttccgtgcgcagctctgcgcatacctcttccaaagatatactcgttcaagcagctggtagcaaagaggggtccttaaatcactctgtccctactggcaacaaagaggcatcttcaaattgtactattcctatcgctaaggaggctaaaatatcaagggcacgagaaattgagcgctgctctggttcaattggaaaacaatcatggtcttgcaatgacacttctacttcacctctcgcttcctctgtgcaaggtgaggaaagttaccttcatgatgaacctttgtcaccaagcagggctcttcgtgcagcaatgctcaggagtcgttttgctgggactatagtgaaggctcaacagaaggcacttctagatcatgggaagaatatagaccctgtgaaattgcaattggaaaaggagaggctggaaaagaggcagcaagaagagaaagcaaggatcgaggcccaggtgaaggctgctgaagcagctgcacaacaaaagtttgaggaagaaatgaggatgaagagaaagcaggaaagggaggcagcacgcctggcactacgcatgatgaagaagactgttgatattgacaacagtgacttcctaaaggagctggagaacttcagcaaaacatggcaggcaaatccacctggcaaattaatcgtggattttatcagtggggacttgccaccggggttagggagtccgctggagaggctcggcctcttcatgaaggaagatttcgaggatgaggtagaacaggaaatggaggacagagtgtcaccctcaatggatgttgacatcaggaaagatttccaggaagacttaggacatgaaatgcaggacagtgcatcacccgtgactgtcattggcacaaagaatgacgtacagggagtggcaggacatgaaatggaggacagcggatcaccagccacagtcattgacacgaagaaagaagagacagaacatgagatggtggacagcgtatcacctttgatggatgttgacacggaggaaggggagatcagctgctgacggtagctacacctctcttcacccgcataatttattgaggcagacatccttgcttggttgttagattaggcaatttcataagcagagtgatgcagaaacattagttttatctgctttcatcgtagaaccatgtggtgtggagaacatgtctcagacgaaatgacgagtggttttggatttgctgcggattttaattttcgtggtcttgtcagtctggcaagagtatgatgactctgtatgttgaatttgacctcccccgctggatgacatgtataaaaggatgagaaaaaaaggatagtttggagctagtgtatgttgttggagtttatggtggagccagatttggtgagcgtgtcgtggacgtaaatgtaggtatagctatatacttgaaatattgataagagtgtttggttcaaaggatcaattcattccagttaaacatcatgagcttgttaatgggtgtttggttcgagagttcgttaatgggtgtttggtttgaagaataagctagtctactattttttttatttagttgttgaatgtaattttttgacctgtcatctcatttcttacaagtgaatgattatttctaagtctatgaaaaaaaaaaaaaaa

SEQ ID NO: 10588 - DNA, 1935 bp, Zea mays
cattgggtacctcgagccggcggcctccccgcaatgatgtacatgctttcgctagagaattgaatgaaatatttgactcagaatgggaatcagtagaaaggaaatttagaggccgaaaccttgttcaagagcagaagacaaaggccataaaagttcgagctatcgtggattcgaagtctacagttgctagagggcaggttgcctgctcaaatcctaaatctttggctgcaagagggccagtaccttgctcaaattcgtttgcaaagaagacactgacagatgcattatcctccaaagtaaaaatcaaattttccgtgcgcagctctgcacatacctcttccaaagatatacctgttcaaacagctggtgtcaaagaggggtcattaaaccactcttttcctaccggcaacaaagaggcatatttaaattgcacttttccttttgctaaggagaatgctaaaatttcaagtacacgagaaactgagcgcagctctggttcaactggaaatgattcatggtcttgcaatgacatttctacttcgcctatcgcctcctctgtacaaggtgaggaaagttacctttgtgatgaacctttatcaccaagcagggctcttcgtgcagcaatgctcaggagtcgttttgctgggactatagtgaaggctcaacagaaggcacttctggatcatgggaagaatatagaccctgtgaaattgcaattggaaaaggagaggctggaaaagaggcagcaagaagagaaagcaaggattgaggctcaggtgaaggctgctgaagcagctgcacaacaaaagtttgaggaagaaatgagggtgaagcgagagcaggaaagggaagcagcacggctggcagtacgcatgatgaagaagactgttgatattgacaacagtgacttcctaaaggagctggagaacttcagcaaaacgtggcagtcgaatccacctggcaaattaatcgtggattttattgatggggacttgccaccggggttagggagccctctggagaggcttggcctgttcatgaagaacgatctcgaggatgaggtggaacaggaagtcgaggacagcgcatcaccctcgatggacgttgacatgaggaaagatttagcagggcatgaaatgcaagacagcatatcacccgtgaaggtcattggcacgaaggatgacttccagggagcggacattaacacgaggaaagatttccaggaagacgcagcagggcatgaaatgcaagactgcatatcagccgtgaaggttattggcacgaaggatgacttccagggagctgtagggcatgaaatggcgaacagcctatcaccatccactttcgttgacacaaagaaatattccgaagggacagaacatgagatggtggatagcatatcgcctttgatggatcctaacaccgaggaaggggagatcagctgctgacgttagctacacttgtcatccacatcatttgttgagttcgtgaggcagacatccttgctgggttgttggattaggcgacatcataagcagagtgacgaagaaacgctattcccctctggttgtgtcgtagaacaatgtggagaacatgtgtcagccgaactgagtagtggttttggctttgttgcggttttttttcctgtcgtggtcttgtcagtcgggcactccgctgtatgctgggttacctgagctcgtcagctggatgacctgtataaaaacatgatgaaattagggaggggttaatttagtgctagtatatattgtaggtgtaggactgtaggagcttatggtggagccggctgcagcacacaagctatagcattgttctcagatttggtcagcgcgccgtagtaccttgttactgtattcattctaaaacttgaataaaatgatgccagtcgcacaagttactgtataaaaaaaaaaaaaa

SEQ ID NO: 10589 - DNA, 1425 bp, Zea mays
gggttacaaaggaagcttttgaatgggttattggtgagattgaatcgaggtttcttcagtctttggtggcccctggcgagatgattggatgtgtggctgcacaatctattggagagaaaggatatagccctctctctccatcatatagccctgcatcaccaagctatagtcccacctcaccgtcttacactcctggctctcccacctacagtccaacaagcccgaattactccccaaccagcccgacgtactcgcctaccagcccatcgtactcacccacatctccgagctacagcccaacatcaccaagctacagccctacatcaccaagctacagccctacatctcctagctatagtcctacatcaccaagctacagccccacctcaccagtttatagcccaacctcaccagcatacagccccacatcacccgcttacagccccacatcgccatcctacagtccaacttcaccatcttatagccctacatcaccttcatacagccctacgtccccttcatacagccctacctccccctcatacagccctacctctccctcctacagcccgacatcacctgcttacagcccgacatcaccaggatacagcccaacgtcaccgagctacagccctacatctccgagctacagtcctacatctccgagctacaatccttcatcagccaagtacagcccttcacatgcatactctccaagcagccccaggatgagtccatacagccagacttctccaagctacagtccaacgtcaccgacttactctcctacatcaccatcatattcacaaccaagtccatcgtacagcccaacgagcccgttcaacacctctggaggacccagcccagactacagcccgacctctccaaattacagccctagcggaagctactcccccactgcaccgggctactccccgtcgtccacaggccagggtaatgacaaggatgataagagcgctcgttgaagaggcacaggagaacaaggcgctctagagcactcgatgaaggcactcggtgatggccacatgggaagatcgaggcacttttttttcccttgagtttttgtatggttgatgaactctgagagcaaacttgtatttttccgagctgctaatagcagaaatagttgtttatgtatgatactagaactaaggactggactgtgctgcgacttgataagtggttaaccgcgtggtcgcccctcagagagtaacacatgtagtaatgtttaatgataatatcgtgactgtacttggtactactatgctatggtgtactagtgtattgcatgcgcgcgtggagcagagtgatctgcgtgtgtctagtgtagtgtgatggtgattaaatagaaaacttagttatacagtagataaatggtgtggtatatattgtaatgcaaattta

SEQ ID NO: 10590 - DNA, 3567 bp, Zea mays
tgctacctgaacatgttgacgatttgaagaccatacgtgaattcagaaatgtgttcgaggcagaggttcaaaagctagaagctgatcggtaccagcttgggtctgagatcaccacaactggtgacaattcgtggcctatgcctgtgaacctcaagcgactcatctggaatgctcagaagacattcaagattgattttagaagaccttctgacatgcacccgatggaaattgtggaagcgatagataaactgcaagaaagacttaaggttgtacctggtgatgatgctatgagcattgaggcccagaagaatgcaaccttgttctttaatatcctacttcgtagcacgtttgctagcaagagggtcttgaaggaatacaggcttacaaaggaagcttttgaatgggttattggtgagattgaatcgaggtttcttcagtctttggtggcccctggcgagatgattggatgtgtggctgcacaatctattggagaaccagcaactcagatgaccctgaataccttccattatgctggtgtcagtgccaagaatgtcacccttggagttcccaggttgagggagatcattaatgttgccaagaagataaagacaccatctttgtctgtttacctgaagcctcaggtgaaccagaagaaagaattggctaagaatgtccagtgtgctttggagtacactacactgcgtagtgttacccacgccacagagatatggtatgatcctgatcctctagggaccatcattgaagaggacacagagtttgttcagtcctattatgaaatgcctgatgaggacattgacccggataaaatttctccttggttgctgcgtattgagcttaaccgtgagatgatggttgataagaagttgagcatggctgatattgccgagaagattaaccgtgagtttgatgatgatttatcatgcattttcaatgatgataatgcggataagcttatcctccgtatccgcatcacaaatgatgaagctccaaaaggagaaatacaagatgagtctgctgaggatgatgtcttcctaaaaaagatagagggcaatatgttgacagagatggcgcttcgaggcattccagatatcaacaaagtgttcatcaaagaagggaaggtcaataccttctatcaagatgacggtttcaaagcagctaatgaatggatgcttgatacagaaggtgtgaatcttttagctgtcatgtgtcacgaggatgttgatgctacaaggacaacaagtaaccatctgattgaagtgattgaggtacttggaattgaggctgtccgtcgatctctcttggatgagcttcgggtggtgatatctttcgatgggtcatatgtgaactaccggcatctggccattctttgtgatacaatgacatacagaggtcacttgatggctattacaaggcatggtatcaaccgcaacgacactggacctcttatgagatgttcctttgaagagactgttgacatcttacttgatgctgctgtatatgctgaatctgaccacctgagaggtgttactgaaaacataatgcttggtcagcttgctcctattggtactggaggctgtgcactatatctgaatgaccagatgttgcagcaagcaattgaacttcaactcccaagctatgtcgaaggcctagactttggcatgactccagcacgatcacccatcactgggacaccttaccatgaaggaatgatgtcgccaagttatctgctgagtccaaacatcagggcttcgcctattaatacagatgcttcgttctcgccgtatgttgggcacatggcattctcaccattcccttcaccaggtggttactccccatcgtcagggggatacagcccatcttctccggttttcaccccagagaaaggatatagccctctctctccatcatatagccctgcatcaccaagctatagtcccacctcaccgtcttacactcctggctctcccacctacagtccaacaagcccgaattactccccaaccagcccgacgtactcgcctaccagcccatcgtactcacccacatctccgagctacagcccaacatcaccaagctacagccctacatcaccaagctacagccctacatctcctagctatagtcctacatcaccaagctacagccccacctcaccagtttatagcccaacctcaccagcatacagccccacatcacccgcttacagccccacatcgccatcctacagtccaacttcaccatcttatagccctacatcaccttcatacagccctacgtccccttcatacagccctacctccccctcatacagccctacctctccctcctacagcccgacatcacctgcttacagcccgacatcaccaggatacagcccaacgtcaccgagctacagccctacatctccgagctacagtcctacatctccgagctacaatccttcatcagccaagtacagcccttcacatgcatactctccaagcagccccaggatgagtccatacagccagacttctccaagctacaggtgcgcacaattctgtgttgtcaaagggtactctgtccatacatatctgtattgactgttactgtttctgtttgcgcagtccaacgtcaccgacttactctcctacatcaccatcatattcacaaccaagtccatcgtacagcccaacgaggtgagtgccatccagatcttcatatcttgtggtgcgtctccaattatcatgcctaccgccgtctgttttacacatttacccaatcaatgcagcccgttcaacacctctggaggacccagcccagactacagcccgacctctccaaattacaggcaagtcattctactgccagccaaatgtatacctgtcgtggcggccacggtggcccccccccccagcccgacctctccaaattacagccctagcggaagctactcccccactgcaccgggctactccccgtcgtccacaggccagggtaatgacaaggatgatgagagcgctcgttgaagaggcaccggagaagaaggcgctctagagcactcgatgaaggcactcggtgatggccacatgggaagatcgaggcattttttttctttccttgagtttttgtatggttgatgaactgagagcaaacttgtatttttccgagctgctaatagcagagagagttgtttatgtatgatactagaactaaggactgtactgtgctgcgacttgctaagtggttaaccgcgtggtcgcccctcagagagtaacacatgtagtaatgtttaatgataatatcgtgactgtacttggtactaccaaaaaaaaaaaaaaaaaagtattgcatgcgcaaaaaaaaaaaaaaaaaaaaaaaaaaaaaaaaaaaaaaaaaaaaaaaaaaaaaaaaaaaaggcgaacggggcctaacgagatggaaaacgggggtttccattgaatgaatgctcgccctggccttaaaaactttccatcttttcttaacgtaagatcttgttgccttaatggaattattttaatacttggttaaattgagaactattat

SEQ ID NO: 10591 - DNA, 1922 bp, Zea mays
tcggtacccctgcagcctggccgcggtcctccttccctaggattctcctacactttccattgtcgccccgatccccgcctatttaactcacacaccccgcctcatttcccccaaaaagcgaagcgaagcaaagcaaagcttcaaagcatcctcccctgcgagaagagaggaggacaatggggttcgtgctggtggtctctttgcacttcatcttcctctccatccttctcggcttcggctgcttcttcctcggcaagcacaggggccgggaggagatgcgaaccggcgtcggcgcgcaggtctacggcacgccgctgccgccgcccggcgtcgtcggagtctcatcgccgccgcctgagccgattcacgccaagaaacaagggcccgaagccgtctgattgagatccattcgtttctacctactactgcctatgttttggtgatgttggatttattctttcttctttattttcgtccagaccgtgtcgacgggtgtaagctgagagtgaatatatgtttgtgtctaaaaattgttcattgttacgacttacgaggggagggggtgatggtgtgtgtatgttgtgatatgatttgcaatcacggcaagcaaaaaccagatgtcttgtgtcactgtcctgactagctggtgagtggtggtgtgtgtatggatatcacatattttgtaaagtgtttttagagattacattgagcttgtttaattgttccactgaatccatccgcaaaataaactggggaatccctaggtctaccaagaatcagatttattgttgtatacaaacgacaagacccaacaccaaaattggcagaacaaacagttctgcccaaaacgaacagtgctcttcgtcatgacgattatcaaggagatgccaagaaggcaaggcaatgaacacctccacctgcaatgcaatgcgatgttggctaattgcagagcaggaacctggtgagcacgagcaccccgcaggcgacggcgaagagcgcgaagacggcgaggtccctggcctgccacctcctgggcctgtcggcgcccttggcctcgacgcggaggctcttggccctgcgcagcgcgtccacctccttgagcaggtcgaagtggaggcccttgcgcttgagctcggagacgcacctggcgaggagcagcgcgtcctcgcgctcccgcgccagcaggcgctccaggacggcctccgtgtcggacttgtaccgcagcgcccagagcatggcgagcgaggagagcagcgagacgaggcaggggatccaggaccgcctgcacgctgaggcggggccggcggtggaggaggagaggaagaggagcaggacggaggcggcgtggaacgcgaagaaggcgcagtagaggaaggcgatctccttgcgcgcgccgtcgaggcgggcctcccgcagcgcgacgcggcgcgccagcaggtcctcctccttgacccactgcttgagcagcagccggtgcgtcccgctcgccgcgatctggctcagcgggtgctgcttccgcgcctccgtgacgacgatggagccggagtcagccatgggcgtggcggcggtttcgtctcgtgcgatagggaaaggggagtttctctgggggccgtccccccgcctcgaggtcccaacgtgagcttaaaaaggttggggaaaagccaaaggcgggttcgcgcacctgagcggcgcaacggtcggaattttctgctcgggccgcaccattcgcgtttcgcggtggcactgacgtgcgtcttcgactgggccactgcccactgtggatagtagttgccgtcagtctgggaaggcaccggcccactactagcccaccgggcagttttgtccgacctcaaaacatcttctgcgaaaaaaacatgtcagtaatggcaatgcagctacttgcccatgtgcgacacctcctg

SEQ ID NO: 10592 - DNA, 1691 bp, Zea mays
gcacgagccgacactctacactggtgaccgagcgggccggccgggagcggccactgcccactgcgttggccgcggtagcagctagcagtccaaggcagagctctcacgcggacggcggacctggccacctggggggcgcggacggagccttcgctttcccccctcccctccctttcgaacgactaccgaggaggcatccgaggtggccagccacgatgatggccgcggcggcgctgaggccgcacaagtcttcgccggcgcgggtgcccacgcggtgcgtggccgcgctctgcgccgcctgcttcctcgtcggcgtcggcgtcgtcaacaggtactggcctgttcctgagcctcatcccggttgcccagacaaggctggccctgaccactcgagggccgtgttgaaccaagcgtcacagactcgcgaagtcgtcatggcgttggacaagacgatatccgacatcgagatgcgcctggctgcggctagagccgcccaggcgatgagccagggcatgtcaccgggcgactcggactcggagggcgaccagggaaccgcgcggcgtaggatgtcttttgtcatgggcgttttcaccactcttgctaaccggaagcggagagattcaataaggcagacgtggatgccacagggtgatcagttgcgaagattggaagacaagggcgttgttatccgttttgttgttggacgcagtgcaaatccaaacctggaaaatgaggtcgaccatgcaattgatatggaggatgaagaatacggtgatatcttgagaattaatcatgtggaaggctatggagggctccctatgaaggttcagatgtttctttcgactgctcttacaatgtgggacgctgatttctatgtaaaagccgacgataatgtccatgtcaacattggtatcaccagatcgattttggcgcgacacaggatgaaacctcgggtgtacattggctgcatgaaatctggacctgttgttgctaagaatgactccaagtattatgagccagaccattggaagtttgggactgagggtaacaactactttaggcatgcaacacgtcagttgtatgctgtaaccagggatttagcaacttacatatcagcaaaccggcatatcctgcacaagtattcaaatgaagatgtatcatttggctcttggttgatcgggttggaagttgagcatgttgatgagagaagcctttgctgtggtactcccccagactgcgaatggaaagggcaggccgggaacccatgtgcggcgtccttcgactggaactgcactggcatctgcaatccggtggagaggatgacagaggtacaccgacgatgttgggaaggccttggagccgaagggcacgcacagtctttgacttttgacagccaatagttggcgcttggcggatcattgtcgcaccattttcttcctcttctttagggccctgtaattaatatgcggagatgaacttgtatgcaatggctcggtttttcagatgtgcagcaatggcatcgtttccgtgccaaaaaaaaaaaaaaaactggggtagagaattaggagttcaatctgcaagtgagtctctaataactggagatgcctcactggacgtccgatgaaactggggtagactgtttgattctctgatgaaagaattagctgtctgtctgagttctctctcgtgcc

SEQ ID NO: 10593 - DNA, 1365 bp, Zea mays
ggaggaatcatctggacctcactgatatacgggttggaagaactgcgcatagtcttggaatatgctatcatcttcaactcaagcttgctcaagcccagacatgttatgagatagaaggacgtgttctgggggttggtcacccagagtattcaagtacaatgtacagtctagccaaggtgctcagtctacaagggaaaaagaaaaaatgcagaatgccttattgaagagtctattagaatacttgaggaagctgggcttggcgattcactaacatgtttacgaagaatggtctctctctctagagagtcgataaaaccaagacgatttgctgaagctgaaatctggcactccttggtattacatgttctggagctttcagagggatgggattcattggtcactgcacgtgcagctgaactcctaagtttaaatcttgaaaccatggagaagttgaaggaatcagaagagctattggaacgatgccttgcagtcaagaaaaagattctacctgaagatcatcttcaggtagcttatacgttggtacacctggcaaggttaacattgcacagagttgtaaaggatcgggatgtaaacagcgatgtaactgcatattacctcgcaaaagcaaaacagttcagcaatgattcaatcaggattacagaaggacaattaaattcttcaagaaaagatcagaataaaattaacaacacatcaactgcagatacagataagagtgcagcaataattctttttcaagcacttcatgtttttggactcattgatattgcagcgaagcagttgctagggcaaggggagcaagactataattctgttcaagatgctctgcagaagtgtgtttcactttacaaagagcctcatacacgaaggttggtgaaaaatgctgccaagcaggactacatgatatgcctgacgagcctgatcgatatggttcagagcttgtttcccattccacacataccggggttgcaggagttgctttgcgaggccgaacaaattttaggagagctagaagaagagagtactaggaagaagcaatgatacgtaggaaccaacacccatatgggtggaagcatttgttaattgcaagttgtgagccatatattttttcagttggtcgagatcgcccacctatatgggtggaagcatttgtttgacgaggtgctgaatcgagtgacgggttaaagagtttaatgcttgtttgcgcagtggtgttatgacgtggtcttcaacatagagtcctagtttctcggtggtggtggtccacaagatagatcatgttgctgaaatcttggatgctttctaaatcaaaatccttgacattggcgaccaaaaaaaaaaaaaaaa

SEQ ID NO: 10594 - DNA, 1825 bp, Zea mays
tatagaggatgaatatataggatcttgctggagctagccttagagtgtaaataagatatgaaaagactgttgaagattaaaaagatatagaaaatatttttatgtaaactactatcctaatgataattaaaattgtggaatttagaaaggctctaggagatgttctaagaggtgtttggtttatagagactaatgtttagtcccttcattttattcttttttagtctataaatcgctaaatatagaaactaaaactttcattttggaactaaaataaaataaaatgtagagactaaacattagtccctacaaaccaaacatcccctaagaaacaattatattttaggacggagaaaggttttgtaacttttattccgctagggctttgttcttgtttgccgccgccggcaccaccgtcagtccccacatggccgccgcctgccttcgccgcctccaccgcatccctcatcctgtccttaagctcgccgcagccactcactggcccttgccattccccggtgccaagttggctctggtcacacagtcgtgcccatccgccgaccgcgtcgaagtacagctgagcgcccgctgccccggttttgcaagtaatggtaacttcaaacatcgatggcatcacaagctgggttcatcagttggtgctgtactgattggacatgcagccttttttcttggtttgagcaatggctctgcatttgcccaggaagattcagttagcccagctgcagctagtgagcatgctgagggaaatgctcctggtttacaaccgattgaagatggatcagtggtctcaaacgaacacacggtcaaatggagaatttacactgataatgcgcgggagtttttccagaaagcacaattggatgaggctgtaacacattatccctagcttggtttcagacaacttttgggatctgtgatgtttctgagagaaactacctttttataggttatacatttttttttctgaaattgttttacatacgaacaatgcagaagtcaaactattgaacactaccctagttttcctgtactcatctggttttctgaaccttgccagtgcatgctttgtattggaaattaagagcataaaccttcagtttcaccatcgggggttatttgctgttatgtgatattgctgtaatatcaagccatctaccataatgctgtggacaattatttatataaatccgttcagtaatttttaataagtaaatattacacaacttatgcatctacagacttatgacatggttcacattcatacttacctttttatctctgcaaatgaactttagaatttggcttgctatacttgctacaaatttcatagggtcagcgagacatgtttaagcccgttccattgaaagaactgttatgaactgcatttcccttgtttcactacctacgtagttattatcttggaattgaactatggaaataaaacttggactatatttctgtaattaaatatttttatgacaggttgaggaaatagaagctgtgattttgatgttgcattgtctgtctattttgtagagacaattggatgaggctgagaagttattccaggcagccctactagaagctaaggaaggatttggacttagagatccacatgtcgcgtcagcccttaacaatctggtaattaatagttttattatgttctgaaaacagaagtgcactgagctgttgttaatctttcaggccgatctgcagtatttatgatgaatctgtaatccagctgtctgatattattgttcatttacctaacagatatgacttataaaaaaccctgattcagggg

SEQ ID NO: 10595 - DNA, 1677 bp, Zea mays
  misc_feature (1517)..(1517): n is a, c, g, or t
  misc_feature (1545)..(1545): n is a, c, g, or t
  misc_feature (1555)..(1555): n is a, c, g, or t
  misc_feature (1560)..(1560): n is a, c, g, or t
  misc_feature (1574)..(1574): n is a, c, g, or t
  misc_feature (1585)..(1585): n is a, c, g, or t
  misc_feature (1591)..(1591): n is a, c, g, or t
  misc_feature (1598)..(1598): n is a, c, g, or t
  misc_feature (1605)..(1605): n is a, c, g, or t
  misc_feature (1607)..(1607): n is a, c, g, or t
  misc_feature (1616)..(1676): n is a, c, g, or t
cattgggggcctccccgcggccagactggcaagagtttgagccaacacacacagagagaggacaactcctcacaactctcccttccctcctgtaggggccaaaagggttagagagtaggagaagtagttccctagcccaacacaagaaaaacaagctcgatctcctcatcaccctaatccaagcaactgctttgtgtgttgggaaattcttgtgacccctgttatattattatccgtgtagctactagcttcattcccccctttgtacccatcaaatggctggcatgtctctgcaacacccctgggcgtttgctttcggtctactaggtaacgtcatctccttcatgaccttcctggccccgataccgacgttctaccgcatctacaagagcaagtcgacggaaggcttccagtcggttccctacgtggttgccctgttcagcgccatgctgtggatcttctacgcactgatcaagtccaacgagaccttcctcatcaccatcaacgccgccggctgcgtcatcgagaccatctacgtcgtcatgtacttcgtctacgcgcccaagaaagccaagctgttcacggccaagatcatggtcctcctcaatggcggcgtctttggggtcatcctcctgctcacccttctcctcttcaagggcagtaagcgcgttgtgctgcttggctggatctgcgtcggcttctccgtcagtgtcttcgtcgcgccactcagcatcatgagacgagtgatccagacgaagagcgtggagtacatgcccttctccctctccctctcgctcaccctcagcgccgtcgtctggttcctctacggcctgctcatcaaggacaaatacgtcgcgcttccaaacatcctggggttcaccttcggcgtggtccagatggtgctctacgtgttgtacatgaacaagacgccggtggcggcgactgccgagggcaaggatgccggcaagctttcctcagctgcagacgagcacgtcctcgtcaacatcgccaagctcagcccagccctcccggagaggagctccggggtgcacccagtcacccagatggcgggcgttcccgtcaggagctgcgctgctgaagcaaccgcgccggcgatgctgcccaacagggacgtggtcgacgtcttcgtcagccgacacagccccgccgtccacgtggcatagattctcgatcgatcgcgtgcatggcccatgcatgcgcccgccacacgtacgctagcttttatatattcgaaggacttgctgctggtcgtgagcatatatatgatggagaaaatgattaagtagtatatatgtaagtaattaactgccatggaagcttgctaatggatggaggcagaggccagaacgatgaagggggaagctatacatatatgtgtgtaatatagatatatggggtttgtgtccaaaaaaaaaaaaaaaaattaaaccgcatggatatctgttattcctttttatgtgtaacgtcttctaataaaatgtaattgaatctgttanaaaaaaaaaaaaaaaaaaaattttttgnccccgggganccctntttttaaaccgccnccccggggggngccccnctttttnccttttngngggggaaannnnnnnnnnnnnnnnnnnnnnnnnnnnnnnnnnnnnnnnnnnnnnnnnnnnnnnnnnnnng

SEQ ID NO: 10596 - DNA, 1020 bp, Zea mays
tagcgtggtcgcggccgaggtacttcgtctacgcgaccaagaagggcaggatgttcaccgccaaaatcatgctcctcctcaacgtcggcgccttcgggtccatcctcctcctcacccttctcctcttcaagggtgacaagcgcgtcgtcatgcttggctggatctgcgtcggcttctccgtcagcgtcttcgtcgcgccgctcagcatcatgaggcgggtgatccagacgaagagcgtggagtacatgcccttctccctctccctctcgctcaccctcagcgccgtcgtctggttcctctacggcctgctcatcaaggacaaatacgtcgcgcttccaaacatcctggggttcaccttcggcgtggtccagatggtgctctacgtgttgtacatgaacaagacgccggtggcggcgactgccgagggcaaggatgccggcaagctttcctcagctgcagacgagcacgtcctcgtcaacatcgccaagctcagcccagccctcccggagaggagctccggggtgcacccagtcacccagatggcgggagttcccgtcaggagctgcgctgctgaagcaaccgcgccggctatgctgcccaacagggacgtggtcgacgtcttcgtcacccgacacagccccgccgtccacgtggcatagattctcgatcgatcgcgtgcatggcccatgcatgcgcccgccacacgtacgctagcttttatatattcgaaggacttgctgctggtcgtgagcatatatatgatggaggaaatgattaagtagtatatatgtaagtaattaactgccatggaagctagctaatggatggaggcagaggccagaacgatgaaggggggaagctatacatatatgtgtgtaatatagatatatggggtttgtgttcatctttgctgctatgtattaatttgcatggatatctgttattcctttttatgtgtaacgtcttctaataaaatgtaattgaacctgttagaatataatataagtgaattcaccatcg

SEQ ID NO: 10597 - DNA, 1409 bp, Zea mays
cattgggtacctcgaggccggttgggcccctcgaggccggccgggagggccagaaacaacgcagagaactcagagctcttcgtgccttctgcaagggccaaggaggaagagaagtgtgcgtactgcgtagttccatagacccctgacaaatcatcgccatcatataacaccagcaacgactgttggtttagttgtatatctgccttgcagccgtattatctgtatcaccgtttttgtgtcgcgatggctggcctatctttggaacatccttgggcgttcgccttcggtctcctaggcaacgtcatctccttcatgaccttcctggccccgataccgacgttctaccgcatctacaagagcaagtcgacggaaggtttccagtcggttccctacgtggttgcgctgttcagcgccatgctgtggatcttctacgcactgatcaagtccaacgagaccttcctcatcaccatcaacgccgccggctgcgtcatcgagaccatctacatcgtcatgtacttcgtctacgcgcccaagaaagccaagctgttcacggccaagatcatggccctcctcaatggcggcgtctttggggtcatcctcctgctcacccttctcctcttcaagggtagtaagcgcgttgtgctgcttggctggatctgcgtcggcttctccgtcagtgtcttcgtcgcgccactaagcatcatgaggcgcgtgatccagacgaagagcgtagagtacatgcccttctccctctccctctcgcttaccctcagcgccgtcgtctggttcctctacggcctcctcatcaaggacaaatacgtcgcgctaccaaacgtccttgggttcatcttcggcgtggtccagatggtgctctacgtgttgtacatgaacaagacgccggtggcggctgccgtgggcaaggatgccggcaagcttccctcagctgcagacgagcacgtcctcgtcaacattgccaagctcaaccccgccctcccggagaggacctccgggatgcacccagtcacccagatggcggccgttcctgccaggagctgcgctgctgaagcaaccgcgccggcgatgctgcccaacagggacgtggtcgacgtcttcgtcagccgacacagccccgctgtccacgtggtctagcttctccatcatcgcaagcaagcatgaatcgagtcgagtccgaactccgaacgcataattaagcacccaatctattggatatataaatacgcgcgccccaacatgtgcgccatatagccgtttattccaacccttagctttgtttaattctcaaatatgcaattcaagtaatgtactttcatgcaaccaggaatttcattttcccctccaaaataaccataagaattttctataataaaaaaaaaaaaaaaaaagcggcc

SEQ ID NO: 10598 - DNA, 1638 bp, Zea mays
cgggatgtgtgtgattgaagagccctgcgcttgtacacgatgacacaacacatgtacaccaaagcatgcgtgtgcatgtgccacctcgcgtgcataatgcggaccacgtcgcgggcggccggggcaagagttttgagccaacacacacagagagaggacaactcctcacaactctcccttccctcctgtaggggccaaaagggttagagagtaagagaagtagttcattcccttgcccaacacaagaaaacaagctctcctcatcaccctaatccaagcaactgcttgtgtgttgggaaattcttgtgacccctgttatattattatccgtgtagctactagcttcattcccccctttgtacccatcaaatggctggcatgtctctgcaacacccctgggcgtttgctttcggtctactaggtaacgtcatctcattcatgaccttcctggccccgataccgacgttctaccgcatctacaagagcaagtcgacggaaggcttccagtcggttccctacgtggttgccctgttcagcgccatgctgtggatcttctacgcactgatcaagtccaacgagaccttcctcatcaccatcaacgccgccggctgcgtcatcgagaccatctacgtcgtcatgtacttcgtctacgcgcccaagaaagccaagctgttcacggccaagatcatggtcctcctcaatggcggcgtctttggggtcatcctcctgctcacccttctcctcttcaagggcagtaagcgcgttgtgctgcttggctggatctgcgtcggtttctccgtcagtgtcttcgtcgcgccactcagcatcatgagacgagtgatccagacgaagagcgtggagtacatgcccttctccctctccctctcgctcaccctcagcgccgtcgtctggttcctctacggcctgctcatcaaggacaaatacgtcgcgcttccaaacatcctggggttcaccttcggcgtggtccagatggtgctctacgtgttgtacatgaacaagacgccggtggcggcgactgccgagggcaaggatgccggcaagctttcctcagctgcagacgagcacgtcctcgtcaacatcgccaagctcagcccagccctcccggagaggagctccggggtgcacccagtcacccagatggcgggcgttcccgtcaggagctgcgctgctgaagcaaccgcgccggcgatgctgcccaacagggacgtggtcgacgtcttcgtcagccgacacagccccgccgtccacgtggcatagattctcgatcgatcgcgtgcatggcccatgcatgcgcccgccacacgtacgctagcttttatatattcgaaggacgacttgctgctggtcgtgagcatatatatgatggagaaaatgattaagtagtatatatataagtaattaactgccatgcatggaagctagctaatggatggaggcagaggccagaacgatgaagggggaagctatacatatatgtgtgtaattaatatagatatatgggctttgtgttcatctttgcagctatgtattaatttgcatggatatctgttattcctttttatgtgtaacgtcttctaataaaatgtaattgaacccacactactgttgttagctacc

SEQ ID NO: 10599 - DNA, 1930 bp, Zea mays
gccattgggtacctcgaggccgggccgggagggcaagagtttgagacagcagaggacactcctcctcagaactctcccttccctcttgtaggggccaaaagggtcagagatctaggaagaagagaactagtccccaagcctaacaagaaagcaagctcttctgcaactgttggcattcgccttaatttgtatccatatcccaatggcaggcctatctctgcaacacccctgggcattcactttcggcctcctaggcaacgtcatctccttcatgaccttcctggccccgataccgacgttctaccgcatctacaagagcaagtcgacggagggcttccagtcggttccgtacgtggtggccctgttcagcgccatgctgtggatcttctacgcgctgatcaagtccaacgagacgttcctcatcaccatcaacgcggccggctgcgtgatcgagaccgtctacgtggtcatgtacttcgtctacgcgaccaagaagggcaggatgttcaccgccaaaatcatgctcctcctcaacgtcggcgccttcgggtccatcctcctcctcacccttctcctcttcaagggtgacaagcgcgtcgtcatgcttggctggatctgcgtcggcttctccgtcagcgtcttcgtcgcgccgctcagcatcatgaggcgggtgatccagaccaagagcgtggagtacatgcccttctccctctccctctcgctcaccctcagcgccgtcgtctggttcctctacggcctcctcatcaaggacaaatacgtcgcgcttccaaacatccttggcttcaccttcggcgtggtccagatggtgctgtacgtggtgtacatgaacaagacgccgctgccggttgccgacggcaaggctgccggcaagcttccctcagctgcagatgagcacgtcgtcgtcaacgtcaccaagctcagcccgggccgactcccaccagtaacacagatggcggcggttcccaccaagagctgcgctacagaagcagccgcgccggcgacgctgcccagcagggacgtggtcgacgtcttggtcaaccgccacagccccgccgtccatgtgacctagctagatctcatgcccgtgcagcatgcgcccgccatatatacggactggtcatgagcatatgatggaattataagtaattaattgccatgtaagctagctaatgatgcatggagacataggtcagaggtagagggccaagcgcgcgctctctctctctatctatctatatctatttttatatctatatagagagtctatattcatgtttaatttgccgcattatattgcagatatgtattaatttgcatggaaataggttattcgcttgttcatttcgcccttaacacacgtggattagggggtattgagccggtttaaatccataagttaaaatcattctcaatccattccaatacactctaatccacatgtaatctaccccacactactgctgtaggtactatttcttttacaaaaaaataaaatggcttccgtgtgtttgtctgtgctggtttctacgatgtcggaatctgtccgaaaatgtgttattcctttgtttgtgctggtacctccagaccttgtgttctccacagcaaaaataaattacatacaaaaacacatgattacttatattatattgtcttacaacaaatacacatgaacaataaaacaaataccatcatcgtattaatcttactgatttacctgtcactttgctgggcattgtgctgaaaatgtaagaagccagttgttagatgagctatatgaatatcgtcattttggttcacgacacctatgattcaacctcacagaaatattggctttggcttccctatccacatccaagccaacatagatcgcttagaataatggtgtcagaagcctgtgaacctaacaact

SEQ ID NO: 10600 - DNA, 1431 bp, Zea mays
cggaaaaaacattgggtaccatcgaggccgggccgggattgccagaaacaacgcagagaactcagagctcttcgtgccctcctgcaagcgccaaggaggaagagaagtgtgcgtagttccatagaccctgacaaatcagcgccatcatacaacaccagcaactgttggtttagttgtaaatctgccttgcagccgtattatctgtatcaccctttttgtgtcgcgatggctggcctatctttggaacatccttgggcgttcgccttcggcctcctaggcaacgtcatctccttcatgaccttcctggccccgataccgacgttctaccgcatctacaagagcaagtcgacggaaggtttccagtcggttccctacgtggttgcgctgttcagcgccatgctgtggatcttctacgcactgatcaagtccaacgagaccttcctcatcaccatcaacgccgccggctgcgtcatcgagaccatctacatcgtcatgtacttcgtctacgcgcccaagaaagccaagctgttcacggccaagatcatggccctcctcaatggcggcgtctttggggtcatcctcctgctcacccttctcctcttcaagggtagtaagcgcgttgtgctgcttggctggatctgcgtcggcttctccgtcagtgtcttcgtcgcgccactaagcatcatgaggcgcgtgatccagacgaagagcgtagagtacatgcccttctccctctccctctcgctcaccctcagcgccgtcgtctggttcctctacggcctcctcatcaaggacaaatacgtcgcgctaccaaacgtccttgggttcatcttcggcgtggtccagatggtgctctacgtgttctacatgaacaagacgccggtggcggctgccgtgggcaaggatgccggcaagcttccctcagctgcagacgagcacgtcctcgtcaacattgccaagctcaaccccgccctcccggagaggacctccgggatgcacccagtcacccagatggcggccgttcctgccaggagctgcgctgctgaagcaaccgcgccggcgatgctgcccaatagggacgtggtcgacgtcttcgtcagccgacacagccccgctgtccacgtggtctagcctctccatcatcgcaagcaagcatgaatcgagtcgagtccgaacgcataattaagcacccaatctattggatatataaatacgcgcgccccaacatgtgcgccatatagcagtttgttccaacccttagctttgtttaattctcaaatatgcaattcaagtaatgtactttcatgcaaccaggaatttcattttcccctccaaaataaccataagaattttctatagcacgttaatgtactgtaccttgtcttatttttcttctgtctacaaagttagtgccagatatgtgttagattc

SEQ ID NO: 10601 - DNA, 2412 bp, Zea mays
  misc_feature (23)..(23): n is a, c, g, or t
  misc_feature (455)..(455): n is a, c, g, or t
  misc_feature (1752)..(1752): n is a, c, g, or t
agtgtctctttctgcaaaccatntgcagaaactgtgtttatcttttcaactaaccacaccgcttgggcacacatttaaacctcaccaggttgctactcacctcgtatctgataccatgatggcaacttttttcttacatcatttagcaaatgtgttcaggtgttcttgaaattgaggcatgagagtaaggttgaacacttattcgtggtacctggctctgcaaggcagttcaaaattgttcttgtgagtatctctacactggaattggcttcgttagttctttggatgctcataattcattgtggcaatgtagccaatactctagaccaggcactgaactatcttgagaagttgcacctatataccaacaaagtttttgaacctggaaggtaatatttaggcaatgaagcctgtattcgagtttttactctatagtcatgcttatgggaagcagnactgcgggtatgtaggtggcaactgacaaattgaggtttaaaacatcacccagttgcattttggtaaagataggtttcgttcaatatggtatattgatggagtggttgaaattttctgaagcgtttaaagacattgatttctgacatggttccttatattgtgctactttaacttcttgtaggacttcctaggtttggtggagaaattttactacctttctggaagatatgaccttgagcttaccgttggtgatgctgtaatggtatgcaaccatataattatctatactcctatatagggtccccatttgtttgcattgctgattttctttgtctccaggaaaattcatttctacgacctcttggccatttggagttggacctgccagatgccccagaaaaagctccacgtcctcctgcacaagctgttgacccattctcaaaatttgggccaaaggcagagatatcacatatattccgcgcaccagagaagaggccacccaaggagctctcgctagcgttcacgggtctcacgcttctgccgtttattggattcttgataggggtgggtaaaatagtcattggtacttatgcatttcttacatttgcttcgaatcaaagtttctgcctgctccggtgcgactgatcgaggcccttctcctgcagctcgttcgtcttggagtgaacttgaagaacttcccgtccttgccaggaccggccgcatttgcctcacttttccatgctgggataggagcagtcctgatgctctacgttctcttctggatcaaggtttgccttgttcccttgtgatgaatgttcctgtgtgaaaactggcgctgacgttcacttccattttgatttcggtgcagttggtcgcgtgggcaactctcaagtacctcggcttccttggcatcttccttgtgtttgtgggccatagggctctatcctacctttcctcggtgtcgacaaaacagaagacggcatgagtggacagagttttttccgaccatccatttcttgagggggggccattgcaggcccttgggtgtcttatgagggagggctcggtttatttcagttggctttgcagaatactgataactagaaaaagtagtaggacctcaccttcgtgtattatgatgatgcacatacaattttctgagtagaatggatgttgaatcatagaactaatgaataatatgaacactcgccttcgccccaagtgctagtttggaaacttaggatgtgtttgttcacatggcagctaggaacggtattgggatgatcctattctaanccttaaacctaaataaaacagccttatctaagagatcgggacccacaggattcaggatttgcatacgtccaggggtggcagggaaaagctacgggataaattagatctccgtcctgtccgtcgcctccgcctccgttgtgcctgatcaattttttgtgctttctctgatgtatggtggtgtgttgatactttccgatatcctacacgttgacttacgaaaaaggatcctatcgggcactagtttggatccatgattttacacgaagattggaggagactgagagctcaatctcctcaaatctctcacgaaaaaggatcctatcgggcactagtgtgtgtctgatttagctctaagctattatatttcacctctccatatatgtctggtgtcttagtttatatttaaggtgatttgagataatttcagtcaccatttttataccaccaactaataaaacaaattattacttttgtgatttgttatttatctttgtgccatgatatttttttgttcttgtctgactatagaaataattgtaaattgttgttttgctaatacaaatcagatttgtaaggtttttttggctcataatggtctttctctctttttagcttaagtgtagctagctagttcgatgatacatttagtaaggtcatgct

SEQ ID NO: 10602 - DNA, 753 bp, Zea mays
attcggctcgtgggagttggaccgctcgatgccccagaaaaagccccacgtcctcctgcacaagctgttgacccattctcaaaatttgggccaaaggcagagatatcacatatattccgcgcaccagagaagaggccacccaaggagctctcgctagcgttcacgggtctcacgcttctgccgtttattggattcttgatagggctcgttcgtcttggagtgaacttgaagaacttcccgtccttgccaggaccggccgcatttgcctcacttttccatgctgggataggagcagtcctgatgctctacgttctcttctggatcaagttggaccttttcacaactctcaagtacctcggcttcctcggcatcttccttgtgtttgtgggccatagggctctatcctacctttcctcggtgtcgacaaaacagaagacggcatgagtggacagagttttttccgaccatccatttcttgagggggggccattgcaggcccttgggtgtcttatgagggagggctcggtttatttcagttggctttgcagaatactgataactagaaaaagtagtaggacctcaccttcgtgtattatgatgatgcacatacaattttctgagtagaatggatgttgaatcatagaactaatgaataatatgaacactcgccttcgccccaagtgctagtttggctgactaaacagtgatagaatacttgtttaccctcccgcaaactgcgtgccatatgaatcg

SEQ ID NO: 10603 - DNA, 2187 bp, Zea mays
aatacgtttttaggaacttcggagaacgaaggcccccaacagcgagatgtgttagctcggcgtcataagctgtgacgccgagctaaggatccaaaacatgaaataagtcatccagttgtttaaatgtactttttgtagaaaaaatgtttaaaaaccaaaaaatcggtactcctggcaagcgggcccagacatttgagattgggtattcaaaaattcaaaagattgaagaatttagtgtttaacactattttatgtaatacattattgacaaattagtgttctaacactatagatcaccaaaagcataggtattcaatgaatacccatgaaaccccctgggcccgcccatgcctggccctgcgccgacgtcgtcgtccttgcaattccatacgcagcagcgcgtaggggacgaacaggaacatcacgcaccggcgggctggttgattatttcgatggcggcatggatgtccgtgttgtcctgtacgccactgccatcgtctctcagcttctagttccagcagtcagtgctgcgctgcgctggacttttcggcgcatcttaaataatggcccagtgcaaagcttcattcctgtaccaaactactactatatagtactactccagtatagtgataaatcctccttgcgtttcgctcttaattcaagcagagcttgttgtttgatatatatgtttaattgcaattaacatcgatctgggatattctgaaccgtgattcgtgtctacctgatgatcctcatcatcagcagtccagaatccaaaggctaaagaccaggagtcaggtgcaagtcctaactgaaagtcattatattaattttgcattggtgtggcgcactttggtggtcattatattgctccggtccggttaatttgctctggcgtggcatgcgggcatgtgcatgacagctccgtcgcaacctctgtattttggtccctccctcttgggccgtagggcaccttgtgtgcaccctgcatatatgtggagcccgcctcgccgcccgcgcgaggccacacgcacaccaagagatagagattgctggtcgagaagaagagatgttacatatataataactactgtaggcagcggcatctcctgctgggacgaagattcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgagttcggcaacttccagaccagcgccatctccatcctcgtccacgccatcctcttcttcgccctcgccgccatcttcctcgtcgccgtcggggtgcacatgtacctcggctcctaggcggcggcgcggggcgccgtaccttctctctctcgccgcgcgcgccatcgttctcttcttttatgttctctctctatatatatagtctgtatgaatgaatgatatcatataataatgtacgtaccgtcgtccatgcatttgcccttatatctgtctgccttctgatccgtaaacgaattcagttcttcagtttttttttccaaatcggccccttgttcacaaagctagctcagctgtagcgtgctgcgtgcatgcatgaaccatgatggcgtagtatcagatcgacgacgaaaggagctagagcaggtttcgcttttgtgcctctgattaatctgatgcagctagagcgtcgcagtacgtacatactgtaggagtgtagccgtatacgtacgtacgtacgtagaggtctctcgcttggtgccgggtcgcggcgtgggcgatgtgatgggcgtagcaaaggaacaaaagcaattgatacgctagctacctctctcgtgagcaagtgagcaacatggacgtcgtcttgtgtggttcactgctgatacgggacggccgggtcgctgcagatctcatctggcttggcatccatgtgagagagatatgcttggctatggcggtatggcctatatctatacgggatatgaagcgtgtggatcaggtaactccggcctgctcgcgccacacgaagacgacgcacgaacggcggccaattgaaaccaacgactgcgtgcgtgagcctatagatggacaatgagcatgaggcccgtgagcctagcatgaagcccgcaatttgg

SEQ ID NO: 10604 - DNA, 1780 bp, Zea mays
gttgcggtaggacagaatatgtgctctgttacggtgttggtattgatggattcgagatatactggggcatgcaatttcgtgagtagcaatgcaacaggtgttgcgtttttttaatgtttacggtttgtggagcaactggggtgcatttggttgtgaccaagagagatactgcacatactcttccatttggggttcgctcacatgtctgctgctatgtttagctttggtggcacatattataaatagagctgtgctaattttctgcttgtaccactggggttggggtgaaagcaagttcgagttttttagggcaatcggttgctctttatgcccagttttgttagttgggcaatatgtcaactaggaaaattcagagacagaataatggtccaaattgtgaattatatctgcctactccctccgtcccaaattataagtcgttttaggtgcatagaaagctatgcacctagaaaagacaaaaccacttatagtttgggacaggcggagtacttctcaaatgagatgattaattccatcatcctgcagaatactgtcaatcctgttgtttatccttgtgtatgcttgttagtcaaaccatatttcagtaactaattccttgattgtgagttactgctgatctcatcatggaatgggttttcatgtagttcagatgtgtttttttactcaactatttctctattagtttctaggttacttacgtggatgctatttatctgtctggactttggatagtgcaatgttggctcaaaagaaaaaaagatagacctggtgctgaaggctccggggtctgggaaagggataaacagaggcaagccttcttcccacaattgcggagaggctgctttcaacacacgacttagtgggacagctctcaccactgcacgagacgtgtccctctaaaactactaactcacaaaattataaaatttgtgattttgtagccattgtgatcttgtatttgtatcaacaaatggttgatgctgcatgtttgcagggaatatgagaattcattacaacatatcatttatttttactactgagttatagtatggattgacttgtatcttttgtgagttacttctctttgtacttgttgagcttgtgcattgtagatttgaactgaagtcatgtggcatttgatttacttccaagttttattgttgttttcatgtggcgtataggtgagggatgaagaaggaagaagaagatttcatggtgcatttactggtggattctctgctggcttttacaacactgttggctcaaaagagggtatgttctgttgaaattttcattattttttttctccctccgccccgcccaggattcaattctagctctaccccttgccaaactttctaaagtttgaccaaatgtatacaaaaaagtatcaatattcataacatgaaataggtatactataaaaatctatctcagacgaatctaatggtacttatttgttatcataaactttgatgtttttttggtataatcttggttaaacttaatgaattgacttggtattatactagaattccattctttcctgtacagaggagtagtatgcttgaaagtagcgttgaggaaacacattctataatatatgcactatgattttcctcagggtggacaccacagacatttacatcatcacgaaagaatagagctgagctgacaaagcaaagcatatacaattttcttgatgaagaggatataaaggtacataatgttctttaaccatgcaaataaaatttgaaaa

SEQ ID NO: 10605 - DNA, 2728 bp, Zea mays
  misc_feature (5)..(5): n is a, c, g, or t
  misc_feature (22)..(22): n is a, c, g, or t
ctcgnacaggttacatccaagnaatatactataactgccgagaaggatcattataagttcaaccgtctggaggattttatgattttaccaaatttggcaagtattgatgatatcagatcagttagatatgatgtatgtggtattgttcgaacagttactctgaattcaaaagcaatggttactttaacacatggaccagaaaatgtaaagccacagcggaaattagtgggtgaaaatggacatttttgctttgaggttcctgctggtgaataccagttatctgcattacctgtagattccgaacgctcttctagtcttatgttttcaccgggatctattagcgtcaatgtaaatagcccgttgcttgatctggaattctctcagtcacaagtcaatgttcatggtaaagtctcatgcaaagagcaatgcagccagaacattctggtctcacttgttagattggctggcggagttgaacaggaaaagaagacaactacgttggaacaagataatgttaattttgtgtttaagaaagtatttcctggaaaatatcgtgtagaggtgaagaattctttacccgagggcttagctaaggatgattggtgctgggaccagagtatcttgaatatagatgttggtactgatgatgtgagagacattgtgtttgtacaaaaaggctattggattgagctagtttcaactcatgatactaatgcttatattcagcagccagattcttctagacttgatttgttgataaagaaaggatcacaaagaatttgtgttgaaacttcagggcaacatgagattcatttaactaatccttgtatttcctttgggacctcgtctgttttgtttgatacagctaatttaatgccgatccatatcaatgcaaagaagtatcttgtaaaaggtgaaatccatgtggacatgagctccattcaggaaaacattgattccaaggacatagtcgtggatatcttgaagagtgatggcagtttcatagaaaagatatccacatcacttgttcttggaaaggacaatcaaaatgacttcactgcctttgagtactctatttgggctgaccttggggaggacttcatctttgtcccccatgattctagcattggaaggaacaaagtcctattttatccagcaagacagcagtattcagtttctatgaatggatgccaagatactgttcctctaatcactgcaagaactggtctatatcttgaaggatcagtgttacctgcaacttctgatgttgacatcaagattctagcagctggaaagagcaactatgcccatctgaacaaaggggatgtagcaacagaggcaaagacagattctgaaggatcattttttgcaggtcctttgtatgatgacatagtatataaagttgaagcttcaaaggatggttaccatctcaaacaaactggcccatacaccttttcttgtcagaagcttggtcagatattagtgcggatttatggtgaaaattcagagcttttaccttcagtattattatcattgagtggcgagaaagggtacagaaataactcaattagtagttctggtggaaccttcacctttgacaacttatttcctggaagtttctatctccgaccacttctaaaggaatataaattcaatccgtcagcagtagctattgatcttaattctggagagtctagggaggctgaatttcgtgcaaccagagtggcttacagtgccatgggttctgtaacactattaactggccaaccaaaggagggtgtttttgttgaagcaagatctgaatccacaggtttttatgaggaagctaccacggattcttttggtagatttcgtcttagaggacttgtgcctggatcgacttactctataagagtggctgcaaaagataatcttcagtttgcagcagttgagcgtgcttcacctgaatatttgtcagttaatgttggtcatgaagacatgactggtattgattttgtggtttttgaacgccccgaagtaacaatcttgagtggccatgtggaaggagatggcattgatacgttacatccgcatctctctgttgaaatcagatcagcaacagactcttctagagtagaagctgtacttcctcttcctctttcatactactttgaagtccgagatttgcccaagggcaagcatcttgttcagcttcgatctggccttccatcacatacacataggtttgaatcggagttagtcgaagtagatctggaaaaggatccccaaatccatgttggtcccctcaaatataaaactgaggagcgtcatcaaaagcaggaactgaccccagcaccagtttttccgcttattgttggagtttctgtggttgcactggtgatcagtatgccaaggttaaatgacttataccagagcgctgtagggatgacttctctgggttcagggatggcaccgaccaaaaaggagccacgcaagaatatattaagaaagagagtgtaaatggcatattagcttagccttaggggtcgagaaatgagacatgacaaattgagcaatttcaacagtggaatagcttctggtttccccctcgggtaattttgccgacgaaaaggaatgccagttttgttgtacgatagcactatgcacagtttttgaagccttagattgtgccgttttgcagttttagactataaagaaagagttgctgcatcatgaaaaaaaaaaaaaa

SEQ ID NO: 10606 - DNA, 1251 bp, Zea mays
cgacccagcgttcttatcctcagcagtagctattgatgttgggtgtggagagtctaaaaaagctgaatttggtgcaaccagagtggcttacagtgccatgggttctgtaacactattaactggccaaccaaagagggtgtttttgttgaagcaagatctgaatccacaggtttttatgaggaaggtgccacgattgggttggtagatttcgtcttagaggacttgtgcctggatcgacttactctataagagtggctgcaaaagataatcttcagtttgcagcagttgagcgtgcttcacctgaatatttgtcagttaatgttggtcatgaagacatgactggtattgattttgtggtttttgaacgccccgaagtaacaatcttgagtggccatgtggaaggagatggcattgatacgttacatccgcatctctctgttgaaatcagatcagcaacagactcttctagagtagaagctgtacttcctcttcctctttcatactactttgaagtccgagatttgcccaagggcaagcatcttgttcagcttcgatctggccttccatcacatacacataggtttgaatcggagttagtcgaagtagatctggaaaaggatccccaaatccatgttggtcccctcaaatataaaactgaggagcgtcatcaaaagcaggaactgaccccagcaccagtttttccgcttattgttggagtttctgtggttgcactggtgatcagtatgccaaggttaaatgacttataccagagcgctgtagggatgacttctctgggttcagggatggcaccgaccaaaaaggagccacgcaagaatatattaagaaagagagtgtaaatggcatattagcttagccttaggggtcgagaaatgagacatgacaaattgagcaatttcaacagtggaatagcttctggtttccccctcgggtaattttgccgacgaaaaggaatgccagttttgttgtacgatagcactatgcacagtttttgaagccttagattgtgccgttttggagttgttgcatcatgaatgaactttctcaccagtcagcatgcacgttcgaataggttaatctgagcggtccaggactaagtagaatagacaagtttgttgtggcacgttgtttgcccctctttttgattgtacaacgaccaagtaaagcgtgtgcaatgacttctctgacttaaaaaaaaaaaaaaaaaaaaaactcgagggggggcccggtacc

SEQ ID NO: 10607 - DNA, 2105 bp, Zea mays
  misc_feature (9)..(9): n is a, c, g, or t
  misc_feature (17)..(17): n is a, c, g, or t
  misc_feature (49)..(49): n is a, c, g, or t
  misc_feature (59)..(59): n is a, c, g, or t
  misc_feature (162)..(162): n is a, c, g, or t
  misc_feature (193)..(193): n is a, c, g, or t
gcgtttctnataaccgnaacaccttctggggggcaagcttggatgtganacaatctggnaatctccggtgccattccagatactaccgatggaaatgcaaaaacagatgaactagttaaagtagatggtgttatccttcctgaccacaaagagagcttttcntgaaaacacatgtgttgtaaaactggagganggggatagaagtagatcaacttggtcaacaagctgatgcgatacatgcagaggtattgcaggaagaggtgcctgagatgatagaagtagatcaacttggtcaacaagctgatgtgatacatgcagaggtattgcaggaagaggtgcataaatctgaacagtctgatgagccaggggtcgatgctcaagaagtgctgaaccaagaatctgctgaagaaactgatggcctggtgaatgtaaagactgatgaaactgagcacaagagcaacatggtggtccctgatgacacaattccagaacatgatgcacaaacgagagagccacctgtaaatattcaagaacaaagccgggaatcagtaggagatgctgaagcagtcaatactgaagcagaaatgcaacaaaacagtgttgcttttgaggagacaactccagaaaaccatgaagcaacctcagagccatgttctgaaatccaacatgcacatcatgtggaaccagaggaaatcaatggccctgaagatggcaaagatgatgagatcaccaacatgagcagcagagaatatctagttcgagataatgctctgcagagtggaccaataatagatatacaaccagttcaggagttggaacaaattaaaacggatgaagcttctaaccagactcatgctgttatcttcaatgacctagctcaggaagatgctacagaaacaagtgaaccacaagtgactgaaacagaactaaaggacattgaagccactgaagctgaagaaatcaccaaacttgaccatgttactcattccaaggaacttgcagtagaaaatgattcaacagcagatgaaccacataagggtgaaatccatcaaactcttgaacaagatttagttgaagttaaggacactggaacttaccatgaaaaaacaatatctacttcagaggacacagtacaagataatttgacagaagatgagccaagttttggtagtcaagaagtagatgatgcagagtcaacagaagaaactaagcaaaacatagctgagaatattgcagaagtctctgatgtggcgattgttgatgacgcaattgaacagaatgtgctacagactgaggatatcgttgaaatgcataaacaggagctggaacgagaagaaacagagagaatagaacctgttgaatcagaggaagcttctgatcagaggaatgatgcaccattcgattattcagctcgagaagataatacaaaggaaagtgagatacagcagacagaatcagcaacggaaacaaatgaaattgaacccactgaaattgaagcagttcctcgagaaagcaatacctgtgtttcagaggagccttctcaagaagatcatataaaagaaagtgaaacaagttttgacaatcaagaagtgaacatcacagaatcttcagaagtaaatgatagtcacaaagatataatatctggaggaatctctgacccaagcaacacagcttctgctggggattcatctgaaggaagcaatgtccctgaaggcgagccacctgaacaggctgtgcaggaactgggatcagaggagataaagaacactcaaattgatgaagtgaatgaaacatcccttgaaatgaatgctactgtctttcagataccaagtcaagaagaaaatccagacacaaccaaattgcatgaatcaacagaggtgagcaacattgaagccacagaaatgcacggaaacccccaccaaagtgatctggctgctcagtcagaggagcaaacaacagaaggaatatcaagtggtctgaaaccagaatcaattgaaggtaatgatactgaagccaacaaatctcaaagtacctctcaggaaaaaacaatctctgcctctgagtctgtcccagaagatgcaacgtcgacgcggccgcgaattcgg

SEQ ID NO: 10608 - DNA, 3949 bp, Zea mays
  misc_feature (1250)..(1250): n is a, c, g, or t
cttgcatgcctgcagtagctcgtcttggtccatgtgtgctattggtttcttaaatatttacgggtcgagaatcagtttgttgatcatttaaaaaagattattatttttacacacatgatttcttatataccacatttcacctattgtttattacaatcaagatacttcaacatctattaataaatattacatatatagtgatctcgtaagttcgtgactcgactaataaaaatccctacgaacaacattttattgaaaaattaacttttttttaattttttttgttaagttattgatgaactggatttctagctctagaagatataatacatttacttataaaaaattctatatcatagaatacaattctattatggagagaaaacaacgataaacatataatgtcaaataaatgataaaacatgatatatcagagttaaaagagttaaaagccaagagattactctaactacgataaaaaaagaaagaaagaaggggccatagccgccaagcacagatggggaccacttgtgtgtgcgcttagcaatttgtgccctttttctgacaccctcacttcttatccggaagcggtggatagggacacatgcgcccgcccgggtcgcatcccgacccgcgccaccggtccgaccagaccgccgaccggctcagccggttcaccacttctcacttcacctgcctgccgcttcctgctttcccgttcctgaaagagagagaagcatatcctcactctagtctctctcgccccatccccttccccgtccctcctccagctccctctcctccgactgctgcccctccaccgtccgcccctcctccccgccgccggccacatccggactaccccgccgcgttacctcctcctcctggcgcttcccgcttggcggttgcctgggatttacccccgctctgttcccctttcggggaacgccttcagaggcaggacgggtacttggtccgggaggcgcggcgacggcgacagcggcgagtgatcttcggtcgccagagggagagttttttttaacggggttttggtgggaaggaaggaggcggccgcgagtaggcgagacgttcatgggttagatctggcggtccggcggcgcggatctgagcgaggtaggctgtcgcattttttgccccctccggcgtctgtttccatttccttgcagttgcctgcagttggcaggagctgaaggctacccaatctctctctgcaggtttcggtggagggnatcgggtggtggtcactatcttcgcctcatttcgagtagatggagcgtctcatggccaaatcgggcatgtatggcggattctgctactgtctgaagcagcgttgcctgcagatctgaaagtcacttggtctccttgcccagttgaccttactgaatggcattgctttccgcggtttgactgtcattacatccttttcggcgtctgatcaagaatttttagcacgagatgacgtgcttctagttgttgctgatatcttgtcctgtgttgagtaaacctgaagctggaaaggagcggatcacattcgtgctcttgctcttgttgacttctaggtctatcttagatacctagaggctggaaggggtcagatccagttcctgtggtcctagtaacaaggtcctcttgggggaaggcgccatgacctacttccccgaggaggtggtagagcacatcttcagcttcttgccatcgcacagcgaccggaacacggtctcccttgtgtgcaaggtgtggtatgaggtcgagaggctgagccgacgagcggtgttcgtagggaactgctacgctgtgcgccctgagcgtgtggtgctgcggttccccaatataaaggccctcacggtgaaggggaagcctcactttgcagacttcaaccttgtgccgcctgattggggtggctacgcagggccatggattgatgcagcagcaaggagctgtgttggtctcgaggagttgcgcatgaagcggatggttgtgtttgatgagaaccttgagctgctagctcggtcattcctgagattcaaagtccttgtccttatcagctgcgaggggtttagcaccgatggtctagctgctattgcgagtcactgcaagctcctgagggagttagatttgcaggaaaatgatgtggaggaccgtgggcccagatggctttccttccctgattcctgcacttcgctggtctccttgaatttcgcttgcatcaaaggggaggtgaattctggtgcgttggagagacttgttgctaggtctccaaatctacgcagtttgaggttgaatcgttctgtttcagtagacacactctcaaagatactattgcgagccccaaatttggaagacttggggacaggtaatctgacagatgagttccaagctgagtcctattccaggcttactagtgctctggagaaatgcaaaaagctgagaagtctgtctggattttgggatgcttctcctatttgtgttccgtatatctatcccctctgtcatcaactaacaggcctaaacttgagttatactcccacactggattattctgatctagctaaaatggtcagccgctgtgtgaaactccagcgtctctgggtactggattgcatttcagataagggtttgcaagtggtggcctccagttgcaaggacctacaagaactcagggtgtttccatcagaattttatgttcctggtgcttctgcagtgacagaggagggacttgttgcaatatcgtcaggctgcccaaaactgacctctttgctgtatttctgtcaccagatgaccaatgaagcgctaattactgtagctaataactgcccaaatttcatcagatttagactctgtatccttgagccaaagaagccagatgccatgacaggccagccgttagatgaaggttttggtgcgattgtccgtgaatgcaaagggctaagacgtctgtcaatatcaggtcttctcacagacaaggttttcatgtatattggaaaacatgcaaaatacctcgaaatgctttctatagcatttgctggagatagtgataaggggatgatggacgtgatgaacgggtgcaagaatctgaggaagcttgagatcagagacagtccatttggcgatgttgcactcttgggaaatgttgccaagtatgagacaatgcgatccctttggatgtcttcatgcaatgtcacattaaaggggtgccaggtccttgcatcgaagatgccgatgctcaatgtggagatcatgaatgaactagatggaagtagtgaaatggagaaccatggagacctctctaaagtggacaagttatatgtttaccgcacaactgctggagcgagggatgatgcaccaaattttgttaagatcctacagagctagccgcgactacccttatatcttcccaccttgagagatggtcggtggaatccggcatgcctggggccagggcaacagtggtaagttcttgaatcgtctccccttttgcagggtcaggaaaagccacactggcctgcgcccttatcgtggagcaacacgaccgggaatccatcatcatcctctgtaccaccgcccccctccctttcagtgtctggtcatatggccacccaggcccccctttattacctgtgaattctcccactcgagaggaggggaccgaacggataactttttctagccatgtaacatctctagtgtacttgtctccatttgcttttgacattggcacggtggattgtgttgctggcgtcgctgttgtagtgttttgtttcgcaaacctgagaattatcgggacattccggggacgacgctctgtttcttgctcctgtgaatgcatggactgcatgtaatatttgatggccttgcaggatttatcgtacacacttttcgcccttgcaaaaaaaaaaaaaaaaaaaaaaaaaggggggcccggtaccca

SEQ ID NO: 10609 - DNA, 2026 bp, Zea mays
  misc_feature (1770)..(1770): n is a, c, g, or t
ggtgaggtggtggagcacattttcagcttcttgccgtcgcacagcgaccggaacacggtctcccttgtgtgcaagttgtggtacgatgtcgagaggctgagccgacgaggtgtgttcgtggggaactgctacgctgtgctccctgagcgtgtggtgctgcgattccccaatgtaaaggcgctgacggtgaaggggaagcctcactttgcggacttcaaccttgtgccgcctgattggggtggctacgcggggccatggattgaagcaacagccaggagctgcctgagtcttgaggagctgcgcatgaagcggatggttatctctgatgagaaccttgaactgctagctcggacattcccaaaattcaaagtcctcgtccttatcagctgcgaggggtttagcacggatggtctagctgccattgccaatcactgcaagctcctgagggagttagatttgcaggaaaatgacgtggaggaccgtgggcccagatggctttccttccctgattcctgcacctcattggtttccttgaatttcgcttgcatcaaaggggaagtgaattctggtgcattggagagacttgtcgctaagtctccaaacctacgcagtttgaggttgaatcgctctgtttcagttgacacactctcgaagatactagagcgaaccccaaatttggaagacttggggacaggtaatttgacagatgagttccaagctgagtcctttgtcagacttactagtgctctggagaaatgcaaaaggctgaggaatttgtctggattttgggatgcttctcctatctttgttccgtttatctatccactctgtcatcaactaactggcctaaacttgagctatactcccacactggattattctgatctgactaaaatgatcagccgctgtgtgaaactccagcgtctttgggtactggactgcatttcagacaagggtttgcaggtggtggcctctagttgcaaggatctacaagaactcagggtgtttccatcagaatttaatgttgctggtgcttttacggtgacagaggagggacttgttgcaatatcatcaggctgcccaaaactgagctctttgctgtatttttgtcaccagatgaccaatgaagcactaactactgtagccaagaattgcccaagtttcatcagatttagactctgtatccttgagccaaagaagccggatgccatgacaggccagccgttagatgaaggctttggtgcaattgtccgtgactgcaaaggtctaagacgactgtcaatgtcaggccttctcacagacagggttttcatgtatatcagaatgtatgcgaaataccttgagatgctttctatagcttttgctggagatggtgataaggggatgatggatgtgatgaacggatgcaagaatctgaggaagcttgagattagagacagtccatttggtgattttgcactcttgggaaatgttgccaaatatgacacaatgcgatccctttggatgtcatcatgcaatgtcacattaaaggggtgccaagtccttgcatcgaagatgccgatgctcaatgtggagatcatgaacgaactagatggaagtagtgaaatggagaaccatggtaacctctctaaagtggataagttatatgtttaccgtacaactgctggagtgagggatgatgcaccaaattttgttcaaatattatagagctagctgcaattaccttggtatcttcccttcctacgaggtgatacttctcatatatccatnttcttttcatctggaaatattgtatgcctgcttatcaatttgtttgctcttctgctagtccattgctgtttgaacttaatctttttgttttgcacttagtaactctgttgaatacaatactgcatctttctaattctaatgcatgctccacaacacgtgaactagtatctctaggcccttgctgctcattataccagaataaatgttccattcagatgcaacagctatacacccatttagatcatatgtcattata

SEQ ID NO: 10610 - DNA, 4810 bp, Zea mays
  misc_feature (3752)..(3752): n is a, c, g, or t
  misc_feature (4711)..(4711): n is a, c, g, or t
cccaaagctccttcaagacgaaaatgtagtctctgttggactagcaaattaaagcaaagacccagaagcccagactttaggcgtagggccaacaaagaggaggatcggccccgaaactatagattttgttcaaataatgtctcaagggtaataaaattctgatgatttagagtgcatactttctacctaatgtatcaactttcagacccatgaacatcaagccaacatcaaaataaatgggggcaccgaggatttcagtttcattcattagcattggcccatgctgccactgtgaaccataaatacagcaaatagaatgcccccctaatctggctgtgacacctgatatgtaacatgagattatcaaacaattcaaataaatcaataaaaatgatgatacttaaggaaacaaacaggtcatgttttgaactttcaagttgaaaaatgaagaactaaagggcccaaatagcctcaccttttatggaggattcttttgtgaagcattcatttactttgccctttagttctccaaccgcttaatttgaatatcagttgcttcgaacattaactcagctacacgaaaacgcaacagttaaagcacatttgtagtgaatgttccctgtcactctacatacttccataatgcagtgactaattcgattaagaaaaaaaagtagaagacactcagcagtcagcacggcaggaagattccatgggacagtccaaagcgcaggagccatatctttccatccttcaagaaaagaagcgccaaccgactaaagctattcataaaccatgtcacaataaaaggctttcaaaagataatgctaacatgttaagtccttttaggacatccaggctcagaattatgcagaggaccacaataggttatgtcacgaaccaactctgaatcaactttgtcttaaacaaaaaaaaaggatgaccagacaacaacatccagcctaaatttcctctatgaatgatgattgcgctctactatgaaccgttgacagaaatgttgttagttcatacaatctaatctggtagcagggtgaggtgtcctcagcctgacagatgattggcatttatattatcgggtactaaaggtttgaagttcaaatattacaggaacaggaatccatgagtggagaaaactgaaacttgaagaaaaaactgttaaccaagaaaagtacaaggtgggtcgatttacatgggaaattaagcgcgctctttctgagaattcagcaaagggacaaagttttttgcatttcgtgaggctccccatattcccacagcaccattagccccgcccactctagccaccaaccgaaggcaaaaaaagaaattaatgccaggaaaaggccagcaaacgaggctcacacccaactaactctgtctcaaatctctgacctcagaacatgcaccaatacctcaccatcaataaataccctcctcccccgccgcccccggccaccatagtaacctccctacaatagcctccagttcaaggaatcaaggcacatagaaagcagtagcagcaaacaagcaagcaagcaatggagatagaatcggtcaagtgcgagtgctgtggcctgaaggaggactgcaccccgcactacattgccagcgtgagatcaggcttccatggccaatggttgtgtgggctgtgctgtgaggcggtcagagatgaagcatgcaggaggaaggctcaccatggagtagaggaggctgtgagggctcacatggcgttctgcaacatgttcaagttgaaccccgccgtccgcgtggccgacggcatgcgccagatgctccggaggcggtccggtgatatgtcaaagccagaatcggccaagaagtacgaatcatcagtgacactgtattgaagagttcatccatcctaaggcctgtagaccgtctagccctcttctcaggctgaaataccttccaccttttgtcagtttgctgtatgttcttcttatcatgcctatgccttcttggaatgtacatacgattcatgcaaacagatgctagtactgtatggctttttgatgatatggtcttctttctgtgctcacaacacaatcattgagctgataagatatgcttagatcatactaattctgtttctgtctgggacctaacaaaagagagggagatatggttatggttagcatgtgcaagcagaactgttcacgcgtcaggtactcaggtcaccaagcttgctctatctcacttgacgtgtgatgcggacactacaccgtcaagggctccatgcataataaaatatatggcttcctaaaactgtaatattgtggcagtgtaatccagggccactttcttttaagaaccaccaatgctgtttctttggattaaacgctactaatttgaagatattgagttaatatgcacactgcaaatacttgattgcttcaacatcccttgtcaaaataaatagtgcaacaccaaaggcattcatatatattggagaactctcttccaatgtgcaatggcaacgattctggataatagtgtaactctagttagcaacatagttgtgatactgtgatttaataacagttcaaagtcgtggtctagtcccttatttttttataagacattgtggtctagttatctgaatactggacaactagtatgctttgggcaccatttctgtagttcatggaattatagctcaatgaacagagtagcttatcttcttatgatcttggttttgtcaagtattcacgtcctatggctgaaaaactgttacctaatttttggagtctgtcgtgcccagtgagatcaaaggtggatgcagacctaaaaacatagcactagaggtgttcgtagataattaatcacagctgaacgatgcatttcaattgtgaatcatctagtattttttttttttttttggccacgcgaaacatcatttctattgcacatattcaccgtgccatcacagcactgacaatctgatacaaactgtaatgcttatatgcaagctatttcagggaagttgattcagaatttcaactgctgcagcggatagggtagttatcatataaactgtagaaccgacacaaacggacgtaaccgtaatggcactgacacgcagtggaagtgcagcgttgcaaacgaccatgccgtccagaacccaagcaccatgagtcatgggtcatttcgcaatgattttgcatgattaagaaagggaaatgctaacagaggagcgaggcagtgcctggtgcgctcgccacaagttaacactcgagtacagagagcaagcacctgcgctgtgcttcttcctgtgccctcgcaatccatcaagcacctggtgggagcgcgtgacccggggatgcctgcatctcctgccgccagactacacagcctttcatacggcgagctcccgtcacgatcgagtgaacgacacaggcatctgccaatccaattgatagattgcgagagcatcatggcatcaggtaccagagaggcagcgtcgtctccgcgcgaggagatcgtgcgcggcatggcatggcatggcatggcacgtggtccgtcgccgtcgcacttgacagcgcaacggccgacggggatgggaatgggatgggacctgggaatgggagtggggaagcagaaatcagaacgcgtttcggagagcaaagcccatgggccgtgcgtactcctaaatccacacgggccaggcgcgcaaattccgtcgtgtaaaatgatgactcaagcttaaagacacgatngagagaggcccatgcttccgtgtactctggccttcctaaaaactctccggcctagagacaccggactgcgaggtatatgatgcgggataaaacgggaataagtttttttttcctcttgactttatttgacgctcatgagattaggaatagtgagggaaaatattaaactatacttggctaaatgtatcgtatctagttggctagtccaagacccgtgctatttatagtatatggtacgacctgtttagaccacctttacagttgaatctgacacgattatatttttaaattattattatatataatacatgtaatataaataacctgtggcacactagttataagactagagctttgctcttcactcgtaagaccaagattcaaatcctgttagtgcctcattttttggttatttttgttaataaaccataatgaaggttatgtgggtaaataccggttttatatcggagtgatatatcatttctatataagtaacttgtacatcccttataatacagatacgggaaagaagtcggaggctaaaccatacatcatgtgtcttgtccgtttcttatcatgtttctggaaagggagacagatcttccataacttctcgtgtataatctgctgatagaaggaagggagcggatctggtaattcgtgataacgtagttattcaacatgttatcaggacacactacctcaacgttgttgtaagatcagatttgtatcaactctctatcaagctgacatgtcttccaacctagccgaactgttctacacgacgtgctacacaattgaactatatgtctttatagtatattagatctaatctactattcttgatctgtgtgcgctccagtgctcggtccgagagttccgtctggcagaactatcgtccagcgccaccactcgcattggcatcagggcgctgtgccgtcgagcaggtcaaaggcaantagtcgctgcgtcgtggctgccctgctttccctcgggcgtagcaggccgcaagcgtctagcgccgtcatcatcttttcaagagggtcgcctgcccataa

SEQ ID NO: 10611 - DNA, 1550 bp, Zea mays
ccggggatcggattcggtgggacggtggcatctatgcgcccgcggcaccgtcgctcaaactgtataaacctgcgctcgaacacttcgagctcacccgcaacctcctccgggaagcgcgatcgccatctcgaaggagctgagatccaagattccaagctcttctgtcacagctgtgctcacgcaacttcgtgttatttgttcgtagcaggttgagggaagttgaagcaaaaatgttttacgggggatatgcttaccatggcaactcgtttgagcaaacataccgttgttatccagcatcgttttttgataagccacacctggaaggcggtgataaagtaataatgccaccttctgcccttgatcgtcttgcttccttgcacatcgagtaccctatgctatttgagctgcacaatgatgcaacccagcggatttcacactgtggtgttttggagtttgttgcagaagaaggcatgatcatcatgccctattggatgatgcaaaacatgctgcttcaagagggtgacactgtccatgtaaaaaatgcgactcttcccaagggcacatatgtgaaattgcaacctcacacaactgattttctggatatttcaaacccgaaagccatcttggaaaaaactttaagaaatttctcctgcttaaccacgggagacagcatcatggtagcctacaacaacaaacaatattatattgatattgttgaaacaaagcctgcttctgcggttagcattattgagacagactgtgaagtggactttgcgcctcctcttgattataaagaacctgagaaaccacgacaaccaacagttcctgcaagcaaggcacctgctgaagatggcaacactgcagtggaggatgaaccaaaattcaaaccatttactggttttggaaagcggttggatggaaaagcctcaaaactgcaagcatcagaggttccttccactgcactttctgcaccttcagattcaaacaaaagagcaaatcagcaaatctcagcacccgcagcttcaggagctagcaattacagtcgacagaaaactgggaaacttgtttttggttcaagtgcaagcaacaataaggaaccacaaaaggctcctgctaaagaggagcaacccgcaaagaaggacgacgagccgaggttccaagcgttcagcgggaagagctactcattgaaacgttagctgcttcagttaaccttgaaattcgccgctactctttcgtttgttgcatggtgggtgttctggcacctggtcaccaccatgtagatatgaattgaagtatgtatatgcttatcttgatggaaacatgacagtctgtttatttaagcccaaaagtttaaaacagcgctattgttcttacccagtgtgtgttttggaatctgctcctgttttgggggccatggtttcggattagtagacccaagcaggatagtgaacgtgtcagcaatcagtcttagcggcagacgagatgtgatgattgttgggccctgggagtttggtcatgttccaatattatagaccgtactccaagtctcc

SEQ ID NO: 10612 - DNA, 1573 bp, Zea mays
gcacgaggcaagatcattttagacccaagaatactgatcctggcctcatgggcccatggatgctccgtgcgatcgtgcattcgtgctcgtgccgggccccccatcccggccccgcagcccccccataccggcggctctctgtttctcgaatacccgatcctatcgcatcgaatcgaaactgttccgctcccactccgatcggattcggtgggacggtggcatctatgcgcccgtcgcaccgtcgctcaaactgtataaacctgcgcccgaacacttcgagctcacccgcaacctcctccgggaagcgcgatcgccgtctcgaaggagctgaaatccaagattccaagctcttctgtcacaggttgagggaagttgaagcaaaagtctaagcaaaaatgttttacgggggatatgcttaccatggcaactcgtttgagcaaacataccgttgttatccagcatcgttttttgataagccacacctggaaggcggtgataaagtaataatgccaccttctgcccttgatcgtcttgcttccttgcacatcgagtaccctatgctatttgagctgcacaatgatgcaacccagcggatttcacactgtggtgttttggagtttgttgcagaagaaggcatgatcatcatgccctattggatgatgcaaaacatgctgcttcaagagggtgacactgtccatgtaaaaaatgcgactcttcccaagggcacatatgtgaaattgcaacctcacacaactgattttctggatatttcaaacccgaaagccatcttggaaaaaactttaagaaatttctcctgcttaaccacgggagacagcatcatggtagcctacaacaacaaacaatattatattgatattgttgaaacaaagcctgcttctgcggttagcattattgagacagactgtgaagtggactttgcgcctcctcttgattataaagaacctgagaaaccacgacaaccaacagttcctgcaagcaaggcacctgctgaagatggcaacactgcagtggaggatgaaccaaaattcaaaccatttactggttttggaaagcggttggatggaaaagcctcaaaactgcaagcatcagaggttccttccactgcactttctgcaccttcagattcaaacaaaagagcaaatcagcaaatctcagcacccgcagcttcaggagctagcaattacagtcgacagaaaactgggaaacttgtttttggttcaagtgcaagcaacaataaggaaccacaaaaggctcctgctaaagaggagcaacccgcaaagaaggacgacgagctgaggttccaagcgttcagcgggaagagctactcattgaaacgttagctgcttcagttaaccttcaaattcgccgctactctttcgtttcgtgcatggtgggtgttctggcacctggtcaccaccatgtagatatgaattgaagtatgtatatgcttatcttgatggaaacatgacagtctgtttatttaagcccaaaagtttaaaacagcgctattgttcttaaaaaaaaaaaaaaaaaaaaaacaaaaaaagcggcc

SEQ ID NO: 10613 - DNA, 1423 bp, Zea mays
acgaccgactccctcaattacctgcccgtcccaattgtttccgcaagtcgcccagaccagatttgccagaacgcaacctcggctccgaaaccctagccgcacgcagctgtccacttctactcccctcgcctcgccacacccgccgcgcggcacgatcagacgccatggccgccgagaactactggaggtacgctgatgcgcggcagcagcagcaggcgatggtggccgccgcggcggccgcagcggggatggctcccgcggcgaccgtcgccgcggcccagacggtcgggagtgcggcggcggctatgaaccagcaggctgccgccgccgccatggcgcagcaggccgccgctgcgccgcctctcaagcgcgcgcgccccgacttcggtgatgtgtctggtgggcaagacatgacaggatattatccacgtgaaactgacaggtcaggataccattccctcagagagaacgacacacttggggcatcttatgaccgttacttgcgcaatgggatggcctccgtcggtgcaaatgacacttctagggctgccgggatgggtgctggattggctgcagggatgactgcagggatgggtgctggaatggctgcagggatggctggctatggtgttgatggtcagcgtatgatgggtgttgttggtatggacagcagagggatgggatatggtggcagacctgagccacctcttccgcctgatgcatcaagcactctatatattgagggcttacctgcaaactgcacacgacgggaggtttcacatatatttcgcccatttgttggttttcgtgaagttcgtcttgtcaacaaggagtccagacatcctggtggagatccacatgtgttgtgtttcgtcgattttgacaaccctgctcaggctacaattgctctggaagcattacaaggttataagtttgacgaacacgagcgtgattcagcccatttgcgtctgcaattctcacgctttcccggtccaaggtcagctggtgggcctcgcggtaggcgttaagacgtgcggacctcgtggttgccgaacctatcgtttatacgagcgatccaactacggtgggctaacgcttcgatatgcgctgaatttcggggcggtggctttttagggttcgtcagctcatttcgtgaatgcgtgaaagggacaatgcaataagtgatattctgccatatgttattagatgccgtataatgtgttaggcatggaaagttattcgacatactgtatctgctgccttagctattgtggtctactgtaacttcattaccttgcttcacatccgagacaatttgagtttgttatcatgtggattatctgttttgaaaatgaaaactagatgatgttagcctattttagcaaaaaaaaaaaaaaaaacaaaaaaaaaaaaaaaaaaaaaa

SEQ ID NO: 10614 - DNA, 759 bp, Zea mays
agagatactataaactcatcaattctctaatcaagaaatagtttaacaataacaacggattttttttgacacgaataaccctccaaaaaaatctgtgtaaaaggtaacacggctacaaattacagtggcactctatatacacacacgtgacaagtcttcgctacttgtgcggtttcgagtttaggacagagctagagacgaggacatgctgcggcccttggacacggcgacgtagttgaacggcggcgccgagagccgcctcacgcccttgaagaactcgccgcactgtcccgagcccgccgccgaggaacgcggcctgatgagctcggttgcactcgcaccaccaccgctgctgctgctgctgccgctggtggtgccactgccaccggaggacgcgagcctgcccgcgtcaacccgtttccggttcactttgcagggctcggccgccctgccgaagctgctgccgggccgcttcaggtgcggcatcgcctccttctcgctcagcagggtgcgcagcttcttctgctccctgagtcgcctcctctcctcttcctgcctgagcctggcttgcttgtgctcctccaagacggcaaccaagcgagccccgtcgtacaggaacggcttctttctttcgctctcccatgcgagtgtacggctcatcaggctgtcaaccacggccggaatcttggtgatgataagcctcgctttctccgcgcgtttcaagttgaggcgtgcgatcctgccggtactgaatctgtt

SEQ ID NO: 10615 - DNA, 1446 bp, Zea mays
aattactgtgcctttatcttcaacccaaaccatccattaccatattcctaagctatcatggtgcaccggacttccatagccgatgtgcatgtgatgtgcatggatctaagcccaaagaaacccaacaaggccagcgccagcgacggcggagctactacgactggtcccccgccgatctgcccatgctcggcgttgcctccattggtgccgccaagctctgcctcaccgccggagtcttgccctacccagctactccgactctgccaagatcgcctacgtcctccaaggcaaaggtatattcggcgtggttctcccggaggcgaccaaggagaaggtcatctccgtcaaggaaggcgacgcgctggcgctccccttcggcgtcgtcacctggtggcacaacaacgccgacgccgctatctccgacctcgtggtgctcttcctcggcgacacctccacgggccacaagccgggccagttcacaaacttccagctcaccggctccacgggcatcttcacgggcttctccacagagttcgttgcccgcgcatgggacctcacccaggacgacgccgccaagctcgtctccacccagcccggatccggcattgtcagggtcaaggacgggcacaagatgcccgaggcgcgcgacgaggacaggcagggcctggtcctcaactgcctagaggcgccgcttgacgtcgacatcaagaacggagggcgcgtcgtggtcctcaacacccagaacctgccgctcgtcaaggaggtcgggctcggtgctgaccttgtcaggatcgacgcccactccatgtgctcgcccggcttctcctgcgactccgcctaccaggtcacctacatcgtgcgcggcagtggccgcgtccaggttgttgggatcgacggcacgcgagtgctcgagacccgcgccgagggaggctgcctcttcatcgtgccaaggttcttcgttgtctcaaagatcgccgacgaaaccggcatggagtggttctccatcatcaccacccccaacccaatctttagccacttggcgggccggacatcggtgtggaaggcaatatctccggcggtcttgcagtcgtcgttcaacaccacgccggagatggagaagctgttccgtagcaagaggcttgactcggagatcttctttgcgccttcaaactgattcattcgccggtggaaattggtccatccatctcgagtaaacttggtgtcctgggtgtgttctttagcagcttcagtttagaataatcaggttatgtcttcatcatcagttttttagatcgcttcatgtaataataaacttgagatggtacacatgtttcttaattagttctcttggtattttttaaaaaaaaaacaaaaaactcaatgcgcccatgaaacactgaatatagagcactatcaaattaataaataattagaattttctcactt

SEQ ID NO: 10616 - DNA, 1345 bp, Zea mays
ctgcagggtcgccagcactttggccccccccccccccccccccgcccgacgtttccgatcttgtttctctccttacgagtagcgaaatcttcgtacattctaaggtgtgggagtcatcggctgatgccttgcaactctagtctttcttcttcctcttcttcgtccaattgaccgttctatttttctgccggttggcaaatggcaatggcattggcattgccgaacgaatgacttttggttctttgtgatcgcgttcgatgctaacagatgcagatcttcgtgaagaccctcgccggcaagagcatcaccctggaggtggagagctcggacacggtcgagaacgtcaaggccaagatccaggacaaggagggcatccctccggaccagcagcgcctcatcttcgccggcaagcagctggacgacggccgcatcttggccgactacaacatccagaaggagtccacgctccacctcgtcctccgcctccgtggtggtggcggcggccagtgatctggtctgctgatcgcctcccgccatggggactggctagctcttgccgctgcctgccagtgcgtgctcgtttcgtctttcattacgtcatgtcttgctcaggccgtctcatgcatcttcatcagtctcttgtcttaggtcgtcgtttcttcttcacattggtaggaacgcacgttgtgcagtgctttggttaaaacaatttggagtaataaatctggcatattgttctactgtgttgtctgagccgtttcatctttttttcttcttcaaatatgtctgtcattgagaattttttttcctttttcacaaacgtgctatggtgcattttaaattataatcggaacgctgatcccggccctctaatgacgatcgcagcaactaaacaacagcaaactccgaacgctaaccacaacgactgatccatacaaaatcttatcttactgaatatcttgggttcggctatcctcgtcttattgtatgatatcttggattcaaaattggtctccgatgcggttcatttttgcagaaaatgaaaagtttaaaagcaaaaaaaaaagaggacgtcagttcgtatttactcgttattagtatctaacctcatataaaaacactcaaaacaaaatgaactttctcttgtgtaatcgtgtagttgacttgttctttggatctctgaacaatgaactaatgccgttgcatgcagcctctgatggcggcgtgcgggtccgtgcgataggattttctgttgtgatcagctggtgaacattagtagagcacgtgcccttcaatgggtaatcgacagaacgttgcatgcattccggtaacatgaaagcctgca

SEQ ID NO: 10617 - DNA, 534 bp, Zea mays
  misc_feature (484)..(484): n is a, c, g, or t
  misc_feature (496)..(498): n is a, c, g, or t
ccatcttccagaagccctcatctcccttaccgccactcccagccctgaggctgacaccctctcccatggagccttgagcgccagaaacagccctgtcatggtgccgcgccgcagcatgggcaacgctgctgtcgccaccgggagcggccggacggaggaagctttcgtcgttcggttggggcgttatcccggcgccataaccgtgcccctctgctcgactctttcgtccccgcgctcttctctcccaacttcggtcacgggtgtcggggtccagactgtgcactgcacgcgcgaggtttcgaggatctgaagaatcaccctggtatctggaatctcaagtgccaggagaagtacaggtggttcaaggaggagccacgcaacgaggagttcggattcgatctaggtggcgtctcccagttgactttctggcgccaaggacgatccttagttcgttttatatttatactttattttgtaagtcttncgctatgtaatnnnaactctgattatattgtggcaaaaaaaaaaaaaaaa

SEQ ID NO: 10618 - DNA, 2840 bp, Zea mays
  misc_feature (2800)..(2800): n is a, c, g, or t
ccggccgggcagtagtcagccctcgacctggaaggaccgcacacggctccgctgcttcgcgactcctctccggctctccgcacaggactccaaccgcctcgccgttgcatcgccgcgggcgtcaacctaggctgctgccggtaccggtgcgtccccagccatggctcggccgccgcaggaggcgatcgacaccttcgtcagcatcaccggcgccgacgaggtcaccgcagtccgcgtgctcgaggaacatggtcatgatctaaatgaagctgtgaatgcttattttaatgaaggagataggaccaccaccagaatcaatcagaatcctgtgcctgccactgccagttatgatgacatgatggagctggatgaaccacttgatcccatgttcaacagacctttgttccctagaactttgggcaacccttttgcccttttggatccaggttttgctgacataactgctggtgatatatttggacgtggaccccgagttacacaacctagggacgtgaggcagatacctattgaagttaaggacagcaatactcaaacaggcagttctggtcagggtcccattattgaggatgttactggacgtgaatctttctatggtccagaggtccatgggaccgttatagttgacgaagatgatgaagacttgccattaacactatctgctcaggatcctaagatcccaagcagtgctttgcacccaaaccatttcatgcctagtgcgcctccagtggttgatgttagtgaccataacaatgatatagaagaggagatgattaaggcagcaattgaagcttcaaaaagggaagctgacgggatgaaaaatgttctaagtagtggtcaatctgaaaacatgtcacgtggcagaggtgatcatgagcttgctcgggcggtttctttgtccttggaggtagccttttaacttctaagatgtagctatgtatttttgttcatatacctatacctgcaatgtgttttttatgtggctatcagacagcagagcgagagagagctctgcgccaagagggaatgtatgtagcagatcactctcctgacttatctgataaagaaggcggtcaaggaggaagtgggataagcgaaaggtgaagtcacatttccaaatgggtagaacagtggtagtgtgtggattattacttatttataatcaattaatggctcaatttctgttcccctatcatttgtttttttgtatggtttcatttgcatggaagccatgcatcgtgtgggatatgatattgtttccctgtttgtgtgggtcacttctcatgcaatgttttagcgagcttttcctaacctttgtaagtataatctgtgtctaattggaatatacttggtagcagctgattcctcatacatgtccattcttattgtaggcgaggactaactacaggagaagtgggaacttctgagcaaacagtagatgaagagaacttccaagaggacaatgaagatggtgaagaacaacctttagttaggactcgttctaggcgacttcgaggcagaactattgagccagcagaaactgttcaaagggctgacagcccgccctcaagtccccaacctcatgttcaaattggtcatcagcgtaatgtggggtttccttcagtagagtggggtggtatttcttctgaagagcgtgatgaagctcttatgcttgaggctgcaatgtttggtgggattcctgaaggagcaccatatccattttccttcccagcccatggcaggtcgactcactatcccctagtagcacgtcctccatcaccatcattaacggcacagcggttgttaagggagcagcaggatgatgagtatcttgctgctctccaagctgatcgagaaaaagagttgaaggctgtgcaggaggctgaacttcgcagggtagaggaagctgcagcaagagaggctgctcttgaacgtcaaaagaaagaagaggaggagaagctaaagaaacaacgtgaggaagaggagttggaatccaagcttgcagccaaacaagcatcactacctaaggagccactacaaaatgacgagggggctgtcacagtggtagtccgcatgcctgatggtagtcgtcgaggacggcgctttctcaaatctgacaggcttcagtatctttttgatttcatagacatcagccggactttcaaaccaggaacttatagactggcgaggtcttatcccaggcgtgccttcactgaattggagagccagatgtcactgagcgatctcggtctcactagcaagcaggaagctctgttcctagaaaaactgtctgcgtagagtacaaggttctggagttatggtcgagtagtatatgcacttataaaatcggtcatttagatcgtgcctggcgtgtgttcatgaaaatactgcagcggttgaatgattactgatctctagagatcccgtcgccatcttctgtgctctgaaacggaggtgtttcgatctgactgtgcagatgggcagttctacattcagatttcagaacaactgtagctcttgcggttttaagacttgagtatggtttactttggagatagtggtttagaccatccgtgttggtctcctgagcggtattcttacgtgatcacgtgtcaaaacgaacagaatcctttgttgcagtcattatagttaaccgtctcgctggaactcgcaaaaaaaaaaaaaaaaaaaactcgagggggggcccacttattttattattattatgctgatgatatagaccgcaagacagagtctgaatatcaaaagaagaagacgacgncgacgacaacgttggagctcgactgctctcactgtgaaat

SEQ ID NO: 10619 - DNA, 944 bp, Zea mays
ctgtgcggcgctcaggcggcgggttgaaaccctcccaatcccacactcgtcgtcccagtcccaccgaaccctactcaccaacaacagacccgcaggagaagggggaaagggggggaaattcctgtggagacgacttcgccgccatggcgggcgatcccccgacggccgcggagaaggagaccctggtctcctctttcctcgagatcgccgctggccagacccctgagactgccactcagttcctcctgatgacgagctggcacctggaggaggcgctgcagctgttctacatcgacggcgagtccgccctcaccgcggcgcatcctgtggccccgccgcccacgtcggcggccgcgtcggcgttggcggcagcggccggggcggaagaggcgatgaggttcgctccacccccggcggctgcactgggcgatgcaatgttgcatggatttggggtcggggaggacgacgacgtccgcgcgcctctgcctgtgaagagggagactctctacggcgagggcatcgtatccgtcatgcgacctaatgcatcagctgcatttcgtaactttgaacaagaagcaagacaatctgctgtttgggactctgaccagaatgctacatctagttctggtgataatcttgcttctttataccgtccacctttttctttgatgttcaacggaccctttgacaaggcaaagttagaggcttcttccctggacaaatggctattaatcaatttgcagtcgacagcggaatttagctctcacatgcttaatcgagacacttggggaaatgatgcggtggctcagttgattcggtcaaattttattttctggcaggtttattatgacacagtgaaaggggaggaaggtatgcacgtactaccatttggtggtcatgcctgctattctcctaattgaccccgtcactgggcaaaaatgcat

SEQ ID NO: 10620 - DNA, 1294 bp, Zea mays
tgttcaatgacttgtgcacataaactacctttgagctgaaactccaggagattcttaactattgctccggccgggccttgctgttgatcggtccccttgtcaaggcaaagttagaggcttcttccctggacaaatggctattaatcaatttgcagtcgacagcggaatttagctctcacatgcttaatcgagacacttggggaaatgatgcggtggctcagttgattcggtcaaattttattttctggcaggtttattatgacaccagtgaggggaggaaggtatgcacctactaccatttggtgtccatgcctgctattctcctaattgaccccgtcactgggcaaaaaatgcatgcttggaatggaatggttcacccagatcgtttacttgaggatttactaccttacctggataaaggtccgaaggagcaccatgcagctcaacctcaaaagcgcccaaggaaagttgatccggaagcttctacgggcaagcaaggcaaaatagctgtagaggatgaagatgaagagctagcacgggcagtagcagcttctctagaggagagtaaagaagtcattgaagcatcagacgccagtgatgacatggttgaagctgaacccgaggaggaaaatgagcccaccctaaacaccaagcctgattaccctcctctccctgaagaacctacaggaagcagggaccttctctgcagggttgcgattcggctaccgaacaaccggaggatccaaagaaacttccttcacacagatcctatcaagctcttgtggtcattctgcgctcctcaggtcgaggacggggagaggagggctttccacttcgtccaggcaattcctggggcatcccagaaactggagttgggaagcgacctaacattcaaggaagccgggctggccaactcgatgatcaacctcttgttggactgagccgcccgctctctcaacctgcactttgagatgagacgccgtcggccggtcgaggggtttgtatttcaggatgggcttgaagatgatggtgcgcttgggtatcttctttccttgaggattaactcttatcttttgctccactggagctaggagtccgaggacaaaccaaaaaaaaaagtctggtgtgccctgagctgtttgtgtgtggaaatggtccttttgtcgttcgttcttgtgtccgtatacatcctgtccccggtagggcttaactctatttaatgcacatatctatgaaagattcagtctggagcttgctttgatgctcccaaaaaaaaaaaaaacgtggcccccta

SEQ ID NO: 10621 - DNA, 5156 bp, Zea mays
  misc_feature (4760)..(4760): n is a, c, g, or t
ctgcagggttgcgattcggctaccgaacaaccggaggatccaaagaaacttccttcacacagatcctatcaaggttacacctccgtcacatataaaattttcttttcgtggtcccattttcttggctcccatcctcactggtgcttccttctctcggatcctatcaagctcttgtggtcattctgcgctcctcaggtcgaggacggggagaggagggctttccacttcgtccaggcaattcctggggcatcccagaaactggagttgggaagcgacctaacattcaaggaagccgggctggccaactcgatgatcaacctcttgttggactgagccgcccgctctctcaacctgcactttgagatgagacgccgtcggccggtcgaggggtttgtatttcaggatgggcttgaagatgatggtgcgcttgggtatcttctttccttgaggattaactcttatcttttgctccactggagctaggagtccgaggacaaaccaaaaaaaaaagtctggtgtgccctgagctgtttgtgtgtggaaatggtccttttgtcgttcgttcttgtgtccgtatacatcctgtccccggtagggcttaactctatttaatgcacatatctatgaaagattcagtctggagcttgctttgatgctcccctctgggctctggtcgtgtcaaatgctggaagagatgcatgcatgcatgcgggcagcccctaccggattcacagctccatgtgactgccgaaagctgatatgcttttcctcagtcgcggtcaaggagcaaaccgatgtgagctttgcatcatgccgaatcgttcagttccgttccatccatttccgagcgctccacaagctctgctaagtggtccgaggaacacgacgggggcctggcctagcactactgtactgtactgtaccccctgttgcggcacgttgctgaactcgctcccctggactggatgagcagcaactgtagcggctggacctggatccggctcccatcgagccatgaatgtccagacctgggcctttgtgtgctccaacctcacacggcggccgctgaaacctgcgtgactgcctgcacaggacagcgtgcagatgctccggtccggagtcagtgcaggagcacgcgggacttggagcgttgccgggcgatccgcgacttgcaagaccctacacctcccgtactaatactagcatggtgtggcactggcaggtaagaacagccatgaatgggaggcacacacaagtgagggaggggcttgtgtggtgtggtgctggaactccacgcaggctgcctcagctatctgtctctctttctgtgactgcctatgctgtgcgtgttaaattactacctcacctcctctgccgttggagagtggagagagagtggtgctgagctagcgtgtggggttacgcttacgacggcctgccttgaaggctgccgcaggctaggcttcctgtgtggaagggggggagttttgaccgcccacgtttgactgccccgcgtgggcccgccgcttatgatttgcctctgccccgcgtgggcccgccgctcgcaaactcacgcgctaccgggggcagccggcagccccagaggcccgcagcggctggctggactggacccgaattattgcaccccgacgcagaggctgccatcgtgtgatccctccctccctctctctctctctctctctccaaattgctgacggaggttggtttgcccgtgctcggcggagaaagaaagagagagccggcaccggagctggagctagcggccgacgagcactgttccacggcgcagcacacctccgtacgtgggccggcgtcccatcgtgctctgaactgaactctctgacaggcagcctgaggttattattggcatcctccagtgccactccacatgtgcacgctgagcgccctcctgcgtctgcatcgcatgtaacacaacgacgagacgacgcaacctctgcttctgcgatagcagcggagagtggacactgtagcagcctagctagtaggggtaggggggctggactggactggaagcactggaccacgcactctcctctctacctccagcaaagtagtattgggcattttggccgggctcgtgcacggagcacagcgacccaccaagtgctgcgttttttggccgcatctctgggccgtccaacggaacacaacacaagtacgggaacgggacggggatgcttgcgttgcattgcatggggacgacgaggacgaggatccatccgcgtgcgcgcgtgcgtgcgtggaggatcgtgccttttttacagcttgcattgtattggcgtgcatgcatgcgccgggccggggcgggcgggatctgcactgcgctgcgctgcgctgcttgcatgccgcgcctagtactagctttttacagagccggccggccggctggccggtggctgcccctgcccctcggtgactagtggtagtgggtgcgtagtggagctagcatccaatgctcagggctagccgctgctcccaccagcactccagctcaagcaccaccagtacccgtactaccacaccacggctagtggaggtgtagctgtagagagtacagactagagaccaaggcgttgcacttgtacatagacctgatcatgtgccactcaatctagtccacacaaaaaaaatctaactcgaccagaccaatacaacaaacagttacaatccatagtttttaactcgcaataatctacgcctgaccattttttttgtcttttttaactactagagtaagataaatttgactatgaaattttgtatatagatgagttaagctgagatgtacattcatgtttttaagaatttttattctgaaatttttaaaactcaaatagatcgaaccaatttctagtgacattgaagagatcagtatagattttgggggtatatattttgatgacattggagggatttgctttaaatataactaacgacgttagcttcaaaatatcagtgatggcattcaaagaattaaaatttaaattcgattgcattgaagggaagctataaatcctgatggcattgaagggattggtataaatttggatgacattgaaggaattttctctagatttttccccgattccgctgtgatgacatacgatgatgatattgagctcagcaggatcgagtacaaagttttgtgtgcacacgtacgcgcgcgtgcgtgtatactatgagtttgcatacgatagctagtggggtaaatactctgctgcctgcctcaagaccatatatatagaaatgattggcagcagtagacgacagtagtggtatactaccagttttcttcttcttcttccagctgagctaagaaggggcactgcatgcatgccgacagagaaaaaaaaaaagctaccagcaacgactacggggcggcaacaatctcttgactccttctcaaagcctgccctgaactactgatgaactagcgatcgagagtgacacggtccatgcatgctactatatatctgccgctgctgtgccacaatgctacatacaagctgcagtaggagttcacgctcgacgcagcgagtgaagggttggttggttgtttcaaggcttcaagatgtggcgtggtgtgtcgtacagccgtacagggactgggggtgacggagacggcaggggtattttgggtagagatggaggtaaagaatggaatggtggtggctgcctggctgggaggaagtatgtagtatagcgttagcatctgatctgatctgatatcgcattgctgtctctctctctctctccaatccggtcaagccacttttgactacggacggacctgagagcggtggcagccgagaggcagagagagaggggggtgtcagtcttttctgacaccaagaggacagatccatacgctcgccaccgactgtgtcctgtccaccccaccgcgggttacggttacgggtagacgtatataaggtacaaaatttttattgtacgtactaacaagtatcagtatgataggtaacgaatatctttaatatcaacactgaaatatgtactttcataatgatgattatatttactgatgtgagtattgataataccttttatgaatcttgctaatttttttggggacgtaataagcgaccaaagtaaaaataggcactattatatcaaaacaagctcaccgatctcctgtaaacataggcactattatatttacggaccgagtgccttttgttatctacttgatactatcaaccttctctcctgtaactctcatctcatcgagagtcgacaccggtcactggtctttgaaatccaattaactatccagtcagcgggcgcggaaagacaagtctgtccctagacacgacacgagacagagagcgcagagagagcaaggaagggtagtgcgagaggccggatcgggacaaagtgcccaccgggtcgggtctctggtccagtccagcgagatgatggccgcaagccgacaaggcagcggtccacccgagccaagcccccttctctcacctcccccatggccatgtatactcgttcgcagtcgcagtacagtagcagcagagtccattgaccacgctacggcccacgtagccccgctagatcccctgctgccagtgcccgccgagggcagtctcgtcattgcgccgcgcgcccggatgcggtaaaacttttgctcgcctgcgtacgtgtattccttccacactgccgcgattatctacgctacgcccaaggcctancgcctagctggcctgggagaagatgagagctcatctcatgcatgcagccagtctcagcgaaccagaggggcccgctgcgagcgtgatcctctggcagagccaagccaactggccgaatgtgtgtttggaaaatggaaatgataattatatctatcaccactctcctcgtttcgaaatggtaagtatgttttgattggggtcaaaccaaagtgatcagagcacattttgaccattaactaaagattcaatattaatttatctctgagaagctatctgaaatagatagaaatccttcgtgtccagataaactctttatacgatttgattaatcgttgccttgtacgtaagagcctgtagtattcttcactatagaaaatgcagccacaaattaaatcg

SEQ ID NO: 10622 - DNA, 1574 bp, Zea mays
aactataagtgccgcgagccaccaccggcccggaccccttcgccccgtatcgttcccttcctcctctcttttccccaccgccccctttcttggcgtctacccggcgcgaccaggaccgaatcctaaggccgccggccgccgccgccgccgcctactcccgttggacacgagtttggagtaaagaaaccaaccctgcatctgtattctgtctgtctgtgctgctttgctttggattccagaacaaaattcgaataagccttgcatctcgctgacttgggatataactatgccgaaggacaggagctcccgcgtttcctcttacgagagccgccgggctggtgcctccccatacttctcatcgtctcatggacagagcagttcttctcgccggtcagaggagtcttgtgtggcagcagcggcggcagcagcaaagcaagctgcagagtgggaggatgttcggtgcccggtgtgcatggaccacccgcacaacgccgtcctgctggtctgctcctcacacgagaagggctgccgccccttcatgtgcgacaccagctcgcggcactcgaactgctatgaccagtaccggaaggcatccaaggattcaaggacagagtgcagcgagtgccagcagcaggttcagctctcgtgcccactgtgccgtgggccggtcagcgattgcatcaaggactacagcgcgcggaggttcatgaacaccaaggtccggtcgtgcaccacggagtcgtgcgagttcaggggcgcctaccaggagctgaggaagcatgctagggtggagcgtccctcggggccggccgggggggtagtccctgagcggcagcgggactggcgccggatggagcagcaacgggaccttggggacttgatgagcatgctgcgttcagggttcaccagcaatattgaggacgacagtggcgggcttggagacaccgaagaagggggagaggaagctgaaatgactccggcctccataaccatggtcttcatcatgccatctagaggctcaatcatgcagtacctatcggaacgcagcagaacgatcattctggtcagtcggaggcgagcaagcagcagcagcggtggcgacgctgaagccactgctccagacagcgaggaaggtgatgaccctatgccatcggcagaggcatctgctggttcacagcgttcttccgaacaagaggaggctgacggtgaccctgcccaatgacgtaagtcagctggcaagaggtgtgccatggcatcttcttggcctgaagatcccgaccaacatggcaacatggtatgtggcgaagaaaaacatggatgcaggtgccaccaaggcgtagccaggataatctgtctacgcagaaaaatcaaggggaatcagcatcgcgcgaaggcttcagaaacgtgttggcctctagtaccaattctaatgtatccgcggggttctgaagcaatggagagaaaacaattgggtggttgtagctatcttgtctgaatggatttcattttccttgcattgtaattctctaatatatattatcatatgaaatagattcggccgtctttgcactgtg

SEQ ID NO: 10623 - DNA, 3563 bp, Zea mays
  misc_feature (386)..(386): n is a, c, g, or t
ctatctaaactactcagtaaattactaactagattgcaaactaacaaacaagtttgctacccgtaactagcaagtttctaactaaataatgttcctaactaaattactcccaaatctatacctatgggattaaaatcttcctatatcctagctttagggctagtttaggaaccacaattttccaatgaattcttatttcccaaggaaaattagttcatttcctcttggaaaaataaaaatcccttggaaaaacatagttctcaaactagcttttaggaaaataaaaatcccgtgaaaaaataagatttgacaattccatttttccaaaaaaataatctattttttttttgaaaaatagaaatctctcaataaaatagggatatcanactagcagtaacagggaattcccatattatattatcgggtatggggtccattaacgcctctctagacatgttagcgctagcggtagtatattgctggtagagaggtagagtttgctggcgcccaggacgaggtagaaaagttcaaacaagcaggagcatctgaatgcctgccactagagccgtgcacccagacccagcgctcgtaaatgcatgcacatctcgtgtccaagaaaaaagtaccgagtactccatacagtagtgccactggtttcccgggcccactagaaattattcgccgcccacttatttccaacgcgcattcccccacgccgcgcgtaggtaccccgtacccccggcccccaagccacccacagccttttgtccaccgtatgtgaatccgggcctgcataagaacatcacgggcccacctgccattgccaattcgatactttccagtcctgcgcttgggacgcatagccagcgcacgccccccagctttactttaccgttccttccgatcgctgcaggggaggcaggtcgcactcacatcaaggccgctgatgtggtacaccccgtccagtcctaccgtacctcccctgctcccccgtcggtcggtcacctcactcgttcacccatcgcgctcttcatgattcagacggacgcccatttccggggcccacccgtcatgctgttagccacgcggacgcgggcccgcctcaccacccaaccggcgacggacgaggacgccgacaggtggggcctggatcaccggcacacggtgaggtcggttcacgcgaggcggcgcggtcgccgacatggacggcgcggagccgagccgggcccgggagccagctagaagagagactagagagagagtggggagccctagccaaccacgtcatcgtccatgtcccgcccaactataaaagtggagcgagccaccacccaaccagaccccttcgccccgtatcgttcccttcctcctctcttttccccaccgccccctttcttggcgtctacccggcgcgaccaggaccgaatcctaaggccgccggccgccgccgccgccgccgcctgctcccgttggacacggtaaaacctcctccctcctcgtccgtgtcgccggggtccggggtccaagcggctgcgcgcgcggtctcgccgccggcgccgatctgggcgccgccggcgttgaccctgtccgattcgccccgggctgcgagacctctgcctccctgaccggttactcggaacttctactcgcctgtgggatcctccagcggatcagatgagcacatcgacttgagcaccacgctttttggttggaaggcgaatcgtagagctttcctgggtttctctgagggctcttctcagatgtggcgtcctccagagtctaccacatactgtttgaggagtcctggttcttttcggaatccggactaaccaagggctcctactgtgcacgactgcttgacaggatatttcggattattattatgtgcgtgcgagcgcgcgtgtgcgccttctagagagtttggagtaaagaaaccaaccctgcatctgtattctgtctgtctgtgctgcttcgaataagccttgcatctcgctgacttgggatataactatgccgaaggacaggagctcccgcgtttcctcttatgagagccgccgggctggtgcctccccatacttctcatcgtctcatggacagagcagttcttgtcgccggtccgaggagtcttgtggggcagcagcggcggcagcagcaaagcaagctgcagagtgggaggatgttcggtgcccggtgtgcatggaccacccgcacaacgccgtcctgctggtctgctcctcacacgagaagggctgccgccccttcatgtgcgacaccagctcgcggcactcgaactgctatgaccagtaccggaaggcctccaaggattcaaggacagagtgcagcgagtgccagcagcaggttcagctctcgtgcccactgtgccgtgggccggtcagcgattgcatcaaggactacagcgcgcggaggttcatgaacaccaaggtccggtcgtgcaccacggagtcgtgcgagttcaggggcgcctaccaggagctgaggaagcatgctagggtggagcatccaacaggaaggccaatggaggtagaccctgagcggcagcgggactggcgccggatggagcagcaacgggaccttggagacttgatgagcatgctgcgttcagggttcaacagcaatattgaggacgacagtggcgggcttggagacaccgaagaagggggagaggaagctgaaatgactccggcctccataaccatggtcttcatcatgccatctagaggctcaatcatgcagtacctatcggaacgcagcagaacgatcattctggtcagtcggaggcgagcaagcagcagcagcggtggcgacgctgaagccactgctccagacagcgaggaaggtgatgaccctatgccatcggcagaggcatctgctggttcacagcattcttccgaacaagaggaggctgacggtgaccctgcccaatgacgtaagtcagctggcaagaggtgtgccatggcatcttcttagcctgaagatcccgaccaacatggcaacatggtatgtggcgaagaaaaacatggatgcaggtgccaccaaggcgtagccaggacaatctgtctacgcaggaaaatcgaggggaatcagcatcgcgcgaaggcttcagaaacgtggtggcctctagtaccaattctaatgtttccgcggggttctgtggcaatggagagagagaaacaattgggtggtagctatcttgtctgaatggatttcattttccttgcattgtaattctctaatatatattatcatatgaaatagattcggccgtatttgcactgcgtgatggcggccctataagagttagtttgggagccagaaaattaaaggagattaaagggctaaagtcctcttatttaaaaatatccctttcttcctgtttctggcttctaaaactagagcttgtttgaaagcaagtgtaatagatgcgattgaggggttaaaatcttttactatttaaattttgactagtaaaagattttggtcctcaatcctctctattacccttgtttctgaatgaggcctaaatctatactacctattaagac

SEQ ID NO: 10624 - DNA, 1569 bp, Zea mays
cattgggtacctcgaggccggccggggaccccttcgccccgtatcgttcccttcctcctctcttttccccaccgccccctttcttggcgtctacccggcgcgaccaggaccgaatcctaaggccgccggccgccgccgccgccgcctgctcccgttggacacgagtttggagtaaagaaaccaaccctgcatctgtattctgtctgtctgtgctgcttcgaataagccttgcatctcgctgacttgggatataactatgccgaaggacaggagctcccgcgtttcctcttatgagagccgccgggctggtgcctccccatacttctcatcgtctcatggacagagcagttcttgtcgccggtccgaggagtcttgtggggcagcagcggcggcagcagcaaagcaagctgcagagtgggaggatgttcggtgcccggtgtgcatggaccacccgcacaacgccgtcctgctggtctgctcctcacacgagaagggctgccgccccttcatgtgcgacaccagctcgcggcactcgaactgctatgaccagtaccggaaggcctccaaggattcaaggacagagtgcagcgagtgccagcagcaggttcagctctcgtgcccactgtgccgtgggccggtcagcgattgcatcaaggactacagcgcgcggaggttcatgaacaccaaggtccggtcgtgcaccacggagtcgtgcgagttcaggggcgcctaccaggagctgaggaagcatgctagggtggagcatccaacaggaaggccaatggaggtagaccctgagcggcagcgggactggcgccggatggagcagcaacgggaccttggagacttgatgagcatgctgcgttcagggttcaacagcaatattgaggacgacagtggcgggcttggagacaccgaagaagggggagaggaagctgaaatgactccggcctccataaccatggtcttcatcatgccatctagaggctcaatcatgcagtacctatcggaacgcagcagaacgatcattctggtcagtcggaggcgagcaagcagcagcagcggtggcgacgctgaagccactgctccagacagcgaggaaggtgatgaccctatgccatcggcagaggcatctgctggttcacagcattcttccgaacaagaggaggctgacggtgaccctgcccaatgacgtaagtcagctggcaagaggtgtgccatggcatcttcttagcctgaagatcccgaccaacatggcaacatggtatgtggcgaagaaaaacatggatgcaggtgccaccaaggcgtagccaggacaatctgtctacgcaggaaaatcgaggggaatcagcatcgcgcgaaggcttcagaaacgtggtggcctctagtaccaattctaatgtttccgcggggttctgtggcaatggagagagagaaacaattgggtggtagctatcttgtctgaatggatttcattttccttgcattgtaattctctaatatatattatcatatgaaatagattcggccgtatttgcactgcgaaaaaaaaaaaaaaaaaaagcggcc

SEQ ID NO: 10625 - DNA, 1465 bp, Zea mays
  misc_feature (633)..(633): n is a, c, g, or t
  misc_feature (780)..(782): n is a, c, g, or t
gaccccttcgccccgtatcgttccctcctcctctcttttccccaccgccccctttcttggcgtctacccggcgcgaccaggaccgaatcctaaggccgccggccgccggccgccggccgccgccgccacctgctcccgttggacacgagtttggagtaaagaaaccaaccctgcatctgtattctgtctgtctgtgctttggattccagaacaaaattcgaataagccttgcatctcgctgacttgggatataactatgccgaaggacaggagctcccgcgtttcctcttacgagagccgccgggctggtgcctccccatacttctcatcgtcgcatggacagagcagttcttctcgccggtcagaggagtcttgtgtggcagcagcggcggcagcagcaaagcaagctgcagagtgggaggatgttcggtgcccggtgtgcatggaccacccgcacaacgccgtcctgctggtctgctcctcacacgagaagggctgccgccccttcatgtgcgacaccagctcgcggcactcgaactgctatgaccagtaccggaaggcctccaaggattcaaggacagagtgcagcgagtgccagcagcaggttcagctctcgtgcccactgtgccgtgngccggtcagcgattgcatcaaggactacagcgcgcggaggttcatgaacaccaaggtccgggtcgtgcaccacggagtcgtgcgagttcaggggcgcctaccaggagctgaggaagcatgctagggtggagcacccagcaggcgagnnncgatggaggtagaccctgaacggcagcgggattggcgccggatggagcagcagcgggaccttggagacttgatgagcatgctgcgttcagggttcaacgccaacgttgaggacaacagcggcgaacttggagccaccgaagaaggggaagaggaagccgcaaggactccggcctccataacaatggtcttcatcatgccctctagaggctcaatcatgcagtacttaacagaacgtagcagggcgatcattctggtcagccggaggcgagcaagcagtggcagtggtgatgctgaggccacagcaccagacagcgaggaaggtgatgaccctatgttgccatcggcagaggcgtctgctggttcgcagcgctcttccgaagaagaggctgacggtgaccacgcccaatgacagaaatcaactggcaggaggtgtgccatggcatcttattggcctgaagatcccgacctgcttggtatgtgatgctgtgtgctggggaagaaaacatggatgcaggtgccatcaagcaatggagagggaaaaaaaacaattgagtggttgcatctatcttgtctgaatggatttctttttccatgcgttgtaattctctcatatattatcatctgaaatagattcgaacgtatttgcactgcataatataatctttatatggcggctaaaaaa

SEQ ID NO: 10626 - DNA, 1455 bp, Zea mays
acctcgaggccggccgggaccccttcgtcccgcatcgtttcctcctccttttccccgttcgtcccctggattggcgtctacccggcgcgacccggaccgaatcctaagtccgcctgccgccgccgccgtctcccgttggaaacgagtttggagtaaagaaaccgaccttgcatctgtgttctgtctgtctatgctgctttgctttggattcacaaaaaataagccttgcatctcactgacttgagataactatgcctaaggacaggagctcccgcgtttcctctcacgagagccgccgggctcgtgcctccccatacttgtcagcgtctcatggacagagcagttcttcacgccggtcacaagagtctcctgcggccgcggcagcgaagcaagctgcagagtgggaggatgttcggtgctcggtctgcatggaccacccgcacaacgctgtcctgctggtctgctcgtcgcacgagaagggctgccgccccttcatgtgcgacaccagctcgcggcactccaattgctatgaccagtaccggaaggcctccaaggactcctccaaggattcagggacagagtgcagcgagtgccagcagcaggtccagctctcgtgcccgctgtgccgtgggccagtcagcgactgcatcaaggactacgacgcacggaggtacatgaacaccaaggtccggtcctgcaccatggagtcgtgcgagttcaggggtgcctaccaggagctgaggaagcatgctagggtggagcacccagcggcgaggccgatggaggtagaccctgaacggcagcgggattggcgccggatggagcagcagcgggaccttggagacttgatgagcatgctgcgttcagggttcaacgccaacgttgaggacaacagcggcgaacttggagccaccgaagaaggggaagaggaagccgcaaggactccggcctccataacaatggtcttcatcatgccgtctagaggctcaatcatgcagtacttaacagaacgtagcagggcgatcattctggtcagccggaggcgagcaagcagtggcagtggtgatgctgaggccacagcaccagacagcgaggaaggtgatgaccctatgttgccatcggcagaggcgtctgctggttcgcagcgttcttccgaagaagaggctgacggtgaccacgcccaatgacagaagtcagctagcaggaggtgtgccatggcccatggcatcttcttggcctgaagatcccgacctgcttggtatgtgatgctgtatgctgggaagaaaacatggatgcaggtgccatcaagcaatggaaaggaaaaaaaaacaattgagtggttgcatctatcttgtctgaatggatttctttttccatgcgttgtaattctctctcatatattatcatatgaaatagattcggccgtatttgcactgcataatataaaaaaaaaaa

SEQ ID NO: 10627 - DNA, 1667 bp, Zea mays
  misc_feature (1581)..(1581): n is a, c, g, or t
cgacctgcaggggaggcaggtcgcactcacatcaaggccgctgatgtggtacaccccgtccagtcctaccgtacctcccctgctcccccgtcggtcggtcacctcactcgttcacccatcgcgctcttcatgattcagacggacgcccatttccggggcccacccgtcatgctgttagccacgcggacgcgggcccgcctcaccacccaaccggcgacggacgaggacgccgacaggtggggcctggatcaccggcacacggtgaggtcggttcacgcgaggcggcgcggtcgccgacatggacggcgcggagccgagccgggcccgggagccagctagaagagagactagagagagagtggggagccctagccaaccacgtcatcgtccatgtcccgcccaactataaaagtggggcccgccaccccggccggggaccccttcgccccgtatcgttcccttcctcctctcttttccccaccgccccctttcttggcgtctacccggcgcgaccaggaccgaatcctaaggccgccggccgccgccgccgccgcctactcccgttggacacggtaaaacctcctccctcctcgtccgtgtcgccggggtccggggtccaagcggctgcgcgcgcggtctcgccgccggcgccgatctgggcgccgccggcgttgaccccgtccgattcgccccgggctgcgagacctgtgcctccgtgaccggttactcggaacttctactcgcctgtgggatcctccagcggatcagatgagcacatcgacttgagcaccacgctttttggttggaaggcgaatcgtagagctttcctgggtttctctgagggctcttctcagatgtggcgtcctccagagtctaccacatactgtttgaggagtcctggttcttttcggaatccggactaaccaagggctcctactgtgcacgactgcttgacaggatatttcggattattattatgtgcgtgcgagcgcgcgtgtgcgccttctagaggcatgattcttaaatcagagccttcgtgtttaaatccgagtttgccttcgtgttgaactatgagtgaatttcattttctgcgggagttgaagtcgatttagatcaggacagtgtttcttgcgatctgattaagcctttttttttcttgctattgtgatttcttttttcagagtttggagtaaagaaaccaaccctgcatctgtattctgtctgtctgtgctgcttcgaataagccttgcatctcgctgacttgggatataactatgccgaaggacaggagctcccgcgtttcctcttatgagagccgccgggctggtgcctccccatacttctcatcgtctcatggacagagcagttcttgtcgccggtccgaggagtcttgtggggcagcagcggcggcagcagcaaagcaagctgcaggctggcaggatgttcggtgcccggtgtgcatggaccacccgcacaacgccgtcctgctggtctgctcctcacacgagaagggctgccgccccttcatgtgcgacaccagctcgcggcactcgaactgctatgaccagtaccggaagcctncaaggattcaaggacagagtgcagcgagtgccagcagcaggttcagctctcgtgcccactgtgccgtgggccggtcagcgattgca

SEQ ID NO: 10628 - DNA, 1242 bp, Zea mays
actagagcggagtaagaggccgcttctcttgtttgcttgttcaatattatttctttatttttccggtcaattgtccatgtaacaagggatgtaccatggttcacttttgacataatatcatctttgtataattgtttcgctgggtctgaataagcaaacgggctaaaaccgatcatgtcatgtggagcaactgcttgaagttgatgggcgtagtgtattgggccggcccatcgcagaaagcctgggctctgagcgccgcggcccgctcagaagggtgcacgctgtcccagaagtagtaaaggccgcggtcggcgcagagcgtcgcgttcggcgcgcagggcgcctcggcgccgagccggccgccgccgcagcacgcgttggcgacgtccgtgaaccccgacgccagcgggtgggcgaaggtgtccgccatgaggccgagcgagtcggccagggagtaggagaggccgggcagcccggacctagaggagggggacgcgaggccggcgagcagggagcgcagcgcggcgttgaagccggcggcgagccggttccggtcctcggcgcacgcgcccgtggcgtccagcacccgcgccacgggcaggcaccctgcgagccccacgttgacgacggccagcctccgcacgcccagcgcgtgcaggcccctgatggcggccgagtagttggagacgaggccgccgtagaaggcggccgcgtcgtggctctccaggtcggcgccggacctgttccgcgcccgctccgcgttcgcgaatgcggacaggtcgttgccgccgacgaggatgaggacgaaggaccggttgatcagggcgtccaccgcgtcggaggagcccgccgcggcgatcatctccgacctcgtggcgttgaagtactgcacctgcttcgatagcgggatcgtgttgccggcgttctgcatcacgcacgcacgcacgcttccttgtcaaagtttgctatatatggatgctagtacgcacacgtcggagcagacgtaacgaacagtacttataccgtggagtcgaggatgccagctcctccggaagcatagctgacgccgatagtgagagccgtcggaaccagaaggccgccgccgcagcttgctgctcccagcagcgacaggtacggcggagggctgctcacgaaccctatgcactttgctgcaatgcaagtatgcaacgtacttactatacaaagttatgcatatatactactctaggtattctgttgagc

SEQ ID NO: 10629 - DNA, 862 bp, Zea mays
  misc_feature (30)..(30): n is a, c, g, or t
gggtaccgggcccccccctcgaggttcggncgggatgagctgtttttttttttttttgagaactgagaagtcacaactgaatgtcatttcaagttcctacatgaccagaaatccatagtaccagaattcattacataaccaaatgaaatgcatagtgacatgagatccaaaagcacacgccgcacaccaatcacaagttcattacaagttacaactgacaaatggcatgagaaccaaaatgatgcaggatgctagtcaattgttcttgtacttgacttgtccttgcaagttgcagccaaaaggtgaacatcatctgaactcttgagcccaaagtgaaagtcatattgtaagttcctgaagaccctcttgcatgtcttggagacaagaccaaaatgtggcaggctgtttagttttgtcatcaaccaagaggtgatcgccgagtgttacggttggcagctgcaggaacaggcagagacacagggggcgctggttcttgggtgatgcagcagtggcagtagtaggcttctggcgtgagacacagaccttacgcctggacaagccggcgacgatgataccgtcttcgttgggagcgccagagatcagcgccattgccggagcaagctgcaaagcgagggcgcaaagctgcttgcgtgcgtgggggcggccggcggcgttgcttgcgcgctgcgcgcagcggcgcaggcggcaggcgcggcgcagagtgcaggtggcggtcgacgggcactgtggcgctggcgcagtggcggcctccacaactggaggggacgaggggtcctgaggactgaggactgaggagttttcgattaggatgttgtttaaacacaataaagttggaacgtga

SEQ ID NO: 10630 - DNA, 642 bp, Zea mays
  misc_feature (26)..(27): n is a, c, g, or t
ttttttttttttttttgcagaccctnnagcatcattccactaattctgagaactgagaagtcacaactgaatgtcatttcaagttcctacatgaccagaaatccatagtaccagaattcattacataaccaaatgaaatgcatagtgacatgagatccaaaagcacacgccgcacaccaatcacaagttcattacaagttacaactgacaaatggcatgagaaccaaaatgatgcaggatgctagtcaattgttcttgtacttgacttgtccttgcaagttgcagccaaaaggtgaacatcatctgaactcttgagcccaaagtgaaagtcatattgtaagttcctgaagaccctcttgcatgtcttggagacaagaccaaaatgtggcaggttgtttagttttgtcatcaactatacagaacataaataaattagcttacagctgcaaaagaaataaaatgcaaaagaaacaaatgttagatatacatttgtatttgtttctaagccaatcttgagagcacatgagagcctctaacatctttgaagtcagcctgctgcgatgctcactaagaactcgaccacctgtgctaaaagcagattctgaagctactgtggtaactgggatagcatatatgtccctt

SEQ ID NO: 10631 - DNA, 1555 bp, Zea mays
accgagcccctacgttccaagtccaaccaacccattccccaattcagtatcaggcctttgcgaattgcgacagcgagagcgggaagaggaaactcgaaactcggcgagcgggatggcaaccggcccggagcacgtggcggcggcggtcgaggagacgccggagaagaaggcggccagcacaaccgagctccccgcaccctcaggctggacgaagaaggttgctccaactcgaggtggacgatttgaggttatttttgtttccccaactggtgaggaagttaagagcaagagacagctaacccagtacctgaaagctcatcctggaggccctgcatcctcagagttcgattggggaaccagtgatactcccagacgctcagcacgcttgagcgagaaggtcaaggcaactgagagcccagagggtgagaagacccctaaacggggaagatcaagttctaagagaggcaaaaaggaggaaaaagaagacacagaggctgcaaatgaggctggagaagatggtgcttcggaggaaggtaaaggtacagatgtggagatgaaagatgctgaaaacgctgaagacgagaagaaagaggtcccaaatgcagatgctgcagagaagactgaggaaggtgaagataagaaagaggaggcccctgctgtagatgcagcagagaagactgaggaaggtgaagataagagagaggaggaggcccctgctgtagatgcagcagagaagactggtgagaaagaggtggcccctgctgtagatgcaacagaggagacagaagaaagcaccgaaggccaagcacagcctaattatgttgctgccccagaatctgagtataaaggagacggaaagccaggtgaatccgaagcagctccccttgcatttgttgatgaaacagctccccatgtaattattggtgaagagaagaaagaggaaaatactgagaatgagaacagtcaggcagccgaatctgccgtgccttccctggcatctttagagggagagaagaaagagaatggtggtgcccctgaacaaccagccctgcctgtagctgagacgaaggcagatgctcctccggcagaggcagaaaagggggctgaaaattcaggccagccgaataccggctctcaagaaccgaaggcagcaaactgcgacgaggggcagattcaacctggtgcctctgctgtgaggtgcacataagggagcttgatctcagatgggactctgttgcgttatgtctttaggacgatacctcgcatttgctttgagaattgtaatcgtggttaacctgacagcgctgtgtagcactaggctgcccagcacgtagttatcctttcgtttcttttataacggtggtgttgcagcatgggtaatgggccggcctgtgctgcctcagccaccactgcatacccagtgtaagtgtaactcgttattagcgtggtcgacattgatctgtggagaggactgcaggacagtactgtccttgacagctgtaacgttacgttttgtgtgttcccttgtgttattgaaccaaaaaaaaaaaaaaaa

SEQ ID NO: 10632 - DNA, 2758 bp, Zea mays
accgagcccctacgttccaagtccaaccaacccattccccaattcagtatcaggcctttgcgaattgcgacagcgagagcgggaagaggaaactcgaaactcggcgagcgggatggcaaccggcccggagcacgtggcggcggcggtcgaggagacgccggagaagaaggcggccagcacaaccgagctccccgcaccctcaggctggacgaagaaggttgctccaactcgaggtcgacgatttgaggttatttttgtttccccaactggtgaggaagttaagagcaagagacagctaacccagtacctgaaagctcatcctggaggccctgcatcctcagagttcgattggggaaccagtaggcatctagtttcatcatttttttgtcatctcttcttagttctcgtttggtactagtaggtttcccaatattcaatgtcttgctgctgcctctaaaaagcttgtaagcaggtgatactcccagacgctcagcacgcttgagcgagaaggtcaaggcaactgagagcccagagggtgagaagacccctaaacggggaagatcaagttctaagagaggcaaaaaggaggaaaaagaagacacagaggctgcaaatgaggctggagaagatggtgcttcggaggaaggtaaaggtacagatgtggagatgaaagatgctgaaaacgctgaagacgagaagaaagaggtcccaaatgcagatgctgcagagaagactgaggaaggtgaagataagaaagaggaggcccctgctgtagatgcagcagagaagactgaggaaggtgaagataagagagaggaggaggcccctgctgtagatgcagcagagaagactggtgagaaagaggtggcccctgctgtagatgcaacagaggagacagaaaaaagcaccgaaggccaagcacagcctaattatgttgctgccccagaatctgagtataaaggagacggaaagccaggtgaatccgaagcagctccccttgcatttgttgatgaaacagctccccatgtaattattggtgaagagaagaaagaggaaaatactgagaatgagaacagtcaggcagccgaatctgccgtgccttccctggcatctttagagggagagaagaaagagaatggtggtgcccctgaacaaccagccctgcctgtagctgagacgaaggcagatgctcctccggcagaggcagaaaagggggctgaaaattcaggccagccgaataccggctctcaagaaccgaaggcagcaaactgcgacgaggggcagattcaacctggtgcctctgctgtgaggtgcacataagggagcttgatctcagatgggactctgttgcgttatgtctttaggacgatacctcgcatttgctttgagaattgtaatcgtggttaacctgacagcgctgtgtagcactaggctgcccagcacgtagttatcctttcgtttcttttataacggtggtgttgcagcatgggtaatgggccggcctgtgctgcctcagccaccactgcatacccagtgtaagtgtaactcgttattagcgtggtcgacattgatctgtggagaggactgcaggacagtactgtccttgacagctgtaacgttacgttttgtgtgttcccttgtgttattgaacttatattatgatccataaataaagccataagcgtggcagggtcattccctgaccaccttcaggcatcaccatttgttggccgtatttacagtactcagcttgctcagaagcattgttgcaacagtagtagtgctaccaagcaagctagctgactaggattaggcaatgtttggtttgagggactaaaaatattagtctctctattttagtactatttagtttctaaattactaaacagtgagactaaaatatggagtaaattgttttagtctttagttcctcaatggataactaaaatgaactaaaccatataaattcatcttttgtctattctttattttagttgcaataatgacgtgaaaatactaaggtgtattttggtccttttattattcatttaatgtgttttgaatatttttattctttagaacctaacatggtagtgactaaactttagtctcctaactaaactttagtccctgaactaaatgaaccaaacggacccttaaaaatagttttggttggtttcaaatgttcagaatggaagcaaatcatccgcagttatttaactcgcatttggatcaatgtgagttcagttcacctgtgatccaaatgcacccacagtgatccaaatgcagtttttatttttcacgagtcgttaaggttctcttaatacttcttccgattttttatttgtcacattttaattaaaaataaactaccggtgacaaatattgagaacgggggcagtagttcttttggtgctagatgttcagccctagctatagactgtaaacctcagttaaccgttgctcgcctgttgttgctttgaacccctcctttctagccgttgcaaggcacccaacggcgcacgcaccctggagtctgcgcccccacacccagagagagagagagagagaaacgtacagacaaaccgatccgcagccccctttgctttgctgccccatcccacagaatctaccaacggccggcagctggcagctgcgacttccgagttgcgatcacaatcacaccacaaggccagagtcagtcggtgaggtcagtgagaggcgaaggaggagaggagaaatgggagggctcagatcg

SEQ ID NO: 10633 - DNA, 2362 bp, Zea mays
cccacgcgtccgcccacgcgtccgcggacgcgtgggttcagcaccagcctttgcgcatcgcgacgagcgatatcgggaagaggaaactcgaaagcccggcgagcggtatggcaacccgccaggagcacgtggcggcgccggcgccggcggtcgaggagacgccggagaagaagcaggccagcacaaccgagctccccgcaccctcaggctggacgaagaagcttgccccaactcgaggtggacgaggtggacgattcgaggttatttttgtttccccaactggtgaggaaattaaaagcaagagacagctgactcagtacctgaaagctcatcctggaggccctgcatcttcagagtttgattggggaaccagtgatactcccagacgctcagcacgtttaagcgagaaggtcaaggcaactgagagcccagagggtgagaagactcctaaacgggcaagatcaagctctaagaggggcacggaggcggggtggggagatgcagaggaggcaaatgaggctggagaagatggtgctgcggcggaaggtaaaggtaccgatgtggagatgaaagatgctgaaaatgctgaagacgagaagaaagatgtcccaagtgcagagaagactgaggaagttgacgataagaaagatgctgaaaatgtggagatgaaagatgctgcagagaagactgaggaagttgacgataagaaagaggaagcccctgctgtagatgcagcagagaagaacgaggaaggtgatgataagaaagaggaggagccccctgcagagaagactgttgagaaagaggtggtccctgctgtagatgcagcagagaatactgaacaaagcaccggtgggcaagcacagcctaatgatgttggtgccccagaatctgagaataaaggagacggcaagccagctgaatccgaattagctcccactgcatttgttgatgaagcagtgccccttgtaatcgttggtgaagagaaaactgaggacagtcaggcagctgaacctacggtgacttccctggcgtcttcagagggagagaagaaagagaacggtggtgccactgaaccagcagcacctcctccagctgatgcagacaagggcgcggagaattcaggccaggtgaacaccgccccccaagaaccgacggcagcgaactgcgacaaggggcagatccaacctggtgcctctgctgtcaggtgcacataagggagcttggtctccgatgagagactgctgctttgtgtgtttagggcaatacctcgcatttgctttgagaattataagcgtggttaacctgacaggacagcgctgtgcagcactaggctgcccagcacgtagttatctttccgttttttttatggcggcagggacaaatgtgtgtacccggttcaaagtgtaactcgttattagcgtggtgaacattgatctctggagcggactggaggacgtagtactgtctccaactgttgtaacgtgacgttgtttgtgttgctgccttgtgttattgaacttattatgatccataaataaaagccataagcgtggcagggtcattccctgaccaccttcaggcaccaaaaaaaaaaaaaaaatcaaaatgcacttgaaatttaccggaaaacaatgcgagggagggttggaaactcaaagaacttctagtgcgcatgacgaacattactaggggggggccgcttttaaaagaaccaagtttaaaaagcgggggaatgcgaagttaataagcttttatataggggccccaaaattaaattacctggccgcggttttaaaaagggggaaacagggaaaaacacgggcggtcacaaaattaaaatcgtttggaaaaaaaaaccccttttacaaagtggggggaataaaaaaaaaaggccccacacagatccccttttcaaaaaaatggccacccccgaaaagaaaaagggggcccccccctttaagggggatataaaagcgggggggtgggggggggtatccccaaaagtgataccctaacattttagcaaagcctgtgaaaggcgcgggggggggggggggggggtgcgggggtcggggggcgccctcctacccccctccccccccagaccaccccaaacaccggcgcacactccccccgggagggtatttaaattccccttgagccttacccctcaaaaacacagaattgtgatgaggcatctcgaaacgtgtccggctcctccttaaaaaaaaaatttaaccacgctaatttaggaacaacctactcaacaaatcgttctgtatctgccgtagaaagacacataacacacaactggacgactcttttattacaatgaaggtacccatagcccaatgaatat

SEQ ID NO: 10634 - DNA, 1588 bp, Zea mays
cattgggtacctcgaggccggccggggtctcttttcgagacatccgataaaattggaacgatacagagaagattagcatggcccctgcgcaaggatgacacgcacaaatcgagaaatggtccagtaggcatctagttccattatttcttgaccacttcttagttgtattgtaaattcatctgtttttgtactagtaggtttcccaatattcaatgtcttgttgctccctctaaaaagtttgtaagcaggtgatactcccagacgctcagcacgcttgagcgagaaggtcaaggcaactgagagcccagagggtgagaagacccctaaacgggcaagatcaagctctaagaggggcaaaaaggaggaaaaagtggatgcagaggatgcaaatgaggctggagaagatggtgcttcggcggaaggtaaaggtaccgatgtggagatgaaagatgctgaaaatgctgaagacgagaagaaagatgtcccaagtgcagggaagactgaggaagttgacgataagaaagatgctgaaaatgtggagatgaaagatgctgcagagaagactgaggaagttgacgataagaaagaggaagcccctactgtagatgcagcagagaagactgtggaaggtgatgataagaaagaggagccccctgcagagaagactgatgagaaagaggaagccccagctgtagatgcagcagagaagaatgaggaaggtgatgataagaaagaggaggagccccctgcagagaaaactgttgagaaagaggtggtccctgctgtagatgcagcagagaatactgaacaaagcaccggtgggcaagcacagcctaacgatgttgctgccccagaatctgagaataaaggagacggcaagccagctgaatccgaatcagctccccttgcatttgttgatgaagcagcgccccatgtaatcgttggtgaagagaaaactgaggacagtcaggcagctgaatctgcggtgccttccctggcgtcttcagagggagagaagaaagagaacggtggtgccactgaaccagcagcacctcctccagctgatgcagacaagggcgcggagaattcaggccaggtgaacaccgccccccaagaaccgacggcagcgaactgcgacaaggggcagatccaacctggtgcctctgctgtcaggtgcacataagggagcttggtctccgatgagagaccgttgctttgtgtgtttagggcaatacctcgcatttgctttgagaattataatcgtggttaacctgacaggacagcgctgtgcagcactaggctgcccagcacgtagttatctttccgttttttttatggcggcagggacaaatgcgtgtacccggttcaaagtgtaactcgtcattagcgtgctgaacattgatctctggagcggactggaggacgtagtactgtctccgactgttgtaacgtgacgttgtttgtgttgttgccttgtgttattgaacttattatgatccataaataaaagccataagcgtggcaggggccattccctgaccaccttcaggcaccaaatgcatctatttgttggccccagagtacttct

SEQ ID NO: 10635 - DNA, 1952 bp, Zea mays
  misc_feature (1804)..(1806): n is a, c, g, or t
  misc_feature (1810)..(1810): n is a, c, g, or t
  misc_feature (1812)..(1815): n is a, c, g, or t
  misc_feature (1821)..(1823): n is a, c, g, or t
  misc_feature (1831)..(1837): n is a, c, g, or t
ttgtctaattttagaatgactgtagttctgtcccacctgcgacagttagcttgctcttgtagatgaatttgttgaaatgaatatacttagaaactggcacaccgtatttcatatctataacaagttggccctttgctatgtttgtcatattctatcagaacaccacctgcaggcagcttgaattagagttcaaattgacccataccatgtttgattgctttagtttcattgcatatttttaatgctaacttgttcatgttatattgcaggttgctccaactcgaggtggacgatttgaggttatttttgtttccccaactggtgaggaagttaagagcaagagacagctaacccagtacctgaaagctcatcctggaggccctgcatcctcagagttcgattggggaaccagtaggcatctagtttcatcatttttttgtcatctcttcttagttctcgtttggtactagtaggtttcccaatattcaatgtcttgctgctgcctctaaaaagcttgtaagcaggtgatactcccagacgctcagcacgcttgagcgagaaggtcaaggcaactgagagcccagagggtgagaagacccctaaacggggaagatcaagttctaagagaggcaaaaaggaggaaaaagaagacacagaggctgcaaatgaggctggagaagatggtgcttcggaggaaggtaaaggtacagatgtggagatgaaagatgctgaaaacgctgaagacgagaagaaagaggtcccaaatgcagatgctgcagagaagactgaggaaggtgaagataagaaagaggaggcccctgctgtagatgcagcagagaagactgaggaaggtgaagataagagagaggaggaggcccctgctgtagatgcagcagagaagactggtgagaaagaggtggcccctgctgtagatgcaacagaggagacagaaaaaagcaccgaaggccaagcacagcctaattatgttgctgccccagaatctgagtataaaggagacggaaagccaggtgaatccgaagcagctccccttgcatttgttgatgaaacagctccccatgtaattattggtgaagagaagaaagaggaaaatactgagaatgagaacagtcaggcagccgaatctgccgtgccttccctggcatctttagagggagagaagaaagagaatggtggtgcccctgaacaaccagccctgcctgtagctgagacgaaggcagatgctcctccggcagaggcagaaaagggggctgaaaattcaggccagccgaataccggctctcaagaaccgaaggcagcaaactgcgacgaggggcagattcaacctggtgcctctgctgtgaggtgcacataagggagcttgatctcagatgggactctgttgcgttatgtctttaggacgatacctcgcatttgctttgagaattgtaatcgtggttaacctgacagcgctgtgtagcactaggctgcccagcacgtagttatcctttcgtttcttttataacggtggtgttgcagcatgggtaatgggccggcctgtgctgcctcagccaccactgcatacccagtgtaagtgtaactcgttattagcgtggtcgacattgatctgtggagaggactgcaggacagtactgtcctcgacagctgtaacgttacgttttgtgtgttcccttgtgttattgaacttatattatgatccataaataaagccataagcgtggcagggtcattccctgaccaccttcaggcatcaaaaaaaaaaaaaaaaaaaaaaaaaaaacacccnnnccanannnnaaaaannnaaaaaaannnnnnncctctgcgttgttcccgctgcttaagggcgatatccagcgcactgccggccgttgctggtggctccggcctcggtcccgtgcttggcgtagtcctggcccttgctgctccctgcg

SEQ ID NO: 10636 - DNA, 1882 bp, Zea mays
ggtccccttttccccgcggctcccacactccaacccgtccccccccccccccaattcagcaccagcctttgcgcatcgcgacagcgatatcgggaagaggaaactcgaaagcccggcgagcggtatggcaaccggcgaggagcacgtggcggcgccggcgccggcggtcgaggagacgccggagaagaagcaggccagcacaaccgagctccccgcaccctcaggctggacgaagaagcttgccccaactcgaggtggacgaggtggacgatttgaggttatttttgtttccccaactggtgaggaaattaaaagcaagagacagctgactcagtacctgaaagctcatcctggaggccctgcatcttcagagtttgattggggaaccagtgatactcccagacgctcagcacgcttgagcgagaaggtcaaggcaactgagagcccagagggtgagaagacccctaaacgggcaagatcaagctctaagaggggcaaaaaggaggaaaaagtggatgcagaggatgcaaatgaggctggagaagatggtgcttcggcggaaggtaaaggtaccgatgtggagatgaaagatgctgaaaatgctgaagacgagaagaaagatgtcccaagtgcagggaagactgaggaagttgacgataagaaagatgctgaaaatgtggagatgaaagatgctgcagagaagactgaggaagttgacgataagaaagaggaagcccctactgtagatgcagcagagaagactgtggaaggtgatgataagaaagaggagccccctgcagagaagactgatgagaaagaggaagccccagctgtagatgcagcagagaagaatgaggaaggtgatgataagaaagaggaggagccccctgcagagaagaagactgttgagaaagaggtggtccctgctgtagatgcagcagagaatactgaacaaagcaccggtgggcaagcacagcctaacgatgttgctgccccagaatctgagaataaaggagacggcaagccagctgaatccgaatcagctccccttgcatttgttgatgacgcagcgccccttgtaatcgttggtgaagagaaaactgaggacagtcaggcagctgaatctgcggtgccttccctggcgtcttcagagggagagaagaaagagaacggtggtgccactgaaccagcagcacctcctccagctgatgcagagaagggcgcggagaattcaggccaggtgaacaccgccccccaagaaccgacggcagcgaactgcgacaaggggcagatccaacctggtgcctctgctgtcaggtgcacataagggagcttggtctccgatgggagactgttgctttgtgtgtttagggcaatacctcgcatttgctttgagaattataatcgtggttaacctgacaggacagcgctgtgcagcactaggctgcccagcacgtagttatctttccgttttttttatgttggcagggacaaatgtgtgtacccggttcaaagtgtaactcgttattagcgtggtgaacattgatctctggagcggactggaggacgtagtactgtctccaactgttgtaacgtgacgttgtttgtgttgttgccttgtgttattgaacttattatgatccataaataaaagccataagcgtggcagggtcattccctgaccaccttcaggcaccaaaaaaaaaaaaaaaaaagcggcctttactgtactcggcttgctcggtagtatagatgcagcagccgggttttttttttttgtgtgcgtgtgtgtgtgtgtgtggaggaagagagctggctgctgcttctgtaactgcagtgttgagtctgtgatccaaattctgaagaaggcggccaagttggc

SEQ ID NO: 10637 - DNA, 2823 bp, Zea mays
taatatcacttatagtgttatccatgttgtataaatcgccatgtttaagtttttttagatgtgacatagacttttacaacacacatctatgaatgcatgtgcataaatcgtattcatacgagcgggtgtttgattcccacctcataaaaatgagacattcttaataaatatttagggacaaaagtttagtctctaaactttagaagggtgactattagaaccaaatacccccggtctgttagagagtgtttgtaattcttacaattctttagttaaatactcctaaatatagagtagtgttgttcaaaacaaggacaaaaacacgttttttagtgcgacgttaagagtcgctagaaggtgacatccgcggggcgcggtcagcgatgatcacctagcccacgcgactgccagatcggagcgccaatagaccgcccggcaccccaccctaaagtccaaagccccaccagctctgctcagccaccaccatcctcctcttcctcgaacggtcgaaccgccgaaagcacgcaccccgccgccgcgtaccctcccctcacccgctcaccatcgccggccgccgttcggcgcgacgcggattcgaatccggaaagcgggcgatgggggcgaagcgcgcggtgctggtgggcatcaattaccagggcaccaaagcggagctcaagggctgccacaacgacgtcgctcgcatgcgccggtgcctcgtcgaccgcttcggattcgacgagtccggcatccgcgtcctcatagatgacggctccgcgccgcagcccacgggggccaacatccggcgggaactcgcgcgcctcgtcggggacgcgcggcccggggacctcctcttcttccactacagcgggcacggcatacggctgcccgccgagaccgggaaggacgacgacaccggctacgacgagtgcatcgtgccctgcgacgtgaaccttaccacaggtgtgcgagatgtgcccctctgttgctaagttgctatgaaaatagggatcgaactgtaggtggaattattgaagtgtataagtggattgcatatcttcttcgcttaagcttttggtttgaattggtgagcgcgtccactctaaccggaactgtggaagttttagaattgcaaacagatccatatacgtttaaattgtgagttaacataatagcattgtggtaatgtgagtgaatgattggattggttcctacgtggctatgaattcatatagcacaaattatttttgaaccagaaatggatgtagattttaggccaataacgaaaaggatttcagatgtctactgaaccaggatctgcatattcggaagatgaacctaataatttagatctgcattatgtgttaaatggtactctatgtcacatgtgtttactttaccagatcaaatactatacattgtaaatttgtgccttgagagctgaaaatgcagtttctgaaaggctgaaactgttctgatcactttgacaactgtggaaaatattaaaatttgggatcccggacgcgtgggcagctatgcctgaatcctgaatgtatgccattttacctggttaatgtttggatgctccatttagtggttgaaataagtaactgatgttctgttatgcaccgcagaccaagatttcacggagcttgcgcaaaaagtccccagtggctgtctctttaccatagtttctgattcgtgccacagtggagggctacttgacaagaccaaggagcagattgggcacagcaccaagcagaagcagaagcagacccagacccagacccagagccgggaacttgaggaacggtctccttctggcaccagcttccgggaattcctcaaaggtactgttcgggaagcgtttgagtctcaaggaattcacctgccccaccgtagccgtagccaccagcaagggagcggtcacggcgacgacggtgaccaagagtcgcgctacatcaacacagccgatgcccacgtcaaaaaccggtcgctacctctctcgacattgatcgagatgctgaaggagaagactgggaaggacgacattgatgtagggtcaatccggctaacgctttttaacctcttcaaagacgatgccagcccgaagataaagaagttcatgaaggtcatgctgaacaagttacagcaggggcagcacggaggcattgtgggcttcatgggcgctctggcacaggaggtcctgaaagccaagctcgatggcaaggaagaagaagagttcgacccggcaatgaaacagcacgtgcacagcgatcaagaggtgtacgccgggacgacggcaagggtgccgagcaacggtgtcctgatcagtgggtgccagaccgaccagacgtctgccgacgcgaccacgccgaagggggtgtcctacggtgcgctcagcaatgccatccaggccatcctcgcggagcgtgggacggtaacgaacaaggagctcgtgctgaaagcgcgcaagatgctgtcgaaacagggctacacccaacagcctgggctctactgcagcgatgagaatgccagtgcggcttttatatgctgatgatgattcattgggtttgtcctgtggattgcaatatttgtattttgtctctaagtgcatgtgagttggactggtggttatgttttttcgctgagatttgggaatgtatcgtttctttcgcaaaaaaaaaaaaaaaaagaaaaaaagtcatttaaacataaaataaattttattttaataaagcacaaaatatacgttttctattatttaggtgttgtgaacgtggagccaacaatcaaaattcaaaactcacttatacataattcacc

SEQ ID NO: 10638 - DNA, 3498 bp, Zea mays
  misc_feature (2871)..(2871): n is a, c, g, or t
ccgcgggtacggtcgcatgcgggtatttattaaacccgatccgaattctacccgttgacatccttaatctcaattatgtcatttgtttggatttggatgcaatcagaagattttgttacggtgtgtcacgaggcctaactcaacttttaggatatatatatataataataataatggatcagtgtttgtgtttgcattcgtactgtaatgttttttatttctatatttataaagatacatataaaatagatactcttgcatggggagatatatattagtatccttttgccacagacgttttttttctcgattgtaccttctcatgaccctcgtatggagtttttttttgccgtttggagaagaaaacagaaggagatggaggatgatatgggaggataaaaatacaaaaactatcgttggatctaatattaaatagtatagtctgcttgtacgttagatcagacaagtgattgtacaaaattgagctccattttagaagataagctttggtggtcctttccttgaatccaaacccaagctcttggttaccttcggaaggagttggtgagctcgacggagctgaaggacccaaggttcttgtacggccccggcgagagcccatcatcagcggcaccaatctgccgcctcgcgtccacggcgctccgccgtctcctgtcccacaccctgtacgccccgaatgcagcagcagcgaccaccaccgcgacaccgacaacaaggagggccgccttgaccccgctcgcgcgcccaccgccgtgccctcgcgtcccttcctcctccaggctcctgatcttgaagtagcccatcttcctgtcgtcaccagccaccagaagctgtgccgggtagtccatgacgtagcagaccccggtcccgttgctgtacaccgcgccccggcccctcctggcgcgctcgcaccgcgcctcgcagtccgtcgcggacgccgcctgctcggaccgcagcagctccttgttcaccggctccacgccctgccgccgcaccgcccagtacagcccgccgacttccccgcccgtggtgccgcaaaggctgctcgcgacggaggcgggcacggccgcggcgcagcccgagccatcggtcgcgttggccaggcactcgcccctgccgctgggctccgcgcagacgctgtaggcgccgcaggtggtgggcagctcgcatcggtcgttgtcgttgatggcagtgtagtcaagggcccaccgggcgccgttccagtagtaggcacggaggttcccgttgggctccagagtcatgcggcggagggcgcggacgccgcggttgaaggtgtcgaaggagagcacgtcggcgggcggcccctccctctggtacatggcgaggaagccgtcaggctccacgcgcgcgtaggtcgggccgccgccggccacgatctgggccttggcctccatcgccgtgtgcttgaagtacatggccgcagcgacgccgcccgaagacggcgggggctcgatgtacaggccgaagtagttgctccccagccgcacggcgaagcgccggtcgaagctgtggagtgtcgccgcggaggtgaagttctggccctggacgatggtctccgacgggtagtcgaagctctgccacaccacgtcgggcgaactgctgccaccagtgctctggatttggaggttggacgtgttgaggaggacggcgcggtcgccggccgaggcagaggtggcagcggtggaccagagcaccttgtcggccgcgcggtcggtgaggaagaggccgccgtcgaaggagagggaggcggctgtagaccatggagcggggcggtcggggatcgcgcgccagagcgggaaggcagacgggaggtggacgacggcgaggtccagcatggtggagttgacgcggaggaagccgagcgcgaagacgccggtggggtcagcgagcaccggctggaactgcgagtaggactggtcgtgggcgacggagaggccttgccgcagctcctgcgccacggcctcgccggcggcgccgccgatcaaagaagatataagcgccgccgcagccactaactgcaccagtactattgcttccatgttcccaatcggtggtgggtggtctgtagttacaagatcggattcttgcgtggaatgggttctttaaaagtcgatggatttaaaagataaggactagtggattcttggagcggtggctagtgatcgaatcagtgagggacgacggacgagcaggagcagacaagaagagcctggaatatttatttgtccactgaccattgaaatggtggggtggccgctggccctgtgagctaccgcagcctactccgtaccagcgagtgagagcgcagcattgtcgtgtgcccatgccactcgtggctgcgaagataaacctgaagcaggggaggcgacattgattcatttggagtttggtcaatgagcaccgagtacactgaatagattacttttggcttcttcctgtccatgatattatgatcggcagcagctcgcattttttatatgctccttctgattgcctactttgcagttggaaagcatttatacaacagcggcgctcgaggagtcatcaggaattcaggatgaactcgtcagtcggcagtgcctcctactatatttgggatatatattatacgtactagtctacacgtccatattaagaccgtgcctagtagtttatcgataggttatccgaacgttgtttttcgatttcctacactattaatagtagagtttaaatagaagtatagagataaataagctactgaagatagtctaagactaaccgcaacgccagccgctcactcgccccctccccttgcatggcgggcgcagaggcacccggacgggtgcnacgtggccctctacggcgtactctactcgtgcgtgctcttctctctcccttcagctgtggcgtgcggctgcccctaatcactgttgatgtcggtccacctccaattattagtagaagaaaaattaatagtagataaaaatatatctagaaaatgacattttatggttgtagtggggtataggggaagaatttaaggggaaccgagacaaaaaagtatgggatgaaatattgataatatgacgcaaaaaagtgatataggaggggaattttaaagggaaccgctgcggatacctaatgcaacagtcctacaaagagcgagggaggggcaagtgagtgggagggggtgacgaggtcgtagaagaggatggcaagagattattgtatgtgtgaggaacgaagaaggaatgctgatttaaataatattgatcatttgattgaagttagtaaaaaaaatatgagaattatttagcgatctgaactgttaattttgaggttgtgttatgtgtgggtgtaatttatttagtggatttggagaagtttatgggtagaggtaatttaattggatgagttttgcaaatttaaactggtgggttaagatatagatatacccgcttacagaaggaaatg

SEQ ID NO: 10639 - DNA, 2233 bp, Zea mays
cctcttcgctgcacgagaccattacctagaacatcctaatcgaaaaaggacactcttctccccggcgcagtcaggacactcttcttctcaccgccgccagcactgctctgggcgcgcgccgcctaccctcccctcttccctccctcacctctcgtcctcgaagcaagggtttccctgccccaggctgcctctcgtccgttctccttctctaccgccgccacaactcgcccgccgccccgccctcaccgccggcaacgtgacacgacaagcccacccctttattcctgcagctatactccgatggccctcgtgaagtccgacgctgaggaggagtggtccgactctgacttcgatgatgcctccgactccgaggtcgccgaagctctggactggctcgacgccgtggagggccctgacggctcagctcgcccccacgtcgccttctcggcctccggaggcggggctgcggcgcggaggcctaacgcacacggcggcgtgctgtctcgcccgctccagccgctgtctaaccggacccagaagctggcctcgcacattagtgctactcccttggaggagtgggaaggtaggatgaacgttgcgatgtcaaattccgtcacaactgcaatcagggatagcataagggacacagctattgggaaaataaggaacactgagaaggctgatcgtgctacagtggaacaggctattgacccaagaacacgcatggttttattcaagatgttaaaccgtggtgtctttaataacataaatggctgcatttctacagggaaagaggcaaatgtctatcatgcaacaaagacggatggccaggagcttgcaattaaagtctacaaaacctctgtccttgtttttaaggatagagaccgatatgtccaaggagattatcgttttagacatggttactgcaagcataatcctcggaaaatggttaagacctgggctgaaaaggaaatgagaaatcttctacgagtgagggcagctggaatccgatgccctgcaccattactcctaaggcttcatgtactggtgatggaattcatagggaaaggaggctgggctgctcctcgtctcaaggacgctgctttgtcagatgacaagttgcatgaaagttactttgagataattacaacaatgcggactctttaccaaacgtgcaaactggtccatggtgatttgagtgaatacaatattctatattttgagggtcacttgtatattattgatgtttcacaatccgtcgatcttgatcacccttcagctttggattttctgaaggaagattgcttgcatgtttctgacttctttaaaaaacgtggtgttcctgtcatgacagtaacggatttgtttaattttgttattgatcaaagcatttctgatgaagatgttgatgattacctggaaaaggctcagcaaaagattttggaaaatggtggtgcggttccaaatgatgatgaaattactcctacagtcatggtgcagacgttggactacgtgaagcaatgtgaggcagatattgtcaacatgtcaataatgcaacgttcatcctctggctatgagccaaccgcagataagctttatgaccaaccattgttagggtttgtgcggactaaaaacacaaacactgaaaaggagcaaggacaaccggcacgaaacttagttgaggttgaagaagacgagagcgaatcttgcttgagttctgatgaagatgattcgtggcacgaggatgatcctaaggtgggacccgaggaaaggaaggctgctcggaaggaaaacaagaagaaagtgaaggaagagaagagggaggcccgcaagaccaagatcccaaaagctgagaagaagaagaggaagaaaatggcgaaggcaaaatgcaagcggtagcgaatatctatgaacaatccagtagttaactccgtcagtagagatggataacttcgtcgtgaatcaaacaagatgatggataacttcattgtgaatcaaacaagatagcctttatgagggagtgcaggttggaagtttggttcacagcgctactttacacatcacaagattattcacgatgttttcaacctttttgttcgtttcaattttgtagagaactactgtacgtaatgtgaccacatatatgtttatcttgagtggaaccgtatagtatttttttagagaagagtacaaatggtactttgtgccgcaaaaaaaaaaaaaaaaagcggcc

SEQ ID NO: 10640 - DNA, 3974 bp, Zea mays
ctagagactttcccgtccgcacagtgtctttaccttgtaacaaggggtacccctgtttcaaggtaccgacaggcccctagatgagttttagtgagttaggtcaagacaatgaatattatttgggattatgtgcccctattgatggaattcaattaccatttttcaaaggatgagtgagaaagttaagcatcaactagttttaagtgcaaagaagttattggacacatacaatagtgatagaatctttttggaggtactataaaaggggtatgactatacatgaccaaacggatgaccgacccatccatgcatgggcccgctacgacagcccgtttaggtctgtctagataatcggatcgtgtcgggttgggccacgtgtcgcggttgtagtccagacacggcacgccgacctgttaagtgtgccgaaaattaactaatttccatggactacctactaacaaaactaaaaaaagttgaccatatttccttcggccgagcaattacaaacgtatattagttaatttctgtcgactacactaaaagtcaataaaaattaactagactgacagaagtgtgtgtttatagtggtacaagctataataaattatggcttccccttccaacatataacaacacacaagccaatatatttaggagcgagacatttcttcgttggtctttatagatactatcttcatataaaagacatatttggttcgctgtctaacttatcatattttagcgtagttagtcgcaaaccaaatatatctgaagttttcatgacaaattttaaggtgttgtttggttcaccgttttttatgcccgtaaacgtttgcaccactgtctgctcgttatctctacccagaagcgctatccaatcctgcaggctacacgttaatgaaccaaacaaatccgtttctgttacaatgcaacaggagccgtaatcccatcaatccgtcgtcctttgtagttgaggaattcttaacacagatttcccgcgcgcgtacttagttgcagattcctcgcgcaaccatctcaaagcggggcatctcagggttcaacgcatcgcaggaacccttccaggctctccgccgccgacccgccaggcgcttcccacgcggcctccatggtgcgtgcgatcgccgccaccaccctcctcatctcatcacccttcgccgtgtcccccatcaccgtccgctcggcctcgaccaccgccctgctctccaccgcggagctctccaggttcccgcgcgccagctccacgcagacgccccactcgaccgcgagatttgcgttgaagaactgctcggcgcccaacggccacccgatcagcggcacgccgcgggacaggctctcgaggacggagttccacccgcagtggctcaggaacgcgccggtggacgggtgcgacaggatccgcatctgcggcgcccacccgcgcgccagcagtcccacattcgccctcgccgttcgctcctcgaagccagccgggagccactcgggcctgaacacgtccttcgcgtcgaaccccagcggcgggcggagcgcccagaggaaggggcgaccgctcgcctccagccccagcgcgagctccatcatctgatccgcgctgatgctgttctgcgatccgaatgatatgtacagcaccgagcgcggcgggtgcgtgtccagccaccggatgatgctggcgtcgtcccgcgagtctgacgacggggccgtcggctctgcgaggactggcccgattggccatggctggacgccgaagcttctccggagcatgtcgaggccggagggttccagttcccggacggtgttgacaaggagagcgtcggtcttgcggcaggaggcgatgacgcgccggaagaaggccgtccaggggtccgcccccgtggcagagaggatgaacctcgggatctgcgtgcggtggagaacgacgtctgggaaatccggcagcgggaactcgtcggcggccgtaagggcgtgcgggaggtgctcccacacggagaagaacacggcgttgccgaacgcgccgccgggaaggaacaccgcgtgggacgcgccccgcgcgcgcgcgacttcggccgtccacccgaagaaggcatcggcgacgatgcagactggggaaccgatgccggagacgaacttctcgaacgcagggcggagcgactcggaggccgtgaagaaggtgatgaactggtggatctggacatcggcgagggagtcagcgcctgggggcaggccgtggtcggcggggacgaacgggagcgcgtggaggcgcacgggtggggaggcaggcgggagcgtgagggagcccaggagccgcggggtggagacgagcgtgacctcgagccctgggcggagcgcgcggaggaggccagccaggcggaggaagacagggacgtggccgtgagccaggaagggaaagagaacaaagtgtgggctcctcttcgcttccaccgccgccatggcaattgatgcaggcaagaagctgctggccaagtggatgggtgggtggagttggttctactgcggaagtcgccggtcgccggccgacggcccccggggagcgatgtcgctcgtgcgccgacgctgcgacaacgcgctgatctgcttttttagaggcagcgtccgttggtgggcgcgacttcgtggtttcataacttattttttggtacggacatgccaaggggaagagaaagacgactcagcaacaacgatcagaggctacaggttaacagctacaaaagagcgattgcatatgatcgatgattacatatgatctgcactgcagttcatgttggagaatattacagaattggctacctgacaggtgttcctagtgtacttgtaactcgagtaagaatgcaccgacgcatatagaattaactgaacaatgaacatctgcagagaagaggaagcctttctgagagacaacggcatcagtaagaccgtcacgtgcctcaaatgcttcatgctagtctgaaacctttctgagacaacggcatacaatgacactacgaaactatgaaccactatcatttatctccctatgaaatgctgacacaaataatgaatgcagattacaagaaccctactaattactatcaatactaggaaaagtcagtaaaaaaatgtgtattacctttggctaatcgaacatattataaatacattatgagtcatccttctttgaagaatcatcagaggcaggcgaggatgcagagctgaccctcgtcctatctttagactcgcttaacatgactacaacatgccgcattggtggtctctcgtacggagtcaagctagtacataccaaagcaattttcatgacctcgatcatatgatcgacaacactttggtcttgtaaatccaaatttttatcgaggatccctggacccaaacaattgtccttgatgtagttctttacccatgttaccagatcgcctcccagttccaagggttgcacaggggcacgcccagttagcagctccagcagcccacgccataactatatatatcacatttctcagtaaccttcatggtataagcatattctggtcaaaacaagaggactaggttagtacttcacagtaggcatcagcttgtagttcactagcacaaaaccgaaaggacttacccagcaaatggatgtctgtgagcttctggcacaagggtgggatatcaagtagatatatgaataatattcagctcacatttcaagatatcaagtctttaaacattgaaaatcaccaagatatggaaacccccacagcaatatatcaccacaatggttcgaggaaaagttgcctagttggttttattaatataaaatccagatgtcagcataagcttaaagtttccttgctgccattttttgtgggaaaaccaacattataataatatttattgcaaagtaacgcccaatgaagaataactctaccagcaaacaaaacactacataaatttagacattg

SEQ ID NO: 10641 - DNA, 2334 bp, Zea mays
aagatattggctgtaaggtatattgtgcacaaaactcatctaaccatttttttctcgaccaaggggagagacgcccccctgacttttttcttaagaagctggtgccgcgactcgaacccgtgctggctcagcagactgcttctttggcgtgtctggctgaccagttgcaccgtgagagtgttggcatctagccaatattttggttcaccattctttggtattttgcttttgtggcttcatgtttttgcgattattacagtgtgtagtatgtattgacaccccgaacatgtttatgtacagattgtggagattgttggtgagctggaggaaattgtttttacattagatagcatcagagaaggaagctggtgatgagctgatcaaattgctccagagaaataataaaacaaatggttccagtgacagtggggagcttgaggtattccatatgtctgctcttaaattgggaattacatcttctagggcagcactcaccgagagaagagcccttaagaagctaattgagaaggcccgttctgatgaagacaagcggaaggagcttgttgtgtcatacttgtacaatctcatgaggaagtactcaaagttcttcagaagtgagactggtgatgatacagattctcagggatcgtctccatgctcgccaacagtattaggcatggatgatatgtatgggccgtacaacaatggtcgggcatttagtagacagctttcgagcattcagtctttcaattcaaggtttggatctttcaattctaggcttggatcattcaattgcagacgtggtggtggtccaaggtctgagaatatgtcaatccctcctgaagaacttaggtgccctatttccttacaactcatgtatgatccagtcatcatttcatccgggcagacttatgagcgtatttgcattgagaaatggttcaacgatggtcacagcacatgtcctaaaactcagcagcaacttgcccacctgtcattgactccaaactactgtgttaaggccctcattgcgagctggtgtgagcagaacgattttccagttcctgatggtccaccagggacttttgatgtaaactggagacttgctttgtctgacactgaggccgcaggctgtgtgtcacttgaaagttttgattgtgctaatgcaaagagtgtcaaggttgtcccaatggagaacgttagaaaggaggagccagcaaacagtgaatcgggaactctggatgacggctcctgtaacgatttcgatttgaacgaaggctatgggaacttgctgctcctgctccatgaaagaagtaacatgaacaagcagtgcaggttggtggagcagataaggtatcttttgaaagacgacgaggaagcaaggatccccctcggctcaaatggctttgccgaggcactggttgagttcttgtggattgctgtgaatgatggaaatgagaaggcgcgagaagttggtgcaacggctcttttcaatcttgcagtcaacaacaacaggtattgtttcctagttgtgtggttgtccctgattgttgctagttgaaaaaaaatacttattattacttaaacttagtgaagtatttttttgcttatcaaaaccctttcttatttcagaaacaaggggctcctgttatctgctggagtcaccgatctacttgagcagatgatatcgaatccacggctatctggtcctgccacagcactctacctgaatatttcctgccttcctgacgcgaaggccgtcatcggttcgagccaggccgtgccgttcctagtcgaccgtctgtacagccaagacggcagcgacacgagaggaagctcctgcaagcacgacgccctgtacacgctgtacaacctctcgagccaccaggccagcgtgccggcgcttctagccgcgggcatcgtggacgctctccactgcctcgtcacggagtctccagggtcggaggaggggcttggctggacagagaaggctctggcggtgctcatcagcctcgcggccacccaagctggccgaaaggagatcatgtccacccctggcttggtcagcacgctggcgatgctgctggacacgggcgagtcgacggagcaggagcaggcagtgtcgtgcctcctggtgatgtgcggcgccgacgacaagtgcatcgcgccggtgctccaggaaggggtggtcccgtccctcgtctccatctcggcggccgggactgggaggggcagggagaaggcccagaagctcctgaagctgttcagggagcagaggcagcgggacacgccgccgccacagcagcagcagcagcagctgctgcaggcccgcctggc

SEQ ID NO: 10642 - DNA, 827 bp, Zea mays
tagcgtggtcgcggccgaggtaccagtgcaaagagcgtcaagattgtcccgatggaggatgctagaaaggaggagccagcaaacagcgtatctggaacgctggatgacggttcttgtaacgatttcgatctgaacgagggctatgggagcctgctgctcttgcttcatgaaagaagtaacatggacaagcagtgcaggctggtggagcagataagatatcttctgaaagacgacgaggaagcaaggatccagctgggctcaaatggctttgccgaggcactggttgagttcttgaggaatgctgtggatgatggaaatgagaaggcacaggaagtcggtgcaatggctcttttcaatctcgcagtcaacaataacaggaacaagggactcctgttagctgccggagtagccggtctacttgagcagatgatatcgaatccacgcctatctggtcctgccacagcactctaccttaacctttcctgccttcctgacgcaaaggccgccatcggttcaagccaggcggtgccattcctagtggactgtctgtatatccaagacgccagcgacacgaacggcagctccagcaagcacgacgccctgtctatatatatcacatttctcagtaaccttcatggtataagcatattctggtgctatatagccgtatgaacctgcaattgcagacattgacttcgagtatggcatgtcaatcacctttgctaacccaaaatcaccaacatgggcttcaaagttttcatcaagtaaaatgttattagattttatatcacggtggatggtacgaggcttgcagtcgtgatgtaggt

SEQ ID NO: 10643 - DNA, 2873 bp, Zea mays
  misc_feature (1956)..(1956): n is a, c, g, or t
atgtagagacctgttctttcgtttagcctaaggaaaggccttgagaaatgttcagaatgaaatgctaatgttatctgtttttcttgtgattcttgtagtcagatgttggagctcaggtaatagccaaccatggaagcaatggaggccgaagaaggtccttttctggctaatgatgccaaggtatcatctttacagtgaatgtgtctggtactcctgttaatctgttggtctcctaccttttgcaagtacatcttaaaagcctgttcatgtttagttgatcaatgagagttaccttttcttttccatattgtttaggtagtatttgtttcaatggttagtactatcacaatgctttgatttctttaaggttcctttttctttaaatactactttgtactgtgataagttactggaaccttatagctttccgtttggtggttttgcttaatttcgcagcgaatctaaagaaattttgtttttttgcagttgcacgcaggaatttgtagagcatttcatccttctgtatctaaactttccaccattttcccctttatcgaagcatcaagacccagaagcaagcctggtatacaggcattgtgttcactacatgtggctcttgataaagccaaagggcttcttcaacattgtgcagactgcagcagactctacttggccatcacttcggaaactgtgcttttaaagtttgagaagtctagaagccagcttcaggagagtctaaggcgcactgaaagcatagtaactgaagatattggctgtaagattgtggagattgttggtgagctggaggaaattgtttttacattagatagatcagagaaggaagctggtgatgagctgatcaaattgctccagagaaataataaaacaaatggttccagtgacagtggggagcttgaggtattccatatgtctgctcttaaattgggaattacatcttctagggcagcactcaccgagagaagagcccttaagaagctaattgagaaggcccgttctgatgaagacaagcgtaaggagcttgttgtgtcatacttgtacaatctcatgaggaagtactcaaagttcttcagaagtgagactggtgatgatacagattctcagggatcgtctccatgctcgccaacagtattaggcatggatgatatgtgtagtccatacagcaatggccgtgcatttagtagacagattttgagcagtcagtcgttcaattcaaggtttggatctttcaattctaggctcggatcattcaattgcagacgtgctgctgctggtggtccaaggtctgggaatatctcagtccctcctgaagaacttaggtgccctatttccttgcaactcatgtatgatccagtcatcatttcatccgggcagacttatgagcgtatttgcatcgagaaatggttcaatgatggtcacagcacatgtcctaaaactcagcagcagcttgcccacctgtcattgactccaaactactgtgttaaggccctgattgccagctggtgcgagcagaacgattttccacttcctgatggtccaccaggaacttttgatgtaaactggagacttgcttcctctgacactgaggctacaggttgtgtgtctgttgaaagttttgactgtaccagtgcaaagagcgtcaagattgtcccgatggaggatgctagaaaggaggagtcagcaaacagcgtatctggaacactggatgacggttcttgtaacgatttcgatctgaacgagggctatgggagcctgctgctcttgcttcatgaaagaagtaacatggacaagcagtgcaggctggtggagcagataaggtatcttctgaaagacgacgaggaagcaaggatccagctgggctcaaatggctttgccgaggcactggttgagttcttgaggaatgctgtggatgatggaaatgagaaggcacaggaagtnggtgcaatggctcttttcaatctcgcagtcaacaataacaggtattgtttcctagctgcatggtgctcgttgattgctgctagtttgaaatggtaattataacttaaacttaatgaattatttttgcctagcattttcgcttatcaaaaccctattttatttcagaaacaagggactcctgttatctgccggagtagccggtctacttgagcagatgatatcgaatccacgcctatctggtcctgccacagcactctaccttaacctttcctgccttcctgacgcaaaggccgccatcggttcaagccaggcggtgccattcctagtcgactgtctgtatatccaagacgccagcgacacaaacggcagctccagcaagcacgacgccctgtacacgctgtacaacctgtcgagccaccaggccagcgtgtcggcgcttctagccgcaggcatcgtggacgccctccaccgcctgctcgcggagtctgcagcgcctccggaggaggggcttggctggacagagaaggctctcgcggtgctcatcagcctggcggccaccgaggctggcaggaaggagatcgtgtccacccctggtctggtcagcacgctggcgacggttctggacacgggcgagccgacggagcaggagcaggccgtgtcgtgcctgctggtgatgtgcagcgccgacgacgagtgcgtcgcggcggtgctccgggaaggggtggtcccgtccctggtctccgtctcggcggccgggacggggcggggcagggagaaggcccagaaggctccgccagctggctctgcgagcagcggcagcgggacacgcgccggcgccgcaaccccagcagcacctcttgcaaacccattgcgcgaggccgggattggtgcgggtgctattatcgcgtcccaccacg

SEQ ID NO: 10644 - DNA, 2032 bp, Zea mays
aggctatgggaacttgctgctcctgctccacccacgcggccgcatgaacaagcagtgcaggttggtggagcagataaggtatcttttgaaagacgacgaggaagcaaggatccagctgggctcaaatggctttgccgaggcactggttgagttcttgaggaatgctgtgaatgatggaaatgagaaggcacaagaagttggtgcaatggctcttttcaatcttgcagtcaacaacaacagaaacaaggggctcctgttatctgctggagtcaccgatctacttgagcagatgatatcgaatccacggctatctggtcctgccacagcactctacctgaatatttcctgccttcctgacgcgaaggccgtcatcggttcgagccaggccgtgccgttcctagtcgaccgtctgtacagccaagacggcagcgacacgagaggaagctcctgcaagcacgacgccctgtacacgctgtacaacctctcgagccaccaggccagcgtgccggcgcttctagccgcgggcatcgtggacgctctccactgcctcgtcacggagtctccagggtcggaggaggggcttggctggacagagaaagctctggcggtgctcatcagcctcgcggccacccaagctggccggaaggagatcatgtccacccccggcttggtcagcacgctggcgatgctgctggacacgggcgagtcgacggagcaggagcaggcggtgtcatgcctcctggtgatgtgcggcgccgacgacaagtgcatcgcgccggtgctccaggaaggggtggtcccgtccctcgtctccatctcggcggccgggactgggaggggcagggagaaggcccagaagctcctgaagctgttcagggagcagaggcagcgggacacgccgccgccacagcagcagcagcagcagctgctgcagagccagctggcggagggcgggaacggtggtggtggagctatcgtgtgccaccgggaatcgaagccgctgtgcaagtccaagtccaggaagctgggcaggacgctgagctcgctgtggaagaacaggggcttctcgctgtaccagtgctaggagatgcatgctagagtagtgttttgagttgatcagtgggtctgcgtctgtacatcatcttctgccttgtttttctcaactggtcctttcttccccccttcttctctgggggtgttgttttatttgaggtaaaaaaaacttgatgttcttccccccctcctcggttgggtgatgtagggcattttcttccatctcggccatgacaggtcatttgtacagttgctgctgcttcagtctatctgatactcagtctcccccttttcagatcaggcgcttcttcccattcagttcctaacccaacacggcttgcagcttgcaaggaactgattgttcccattcttatcctgactcctgccttgaagaagactcattgcgcattgcattgtgaggtcaaggtgtagactgtagactcacggctcttttatcagcagcctgagcatgacgcaaaaacctaaccagagccgagaacaggcttgccccatggctgactctgactgagaccactgaacgacaggtgatgcgccgcaagcctacaaacaaaagtttgtttggctttaattcatatcagcttctgcttatacgatgttttatctctatagattgtagcagtcggctataatccgagacaaaaagctgctggctaggctagggcactgctacgggtggcgacaatgcagggttaggtaagattgacagcaggagaaggacaccgacaccaggtcgcagagatgaaagggaaataatggcgtccgcacatcctgccgacaggaacggacgtacagagttgacactccgagagccacacggaatggacgacatgttcgatgacgcctcgtccccgacatctcacaggggccccggaccccgagtggctaggactgggcggacggccgcggaccccgttccgttccttcaatcatcgccgttgagcagccaggtgtttaagat

SEQ ID NO: 10645 - DNA, 1679 bp, Zea mays
cattgggtacctcgaggccggccgggcgaaacaaattgcgcattttcttctcctgcggtccttccttcgcttccccgttcttccagaatcctgtcgagacctgaatccaccctcacccagcggtccccatggcctccggcgaaggtgtagttgatcagctgtacgaggcggctggcggcgaggcagtggccaagatagagggggaggccaaggtggaggcggaggccaagatggagacggaggagccggtgctgtacctcgacctgacgagctaccagctgcacgatctaagcgaggtggagatcccacccacgctggaggaggtcgacctcaccgccaaccgcctctcttctgttgatcctcgcatcggccaactcccccatctccgcaagctctcattccgccagaacctcctcgacgatgacgccgtcgcgccactcacgtcctgggaggctattgccgggttgaaggagttcgtccttagagataacaaacttacaaggattcctgatgctggcatattcaaggatcttctggtgttcgatgtatctttcaatgagatatcttctttgactggtctgtccaaggtttccatcaaattgaaggaactttatgtttcaaaaaatgaagttgcaaagatggaagagcttgaacatttccatgcgctggaaattcttgaacttggtagcaacagattacgggtaatggaaaatcttgaaaccttgacaaatctacaagaactgtggttgggaagaaatcgaattcgagctgtcaacttgtgtggtttgaagctaattaagaaaataagtttgcaaagcaacagactgacttcaatgcatgggtttcaggaatgtgctgcattagaggagttatacctcagccataatggaatccaaaagatggaaggcctctctactttgcataacctccgcattttggatgtttcagctaacaagctaacgactatagaaaatatcgaaaccttaaccaggctggaggacctgtggttgaatgacaaccaaataccatctctagagggtatagagacagctttggctggttcgcgggagaagttgacgacaatctatctcgaacgaaatccctgtgcaaaaactccagattactcgtcgacgttgaggaaaatatttccaaatctcgaacaaattgattcagatatcatagcatgataactagctaatccttgcccagatactaaggcaaagaaggctttggggttccccggagaagtcattaacagcaatcaacttgtgaggcgaacaatagacagtaatttgatccttaaagtcttcattgccaactctgctcgtgttgtggaagacattggttcggagtttgtagccttgagccgttacgggcttaatatagtgattggtaaccaaataattagaggtgtacgaggattgtcacaggatccatatccgtgttactagttttaagatgtttcatttcagttctctagattagtgttgatttttttttctctccaaatgaggctaggaacagccagcagttcatttctgtaagttgaatgcagacatctctgtgttgcatatcaacttgcaaggatgtgtcagcctgttgagaacccgaaattatcttttatttgaattttatttattactccaaaaaaaaaaaaaaaaaaaaaaaaaaaaaaaccc

SEQ ID NO: 10646 - DNA, 1105 bp, Zea mays
tttttttttttttttgacttcaaaacagaagaagcatccagcatcatagacttagagcatacacataagagagaagacatctcttctatgccaaataacttacagatcggagaagacgacatggcgtgtgttcttcaaccacagcattgaaaaactttatacattatacttaacttaggactagtaatgacgcatacgagtatactgtttctcactacctaatctctatggcgtgcgctacgagaggcacttaaaaccttctaacctgaagctactagatacacgcgcgccaacagaagcgcgaactgaaaacctgtggcgccatatatatatatactttacatctgatcgaacgacgccgacaggttgacggcgatgctcgacaggttcgtgtcccccaggtgcgacctcgcaaccctgtgttgcttgggcgcgccggggccctcgtcgtcgtcgtcgccgccggcggtttcctcgtctctaaaaccggacttcgccggcggcgtcgagaacttgaaatgctgctccctagcaaggatggtcgcttctttgaccgatttcgatatcaggaggaggttcctcagatcactgtggttcaccttgtaaaagatcataaccagtacatctagcgacagctggttgaagaggttgacgccgtcgtcctccatgtggaaccggacgctgcgctgcttgcgcagggtgcgcgtcggcgagtgcgggctccgggagcccggagtcggcgagacggcgactctcttccgcccaaaaattattgcgccgctcccgcagtttgagcagctcaagctcctggcaagggagcccttcttctcgtcgccctgtccaattgccatttcacctgttgctagctataatccctcctgctctccgcgtctggcgattcaaaaaaaaggatcacttatccagccggaagtccgattatctattctgccgctctcaacccaaaactccgcctcctcctcttcttcctcttcctctcgatagtgttcaaacaaaacaacaacctgcgatgtttccccctgatgctaagcaaccaaacctgcggctaatgcgggaggaagaagacccaaaccttggaggtaaaatt

SEQ ID NO: 10647 - DNA, 1234 bp, Zea mays
gacgataaataaaatacaagatataagtacgcataagattagagaagacatcgcgtgtgttcttcaatcacttctttgttgttcttcgttcgtcagtagagaagagattacttaagactaggaatcacgcatacgagtatactattcccactatctaggagcctctctatgacgtgggctacaaaaggcactaaacttgtaaacctgaaactactagatacaagcatgaacaaaccataaactgaaaacatgtggatgtcgtatatttgcatctagacctcggggagcatgctctcgaacgacgccgacaggttgacggcgatgctctctaggttctggccccgcaagcgtgactttgcagcccggtgttgcttgggcgcgcaagggcaagtgtcgtcgccaccgccggtttcctcgtctctaaaaacggacttcgtcgacggcgtcgaaaacttgaaatgcagctccctagcataaattgttgcttccttgacttgttttgacactaggagaaggtgcctcagatcactgtagttcaccttacacaagatttttatcagtacatcaagcggcagcgactcaaggaggttgacggcgtcgtccatgtggaagtggaagcggacgcttcgctgcttgcgcagggtgcgtgatggcgagtgcggggtccgggagcccggagtcggcgagacggcgactctcttcctcccgatgatccttgtgctgctcctgcagtttgagaagctcaagctggtggcaactggcaagagacccccttcttcgcgttgcccttaactaatcggagatcttgcaatgaagcctatctgcatggtattggagatagtaatccacttcctaaaaagaacaggagacgtcagcccacccctcacggcactgcgttcggcttctaagggccggtggtccggctcccgcctccggcctcgccggctcgcccccttaggcccctctggctccggtgcctgaacgggctgcctgtgaaacggccaccagcttctcaggccggcgccagccaggccatccccctgccaagtgcccaggccgtgctggacgtgtttgaagaaacgaacgccaaatcgaaaaaaaggtttcgggaccaggaggaaaattcacctgttcttccgctgtcaaacccaggctcctcatgcgcctctcgacaggtgatcacctgggatgtttgctggagcctggaggaccaaacctattctaggtaaaactg

SEQ ID NO: 10648 - DNA, 631 bp, Zea mays
ttttttttttttttttggaatcatggaatgggacgttggaacggagaggaaggaatagatggaactgggcctaagaaacagaagatccaaccaagagcaattaccagtacatctagcgacagctggttgaagaggttgacgccgtcgtcctccatgtggaaccggacgctgcgctgcttgcgcagggtgcgcgtcggcgagtgcgggctccgggagcccggagtcggcgagacggcgactctcttccgcccaaaaattattgcgccgctcccgcagtttgagcagctcaagctcctggcaagggagcccttcttctcgtcgccctgtccaattgccatttcacctgttgctctccgctctccgcgtctggcgattcaaaaaaaaaaggatcacttatccagccggaagtcggattacctattctgccgctctcaacccaaaactctgcctcctcctcctcctcttcctctcgatagtgttcaaacaaaacaacaacctgcgatgtttccccctgatgctaagcaaccaaacctgcggctaatgcgggaggaagaagaccgaaaccttcgaggtaaaattgggaagagctgacctcccattctccgtttttatagtaacctccctgtatttt

SEQ ID NO: 10649 - DNA, 851 bp, Zea mays
  misc_feature (54)..(54): n is a, c, g, or t
attctcaatattttaggagcctctctataacgtgggctacaaaagccactaaancttgtaacctgaaactactaagatacaagcacgaacggatcacaaaactgaaaaccatgtggatgtcgtatatttacatctagacctcggggagcatgctctcgaacgacgccgacaggttgacggcgatgctctctaggttctggctccgcaagcgtgactttgcagcccggtgttgcttgggcgcgcaagggcaattgtcgtcgtcgccgccggtttcctcgtctctaaaaacggacttcgccgacggcgtcgaaaacttgaaatgcagctccctagcataaattgttgcttccttgacttgttttgacactaggagaaggtgcctcagatcactgtagttcaccttgcacaagatttttatcagtacatcaagcggcagcgactcaaggaggttgacggcgtcgcccatgtggaagtggacgcttcgctgcttgcgcagggtgcgtgatggcgagtgcggggtccgggagcccggagtcggcgagacggcgactctcttcctcccgatgatccttgtgctgctcctgcagtttgagaagctcaagctggtggcaaccggcaagagacccccttcttcgcgttgcccttaactaatcggagatcttgcaatgaagcctatctgcatgggattggagatagtaatccacttcctgttcttccgctgtcaaacccaagctcctcatgcgcctctcgagtctcgacagtgatcagatagaccacctgggatgttttctggaggaccaaacctattctaggtaaaactggtttccccggccggcctcgaggtacccaat

SEQ ID NO: 10650 - DNA, 805 bp, Zea mays
cgggaatataataacagttgcaaccacctttgccccaattgtcaaggccaccatctgggccccccgggccccgccggggcttatgacaagtaccaaattcatttgggttgactcatgcaaatgctccgcagcacatgttacaacaaccaatgtttcatccggttgcgaatcctcaaactaatttcctccctggccaaccaccattgcctagccagccaccaccacagcagctgtaccaggctagttcacactacaatacacaaaatacgactccaatgcaagttgataggggcgctccctgggggcgggcccctgatgctcccactcctggctctcatttccctggacaattacccgggttgcccggacaaatgacccaaggaattggtggtatccaggcaggccaagcaccactgacacctgagatggaaaagatgctagtccaacaagtcctgggcatgtccgctgagcagattaacatgttgcctccagaacaacggcaacaggttcttcaactacgagacatgctacggcaatgatagatcgtcagttgactgggtggagaagtttcagttcactgcagcagggatcccgagtgtgggtgcctgttcgttttagccttttgtatcacctgattgacatcccgactagtctgcagcctaccttggatatgcgattgtagaatggtagtcgttgtcgtcatttatagaaatgcttgggcaatatgttttccgaaggactcacaaatgaactgcatgttttggtccagttcacccgcttcaatttcaagtcgtgttgctccttt

SEQ ID NO: 10651 - DNA, 819 bp, Zea mays
  misc_feature (716)..(716): n is a, c, g, or t
cctcgaggccggccggggtgacagtcaaacccgccgtccctctgatgcccaaatctctctgggattgggatctccagttgcccgatccccttccatgacacgcgaaatgcacgccatcctcgctgggattccgcagtccctccggcccgcggtgctgatcgcctcgacgtgcgcgctgctcctcctcgccaccgcgctactccttccgcgcgctcctccggcggcgccggcggcggcgctgaccactgtcaccgacgcggacgccgtccgcttggacgctagcgtcacccgaaggaacggcaacgaggtgctgtggcagctaccgcccccgtcgtccccactgcgagccgcgttgttcgcggcgcccgggtgcaccatccgcgccaccgacttcttcgacgcctccccgggctgcccgcgctgcacggggcttcccgaggagcgccgtttcacccgcgccgcgctcagccgcgggtacgccgtcctcgccgtctccagccgcgccaagtgctggtccctcgacgacgccggcggcggggaggacggcaccgcgcccccccccccatctcaacatccaaatatggccctacctcatgctcctccacagtattccaatgttccatcacatatacctatagttcatagtcagccacagcaacctttgcaaagtcctgcaatatataatcaacagttgcaaccacctttgccacattgtncaggacgccttttgctcatcagatgcattcacaagtaccaaattcatttgggttgactcatgcaaatgctccgcagcacatggtacaacaaccaatgtttcat

SEQ ID NO: 10652 - DNA, 598 bp, Zea mays
gacaaacgacagcggcctagccccgcctccccgttatccgacctatccccagcgtcgttgggtcatctccggcagctcccccgctaacacctccatggcgtcgaagcaggcggcggctggcgaagcccttgcggcccaaatcaacggcatgtcccgccctgagatgtacgacatgatgtccaagatgaagaccatgatcgaccacgaccaggagacggtgcgccgcatgctcgtcgacaacccggacgtcacccgtgcgctctttcgggcacaagtggtccttggaatggtgaaaacaccaaaaactacacaagctttggacatggtccaacccacagcagtgtcaacagcaccttcctcagtcaaaactactgcaccagatcatgtcagcttgcccccgcccccattacctgctaaccagcagagtgttgctcaactttctgccccgttttcatctggcttgtctaatgtgggatcgaccatggaccctcctactatttcagcaaatccaccacaatcagcacaagcaaaaggataccttatccatcagatgccttcatcagctcctcagccatctcaacatccaaatatggcccta

SEQ ID NO: 10653 - DNA, 3433 bp, Zea mays
ggtgggtagaatctgggtgtttggatacgcagattatgagattgtagattctgattaaaaaaagaaaacagataaatacaaacaaccaactagtgcattaattccgttggggcctgttgtatgcattgacagcattagaaatacatgttggcattctcttagtgctatgagttggtattctgtattaatttttataccaactgtatttgacatcaattccgctcgaattagtttattttttaaatatcatgtaagtttgtgtttgtttttttatccggttagaatctaggtatttggatacgcagattatgagattgtagattcttagtgaaaaaagaaaataggcaaagacacaataattaaaacctgattaaaattatacatgatttgtctattacaatataactattgaccggttcagataacaaaccatgacactaagcattagctttttttcggcatggatgtaaatggcccgtatatctatctaatataatgctcgtaattaacatcacggctaaagtgttgatgattactgatcgtcctagtacagttagtgcgtatttaccagtaatataatcgatgtgggttgagataaagagagagtcagacgtacgtacgaagcagatgagaccaggattcacgagacttcacacggacgtggtgctgagctgcttctccgcagtcgttgaaaacctgcttctcagaaaatcggcggtggctagaatcacctcagaatctagacgtttggacaccaaaacccgcttatggcggccagaatcggctgaaaagtcgaaccaaacacgggccatgatggatctcagctggagtccacttcatggtaaattctaaattcaaaaaaaaatattagagaaaccgagcataaacataatgtagacggcaggcatcaaagcaagtgtatgcatggctctggcctacacccacgtactacggcggcggcggcagcagcatcggagttgagagtaccgtcgcacgtgacgtgagacgttcaatggtccatccatgatatggatggaatcatttgacgctactactacgaggcgggaggggagatgataagcatccctgctactgctactgctacgcaagcaggccatcaagtttggcacgcgcgaatatgttcttcgttagctttatatatagaagaataagaaatatatactatgatcttatggtcgctatgtttgtgcgatgcgttgtcgatcgctccctccgactgtattattaacgtgtgtgtgtgtgtgtgtattcagatagatagatgccttggtcaagagcatctgcagtgcctcaatgaccattagctgtatacgtactatggagcaataatagagcgccacctgatttctaattatttggaccataattaagcactcgacattgatttcttaggctcaagggaaatcgaaatgttcgatccaaccattattccaagatgcccagatagattagatagaaagcgagtcaagtaacggatggagcacatatccatccatttgcttgccgcccctgctccaccaccatcaccgtaccatattatcctatcctatcgagcaagagcacagatgccctcagcctgctctcccctcgcgttctcgccacggcctacggcgctatatataaagcagggggaacccccgaccagccagacccacacaaagccaaggcgcggcgcagccagagtaagcagagagttgcactaccgtgcttcttcagttcttcttcctagtatgcactcgcttgtgaggcgtggcaatggctacggctacggctatggtggttacggcagcagcaatccccatatgaactaccaccgccaaaacaccgagtccgtgaccaccgtcgtcacggagatgaaccgaatggccgtcgacgacaagccctgctacggcggcggcgtgcagaagcaggcctgcaaggtggaggcgttccaggagcacgacgaagcgtacaagggcgccgtggccgtgcagcagaagcactcctccttcaaggaggacaaggaggaggtgcgcggtgctgctgccgccgtcagaagctggcacgacgagttatacaaggaggaggaggaggagaagcgcgtcgtcgacacggagtacggtgcccgctacgggggtgtggccgccgtgaagaagccgggctacaactacaagcagcacgaggcatacggggagaccgaaggtgcagggtacggctacggcgccggcggcgtgaagaagcaagcaggctacagctacgcgcaggaggcgtgcggagagagctacggcggcgctcaccacggtggtgccggtgccgtcgcgcagacgtacgcctacgaccagcagcaggcctacaagcacaagaacgcggcaggggcgggggcggggtacggtgctccctacggtggtggcgccgtgcagcagcacgacggacacaaagatgtgtaccggcacggcgccgccgccggtggcaaagtaaagaagaacggctaccagtaccaagaggcgtacggcggaactgacgcaggagggtacggtgcgcactacggcggcggtggtggcgccgtgcagcagtacgggtacggcggcgccactaccgatggcaaagtgaagaagggcggccaccagtactacggcggaagtggtgcaggagggtacgactctcactacggcggcggcggcggtggcgccgtgcagcagtacggcggctaccataaagatgcgtacgggtacggcggcggcgccaccgccggtggaaaagcgaagaagagcggctaccagtacgaggaggcgtacgctggaactggcgcgggaggatacggcgctcactatggtggtggcgccgccgtcgctcagaagcaaggctacaggcagggcatatacgagagcgagagcgagagcgaaagcgagagcgagagcgacgagagcgactgcgaggaggcgttcctgccgcacggcggccggacgccgcagggcggcgtgcagcacagctacggctacgggggcggggcgtacaagcacggggctggcaacctcggcggcttgcgccgctaccagtcgtacgagagccgcgaggatctcggcggcggacgccgctacgagacctaccagagcaccgtccagtacaccggctccccgaccaagaaccgccacgtcctacgctacggcgcgtaggcatatatacgctctgatccagttgcattgcagcacgtgcacctacgtatattcctatgccgcgtcgtgtgactcgtgtcgtataggcaggcggcaccgctacttggtgggccttgtgtttgctggtgcagatcgaaaaatctgacaataagatgtacttaatgccaccttgatataataatgtatgaagacgaaactttgaaaactgttttacgcgggcggccgcccccgcggcggtgctcagtactgcaggcatgcaa

SEQ ID NO: 10654 - DNA, 1066 bp, Zea mays
ttgcccttcgtggggccggccgggacaccaacacaaagccaaagcgcagcgcagccagagtaagcagagagttgcacttggggaaaaaattaccgtgcttcttcagttcttcttcctagcatgcactcgcttgtgaggcgtggcaatggctacggctacggctatggtggttacggcagcagcaatccccatatgaactaccaccgccaaaacaccgagtccgtgaccaccgtcgtcacggagatgaaccgaatggccgtcgacgacaagccctgctacggcggcggcgtgcagaagcaggcctgcaaggtggaggcgttccaggagcacgacgaagcgtacaagggcgccgtggccgtgcagcagaagcactcctccttcaaggaggacaaggaggaggtgcgcggtgctgctgccgccgtcagaagctggcacgacgagttatacaaggaggaggaggaggagaagcacgtcgtcgacacggagtacggtgcccgctacgggggtggcgccgccgccgtgaagaagccgggctacaactacaagcagcacgaggcatacggggagaccgaaggtgcagggtacggctacggcgccggcgccggcggcgtgaagaagcaagcaggctacagctacgcgcaggaggcgtgcggagagagctacggaggcgctcaccacggtggtgccggtgccgccgcggagacgtacgcctacgaccagcagcaggcctacaagcacaagaacgcggcaggggcgggggcggggtacggtgctccctacggtggtggcgccgtgcagcagcacgacggacacaaagatgtgtaccggcacggtggcgccgccggtggcaaagtaaagaagaacggctaccagtaccaagaggcgtacggcggaactgacgcaggagggtacggcgcgcactacggcggccgtggtggcgccgtgcagcagtacgggtacggcggcgccactaccgatggcaaagtgaagaagggcggctaccagtactacggcggaagtggtgcacgagggtacgacgctcactacggcggcggcggtggaggcg

SEQ ID NO: 10655 - DNA, 832 bp, Zea mays
ttgggtacccctcgtcgaccgcccgccgggaataccaaaccaaagccaaggcgcggcgcagccagagtaagcagagagttgcactaccgtgcttcttcagttcttcttcctagtatgcactcgcttgtgaggcgtggcaatggctacggctacggctatggtggttacggcagcagcaatccccatatgaactaccaccgccaaaacaccgagtccgtgaccaccgtcgtcacggagatgaaccgaatggccgtcgacgacaagccctgctacggcggcggcgtgcagaagcaggcctgcaaggtggaggcgttccaggagcacgacgaagcgtacaagggcgccgtggccgtgcagcagaagcactcctccttcaaggaggacaaggaggaggtgcgcggtgctgctgccgccgtcagaagctggcacgacgagttatacaaggaggaggaggaggagaagcacgtcgtcgacacggagtacggtgcccgctacgggggtggcgccgccgccgtgaagaagccgggctacaactacaagcagcacgaggcatacggggagaccgaaggtgcagggtacggctacggcgccggcggcgtgaagaagcaagcaggctacagctacgcgcaagaggcgtccgaagagagctacggcggcgctcagtctcaccacggtggtgccggtgccgccgcgcagacgtacgcctacgaccagcagcaggcctacaagcacaaggacgcagccaggggcggggtacggtgctcgctacggtggtggccgccgtgcagcagcacgacgggcacggataccggccgaaagatgcgtacgggta

SEQ ID NO: 10656 - DNA, 3515 bp, Zea mays
  misc_feature (3469)..(3469): n is a, c, g, or t
tgatccccgatccctaggacccgccgaccagtgagtgcgctgaggaaagagcctcagatcggtggggcccattagtcagtcagaagagacaggtgcgccaaccctggaaggacactcccccggtcgaaccctgcggcaccgagcccggggccgaggatggtagagcctaacaagggaggatgagcgtgtcggaagggaaccactcgagtggatcccgcacccggccccggactgacccgccataaataattggccgcattaaccacgcttattaccgagccacaatgtgggcgccggtccgcttgccactcatgacctatgagcccctgaactatgacacattaataactcgtgcgcccctcgtcctgtggcgtacttatgttctatcagactagtcctgagtacgcagatctcccgcaaggcactacacgacgagtcgcgccgagccccaggctacaaaagctaggttcaacatagctcgaatgatggtgcctgagaccatcgccgaccccgcgttatccaccacgataaatacgcgacagcgaggcagccccgggcccccacgagtacgttttgcctcacccagggtaaaaaattgattttacccctgttttacggctccttcctagagaagccactgccgaccgacccctttcctatcctataaaagggagagggctgcctcagggtagggggatcaacggataaaagaacacatcatataccacaataaatacacgacagtctggcaacccaggccccatgagtacgtgtggactcacctggggtaaaatgctggttttacccctgccttacgactccttcttagagaacccaccattggtcgacccctctctcgtcctataaaaggaagaaggcggcctgggcaggggggtcgacggataaaggaacataaggacacttggagacaaccggacaccttgagacggatacgagcccacaaggacgaaaagaaggaggagcgccaatgaggatcaaaaggtcggagccctgctaagtcaaggcttagttaggactccacattatagcttcaaagctccacttccacccccaacaagaattctgggagcctctcctccctctctcgactgcttgtaacccctactacgagtttactcattcatggtgctggtagcacaagccaccaatgactgtatgtagggacattctgcccgaaccagtataaatcttatgccctccgcgcatgccctccggagctcggaacgagctctataaatttacttgttggagcgagatacgaaacaccgataggccaacacatggaactatcgttccacgtccctcgaaaccgatctcatctagcgcgataagtaaaggtaaagtcgtcgtcctagcaagaaaaaagagaagagacgcagatcgatggaaagtccctccaacacaacaagatataacattattattgtgcctagggttcatgggagatccatagaatttgatgcttacatatattaaatcaggaccgtccatttttttcaaatgtcctcatgtatttacctcttcatgcacatagcaaggtgaaagtgatagaggatagtaatagagagtgttatttgtaaaacatataggacaactagagacattagatctaatattgatgatcacgataatatagatggtcatgatttaatatgtgcagtgtgttcaccaaatgtttatgtgtatatgatagactctctctgttttttatttttgtgttttagtttaaaaataaactagccggcaacaaatattaaggacaacatatcaggtgcaaaccaagtttccatttagaccccgtgcaaaccaataacaaaagtcacaagatttttttaaaaaaattatagatgtactttattgcctactttaccactgtataaaatttcaagttcaaatcatcacatgttaagagacacaaagaaaagaaatatctaagatacaaaaagtgaaaaatatctcagaatttaatctttttggtatcttttaatatatgataaatttgaatttaaaattttatatagtggagtaggcaatgaaatacatctataattttttgggaatcttttttggattttataagttggtttgtatggaaacttggtttgcaactgatacgttgccaatatccagaatggaggggatatttccttttttcttgaataaagaagaatatatcagtcattaatgcgtgctgttaccggagtaaaagaggatactctaactaaaatatttttgtgtgaatctaaagttgtcgtaagctaaacactttttgtggtgaatttagattcactagttttgccatcaatctcatacccgaatctaaagtcttaaaagctacgaggattctcggtgcctcacagcagccacgtcgtccagaaaaggtcagccatccgattgaaaccccatgtcatttcctcgtagcagatgctgccacagcatgtgtgttgtgccgacgcggacccaaaaatttaatcaaattcagcttccaatggtccacgtccgacctctagtcccaccacgcccatgcctcctcgggtcctcctaaactcgtcgccagccccgcctccacgtcgtcgcccgtgctggctagctccgctccatcggcccgccttacctctagcctcgtcgccacggcgacagcggcgatgctgatgcaaggcgccgtggtagtgacggactgtaccccgacgggcgtagcgtcgctgtcctcgtccgtgcggtgtcggctgggcccggcgggcgggcacgcggggaagcggcgccggctgcggccgtccaagcgcgcgcccaccacgtacatcagcaccgacgtcgccaccttctgcgccatggtgcagcgcgtcaccggcgccgacgaggccgacctacagtcgccgcagcaggacgggcttaaccttggcctcctcctgccgcacctcggcgtcgagctgttcctacaggcggcgggacacgcggcgccgcgcgtcgctgctgcaccgtacacgcctgccccgcccgccgcggcagcggagcagcagccgctgtacccgatgctggctggactcgtggaacgtgatgtatgggaagaagaccgaggtggtctcagccctgactgaccaatgaaaccgtcccgattgttccccatccgttccagttccaggcaagcctgtacgtgcctgcgcagcattagcatctaccgtcgatgatctgatcagcagacgatcccttcttctccatggcggcggagaagctgtacatcatatattcatatatcagttggggtgacctcgagcgtggactaggggatggagtagcagagttgtgttaatcagagaaccagcagtcatgcgttctattgtctcgtggtctgcagttgcatctgctgatctgcactttgcatgctttcccatgatcccgtcaatgtgagcttcctgctatttgtgtaaaaatgtctctttggcagtggccncaaaattttcagctgcaccagcaccacgccaaaaaaaaaaaaaaaa

SEQ ID NO: 10657 - DNA, 1520 bp, Zea mays
ctccctgtcaatataagtgcgcgaagcaacatattgctgatgtttgagcacaaattggtctggcgggtagacaaaactaaaactagtggcaggtcagaacagtacaaatccctattttttacgaatgtttgacaactttttcatcaatgtttgatagccttttttactataatgtacggacataattctaagtatatatgtaaatggagtatacatataaatggagaaatattatttatatatgtgcgtaatgcgtagcaacataggtgagagagagagagagacagagagagagagagagagagagagagagagagagagagagagagagagagagagacgagagagacgagaacggggaatgctgatacaatacaagaacacccagccggatagacgcaagcgtatgtatgtctcccaacgtcaatcgctgaaatcgatagtggcggtggaaaggatgttgtccccggtggtggggtgcgccgccggcacgtcgttcaccaccgcagtcccctgctgccacacgtgggtgaacttgctgctcccctgctgcccgttcccggccggcagcgccagcgtcgcgtacagcaccatctccttcccgtccacgtactccgccgccacgtccgacaccgggaacgccagatccccgggcgccgcgggcgccatggacggcgcgtagctgtcgagcagcgtcgggtacgcgacgaggctgccgtcggagcgctggaacgcgaccacggcctgcgtgccgaccatgccggcgcggccgctcgggttgatcccccacgccacccacccgtcgtcgcccttggcctgcggcgcccggaacgcgacggcgaccgtgttggtggcagccgtgtagttgtagtgcagcgtggcgccgaggcgtggcaggtccgcgcacgacgcgtaggggttctgcccgccggtggtgcccgagaaggtgtggcttgagcacggtgccgccttggcggcggtgctgctcggaggaagcgacgagagtgcagcgatggccatggcgacggcgagggagacgaaggtgctggtggtggagcctcggcgaccaacggcggcagctgccatcgtctcagggacacactctggtttggctccctacgacggtagttgatgtgcccgtggaactgatgtgcatatgtgatggtgggagcatgagctgcgtcgtgaactatatatatatgggcgggtctggatggaggcgggtagaaccgtagaagacggtaataaaacgcacgtctatctgggttggtaagaccacgcttttgtgatttgcgtctctggtcgtctgagttgcagttacgacggttgtgaactctgctgctctgctcatgtcacggattttaattctagaagcaccgtcacctagtcgatttcataattcattaacacaatcggtaggtcatctgaaataatttgatcaccagccttttgcgagccgagcatggctgcatggggtttctctttggcaatttcgccgtaaacagtaagggtttgttcgg

SEQ ID NO: 10658 - DNA, 510 bp, Zea mays
ttctcatcctccttcaccatcctggcagcttgtctgcttaaaacgctaacaatcctttttctttttgccccttcaacacccttgttgagccactcataatcagggtattcaaattttaaagcgtccattacctggtttaaccttcattttggccgggtgcctaaggctgctgtcattaattggtcttcttttttagtatagttccccaaaatttcattacacatagtttcaatcatttccagccattcttggcaaggctccttgaactgtttctcaaacataaaacgataaggtaatcgaacaagttcatatttcttctttgttccctttagctttggcatgccctaatcacttgacgtcggagatgtcctgttggctaggtattcttgcaccaggtctctggtgctgatttgttcagccaccaccctgaattctactgcggccagttggcatggtgaccctagctgcatggttacacaggggccgggtcattctgaagtttaaagattg

SEQ ID NO: 10659 - DNA, 1671 bp, Zea mays
agccggccgagcagggtaagaaggggtagacaaaatgcctcgagccgaggtccgagtaccaagcgctgcagcgcgggtgcctcccgcccggcctgtgggtatccctgcctccgtggtagaagtcctggcagctccagctccaagcgcattagctcgacctaattccttcttcaactgttgtgtacttgtgtgggtgtctctctccctctgcccgagatgttgtctctgagctgcagctgcccaggggtgtcgtccatgagcaagacggcgctcgattgggggcacctggtggcctcctgccgcagccgctggcacggcgcgcgggcgccgcccagacggcggcgcacgccatgtgtttgcttggttgcctcaccgaccaccacccagcctggccctgctgctgttgatgtgccctcacggacggttcctgctgtcacaacatcaagcgcccctgaacgcatttctgtttctgcgctgctcgaggttgtctcagacgacttgctcaacctcaacaacaatctcaaatcgcttgttggtgcagaaaatccagttttagtttctgcagcagaacaaattttcagtgctggtggaaagaggttaagaccagcattagtttttctggtatcgagagcaactgctgaattagctgctttgccggagctaactacagaacatcggcgcttggctgagatcatagagatgattcatactgcaagtctaatacatgatgatgtcatagacgatagcgggatgcgaagagggaaagaaacaatccaccagctgtacggcacacgggtggctgtgctcgctggcgattttatgttcgcgcagtcttcttggttcctagcaaacctagaaaacattgaagtcatcaagctcatcagccaggtaattaaggatttcgcgagcggcgagataaagcaagcgtcgacgcttttcgactgcgacgtgaccctggacgactatctgctgaagagctactacaagacggcctccctgatcgcggcgagcacgaggtccgccgccatcttcagcggcgtgggcagcggcgtgtgcgagcagatgtacgagtacgggcggaacctgggtctggcattccaggtggtggacgacatcctggacctgacgcagtcggcggagcagctcgggaagccggcggcggggagcgaccttgccaagggcaacctgacggcgcccgtgatcctggcgctgcgggaggagccccggctgcggggcatcatcgagtccgagttctgcgagcccgggtccctggcggccgcggtggagctcgtgcaccggggcggcgggatccggagcgcgcgggagctcgcggaggagaaaggcggcctggctctgcgcagcctgcagtgcctcccgaggagcgagttccggagcgccctcgagcgggtggtgcactacaatctccagcgggttcggtagaggaaggtgctgtgctgtgcttccatgtgacatggcagtgcgtgttgtttagtgtaaccgacactgccgcgtgcccaccaacctcgtggagcatgcatctgtaagagcaactctaatagttctttaaaaaataactctccgcactagtagcatggtgtgcagtggttgtgaggttctattgttgttgtaactacaagcaggtaaactgttctggacgacaccacgatgtat

SEQ ID NO: 10660 - DNA, 3692 bp, Zea mays
ttaatgaattattatggccgacgggagtaatcccgattcctgttgtgacacgacggattttaagttgatttgagtgatttttatcgaaacaattctctaaaaaacgagctgataaacgtttttttttgtgatagaatcgaattctagaatatgatccttttttttttttttttataaactgcagatttggagggccctttatagcttaacagagtcaaggaaaactgaagcacggcttacgtacacatgatccaataatacaatgctgaaaaaaagaccaactactatgtatgctatgcaatgcaaaccggcccggacaccgggctgcatgcgctagaatctagggctagcgctagggggtagtacgtcgaaggaagcgcgccgtctcgtctcacatcaggtggcctccgccatgaagcaatccggcggtttgtggcgccgctgccgccggaaaagagaagtctggccacattgaacccgcagcggcgcctggcatcttccacgtgtccacgctgtcgttgtccaccagcagccccgcggcgggccagaggaaggacgacgacccggctgcggaggcacctcctccccccatgagcccgaggccttgcatttgtccggccgcgcccaggtgtaaggcccccgtcgggagtccgagcccgaggtcgaagtcgaacgacgaccctgcgccgcggccttcgagcagcggcggccccgcgcccgcggcgccgagcgcgaacagtgagccgaggaggccgccgctctgtccctgtccctgtccctgtccctgcgacgacgatgtcgacgacgacggttgcaagggaggaggcatcatcggcgtgaggccgaagacgtgcggcgccggaggagcgagcctggcgtgctggtggtggtgcgccaggcgcgggcgcttgcgcgtggacccgccgacggggacgttgcggagggacccgcccagcgtccagtagcgtcggcaggcgcggcagaagtggcgcggctgggacgtgttgtagttgttgtagtagcagaacttggtgtcgcgcgacgcgcaccgcgggcactgctccccgcgcgccgcgccgccgccgccgccgctcttggccgccgcctcggcgcccgcctgctgcaggtgctggaggtaggcggccatgccgtcggccgccgcaccgccagccgcggtagcggtgctgccgttgctgttgttgttgccggaagtggcggccatcgtcgtcgtgtttaggtgcttgcaggtgttgttgtactgatgaggtagtggcgcgaacggcgccatggtgggaggctgcagccggcacgtctgagcttccatcacttggcccgccattggatagttagctagctggggattggagatcgaagttggtgacgacgatctctgtgcgtacccagtcctatatatatgtgcttcgtgctgctgtttggacacgccgacccaaggggtcgtatatgctagaggacgtcgctgcaaacgcagacacaacagacagagattgagaaagacggatggtgacagaaggctgacgagtttggctgcgggccgccgagctcagctacgagccaaggaattttaatcctagctagctaggactggtcagtggtcatatgaccacctgctagctagctggtgtcgtagcttcttgcagctaatacatacaacctccatccaccgttgattgtacctcagggagtattttggcaagcccatgcatgcacacaacacattacgcatgacgtgggtgagggggtgcaacgtggggtgctgcaaccgaagcagcgcgcggcaaagaggcgcctatctatctagacaacgatcgatcgatgctactacggatcagtccttccttgactggacccatgcagatgcggtgctgggctgggccgggcccgactagacctgatacgttgctgtcatagccatgcaccccggaccagcgaccacgacccagcatcaacctgcatggtctcttgctgtccaggggctgatgggacccgcgtgcagtgcagcctgggggcggggcccagtccgtccagccccccggccggcctgcagctgaagctgcagcctttgacgacgcgcccagtcgcgtcgcgtggcatgctggtccgggggtggccaggcctacgttactctactctctccggccactctcgttcgttcgtctccctgtcccgggccacgccacgcccggacaaagccaggagccagcatatgccggccggccgacgccgacgccgacgcgcgtaccaccaccaccaacagccaacagcagctgctgcagcctagcagcactgtagtgctcctgctactagtcctaggcgccaatttggtcgccgtctggatcgatcgatcgaacgatcatgacggccgcctgagtctgacaaggcggctagcattccaaggccatgcacgcgaatgcgacgatggccgtggcccctgggccctggcccccctgccccgcgttttgcatggcaatgccgaccggtcggcacgtagctgcggtgctgctgctatgctagctactggtgctggacatccttggcgccttgcgcttggagccgcctgttgctccccatatgcgcaccgggccggcacgctagctactgtatctttttctcgcgtgccactgccagactccggaggacggcacgcggcaggatgcacccgacccgacagtccctgccgccgcccgccaacacggacatggacaggatggcccagctaaggcctgtttcaaacggctttttttactctgacgttcttttcaagctggattacggggtagctgcctataaggagtagttagaattagggtgtttagcaaattgactgcagataagaatctaggtatttggaaaacctgattttctgttcgcagattctacccgtcactatgggggtgtttggttgcccctgctaaaatttagcctgggtcacatcaagcgtttgactttcaaataggagtatgaaatatagacccaaccaactggactagattcgtctcgtcttttaatcttcggctgacaaattagttttataatccgactacatttaatacccggaacggaggttcaaacattcgatgtgataggggctaaagtttagtttggggtaaccaaacacccccctatgatgttgccctcccacatgtaaaagtgtatcatagacgcatttacaagttcatcgccacgagggcgaccacatattaaatacacaattccacaaatgcattgacttagtacattacgacagaagcaacgtaccactggtaggtcaggccactaacgaggcaacaatcgaatctcgaaacacgctcatgtataacttacgtgatggcccactactacttttcgttactcctacatcctctaactcatctgatggtccactactgccttttcttacccctacaacatcacttacattcatctagatacaaaattttcagattcacgatcgtatatggtatccctagtaaagttatgcaacgccatacatgctataagtattttcgattccttccgcaacaaaaaaaagagagactgagcaagatatgtcacttcaacttcaacacatagaatgattgctctatgacatttcttagtaatgagtgtatagagttgaatacctctttcacacctataggatttctgccatgttgccattctgtaatgtggta

SEQ ID NO: 10661 - DNA, 1506 bp, Zea mays
gttcgctttcctttcaggtcttcattgacatttacccatgtcccgcctccccctctcctccgccctcccagtccatctctccagtgatccagtcctaacactcccctccgcgccgacgcctctggtgtctggtcaggcggtcaccacttcaccaacaggcgccaccacaccaccgacccatttgccgcgttggtgttgccggatcttcaagcaggcagcacaccccacccggacccgagaacccgcgcgcgcgcgtattaataacggcaacctcgctcgcggctcgccgagggaatcgcacgcacccagcgatcagcgcagattccttccacgccccccctcctttccaggtcccctcgcccgcgctctcagatctcgcgcgcctcccacaagggaaaccttgagccatgggcacagttgtggatgccgctccagcagttgtggctgaggtcactgagaacatgttgggtggcaagaaagttacagttgtatttgtcctaggtggtcctggaagtggaaaaggcacacagtgtgccaacatcgtggagcactttggattcacccatcttagtgctggagatcttctgcgtgcagagattaaatctggctctgagaacggaaccatgattgagaacatgataaaggagggaaagattgttccatcggaggtgactataaagcttttgcaggaggcaatgataaaaagtgaaaatgacaaattcctgatcgatggatttccaaggaatgaggagaatcgtgcagcctttgagaatgttaccaaaatttctcctgcatttgtgctattctttgactgttctgaagaagatatggagaaacgactcctggggcgcaatcagggaagggttgatgataacattgaaactatcaaaaaaaggttcaaaacctttgttgactcaactctgcctgtcattgagcattacaactcaaaggacaaggttaaaaagattgatgctgcaaaaccaatccccgaggtgtttgaagacgtcaaagccatttttgccccatattctctaaaggctgaatagagcaatctaagggacatgataaaggtgatacatggtgtctaggcaccacataaacatatctgtgattatgatggaccctttaatatagaacaaaagttttggctcatttgagctaccagcgtaccagtaggcaattcgatttgttaccagcaacaagtgatctgattcccagtggtcctgctagagtaacattttttaccactgtctgttgtctatgtatcctttgatattgtgttgtaccaatgtgcaatttactctatggactgatggaacattgtgccatcccatccaccagatttattgtggcgttatggaaagcatagaaccgctgccatattctctaatttgtacgctgaaatatactcgttggcaccgaacttttggttgatgacttcgtgatataataaccctaccggcagtaaatatctacgctcaaaaaaaaaaaaaaaaaaaaaaaaaa

SEQ ID NO: 10662 - DNA, 1254 bp, Zea mays
ggggtgcgatccgcgatgctggcgcgggggcaaggggggtctcggtttgaattagttgctctcgctgcgcgcgccgcccacctgaagggtgcgccaggtgctcttgctgtgtgatctttgtcgccttgtgacgctcgggaccgggttattggcgggagtttgtcagaataatacataaagaactggtgccacgagatcgggggacttcagatcagggaaaccttgagccatgggcacagttgtggatgccgctccagcagttgtggctgaggtcactgagaacatgttgggtggcaagaaagttacagttgtatttgtcctaggtggtcctggaagtggaaaaggcacacagtgtgccaacatcgtggagcactttggattcacccatcttagtgctggagatcttctgcgtgcagagattaaatctggctctgagaacggaaccatgattgagaacatgataaaggagggaaagattgttccatcggaggtgactataaagcttttgcaggaggcaatgataaaaagtgaaaatgacaaattcctgatcgatggatttccaaggaatgaggagaatcgtgcagcctttgagaatgttaccaaaatttctcctgcatttgtgctattctttgactgttctgaagaagatatggagaaacgactcctggggcgcaatcagggaagggttgatgataacattgaaactatcaaaaaaaggttcaaaacctttgttgactcaactctgcctgtcattgagcattacaactcaaaggacaaggttaaaaagattgatgctgcaaaaccaatccccgaggtgtttgaagacgtcaaagccatttttgccccatattctctaaaggctgaatagagcaatctaagggacatgataaaggtgatacatggtgtctaggcaccacataaacatatctgtgattatgatggaccctttaatatagaacaaaagttttggctcatttgagctaccagcgtaccagtaggcaattcgatttgttaccagcaacaagtgatctgattcccagtggtcctgctagagtaacattttttaccactgtctgttgtctatgtatcctttgatattgtgttgtaccaatgtgcaatttactctatggactgatggaacattgtgccatcccatccaccagatttattgtggcgttatggaaagcatagaaccgctgccatattctttaatttgtacgctgaaatatactcgttggcaccgaactttgggtt

SEQ ID NO: 10663 - DNA, 1512 bp, Zea mays
cattgggtacctcgaggccggccgggccccctcgtgcccggcccggctcctccctccgcgcgcggtccgcgccgcggaccgcggaccgcggtcaccactcaccagaagcgctgcagcgccaccccagtcccccaccggccaccgaccacttgccgattgccgttgccgcgtcggcgttgctggatcctcaagcagacagcccagtccgcccggacccgggaacccgcccacgcgcttattaataacggccacctcgttcccccgcccgccccgaaggccgagggaagcgtacgcgcctagcgaccagcacagattcgttccacgcctacctcctgccctcgcccgtgctctcagatctcgcgcgcgccccgcaaagggtaactttgagccatgggcacagttgtggatgctccagcagttgtggctgaagaggtcactgagaacatgttgggtggtaagaaagttacagctgtatttgttctaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggagggaaagattgttccatcagaggtgactataaagctgttgcaggaggcaatgataaaaaatgaaaatgacaaattcctgatcgacggatttccaaggaatgaggagaatcgtgcagcatttgagaatgttaccaaaatttctcctgcatttgtgctattctttgactgttctgagaaagagatggagaaacgtctcttggggcgcaatcagggaagagttgatgataacattgaaactatcaaaaaaaggttcaaaacctttgttgagtcaagtttgcctgtcattgagcattacaactcaagggacaaggttaaaaagattgatgctgcaaaaccaattcctgaggtgtttgaagacgtcaaaaccatttttgccccatatgctccaaaggctgaatagagcagtctaaaagggacatgataaaggtgtcataggcaacacacaaacatatatgtgattatgaacccttcaatatagaacagaagttttggctcatatgagctaccagcgcatcagtaggcaattcgatttgttatcagcaatatttagatctgattctcaggggtcctgctagagtaacattttaccactgttgtttacgtatatcctttgatgttgtgttgtaccaatgtggaatttactttagggctagtttggacatggaaatacaggggatccatcaggcctgaggcaggaatccccttgttatttataaattaataagaggattcctgcctcatggattctctccattttcctatccaccaaaccagcccttatagagcaatgagaccttgtgcgatcccatcagatttcttgtggcattatggaaagtataaaactgctgccatattctttatacgttgaaatatgttcctttcc

SEQ ID NO: 10664 - DNA, 1525 bp, Zea mays
ttgggtacctcgaggccggccgggccgtcttcccctccgcgttccgcgccgcggaccgcggtcaccactcaccagcagcgctgcagcgccaccccaccccagtccccccaccgaccacttgccgatattcgttgccgcgtcggcgttgctggatcctcaagcagacagcccagtccgcccggacctgggaacccgcccgcgcgcttattaataacggccgcctccctccccccccgcccccgaaggccgagggaagcgtacgcgcctagcgaccagcacagattcgttccacgccccccctcctcccctctcagatctcgcgcgcgccccgcaaagggtaactttgagccatgggcacagttgtggatgccgctccagcagttgtggctgaagaggtcactgagaacatgttgggtggtaagaaagttacagttgtatttgttctaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggagggaaagatcgttccatcagaggtgactataaagctgttgcaggaggcaatgataaaaaatgaaaatgacaaattcctgatcgacggatttccaaggaatgaggagattcgtgcagcatttgagaatgttaccaaaatttctcctgcatttgtgctattctttgactgttctgagaaagagatggagaaacgtctcttggggcgcaatcagggaagagttgatgataacattgaaactatcaaaaaaaggttcaaaacctttgttgagtcaagtttgcctgtcattgagcattacaactcaagggacaaggttaaaaagattgatgctgcaaaaccaattcctgaggtgtttgaagacgtcaaaaccatttttgccccatatgctccaaaggctgaatagagcagtctaaaagggacatgataaaggtgatacaaggtgtcataggcaacacacaaacatatctgtgattatgaacccttcaatatagaacaaaagttttggctcatatgagctaccagcgcatcagtaggcaattcgatttgttatcagcaatatttagatctgattctcaggggtcctgctagagtaacattttaccactgttgtttatgtatatcctttgatgttgtgttgtaccaatgtggaatttactttaggactagtttggacggggaaatggaggagacccatgggacagagatccccttgttaatttgaataacaagtggattcctgctccatatattccctttattttcctgttcaccaaaccagcctttatggagcaaccagaccttgtgcgatcccaccagatttcttgtggcattatggaaagtataaaactgctgccatattctttatacgttgaaatatattcattgcactgaacgtttgttttgaggccagaaaaaaaaaactagagggggggcccg

SEQ ID NO: 10665 - DNA, 8408 bp, Zea mays
  misc_feature (2098)..(2098): n is a, c, g, or t
gattaaatgtttctttggcgaccttgaccgatatcatagatcgtgatgctgacctagggtccgtttggtttaccgcggattctactatgcacgttagtcgagaaaattgagtggaagcttgataaaatcgtggatagtcactgctgcacattatcctctgtagaaaatcaataatgtttggtttgcagccgcaatctcccacctagattctcatatttactgcgaaccaaacgccgccctagtttaaaaactagatttaatttctttaaacaatctaaacgtgaactttttacgaacaaaagactgtgtttggttgcccctgctaaagtttagcccgggtcacatcaagcgtttgactttcaaataggagtatgaaatatagacccaaccaactggactagattcgtctcgtcttttaatcttcggctgacaaattagttttataatccgactacatttaatacccggaacggaggttcaaacattcgatgtgataggggctaaagtttagtttggggtaaccaaacaccccctaaaataaaaaaataggggatgaataactgtagcagcagagctgacctgatggcctgacatgttgctgctagcactagcgcagcagtgcagcgcgcaggctgttcttcacttttacagctgggcacctgacgatgagtggaaatgggtaccgtgaacggctggccgccgcacgttcatcgaggagtggccggcgtgtcgctggcgatacagagaagttgcatgcggcctatcaagacacgaggattcgcctcatcacgcgtcgcacgatagttggccattgacgtggcatggcatatcacaccacccacggcccaaacctgcatggcagaatacacactcaaaaaagaaatgcttagatttccctttaattctgatcgtactgactcaagggaaatcaagttttaagctaataaagaaacaagcagcagcagcagcagcatgcttttgaaatcgataatggacatgtcaaatcaatctccatcgataggtttttgtccaaattattaaaatttggcaggaggcacacatcaaagggcaaaaagctgcctgaccttcggcactcttttgtctatcctgtccaggatggacggcgctcgcttcctcaagtttagcgccaaaacttttgagcatcttttccatttcttgaacaattcgttctaaacattcttggaaataaagaccaagaatatcgtgtgtgattgattattcattatagcaactccaagagaatagttattggcgtcatgcggtccaattttaagtattttcagcagaaacaaggctcggttggtaaagaaagctagctggtgccccggaggcgcttggcattagcctcgcctcggaccctcacgcgcccgctgccagccttagagcaaggttaataatagaaccgattatgggctacaagatatttgcagtcaatcttttaacacatttatataatagttagctctttattattaatgtatattaaattattttttcttggttctcatgtgtaagccggttgtaaaataatagacaacttttgcgctcttttcttttctctcttctctaactcaacatttaaccttcttatggcctgttataatacttgatcttagcccacctatataataattagctcttcattattaatgtatgactcatttgtctttttcataaaaaattcttggttctcgtgtataaagtggctgtaagataacagctcacttctctcctctcttctctccctcccacaactcagcatttaggacgcatttggtttgtgcccttagagacagttgcctgccaatcagccaatcatcatcatccatcctcccatgatgctcaataacgccattctcgagacttggaagaggtcctcgagagtcaagaccactcgtaagattgtgggtatggacgccgctgcgacgctggaactcgagacggtgatggcgtcagcgcccgtcgtcatgcgcagctagcctcatatgatgtggtgaggtgcgatctggtagaggggccaaatagacctgaaagttgggtcgtgacgtaccggcacggcctgggcccatagtatgancagttttatatgagaaagagaaatcaatgttttctataacttttgtgaagagataaaaaacattagagcatgaaataactatttaaacactagttttttaattcgtggcccacttcatatcgtgccgacacaagcacgacgcatctagtcatgtcgtgtcgtgttacccatcgtgcctaagtttgaggtacgtcacagtccgatcattcgggtcgtaccgtcccgacccatttacttggtgtctaatcatgctttatgctcttattttttgccgtatcgtgaccgtcctaaatggtgatgcacaaactttcaggtctatagcaagacgcaaggtgtcgctgtggtatgcagcggcgccggtgtgcaaatggttgtggctcgcgctcaacaatggcatcgtcatccctaacctccagatcaggctcacgcacgatgagaatgaggacatgaccaacagctctagcatcgacatcgacatccagcagggtcggcggtcagcgttgttcatagtgaaatatgacttgcatgcagatagctactgctacctagcgcatggcttgcggtccgctgcttgctggcttgcgcctggtcgcggccttgttcatgtgtgtgcaggcggagaagaaaggatggcgtggcagttttagaaatagacaatgaaaaattgaggaagtcggttggactactttagtttttttggagggtgtttagttttaaagaatggctaagtcatgtgtttcggtatctaattctacatgatttcgttaagttgctcttgcagtgttacttataaatgatcgtaggatttaatatagcagcaccaggaacgtatttggtaaaattacgatgcctaaacctgcaacattttctttatgcttcctgtatttagtattaacacatattgatattttgaccatatatatactagatgcatataaagtcatctcgcatcagataaactatgcacgatttgaggctctgtaaaaataatgctagacacatatttgatgacttgacaacacaaactcttgctattcaaaataaaacaataaaggtatttttagtccctttaaactctttgaaccccttaatcctaaacaagttttaagagatcctcaatccactctaatctcatgcattcaaatactatctaaggtctagttttggagccacaaaaccgaaaaggatatgagtgattaaaatcttctccttattcaattttaaataaatagaagattttagtccatccaatcctcttgggttatttggctgctctcaaactagttaaaggtaggctcgcaagcttgaatccctggatgagaaattcagcagttttggtccctctggcaggagagcaactccatttaaggcagagagacgaccggcgggagagggcaccgtcctaaccagtaaccaaccaccacgcggtctccgagctaaagcaacgggacgtggccagtaatcattgttgccgcctcagcgtcatggtcgagacggtcgaccgagcagttcagcttcagcggtcgacgacgacagggagggagaggagaggccgggtcatccggcacggagccacggccccggaccagatgcaacgcgcgccgtgcgcctccgtcccatcccaccaggacggacgacggagctagcgcacgcagaacggctccgaacaaaggcggtgcaccaaactccgtgcgccccccataacttcacgcgctgcagggagcgtttacgcagcagtagtagctagctgtacggcacggtccggtccgggagcatcatccaggtctcacagcacaaatgtatgccacgacagaaaccggttgctcaggtgtgtgtgtgtgggcgcgcgtgcgttgcctcaagattgcatagtgaccagtatagtgtatagcatctgtgaccggagagagaaggagaaacgtactcgtagcctaacgcccatcctggtctggttgatacaaaactaaccatgatggacgccgaaaatccctggtgccactgccacagatgtaagtatgttcttcacgctactgatgattactctgaagaagtggaagaagagcagcagcagcagctagcacccccggtgccgctaatgatccctgtctgtcggttggcatagccaaacgggcagcgccccccgccctgatcccggtggcgagctgagggcgaggcgatgtgatcacaattcacacaccccccgacagcgacgcgctagataccaactattgcagaggcttcacggcggactgactgactgactagacggcggtgtggtgagtggcgacactgtggcgggccggcttattactagctctctcgctatcaaagaaagagggcttagttttgagacgcttgttccggtgtgtgtttatggcatgctgtcaaaacaaaggttacctgatttatagtgccgtggaggaatcttttggcgcttcgttcgacagaggtacgtcccgaccagttccaagatggtgacagcacttgcgcctacagtttcttgctctctcttttttttttccctgagcctgaaaagatgtttaggccacgtccctctcctccagtctcgtcggtgtaatcttgcacggaacagcatggggatcacggtattgcaataccgggaaatgcgcgtcccaataactaactgtaattcacgctaattacagcaagtttgtaattctagtccttggacaagtcgaccaatatcgagtatgataaattagtgatataataataatacattttggtagtatttctatcgagatggaaatgtccatacaatttcctgtaattctagtaaagttaagaatatgtgactttgtccaaacctaatatttacattatctttgcggctgaggcagtaagaaattccagttaatggtccaaataagcctacaagtacaaaacatatcccaacatcaagaatcaaggatgggggtattctgacaagggggataaggtatcattcgcacacactgttcatctacagtttaaaacttcagtaaacaatgcagactgattggagttgtatctgcgtacgtaattgcatggcagaagttttcaggcgtttccattgtatctccgacatctttaagcaaaagctctaccgacactgaagtccaaacacctaataacgaaactagattgcataaaggacagcaaaaaaaaactgcatcaagaaaaaactaatatatctcctttgctgttctgaagattagaatttttatatcggcaacgttcgttcctttcatattccatcctcccttgaaacgatttcacagcggcaaatgctccatcacagagcaatgccatattgatatgccatgctgccgcgtcaaaaatatgcagcaggaattccagccgccagcccaagcaagaagaaagagaggcctacatgcccttaacgccacggtcttacggccaccagctcagtccagcgcctacggcttctgcggcgcctgcttgaacgcaacggtgggtgcgatccgggaggctctgctgcggtgctcggcgacgagctctgccgcgaaccagtccagcttctccgcgttcgtctgctccccgactcgcctcccctccgaacagcaccgactccacgttccgctgcttgagcatctcgtccgccgccgcgagcagcgcgcgcacgttgcctggggtcgggtcgtactccccgtccggaccgcacggcggcatgctctcccgcttcgcctgatcgcgcgtcaagtttatttagcagcgtaataagacgagaaactgaaatggaattcaagaatttgctcacctggatgcgcaggtagttggatgcgcggcattggccgaaggcgcgcgccacggcgtggtcgacaaggtcggcggcgccgtcggccgcaatacgggcgatggggcgtgcccactccttgggaccccaccgacgcatgcgccggagttccgcctcgccagcggcgccagagcctccgccagagcagccgccgatggagagcacgaggaggtcctcgaccccgcgcacgaacgggaactcgtgcttgttgtggagcacgtgcgtgatggcggcggccgccgggctgcccatggtggggccgccgtctacagcggcgcaggacgtggcgccgtccaccgacgccacctcggcgggctcgaagcgtccggcctcggaccacgcggcgcgcccgacctcgcagaggcggaagtcgtagctcccgttctccagtgcgtcggcgcgcgagaacaccagcggcgcggacgtcttgaggtcgtagcaagagatgagcacgggcttgatggtgtcccgcagggtgagctcctggccgaacgccgccttcattgccgcctccagcgccgccgttggcgcggccaggggccgcttcttgccgcggcagaacagggacgtggacgaggaggccgcgggcctgcggaacatgcgcggcgcgtggtccgcgacgagccgccacgtgtcgtcggcgtggaacagcggcgcgccgcgcgagtgcgtggagaagagcatcgcggcgaacacgccgccggcgccggtgcccgccgcgaggtcgaagtagtcggcgacgcgggcgtcggggtcccccgacgcgcggcgcagcgcggcctccaggtgcgccagcgcgcggccgggcagcagcgcccgcaggccgcccccgccgccgtccacgcagagcacgcagaccttcccgcgctgcgccgccttacccggcgccgccgcggacgcctgcgccggcagttccgccgctggcttgggcagccagagctggtgcgggtcggtatagccgaacaggaacttgctctcgaggatggagaatatctcgtagctgagcttgtccgtgtcggctccccccgcatcggcctcctcgtgcagcctctccacctgcatctcctctgcctcgtccatgcccccacccaccgagagcgagaggcaatacagtcaaccgcgttggagaattataccacttccgccgggcaggaaagcgggaagcagtggtgcagaggacagaatcccgcgcggattcgcaacgattgctgccgccacgacctgctcgcctctcctttgtctctcgctcccttttgagatcacagcagctggtggtcgtttacatgcgactcactcgcctctagtggccggcgccttttgatccttgcgcgcgccagagcacgcgaggaaaggaaggaggcggcgcggaaaggtgcgcgggcgagggagagtcggagagagacgaagataggcgaaggaagggatagataaagggagggagcttaaagacgggggaggcgaagagaatgcctgagcaaagcgagcgggtcgtcgactcgtcgtcgtctcctttctccgtggtcgttcgtgtcgtggtgtgcagcgccgtaaccgatggagcgcgcgcggctggccccgggaggcctggacacccgcacccggtgcagggcgagcggaccgttccacgggcgtacgtttgccgcctcgctatccatgaggcgacacgacagccgtggaacaggtccacggagcttggttggcgtcacgccgcggtcgtcaccctcggctcgtgctggattatttaacagatagaaacaggcaggagcgattaatccaagtggtggggcccggaaaagccaaagtgggcaagtagtaatcaatatgttgattccgtcacggccgttctagagcctggtggattagcacgatcgaggacggcggctctgcgtctgcgtggaggcggtccatccatggccgcaacgccgaggagcagcacggcacgggcctgcctgcacttttgcctgtcgtgcttgcagttgcagtaggcctacctcgtcttttttattttcacttgagaatctggggcgggtggcagtatttctggctgcaatggacggacggactggacatcaggctgggtggcagtgctgcgccgtttcctcagactccaaggctgcctgagaggagagctcgggattaggccctgcacgttacacgtcgacctgtcgcgtacgggcgcagctgcggcttcaggtcttcaggtgccactgcaacagccagcacgttccaggccctcccagcagctaggcaggggttggcctttggcgtttcacagcagagttgagaaaagaaaggaatgcagtagtacgtagtagtcgaccacatgagtacggtgtatagtagtacagactttacagtagactcgagtgagtgtgcgtacaaaaaccgtaaaaacacagcgagtatttgatggtgtacaggactttcggtccacctgcctccttgcagcgtggacatgagctgagatggagccaaaccgccccccagccgctc

SEQ ID NO: 10666 - DNA, 2416 bp, Zea mays
ccagcacagattcgttccacgcctacctcctgccctcgcccgtgctctcagatctcgcgcgcgccccgcaaagggtaactttgagccatgggcacagttgtggatgctccagcagttgtggctgaagaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggagggaaagattgttccatcagaggtgactataaagctgttgcaggaggcaatgataaaaaatgaaaatgacaaattcctgatcgacggatttccaaggaatgaggagaatcgtgcagcatttgagaatgttaccaaaatttctcctgcatttgtgctattctttgactgttctgagaaagagatggagaaacgtctcttgggacgcaatcagggaagagttgatgataacattgaaactatcaaaaaaaggttcaaaacctttgttgagtcaagtttgcctgtcattgagcattacaactcaagggacaaggttaaaaagattgatgctgcaaaaccaattcctgaggtgtttgaacacgtcaaaaccatttttgccccatatgctccaaaggtaattaggtttcacttttttgagcaaatgtagcatttccagatggatctcttaatctcatatttgatttagcactatctgcattgcattgaatatgttgttttccatctttgaatgtacgtctgcaaacattaaattatgttcacctttaaaaacctttgtccattatttttgcatgactaaaaatctaaaatactagtacaaatatactcatcactttgccttctctatcaggctgaatagagcagtctaaaagggacatgataaaggtgtcataggtatactccctctatattgcacctgtcctaaatgatttcgtctggttcttgccaccataagtgagattctcatagaatcttcataatcattttgcaggcaacacacaaacatatatgtgattatgaacccttcaatatagaacagaagttttggctcatatgagctaccagcgcatcagtaggcaattcgatttgttatcagcaatatttagatctgattctcaggggtcctgctagagtaacattttaccactgttgtttatgtatatcctttgatgttgtgttgtaccaatgtggaatttactttagggctagtttggacatggaaatacaggggatccatcaggcctgaggcaggaatccccttgttatttataaattaataagaggattcctgcctcatggattctctccattttcctatccaccaaaccagcccttatagagcaatgagaccttgtgcgatcccatcagatttcttgtggcattatggaaagtataaaactgctgccatattctttatacgttgaaatatgttcattgcactgaacatttgttttgatgactttgtatgtatataataccctcccaacagtaagtatctaagcttagcaagcctcttgtagttgtacatgctgctgcttgtttaattgtgtgtggcatgtttctgacagcttcatgagatccggattcacttaaaaaacaactctactccataaaaaagtttggaccctaggtaacttatactatccacagttaatccaaatctaaatagtagtagaaaatataatataccccctctgttccgaattagtatttattaaaatgaatttattttgggatagagagactagagagtatgtctgtatctcggtagacctttcttgaagtcgaagatgttgtaaacaaaatgacaacagcgcacctgacggaaaccgactgttttgcagcatttgttggcgctcccattcccctccttcccgcttttgagtcctctgggctaggttcaatgaattttgcccacttccaatctaagaagggaaaacgatacagctcgtgggcccttcttcagcgacgccaaaaagaactgaacaaaactgaaatacattcatttgtatccataatcccaattctaaaaacaccaagacctcgttcgattataatttagatatacatatatgtactatttgtttttatgcaattgttatataccaacatgttattgaatatttgtgtgccgtcataatgaatgagtattataatactctattgtatggagcgaaccaaagagcatactacaaattgtagagtagaaaatgtaacattgatatatcgaatcaatttctatcttctgtcctaggaatacgaggcatgcatatatatatataacatgaactttgaaaaagttatgaaacatcaaattttaagacaagttcactgagtggattctaattttatcgaactaagagcatc

SEQ ID NO: 10667 - DNA, 3027 bp, Zea mays
  misc_feature (841)..(841): n is a, c, g, or t
ccccgcgtccgcccacgcgtccgcccagcgtccgaagagtcaaaactctacatgagcatctcaaatgttgcacacaagcataaatgtacttgtttgagcttaaaaaaacttaacctgtagggggtaagacaacccctgggcacctggtccacccatacacaacggcaccatagcccatgtgagaatgactgcgactagggccgggccttgggcctgtttgtcatgggagtatgggacaaagtaggggatatttttaaccttagcctgaaatttactcccgtgaggagtcaaacacaggacctgtgtagtgctactcagaccccctatccattcgcctggtttgagcttatgctgtacgatttctgaacttgaaaatatgtatttgagatgaatatcccttgcggtaaaaactaggacaattatgcttgtaactttatttctgtaaatttgctttaagtaggctggacaatgatcttgaaattgtgacgtgtttgttttcattgcttcttgcttggggtctcaatttaccatgcttggtttcccgggaaagacaatatggattttgtaggaaagagcaaggtgatgttggagccttcggcactgggtctgccctcctgtgttgccctgcatatacttgtgaacgaggcagcatcatagcttcatgtttggtattttgttgttcaactgtgcaaggactgtagtcctatttttactcatcagggcaccacttcttgatcccatgctatctctacatagatgttcaactgtgcgaggactcttagtcctatttttgctcatcagggcactacttcttgatcccatgctacctctacatattctntatgaggctagcttatagtagattacttattccaaaaaagctgctcatttgtattgccaagagcagtttcaaaatctcttttttcatgttaattgcttttcacaggatcttcctaggcactatctgctaattgttctttatttcactcaaggtttatgttattaggtcatggttcacaaacatttttttcctcatgcagtatttgctggttttcagagttgatgctaaacatgcttatttaactaaactagaaatttgttaccgaggttagcgccaagctgcctatccttcatgcaattgagatttaatttgtccaattgtcagtttaacgggcaatggttttgaatttatgctgatgatgtaatttaattgcatatttgcctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgtcaacattggtgctgcaaatgccccatcccaggtccttgcaacgctaagtggccactatggtcctgtgtggcgtgttgcttgggcccatccaaagtatggtgcaatccttgcatcgtgcagttatgatggccgtgtcattatttggaaggaggatgcacgaggcaattggtctcaagtccacgtcttcagtgacaacaagtcatctgtcaactccattgcttgggctccgtatgaggttggcctctgccttgcctgtgcatcttctggtggaagaatatccatcttgacgatgcaagctgacgggggttgggatactgcaaccattgagcgagcacatcctgtcggtgcgactgccatatcctgggcccctgcaacagcgtcactagctggtgcaggggagcttgtttacaagcttgtctcaggagggtttgactctgttgttaaggtctggggattcaacaatggtagttggaagctggagagtgctcttatctctgacatgcacacagattgtgtgagggatgtcgcctgggcaccagttttgggattgtccaagtcgaccattgccagtggttcacaagacgggaaggttgtcatctggaccaagggaaaggatggagacaagtgggagggaaagctcatgcgtgacttcggttcccctgtctggagggtgtcgtggtccttgactggcaacatattatgcatagctgctggcgagaacaacataaccctctggaaggaagggtcagatgggcagtgggaggaggcgatgaaggttgaaccataggatgaccggcaaggtttctgaatttcttgtagatccatgtttcgacaaggacaaagcttgctactgttttactagtgtttcgacaaagtttaagtttgccattgtgttttactagtgtttcctgcggatccatgtttcgataaagacaaagcttgacattgtgtttccatagacactcaaattcacatattttagtaattcctgatgagcaattatgctcttggatggatctggtgcgctttagactgacaaattttttattcaggaaacactagtaatgttacctattaaacattgtagcaatttttatttttaattgtgctgtcttggatcttggtccaccaaaaaaaaaaaaaacaaggtgtatttggtttagattctgaagcgaatctggaatctcaaccaaatgaggacaacagaatatattcttgaaaatatatgtatttttctagtttaatttagaattaccttcgatcgatgacttgtgttagcaagatatgcagtgtagttatgttatgtaggatcaaacgtggaagtctcatgtatccgtgatccatcatattactgagctcttgagctctctaatgttgtgttcatcgtctccatttcagatggaacttaagcctatgaccccttctgagcattgtttttagcatgtttttaaggttcaacaatttaaccaaacaataagatgttacattttaagaacaatgtcttcatgggcttgcacattgttctttggtagcaagggtgagtcggtcaaacaatagctttgttgacataatgttctgcattggtgttgtatagactttttggccatgaaaatcaaccatctgaatctagtcctaaacaaatctctc

SEQ ID NO: 10668 - DNA, 957 bp, Zea mays
  misc_feature (787)..(787): n is a, c, g, or t
  misc_feature (907)..(907): n is a, c, g, or t
atctttgtaggacacccgcaccctccgcgtcgaacacccgatccggacaccgctccaggctccacctctctcccatctcacgccaacgctcactggaccattcctccgtgctggggagcggcggagagctatccacctcgtctcaggcaccctctggcgtccccctccccccgccgcgtgccggcgagccgcggagatccggggttctgacctcgcctccttctgctgtatttgctggttttcagagttgatgctaaacatgcttatttaactaaactagaaatttgttaccgagacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgtcaacattggtgctgcaaatgccccatcccaggtccttgcaacgctaagtggccactatggtcctgtgtggcgtgttgcttgggcccatccaaagtatggtgcaatccttgcatcgtgcagttatgatggccgtgtcattatttggaaggaggatgcacgaggcaattggtctcaagtccacgtcttcagtgacaacaagtcatctgtcaactccattgcttgggctccgtatgaggttggcctctgccttgcctgtgcatcttctggtggaagaatatccatcttgacgatgcaagctgatggggggttggggatactgcaaccattgagcgagcacatncctgtcggtgcaactgccatatcctgggcccctgcaacagcgtcactagctggtgcaggggagcttgtttacaagcttgtctcaggagggtttgactctgttgttaaggtctggggattncaacatggtagttggaagctggagagtgctcttatctctgacatgcacac

SEQ ID NO: 10669 - DNA, 2252 bp, Zea mays
cattgggtacctcgaggccggccggggagtggtctgagcatgctttaagaaatgaagaagaccgccacggcccgcccgctagccgttggcagccttctgccccgcaccctccgcgtcgaacaccagatccggccaccgctccacctctgtccatctcacgccaacgcccactggcgtcctcgttcctccctgccggggagcggcggagagcttttcacctcgtcttagggacctctggcttccttccccctgccggcgatcggcggagatccgctgttctaacatcgtctcccgctgctgacttgtgaacaaggcagcagcatggttcagtttggaaacatgtcatcaaagaagatagagttggatcacaaggacatggtccatgattctgctatcgactactatggcaagcgccttgccactgcctcctcagactctaccgtgaagatcatcaacattggcgcggcaaatgccccatcccaggtccttgcaacgcttagtggccactatggtcctgtgtggcgtgttgcttgggcccatccaaagtatggcgctatccttgcttcgtgcagttatgatggccgtgtcattatttggaaagaggatgcacgaggcaattggtctcaagtccatgtgttcagtgacaacaagtcatctgtcaactccattgcatgggctccgtatgaggttgggctttgccttgcctgtgcatcttcaggtggaagaatatccatcttgacgatgcgagctgatgggggttgggatactgcaaccattgagcgagcacatcctgttggtgcgactgccatatcctgggctcctgcaacagattcaatagctggcacaggggagtttgtttacaagcttgtctcaggagggtttgactcggttgttaaggtctggggattcaacaatggtagctggaagctggagagtgctcttatctctgacatgcacacagattgtgtgagggatgtcgcgtgggcaccagttttgggattggccaaatcgaccattgccagcgcttcacaagacgggaaggttgtcatctggaccaggggaaaggatggagacaagtgggagcggaagctcatgcgtgactttggttcccctgtctggagggtgtcctggtccttgactgggaacatattatccatagctgctggtgggaacaatataaccctctggaaggaagggtcagatgggcaatgggaggaggtgatgaaggttgaaacataggatgtccgtcaagttttctgaagataaagtgtgttttactagtgtttcctgcagatccatgtttcgacgtggacaaagtttgccgttgtgcttcgacagaacatccaattcacttattttggtactttctgacgaggcaattatactcttggatggatcccgtgcgctttagagtggtaatttcagatcggtgagcctgtttagttctgtatatcctcaacttcttttttggtggaacatcagagctgctgcaagtaatgttatctaataagcactgtagcaatttctattgctgtttgtgctgcggctactgtagcgctgctctggtgcgcgccatcgtttgagttttattgatttgttgtgcaagcataacatagcaagattctataattcgttccgcgtgtcattccggtgatagatttatgacatttgaggaagggatatgtttgtaataaaaaagtaattcaatctagaacatataaaaaacaggcgctccattagtccctgttcgattattctcattacacatagattagatatgattgaaaaaaaattaagaataaatttaacttacttggtatttaaatccaaccgatctcacccaatgcacatagattgaaagctaaccgaacaagccatactagaacatggacgtcttaacgggcgccctattaggacaaatggttattgtagagaaatttaattaattctttatcaaaagtttcttgttcataaaactactaagaaataaatcttagaaaatggaacaaacatgaaccagggagatggtaaatattagaagcggtaagcctagctaagctattagcctacacaaaccttgccaattttttccatgtttagttccaatgtcaactttctatctacctaacagtttggtaaatttgaaaaggaagtaaaatatacatatatgtagaatacgaagagaaagcaagaaacttcgaggccagcaaagttgttcctgcaattccagcacttgtagctcatatggcagc

SEQ ID NO: 10670 - DNA, 1592 bp, Zea mays
ggaaacaactttttcattgggaagaaatcaattattccaccgagccgaccgatcgagacctcgctcatctttgtaggacacccgcaccctccgcgtcgaacacccgatccggacaccgctccaggctccacctctctcccatctcacgccaacgctcactggaccattcctccgtgctggggagcggcggagagctatccacctcgtctcaggcaccctctggcgtccccctccccccgccgcgtgccggcgagccgcggagatccggggttctgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgtcaacattggtgctgcaaatgccccatcccaggtccttgcaacgcttagtggccactatggtcctgtgtggcgtgttgcttgggcccatccaaagtatggtgcaatccttgcatcgtgcagttatgatggccgtgtcattatttggaaggaggatgcacgaggcaattggtctcaagtccacgtcttcagtgacaacaagtcatctgtcaactccattgcttgggctccgtatgaggttggcctctgccttgcctgtgcatcttctggtggaagaatatccatcttgacgatgcaagctgacgggggttgggatactgcaaccattgagcgagcacatcctgtcggtgcgactgccatatcctgggcccctgcaacagcgtcactagctggtgcaggggagcttgtttacaagcttgtctcaggagggtttgactctgttgttaaggtctggggattcaacaatggtagttggaagctggagagtgctcttatctctgacatgcacacagattgtgtgagggatgtcgcctgggcaccagttttgggattgtccaagtcgaccattgccagtggttcacaagacgggaaggttgtcatctggaccaagggaaaggatggagacaagtgggagggaaagctcatgcgtgacttcggttcccctgtctggagggtgtcgtggtccttgactggcaacatattatgcatagctgctggcgagaacaacataaccctctggaaggaagggtcagatgggcagtgggaggaggcgatgaaggttgaaccataggatgaccggcaaggtttctgaatttcttgtagatccatgtttcgacaaagacaaagcttgctactgttttactagtgtttcgacaaagtttaagtttgccattgtgttttactagtgtttcctgcggatccatgtttcgataaagacaaagcttgacattgtgtttccatagacactcaaattcacatattttagtaattcctgatgagcaattatgctcttggatggatctggtgcgctttagactgacaaattttttattcaggaaacactagtaatgttacctattaaacattgtagcaatttttatttttaattgtgctgtcttggatcttggtccaccaaaaaaaaaaaaaaaa

SEQ ID NO: 10671 - DNA, 3181 bp, Zea mays
  misc_feature (441)..(441): n is a, c, g, or t
gggcactaagaacaggtgtaacctgggctttcccaggaaaaaattatcgcgagttaggcgaacggtgatggcatggctgatggagggcatggagatggtggaggtgttgttggaggtgacagcaccggatgaaatggagtcggaagccatagcgagggtgggtgggaaaaaatgacctaggctctgattaccaagttgagatacagaatggctcgccgctaatcagggcggccagcactcattatatagattagaatacacaaaaggatttacataaaactgtgaatagttatccggtgttgaagctaactgaacgtatctatccggctaaccattcctatctttcagctaaccattcctatcttccaggtaggttacagaggtaacaactttgttaacagctacaaactacatccgccaaaacagaaaaaagggacatgnaggcctagagttcagagaattctaaggtttcttgaaccaggaagaagtgtaaggtgcaagagatgtggagggtttggccacttcgagaagacatgcaaattggcagaagcaagctatgattactctgatggaagctatatttctagtgatagctgcactccaagaaataggtaattgtcatatttctattttacgtactacataataattttttgaacaaagtttgtatgtttgtttgttaacagaaagcgtaaggctgcatgtgagagtcctaagaagaagactcccaaaaaagaagaaggttcagctgaaccaggtgcaccacctgccaaagtgatcaagaaactcgtagactacctcaaggattgatgcttctagataggggattcatgcttaaaatcttagttgggaattgatgcttctagataggggattcatgcttaaattcttagttgggaattgatgcttctatggacaagttattaaactgttatggacatgcttttgtaacaggaatgcatgcatactgtagttttgcagttttggacaagttatttgttttgtcactggaattggaattgttattcagacgctagaaagttcaggctatggatcgtggtatttctggttatagttgctgtcaatttcagatgctagtatgtttgttgctctattgggttgttcagtttcttcagtagcaagagccggtagatgtgttgtttggtttttgagcagcaagagctggcaaatgctctgtgttcggcaaggtgagcaaaatagcagccccggcgttcgtgacaacaagggcacaaaaggaaatacgaaaatacgtgtactggtgggtgggtataattccagcaaaaccgtagacaatggcttgtttcagatttgattagaagtttaatggcacatttataagcttaaaaagtttaatggctcttttcttttctttccaaaattataatgacatagatataattaacccttatttgtttcactgacaattacaccgaggcccctccttttcacacttccaagtccacgacgggctccggtcaaacaccggccaacagccggtcacgcccgccggtgagggcccctctgaccaaaaagagctcatccacagctaccccgaaccaaggtgaacaccatcaagggcacagacggttcacagaggcttgagagctatactgctgacggcgacggcggacaccgaagtccgacgagcccgttcccggtgactcaacgtcatagaacctaaacgtaaggcatggcgagcattagcgactcacccaacactcgatgctcacacaaacacaaacacaaacagggaaagcgtagaacggacggtcgacgtcgggcggcgttcaacagtgcacaccggcggcgaagcggtgtcccgatgaagacgcaacggtagagctgaaacggtcaagtcgaggagcatcagtacaactagagggagctagaacacgggagctatgggatgaaacactctcgggttgaggcggttccacagcgatggcggtgagcaatttcaaggaattctggtgattggcagatacggtggacgaacgggtgaacggaagggtttgctcgggtgcgcaaagaggaggcgcagagggtgatacgttcaatttatagagggacacgactactgtggtctgtggccgatgtggcggcggtttcaggcgagcaacgtggtccgccggctcatggcaggttgcgccacttcactgaggacgcacacaagcacctacacacaggaaggggcgtggacgactccgaggaagcggtgacgagtgaggagcagcacggccgtgttgaagtaggctgctgcgtgactgttccaggctcggcgagcaccacggtggcgatcctatccaaaaccaagcaatggcaaggagacgagtgccgcacacatatcttggcccgcccgaaccacggtggcgatcctatccaaaaccaagcacgaactgaacaagttcagttatctgaactgaaatatgcaccaccccgactgacagagacactttgggggtactttactcccaatttctcacagcaccaagccaacctcacttaaataaacttgttcactattccatggtcttcgactttactatagagtatgcagtccataactccatggatcaagcacaaaggagctccaaagtaggtcacaaggacactgaaactgtttttcagttttcggaagcaagttcagatcacccaggtctgacagcacaactttgggcaagcttttctcctggttcccagcagttctagggacgtgaggcttaataatatttacttctctaccatagaccaacaggtttgctatagtgatgatttacaaaacgtttacatattaggagttacaggggtcccaagtcggctcaaatccactgaaaccaaatatctgttaactgaagatgtggcattgtacagtaatacatccctccaaatctgttttcttcaaattactttggatttttgtacataacttcaaaatctacaacatgaaagttgcttagttttcgtaattctataactttggtatttggactattagccaattcttattaaattttaaatttcacttttggggctaatataggattcaaatgtggttcaaatcttcaaactacaataacaagtttgatccaccacctaaaatcaaagttggcctacttaccaagatctatctttgatgtatagagctcatgattccaaatcg

SEQ ID NO: 10672 - DNA, 5284 bp, Zea mays
cttgagccacaggcaaaccttaaaagtatggacattctatctgtcattgtatgtgtgagacagaaatttggaaactaaatggcgatcacaatagaagactggcgagggcgctgaatttagaaccctgttcctaaaaaaggatgaatttaaccgaagttgcaatatatatcacaaaggaatcaaaatgatggatgcgccgagattacaagcaaagccagagaaaaaatactatggacatcaaatagactagagctaagcctcagtgaaaaaggggagtcaggaataatctagacactccatattttgctgaagatggtttgcagtctgttagtagatagtttcctgacgatcttcttggcgtcgaagtcaccagattctgccagttctttcaggctgcagaaattttccgacgtcacaatcttcttccttccgctgttggtctcagccagggacatgatagcagagaggatcaagtccttcgccatcaacttgccctcggctggatcaaggagctgcagcagcctgttcagattgtcgccgtcttggatgaagatggcacggttggggtgaagcatcagcaagctggaaagaacctgcgccgccatttcccggactcgacaggatttcgctccaagcaagcctgacagggcgctcaaataccctgctctgcccatcatccggttgtactcctcagaaacctcggagagatgcctcagaatcttgagcgtacattcgaggacggcgtagtcgccgttgttcaggtagaagagcagccagccaagaacatccgagctgatgaggtcatccaaggagtttgcagaagagaagcagaagaaccagatggcagcaagagcaacctccctggccttgtacgagtagggaaggtcggggtatatcaactggaggagggactggatcacccccatgccgacggcttcctccctgacgtcggcgtcatccagagccatggcgtggagcaattcgacggcgccgagcttgcggacctcctccttcttctgggagagcttcaccagctccgtgaccaccccttgctccaccatgaacatcttcacttcctccacccgactgaggttcctcagcactgcaaaagaggagctgacgagcttgctgctgctgccggcgtgggcgcaggcgtgcagcagcgtggtgaggccgccgtgcgcgcagacggcccacacgttgtcggagttctccgtcagctccctcagcgcgtgcgccgccctctgcttgcccagctcgctggcggtgtccgcgttctccagcagctggacgagcggggcgatcacccctgccttcaccagcattcccctgtaacgctcggagctcgcgacgacggcgacggcgccggcagcctcttcttggatgcgcgcgtcggtggactcgaggaaccccgtgagcagggcgacgccgtcgtcgacgtcgagggcgacaaccttcgcacagagctcgtcttccaccaacagctccctgatggcggccagtgcctggctcctctggacggtgccgccgatcctgatcctggaaaagagatccttgaggtagaaggccttctcacccacgctggcctcggcgctgggcctgacggcgacaatggccttggacggcgacggcgccccggacgagacggccatctccttgagctgcttcatgtgcgcatcgagcttgcagctcaggttgtccaggtcgctcctcagacgaagccttccacccttgtatgacccgtcgctgcactgagaagcaacgacctggatgctcctcacggttgctgaagccagccgcagaagctcagccaacacaggatgctccttgtcgtcgtcgtcgtcgtggtcaccgccgccgccgcagagtgaattgaggctgcagcagagcagctggagcttgtccttgatggactgccacttggctgggaactgcgagacagagcaggccagcgaagaggacgccatggacatgaggagctccagtgcctcaccattgctgtctcctggcgcttcttcagcttctcccatctctgcactctgtggaggtcacgtcaccacaagaacactgtctacctacgtagcattcatcttgggattgggagcttgagatgccatgtatgtgcgcgaatatatggtggtgcaaggagccgggacaaatgttagttttgtacgggcatctactggtagccagtgcacgccactacggaggcagatgggtagggctggttggtagtgccggtaccaacctctgatctgtcctctagttatccctgccatgctgcctgcctcctgttggtttcttccattggaatcttgctgctctctctctctctctctctctctctctctctctctctctctctctctctgtgtcaatctgtgtagcctgcctgcagcttcatctctagcttggtcacttgttctctctgtcatggtaactcttgcactctacttggcagtcagcagtagctaaagagtaatctatttggcaagtactaatgaatcgttagcatatgcactctagccgcgaattgatgcaatgagagcaatgggatggaatgatggcttggatcagtgggttgggtgagttaaattaaaggatgctgaatatatacccttcatttcgtcgcctccttggtgatatatataatggggtcatgaactacagttgagttggtgattatgcagtgctctctctctctcaccatgtattatcatgcggctagcatcgagtacctttccgggagtaaaataataacggcaaataaaaagggctttacatgcaagctgtgctgttgccctgttggtcacctaacctgctccgtgctagcagtagcactagcagcgtatgatacttgaaggtaaagtcacaccgtacagctctcacactatttgccattcgagccatcatcaatgagtagcagcagcaaaaacatgtcagtgacacattagtctgccatgcttgcattcaccagttgcgtatagtcattattattcagtgacaaatatatgtaaatttgtcccagtagttccaaataattacatcatgccattattcaagtttatttatttagcatgttcttattgtgcatctgatctgggccacggcatgcggcgaaacaaaggcactgcgggctggctggctgggtctagctagggcaatcagtattggcgagtgcgtgcaaatctagtaaggtactagtactactacactaaggactcttgggctttaagcttggagatgactcgagagatctcttttgtgtgaaaaaggacgagcgcccctacctgttcttcgcttctaatgatttttcttttcgccccacaccggccactccagtgatggatgaagaggcaggagacatgcattgatttgcataggccggccgcagaagagtacccgtcagctgctcctgctccaggctttgcagtggatccagagcagattattatcacaaccggagcagtacgactcacataaactaacggtcgaacgtttagacgtaatatatacatacatacacacagcacgtgacttgagaagtgccagctgcggcagacgaagacgccggccgccggcgcgcgtcagcagcgaaacggaccactcggcgtcggcgttccggtgtgggcactactgtgaaggaccagcccatgcgtagacactaaagaacacatggatggctggccgtggtggcgaccctcgaggcagcagacatgccgttattgctgacagtttcatcctgttgttccaagcagtgaaaacctgaacagcacctagcttgataccctcatctggtggggttcatatcatataccccatatagtccaaaagatgagagctagctccctgcagcaacgatgaacttgcacggcatgtgtgtgcatgcagacaatggctcgcgacaatttcacgtgaagtggttcgattctcgcggcaaggatctgatgcccatgttccaacagtgcaggctaaaaaggggggcccccctctccttcttccaaagttgcttcacatgttgagggagagagagagagagcgcgcgcgccatccatccatgcatcacgtagcaggagcaagggaggaacaccttgcgacgaaagaacagcagttccgttggcaggacctgggggcggggcggggcaggaaacaacagcttttgcttcagaagaaacccctgtgcagactgcagaagaagggcgcgcgcactagattcggcttggaatcccgcccgaacacgaagcaggagcccagtctctggagatacatgggaagataagaacgataggatatgagtggccaccgaaatgacttgcgaggccacaggcctgattcatgatgaaaaaggatagggcggtggctggggtatgtagatataagttataacagcaacatgcaaattaaacacaatgaatggtcgtgctttctccggtcagatgggttctacgtagatgattacagcgcactcgagagtcgagggcgagtttcttctacctgacatacagcagagccactaaatgcttgtttttgagcaaagattcgagagaagattggagggtataaaatccatttactattcaaaattgaatttttttaagatgatgtaaggcaatgtttcggccttccctatcacataagggtatggctaacagttcccatcactcaaaagaaacataaacaccagaccgataagctccaagccgtgtcggtcctatttataaatcttcagctgaagtgagcgaaaatacgaatagacgctgcctccagacaaggcaccaacatgcttcctttattatgtcctcttcgtccttttataactgagcctaaagtctaagccagtaatagcaccatacgaaatattacctgcatataagtaatcataggagatttgtcaaaaactaaatcattcctactaatctatatagcctaacataccgctgaaacacatgtaattatcagttttttagtttttgaagatacccctagaagccacgaacctagctaaaacgtgtttcacggatctaggagtagtgaggccaacacaacaatgaacaagtttccacaagaaacgagcataatgacactgttgggggccttcttctctgccgaatgtcctcaggacgaagatatcatttacaaccaaaagggctggatgccgaagctgcaaccgatatgtgtaaaatgccgaaggttcatagcttcggcccaagactgttacgaaggtcaaacacgttgtcgagccaaagattaaaagacccttgagtctctgatgttgtattaggat

SEQ ID NO: 10673 - DNA, 749 bp, Zea mays
ttgggaccctcgaggccggccgggaaggccttgacagtccgccggcgcgcactccgatcctgccctctaataacagcagcagcagccgccatggaaggcagcagcaagaagctccagccgttcctcctcacgctgctgctggtgctctccaccgccgtgacgcccatcctctcgctgtcagtgccagacgacgaggtagcctgcgactgcgacaaacccaaggcgcccaagccgtcgcacccgcccaagaccaagccctcccacccgtcgccgaagcccaagaaccccaagccacccaagggcggcaccgggtacccggcgccagggcaccaaccgcccaagagcccctcctaccccccggtcgtcggccctcccaagggccccgtcacgcgcccgccagtcacgcgtccgccggtcgtcggtcctcccaagggccccgtcacgcgcccgccggtcacgcgtccgccggttgtcggaccaccggtgacctacccgccgatcaccggccctccgacgacgccgcctgttgtcggaccaccggtgacctacccgccgatcaccggccctccaacaacgccgcctgttgtcggcccaccggtgacctacccaccgatcactggcccgcccgcgacgacgcccccggtcaccggtccgcccgtgacctacccacccggcgggaggcgggggcagctcgacgccgtgcccgccgccaccgaacccgacgccgacgccctcgtcgccgacgtgcc

SEQ ID NO: 10674 - DNA, 1848 bp, Zea mays
catgaattataaatttataatgttttccatagcactcatcacattcacccacactcgtagacatcgagtggtctgaggtcagagagagcacgagtagcgacactagctagcttctggctactagtgagtagtgactagtcgataccgccctaggccctagctagatcgagttcattcacgggcgtcccttacaagctcactcttctataaaccctcactgcctacctcgcggccggtgtgcactccgatcctgccctctaataacagcagcagcagccgccatggaaggcagcagcaagaagctccagccgttcctcctcacgctgctgctggtgctctccaccgccgtgacgcccatcctctcgctgtcagtgccagacgacgaggtagcctgcgactgcgacaaacccaaggcgcccaagccgtcgcacccgcccaagaccaagccctcccacccgtcgccgtcgccgaagcccaagaaccccaagccacccaggggcagcaccgggtacccagcgccggggcaccaaccgcccaagagcccctcctaccccccggtcgtcggccctcccaagggccccgtcacgcgcccgccagtcacgcgtccgccggtcgtcggtcctcccaagggccccgtcacgcgcccgccggtcacgcgtccgccggttgtcggaccaccggtgacctacccgccgatcaccggccctccgacgacgccgcctgttgtcggaccaccggtgacctacccgccgatcaccggccctccaacaacgccgcctgttgtcggcccaccggtgacctacccaccgatcactggcccgcctgcgacgacgcccccggtcaccggtccgcccgtgacctacccacccggcggaggcgggggcagctcgacgccgtgcccgccgccaccgagcccgacgccgacgccgtcgtcgccgacgtgcccggcggactcgctgaagctgggcgcgtgcgtggacctgctgggcgggctggtgcatatcggcctcggcgaccccgtggtgaacaagtgctgcccggtgctggaggggctggtggagctggaggcggccgtgtgcctctgcaccaccatcaagctcaggctcctcaacatcaacctctacctgccactggcgctccagctcctcctcacctgcggcaagacgccgccgccgggctacacctgcaccgtctgatctggactagctggcagcccccggctcatgcgtccatttatccgtgaacatgtacgtagctatacgtgcatgcatctctctgcaagtactagtcttttgcaagtggcacatgcacatgcacatatataatatgcgtacgtacatatacgtgtactagcctgcctggtctgatgactttgtttctacacgtgcaaatatgcaggggttttggagtgagctagcatccagttcatcggtcgtttgaagagagatcgacatgagaggatgtcgtctgcttcgtcgttccaagctgaagaaggcacgccggaggaggaagagagtaacaacggccgggtcgatcagctaacgatggatcgatcatttttttccccatatttattgtgttgcgtctgctgtagtttctaattttctagatgtgctttcggtttggtctgtagaccctgcagcttgatttggttaagtttgatttgatgcaagggaaatgggtggcggttgattgctaataattcccgttgatatttgtcatgcgtacgtgaacttgataacaaaatgcatgatgtcttctctttgcgtgatttcgagttgattgtcatcaccatggcactcgatcgtgctctttggcagtgttaacgtagtctgttatattatgctg

SEQ ID NO: 10675 - DNA, 1436 bp, Zea mays
agggtgtgcactccgatcctgccctctaataacagcagcagcagccgccatggaaggcagcagcaagaagctccagccgttcctcctcacgctgctgctggtgctctccaccgccgtgacgcccatcctctcgctgtcagtgccagacgacgaggtagcctgcgactgcgacaaacccaaggcgcccaagccgtcgcacccgcccaagaccaagccctcccacccgtcgccgtcgccgaagcccaagaaccccaagccacccaggggcagcaccgggtacccagcgccggggcaccaaccgcccaagagcccctcctaccccccggtcgtcggccctcccaagggccccgtcacgcgcccgccagtcacgcgtccgccggtcgtcggtcctcccaagggccccgtcacgcgcccgccggtcacgcgtccgccggttgtcggaccaccggtgacctacccgccgatcaccggccctccgacgacgccgcctgttgtcggaccaccggtgacctacccgccgatcaccggccctccaacaacgccgcctgttgtcggcccaccggtgacctacccaccgatcactggcccgcccgcgacgacgcccccggtcaccggtccgcccgtaacctacccacccggcggaggcgggggcagctcgacgccgtgcccgccgccaccgagcccgacgccgacgccgtcgtcgccgacgtgcccggcggactcgctgaagctgggcgcgtgcgtggacctgctgggcgggctggtgcatatcggcctcggcgaccccgtggtgaacaagtgctgcccggtgctggaggggctggtggagctggaggcggccgtgtgcctctgcaccaccatcaagctcaggctcctcaacatcaacctctacctgccactggcgctccagctcctcctcacctgcggcaagacgccgccgccgggctacacctgcaccgtctgatctggactagctggcagcccccggcccatgcgtccatttatccgtgaacatgggttttggagtgagctagcatccagttcatcggtcgtttgaagagagatcgacatgagaggatgtcgtctgcttcgtcgttccaagctgaagaaggcacgccggaggaggaagagagtaacaacggccgggtcgatcagctaacgatggatcgatcattttttccccatatttattgtgttgcgtctgctgtagtttctaattttctagatgtgctttcggtttggtctgtagaccctgcagcttgatttggttaagtttgatttgatgcaagggaaatgggtggcggttgattgctaataattcccgttgatatttgtcatgcgtacgtgaacttgataacaaaatgcatgatgtcttctctttgcgtgaaaaaaaaaaaaaaataatcaccatggcgcggccaacaactagtgagctc

SEQ ID NO: 10676 - DNA, 1820 bp, Zea mays
atggatgatcggggcttgtcgtcgtcgtcgtcgtcgcgggtccattcattggtcgcggatttaaaaccaaacaatcctggtagttgtttgtagttttgctagacaaggatccatcatcactcgctcactcactcatagaggccgtcaggccagtcgccctcgcccagtagtaggctagtagcgacgggcgacggtggagatcgtgcgaggctgtgtactacctgtacgcctccatcgtcgcctcgcaccatcaatcctgtgcggtgccagatcctccccgggtcttgtcttgtcgcaggtggaagccatgtccgccgcggacgcagccggcggcaaggaggcggcgccggcgtgcgactcctgcacgggcatgccggcggtggtgtactgccgggccgactccgcgaggctgtgcctgcagtgcgaccgccacgtgcacggcgccaacaccgtgtccacccgccacgcccgggcgccgctctgcgccgggtgccacgcagccgctgccgctgccgccacgcgcggccgcttcctctgcgccagctgccgcttgggggaggagaaggatgagcgggacggcggtggcgccgccgacagtagtagcgacgacggtggcgcggtggaagggtacgccgggtgcccctcggtcgccgatctcgcgaccatcctgggcgccggctccgcgtgggaggagccccagacgctccgcttggagagccggagctccggcggcgagctggctgacgaggtcatccgccagctggtggagctcgccaggtcggaggcggcggctcgcgctgagatggagcagcttactccatggccgtcgccggagcttgctgccattactggacagtacgccgacttcggggctctcgacgctgacaccgcctggcatgatgatgcagcagccatcgcggcagcagtagtgccttccactgaggaggagcagcaagcgtggatcgcggccggctgcgacgtcggcgcgtgccggacggaggagaaggcgcgcgagaacgacgctgctctggccgagccgtgtctgtcctcgttcgtggagatgtcagagatctgccccgccagcgtcgtcggtcaccctcagccacggcggggacgagggcgtcgacagcagcggcaagacagccccgcggccgcagctggccgcgccgacgccggcgaagggcggctacgacgtggcctaccccgaccgcggcacggtgatctcgcgctacaaggagaagcggaagaacaggaggttcgacaagcagatccggtacgagtcgcgcaaggcccgcgccgacggccggatgcggatcaaggggcggttcgccaagtccggcgaggtctgagacgcgtgcgggcgctcacgccatgccaacggcaacgagctggtagggggaccgtgcgtgtgtttcacgtgggtggttaggtttggtattttggttggtgttgcagctcgctgctcgcacgtgtcgatgcgtactagtctacgttgattagagacggttgtctactctttcctcattcgtttaataaaacacggctccaccaccaatgcaagtttcaccccgatcgattggaagcgtgtgtttacgtggagaactcgctaagttagatgtcgtttggtaatgtaatagataaccgatattgttaaattatatttgtttaggtttaattataattaataatatactagaaatagataccggcttattcgaacttgttactgccggtattcgagagtgaatcattaccattattatttaagttgtatttcgtgaatcaaacgacacattagtttctagtcaaatttgttattc

SEQ ID NO: 10677 - DNA, 1845 bp, Zea mays
  misc_feature (405)..(405): n is a, c, g, or t
  misc_feature (1496)..(1496): n is a, c, g, or t
tactcaccactgctccaaccactacgacttggacaactttcccatcagacaagctcaggtgcgtgaccgaaccctcgaccctggtcttagtcaaagatgcaaataaaggaaccaaacatcccctcctagcacaagttaacagcgagcaaaagggccataccaaagaccatatcggataccgggctcgaccacgcctcctcaccgtacacgacaaaccccgacacatctggaggccctccttgaagctataaatagagatatccggagcttcaggcaagggacaaacacttcacggttttcatctccacggtgatattgacatttgtctcaatcaaccccagagacttaagatctttccctctcccaaccagcttttactctctactgcaagcacttaggtgcaantaatataagtctcatcatctctgctggaagtagagtcttctcttatccgaatcagaataaaagacttgtgtcaccttagtatcactcatctgggaggttacacagtatcagattctcgtgtcaaaacaccgacaactgtcttaaaataaaaatcgaacaattttaaaaattgaagagtttaaatctgacatttataattgattgagggagctaaattgaacggttgagggaggttaaatttgggttcttttctttggcgtggaaacctcgaccgatctgtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctcagctggaaccttctcggcccgcctcaagaccttcgcccacggcacgcagaccctcactaaacttcgctttacaaggaatgattttactgaggatgataaagcggcgttcaaaaaagtgcttcaggaaggcctggttacgctctggtcaatggatctgggatggctagctctcggctagttctggatcgtgatttcggcggccttaacataattcgtagatgttctgctcctgttagcttcgttgagctgtttggtcggaataggtagtgaatcatttgctttggattattatgagaagtgtgaatcgagaattggatcttatgatggtgtcccgtgtatgtgtcctactgtctactgtaatttaacaggctgttgttccctagcagtactctcggcggctcagcgtgtttggtcagaggaatgtctccatccagaattatctgatctagaaactgaacctccttgtgctgtttgntttgtcatctgtcaccgtgtagtactcctgtggtagttattccgcaggatgagttcattctgcaaaaaaacgccagacccaccattctggttaaagtcatgccgcatgagctaaatctgcaaaccaaacactgttagttagaccttacccggtactggagtactctagttctgtgggtaagaaaaacaaggcagactggctttttgggcttggtgtgttacagtatatattataaacaaccagttaaattgtacctgtatgacagcacctgttattaagcgttagtgcaggactgctggttagggcactacccaatacccgtttttattttatttacccatggtgtata

SEQ ID NO: 10678 - DNA, 1390 bp, Zea mays
ccacgcgtccgcccacgcgtccgtaaccgggtgcttttctttggcgtgggaacctcgaccgatctgtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctcagctggaaccttctcggcccgcctcaagaccttcgcccacggcacgcagaccctcactaaacttcgctttacaaggaatgattttactgaggatgataaagcggcgttcaaaaaagtgcttcaggaagatggcttttatacaattaggctgccatctaatgtgttggacactacaaagaaacatcatgttgtttcttcaatcagagctagatgcattccacgtgacagtttggatgaacacattgttatccacatggatggtgtaaatattttggcagtcaattatggctctgttgatgggtgccaataccctaggcctatgaaattgccatcaaaatggacattcagctcttacactatcctaaagactgctgaacaggcaccaagaaccccatcgtttgcagatcagttaatagaagctgacaatggtcttggcgaagtaatgaaaccacctgagaaatctttctgggctaaatattggatgtacatcattccgcttggtcttattgtcatgaatgctgttacggcagctgccaacataccagaggaagctgcagggcagggccaacctggagcacaacgggcacctgctgctgttgctgggaggaggagatgatggctgccttccataccgtagttaactatcttcacattgttttctgttttttttggggtattgtatcaatcttaccttgactgcatcatctatggcactgcatgatgatgccatcttttgcttgtgttgaaacacgtagcctatccaagacaatgtggttcctatacatctgtagccaattttggccactagcatgccattggacactgaaactttacttgaagcctgtgcacacatcatttgcagtgaccacttcatacttgatgcagcaaaaacacctattaatttcagctgttgaattttctgctaataaaaaaagaaacaaaactcgtgcaagaaaaaaaaaaaaaaaaaaaaaaaaaaattaaaat

SEQ ID NO: 10679 - DNA, 1118 bp, Zea mays
  misc_feature (481)..(481): n is a, c, g, or t
ccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctcagctggaaccttctcggcccgcctcaagacccgcccccacggctcccagagatgcattccacgtgacagtttggatgaacacattgttatccacatggatggtgtaaatatcttggcagtcaattatggctctgttgatgggtgccaataccctagngcctatgaaattgccatcaaaatggacattcagctcttacactatcctaaagactgctgaacaggcaccaagaaccccatcgtttgcagatcagttaatagaagctgacaatggtcttggcgaagtaatgaaaccacctgagaaatctttctgggctaaatattggatgtacatcattccgcttggtcttattgtcatgaatgctgttacggcagctgccaacataccagaggaagctgcagggcagggccaacctggagcacaacgggcacctgctgctgttgctgggaggaggagatgatggctgccttccataccgtagttaactatcttcacattgttttctgttttttttggggtattgtatcaatcttaccttgactgcatcatctatggcactgcgtgatgatgccatcttttgcttgtgttgaaacacgcagcctatccaagacaatgtggttcctatacatctgtagccaattttggccactagcatgccattggacacttgaaactttacttgaagcctgtgcacccatcatttgcagtgacgacttcatacttgatgttgcaaaaacccctattaatttcagctgttgaattttctgctaataattcatgctttcgttctctgttc

SEQ ID NO: 10680 - DNA, 1219 bp, Zea mays
cttggacacatgcttcttatctccagtacctgaaacttctttttgtctggactagtaatatcatgattatcagcgatccctccacctgcttctgtgcgcctctcagtagtgacctcgtccttctcctcaacactctcatggctgccaccaccaagcttcctcccaccatcagatgaatgcagatgagcatcctccaaatcatcctgcatatcgatgccatcatcatactcatcgtctggatcaacctccttcacccctgttcctgtggctcccatggctgcagcctcatactgcgccagctccttcctgccaccctcattgtacaaggtccctgctttcccaccttcagacgcctctggaacatccttagcgccactgccagtctctagagtcaatcctttatcctcgccacctgcctcagaggtggtacctttatcgccactgccaccagcatctgtggaggccccagttccacctgagttcttctccttctcgtcctcagtgtagtcctcgtcgcggcgcctatcgtcccggtcccagtacctggagtctcgcgcgctccggccacctccgccttgcccgaacttgagcttcttccagcttttgctctggttccactctggcaacgcctccccggcgctcgaatcttggctgacctctgcagaactgcgtgaaatgcggcgcgagaggaggaagacggcggcaaggaggaggagcgcggcggcaacggcagcggcaggcgatcggcggcgcggcgcgggcttcccggggcggcggatccgggaggatggcttggcagaggcgtggtgaggccggtgccagtccgggagcgcctggtgctgatggccgcgggagtcggagaagccaccgccgtactgctgcctgtactgcgccattagaggcccccgcagcggaggtggcggtcgacggccaccagcaccatgaacgcagaggagggggaacgggaagcaaggtcttccttgtaattatgacggggattggtcggagagggttgttaattgcacgtgatgatggtgaggattaggagcggcggcgaatgactattaccgtcagcccccgcggccggtttggtgagacgggaagacatgcgagccgacatgtccataagtattaccatagcgggctttgtcctataaattaggactgcaacaaacaacttaaatacaacaatactacagaagcaatactgcaggcatgc

SEQ ID NO: 10681 - DNA, 4258 bp, Zea mays
  misc_feature (2232)..(2232): n is a, c, g, or t
tgtttcctttgtagcttactcagctgatccattttcttcagcttgattcatctttcattcaatacctgaacactagttagatcttaacggaaatatatgggggttgtccttaacatctttgagtatgccttgtaattcgttgcacaggtgtctgtcgacgttcctgatgtacgtggaaggacagagattctaaaagtgcatggtagcaacaagaaatttgattctgatgtttctcttgatgtcatagcaatgagaacacctgggttcagcggagcagacttggcaaaccttctgaatgaagcagccattctggctggaagacggggaaggacagcaatttcttcaaaagagattgatgattctattgacagaattgtagctggtatggaagggaccgtgatgacagacgggaagagcaaaagtcttgttgcttaccatgaagttgggcatgcaatttgcggaactttgacgtcctcttaacagatcttttctcctttgccttgaacattagaatgtgattggtttaattttggtttcgattggtttctcagatatcctgatgtgcattttaatatttctgaggtatttcaattggtttgggtacatacgtgcgctagtatggtttctaaagatggacagctaaatcttttctaaaatggcctggtaattggaaggatgacagtgaattatttgatgttgaaatagagtacaactttgtcttaatatttaatgcatagcccattgctgtgatgtacaagtagcccacgaaccaaacgctgctcattcatggactatccaccaaaccaaacacaccctaggtggcttctttgtttctatgtttcccatctaaaaagcatattttatctttgcggcttcacttttgagttattggagtgccttttgtacgcgatttccttggtaaccattccatgccaaatttgtacctaatctcattcatttgtggaaacctctttgcagaactttgacacctggccatgatcctgtccaaaaggttaccttaatcccaaggggtcaagctcgtggtcttacatggtttatcccgatggatgacccaacactcatctccaggcagcaactttttgccagaattgttggcggccttggtggtagagctgctgaggaggtgatatttggagagcctgaggtgaccactggagctgctggtgacttgcagcaaattactggcttagccaagcaggtatacttccctttgcattgcaattttgtcaacgggaatgttaatgtttgcaaagaattttgctggtcatcacaaaccattttgcactttatgactaagaaccaaactatgctgcaaaatcacatggtagagcctgttataattgacagcaatctatagatttgttgtctcaaggctttactactactgatcttcgttgccaactgtactgagatcacaatggtcctgcagatggtggtaacgttcggtatgtctgaaattggtccatggtctctgatggagggtggggcacagagtggggacgtcatcatgcgaatgatggcaaggaactccatgtcagagaagcttgcggaggacattgattcggcagtgaagcagttgtcagatgaggcctacgagatcgcattgaggcacattagaaacaacagggaggccatcgacaaaatcgttgaggtgctcattgagaaggagacactggccggagacgagttccgggcgattctttctgagtttgtggagatccctgtagagaaccgggttcccccagccacaccggcggccgccctccctgcctaaagtcaagtcttgtagggggtgaaatttgttgttgtaagatgttcatattttggattcttggtgtacactaattctacttcacctgccgggtttttggtagacgacatgtaacttgctcatggtgaactatagtaaaatgtaattagcttaaaaggcctggcgcaacattttcggtttctagcttctggcgagtgacgtcgcttgctcgtagattaacgagaaaattgcacggttcctacttcataaagctatgttcctactaagaacttgtcattttcctttttggaactctgggattgaggtcagcaaattgccaaatttctaaatactaatctaaggatctctttgggagcgctctcggatgctctggctcgactctttctgctctggttctttctgccgctccggctctggccacaggcccacagccaccttgnctcggctcctaggagagagccatcaaccgtgagagcttggctcggctcctaggagagaccatcaaccgtgagagcgttattcagggaactgtgcggagcgggagccggagccagtcgggagccggagccagtggattgtcgggtgccgttcggccggagccggagtgtcgccgagctcttccaaaatggccataaccagcaaacttaggatctgtttggtagggctttgattttttaaaaatgatcatctttaccttctatgtaggagtagctcctctataagagtcactgtttttttttgcaaattgtttagtaaaacagttcttctgatattttttatttaatgtatgactcaaatatctacagtattcttggttagacatttacacaaacaatttgtacgcgtactacgctgcctccgtcaagaacaccgcgccgcgtgccggctgcctttccagtttcctcacgctgcatgcgcacgctatgctgccactgctcacgcacgctatgttgccgcctccatgcgttcacgcgcgagctcgtgctatgctgcctctgctcacacacgctatgctgccgtcatgcattcgtgcgcgagctcgtggaaccagtaaggcttagcaacatcgtctaaatttcgttcttttaaaaaaatatttctcgttctttacaacactgtctaaaacatttttttctcaacgtcctctaaattttatcctctatattttatgttctatattttcacaattatatcaatattaatgtaagtttttacgaccgtaatgtttaacaaaatattgtgtcgtttacatattacataccatttttaattatgcattaataaatattttaagaactatacatactaagcaaattctctttctgctggccggcgagtggcttgcttctttttctagtcgccggcgccatgtagcatagcagcgcttgctggtggccgtccgctgttgactgcaggtgctagtggccatccacacagcaacaacgaatgttgctagtcgtccgctggtggccaccgacgccatgttggtggccgtccgctgtcgtccattggtggtcgtcgttgctggtagcatttacggcctcacgccaacgatagcgaacaaaagaagttcactagcctgttcgctaaaacagtctgttcgctatatatagcggatgttttcctcatatacgcctccagcaaggactgctatatggtcatatatatttagcacacgctgtcagagacgctaaaggtagatcagttccacggccgcccgctatgcactgttgcttacgtacggtcgcccgcaccggtcaagaactattgcctatttagtttccgtgtacgtccaatagaaaaatatatacaatataaagtttatttagaaaactttcctgttttgttttcctatacatccgatagaaaaaaaaatataatacaaaatttagctagacaatgcaatttcctatactgtgttatcttaattaatttaacaggccactaatttcgaattttaaatacttaatttaaaatttaatttgaatacgtacagttgacagacaatgcaatacaaactaaattgaattagaaatttagttatcactgttgatatagaggaccaaatttagagaatattgttggagatgataaagatatagatgacggaatcttttagagggtgctgtaaaggacagagaatattcttttagtggatgaaatttagaagacgttgttggagacagccggacgctgagctattacagaggaccgtatagggttcgttgttggagctaaatatagagctcaaaacactttagcattaattccttgttatagagagagaggctggctccagcaagggcctctaaagggttctctaccctaaatatagaggatcaaacggtcctctactctctctaaccgcgtcctctaaacggtcctttaaatttagaggacgctgctggattctctatatatagagttttttaaacggtcctcaatccatttaaaacttaaaaaggc

SEQ ID NO: 10682 - DNA, 2641 bp, Zea mays
  misc_feature (2623)..(2624): n is a, c, g, or t
cgagggccggccgggggccgggatacaaaaaaaaaaaaaaaacccgcctcaagcattgggtacctcgccggccgccggcatgtgggctcatctcttccttatcgacgctgtggccgcccagccgcccacgttgcctcctccctgagacaatccccacgccaccgcgcaccggagacgaacctgaggagagaaaaatctgcgcccgtcagtgtgctcgcctacttctacgctccgctcgttcccccaaatagttcctcggcttcgctcccttcccctccctgctccggctccggttcgcacacagtaagaaaagatggcgctgccatccatgagtcttgtggcaaagggtgtgcttcccttctcagcacgtacctcgagtggtgtcacacaaaggccggtgtcagtgactgcttccttggagcacaaaaccagcgatgccagaaggaagttcctaaaacttgcgcttgggaaccttggagttggactgcccaccttgttgggcgctaagaaagctctcgctgatgagcaaggcgtctcgtcctcgaggatgtcttattcgaggttccttgagtatcttgacaaggatagagtgaagaaggttgatttgtttgagaatgggacaattgctattgtggaggccatttctcctgagcttggtaaccgcgtgcaaagagtccgtgtgcagcttcctggtctaagccaggagcttcttcaaaagttgagggagaagaacatcgattttgctgctcacagcaaccaggaggactctggttctcttctgttcaaccttattggaaatttggcattcccgcttatccttatcggtggtctgtttttactttcaagaagggcacagggtggcctcggtggacccaatggtcctggctttccccttggttttggtcaatctagggccaagtttcagatggaacccaacactggtgttacatttgatgatgttgctggtgtcgatgaagcgaagcaagacttcatggaagtggttgagttcttgaagaaacccgaaaggttcactgctgttggtgctcgcattcctaagggtgttctgcttgtcggtcctcctgggacgggtaaaactttgcttgccaaggcaattgcaggagaggctggcgtgccatttttctcaatttcaggttctgagtttgtggagatgtttgttggtgttggagcttccagagttcgtgaccttttcaagaaggccaaggagaatgctccttgcatagtgtttgttgatgaaattgatgctgttggaaggcaaagaggtacaggtattggtggtggaaatgatgaaagggagcagactctcaatcaactactaactgagatggatggtttcgagggcaacactggaattattgttattgctgccactaaccgggctgacatcttggattccgctttacttagacctgggcgttttgatagacaggtgtctgtcgacgttcctgatgtacgtggaaggacagagattctaaaagtgcatggtagcaacaagaagtttgattctgatgtttctcttgatgtcatagcaatgagaacacctgggttcagcggagcagacttggcaaaccttctgaatgaagcagccattctggctggaagacggggaaggacagcaatttcttcaaaagagattgatgattctattgacagaattgtagctggtatggaagggaccgtgatgacagacgggaagagcaaaagtcttgttgcttaccatgaagttgggcatgcaatttgcggaactttgacgcctggccatgatcctgtccaaaaggttaccttagttccaaggggtcaagctcgtggtcttacatggtttatcccgatggatgacccaacactcatctccaggcagcaactttttgccagaattgttggcggccttggtggtagagctgctgaggaggtcatatttggagagcctgaggtgaccactggagctgctggtgacttgcagcaaattactggcttagccaagcagatggttgtgacattcggtatgtctgaaattggtccatggtctctgatggagggtggagcgcagagtggggacgtcatcatgagaatgatggcaaggaactccatgtcagagaagctcgcggaggacattgattcggccgtgaagcagttgtcggatgaggcctacgagatcgctttgaggcacattagaaacaacagggaggccattgacaaaatcgttgaggtgctcattgagaaggagacagtgaccggagacgagttccgggcgatcctttctgagtttgccgagatccctgttgagaaccgggttcccccagccacaccggcggccgcgctcccagcctaaaccctagccttgtaggggaggattttcttgttgtatggtgttcatattttggattcttggtgtacactaactctactaaatctgccggattttcggtacacgacatgtaagatgtaacttactcatggtgaattaatagtaaaatgtaattagattaaaaaaaaaaaaaaaaaacaacattttcagtttggagcttcgcttctggcgagcgaaaactcttgctatatgttccacggttcctactttcataaactatatgttctaattagaacttgnncattttgtttttgcaaa

SEQ ID NO: 10683 - DNA, 2546 bp, Zea mays
ccgggatcgacgctgtggtcaccgaaccgcccacgtcacccccttccgtcctcccccgggacaatcccctcgcaaccgcgcaccggagcggcggagcctgacgagtctacactagcggtggggcgagcaaaatctgcgccagttcgcctcgcctacttatacacttgggtacctcgaggccggccggggacttcgctccctttccctcctcccagctccggccccggctccggttctcacgcagtaagcaaagatggcaccaccatccatgtgtcttgcggcaaagggggtgcttcccttctcggcacttatttcaagtggtgttacacaaaggccagtgtcagtgaccgcttccttggagcacaaaaccagcgatgctagaaggaagttcctaaaacttgcgcttgggaatatcggagttggactgcccaccttgttgggtgttaagaaagctctcgctgatgagcaaggaatctcgtcctcgaggatgtcttattcaaggttccttgagtatcttgacaagggtagagtgaagaaggttgatttatttgagaatgggacaattgctatcgtggaggccatttctcctgagcttggcaaccgcgtgcagagagtccgtgtgcagcttcctggtctaagccaggagcttcttcagaagttgagggaaaagaacatcgattttgctgctcacagcaaccaggaggactctggttctcttctgttcaaccttattggaaatttggcattcccacttattcttatcggtggtctatttttactgtcaagaagggcacaaggtggccttggtggacccaatggccctggttttccccttggttttggtcaatctagggccaagtttcagatggaacccaacactggtgttacatttgatgatgttgctggtgtggatgaagcgaagcaagacttcatggaggtggttgagttcttgaagaaacctgaaaggttcactgctgttggtgctcgcattcctaaaggtgttctgcttgtcggtcctcctgggactggtaaaactttgcttgccaaggcaattgcaggagaggctggcgtaccatttttctcaatttcaggttctgagtttgtggagatgtttgttggtgttggtgcttccagagtacgtgaccttttcaagaaggccaaggagaacgctccttgcatagtgtttgtcgatgaaattgatgctgttggaaggcaaagaggtacaggtattggtggtggaaatgatgaaagggagcagactctaaatcaactactaactgagatggatggttttgagggcaacaccggaattattgttattgctgccactaaccgagctgacatcttggattccgctttacttagacctgggcgctttgacagacaggtgtctgttgatgttcctgatgtacgtggaaggacagagattctaaaagtgcatggtggcaacaagaaatttgattctgatgtttctctcgatgtcatagcaatgagaacacctgggttcagtggagcagacttggcaaaccttctgaatgaagcagccattctggctggacggcgggggaggacagcaatttcttcaaaagagatagatgattctattgacagaattgtggctggtatggaagggactgtgatgacagacgggaagagcaaaagtcttgttgcttaccatgaagtcgggcatgcaatttgcggaactttgacacctggccatgatcctgtccaaaaggttaccttaatcccaaggggtcaagctcgtggtcttacatggtttatcccgatggatgacccaacactcatctccaggcagcaactttttgccagaattgttggcggccttggtggtagagctgctgaggaggtgatatttggagagcctgaggtgaccactggagctgctggtgacttgcagcaaattactggcttagccaagcagatggtggtaacgttcggtatgtctgaaattggtccatggtctctgatggagggtggggcacagagtggggacgtcatcatgcgaatgatggcaaggaactccatgtcagagaagcttgcggaggacattgattcggcagtgaagcagttgtcagatgaggcctacgagatcgcattgaggcacattagaaacaacagggaggccatcgacaaaatcgttgaggtgctcattgagaaggagacactggccggagacgagttccgggcgattctttctgagtttgtggagatccctgtagagaaccgggttcccccagccacaccggcggccgccctccctgcctaaagtcaagtcttgtagggggtgaaatttgttgttgtaagatgttcatattttggattcttggtgtacactaattctacttcacctgccgggtttttggtagacgacatgtaacttgctcatggtgaactatagtaaaatgtaattagcttaaaaggcctggcgcaacattttcggtttctagcttctggcgagtgaattctcttgctcgtagattaacgagaaaattgcacggttcctacttaaaaaaaaaaaaaaaaaa

SEQ ID NO: 10684 - DNA, 1319 bp, Zea mays
ttgggaccctcgaggccggccgagaccttatccccaacctccggtccacggtgactggccgcaagctcctcctctcccgcaaacacccacgcccactccatcgctcctctcctccaacatcgctcacgcggtctcctctccccgctcagctccgctcccggagacacgcaagcttcccgttcccgggaacacgcactaaagatgcctccagccttcgccgccgcaccttcctcctcgatatgtggcgttcgcatcccaactgtgcgccgtttcgaagcgcaaagcacggtttccacgcccagatttctgcgtaatcgggtggcagcaaaaacacggtctacatcagcttggtccttgaaggctggcttgtgggattctctcagatctggccttttgaagaataatagcagtacagagacagtagagccaccaccagcaccacttgaagtggaagagcctttgcctgtggaaatagtactcctagaaagaacactacctgatggaagtacagaacaaattttattttcttcagccggagatgttgatgtatatgatctccaagccttatgcgataaggtaggatggccacgcaggcctctttcaaagatagcagcctcattaagaaatagctacttggttgctacactatattcaataattagatcttcagaaacagagggagaagagaagaaacagctcattgggatggcacgagcaacctcagaccatgccttcaatgcaacgatttgggatgtccttgttgatccttcataccagggtcagggtcttggtaaagcgctcatggagaaagtaattcgtactttgctccagagagacatcaacaacattacactgtttgcggataacaaagttatagatttctacaagaacctggggttcgaagttgatcctcaaggcatcaagggcatgttctggtaccccagattttagcaccagcagccagatatatcgttcgaggggttgttgtacttgaagcatctccccgttctgaaagggtaattgcaggtcagattgacaggtcaggggctccacgccctgatggatctcgcacttaatatttcatccttggtgagaagctgtaattttcttcaatgctaaagcgaccatgtgatcggctcaactcgccgcacccctgttgtaaccataaccccaacaaaacacgctatttgtaatacccttgtttcatacatgcgctctggactcttgccatctgtatgtaacgtacattttcaaatttctacactcgaaatggaaaaaaaaaactgtatccatcagttatccatatgcgcacaccatcg

SEQ ID NO: 10685 - DNA, 1268 bp, Zea mays
gggtacctcgaggccggccgggtgtcgtgccaatccaacaaaagtcccaagctcctcctctcccgcaaacaccctcgccccctccatcgcggccggccgccaacatcgctcacgcggtctcctctccccgctcagctccgctccgctcccggagacacgcaagcttcccgttcccgggaacgcgcactaaagatgcctccagccttcgccgccgcaccttcctcctcgatatgtggcgttcgcatcccaactgtgcgccgtttcgaagcgcaaagcacggtttccacgcccagatttatgcgtaatcgggtggcagcaaaaacacggtctacatcagcttggtccttgaaggctggcttgtgggattctctcagatctggccttttgaagaataatagcagtacagagacagtagagccaccaccagcaccacttgaagtggaagagcctttgcctgtggaaatagtactcctagaaagaacactacctgatggaagcacagaacaaattttattttcttcagccggagatgttgatgtatatgatctccaagccttatgcaataaggtaggatggccacgcaggcctctttcaaagatagcagcctcattaagaaatagctacttggttgctacactatattcaataattagatcttcagaaacagagggagaagagaagaaacagctcattgggatggcacgagcaacctcagaccatgccttcaatgcaacgatttgggatgtccttgttgatccttcataccagggtcagggtcttggtaaagcactcatggagaaagtaattcgtactttgctccagcgagacatcaacaacattacactgtttgcggataacaaagttatagatttctacaataacctggggttcgaagttgatcctcaaggcatcaagggcatgttctggtaccccagattttagcaccagcagccagatatatcgttcgaggggttgttgtacttgaagcatctccccgttctgaaagggtaattgcaggtcagggctccacgccctgatggatctcgcacttaatatttcacccttggtgagaagctgtaattttcttcaatgctaaaacgaccatgtgatcggctcaactcgccgcacccctgttgtaaccataaccccaacaaaacacgctatttgtgatacccgtgtttcatacatgcgctctggactcttgccatctgtatgtaacgtacgttttcaaatttctacactccaaaaaaaaaaaaaaaaaagcggcc

SEQ ID NO: 10686 - DNA, 6362 bp, Zea mays
ctttatacatacttttccagcttgcaaaagccaccgttacattgcaatgagaaactgaaacgagggcagagaaatttcgttgtagtactgtaagttttaatccgcaagtcatatagtatgaaaataaaagcaaacaacaggactccatggttgttaaagaaaacatgactacaaggtgtagtactcagtacgggtgtattaataccacattctgactgtactatccccggacgtctcaaataaaacaaaccaaaataaataaaaataaaactctattaatccaaaaaaacacaaaactctattaatccttcttgtctgtaaggagttaaacagttccaaatcttgttagataagcaaaaccaatataataatcacatatttaagtaagtaatttattaatactacccaaacggcaaacgcaagtatgaaaaaggagaggaaactcccccccattgcagtgtccttgtttttcccaggcttttccctcagaaaaagcaggcggtaaataaagcactggtactactggcgagcattgatgcttttcattgaagaggtgagcagtctgcgtgggcgcgcattcgcagcactcatgcggtcagctccgcccctgcgaatactactggcacatttggaagggcattgaaagcagtaaaaactgaagctagctacctccaatgacagcctggacccctccacggcccacggtacggcggagacgctcctccttcgcctcctagctcctttcctatataaaagccctctgccttgctcgcccttctagcacacaagcacaccgctccgcacttctccctgtcgtctcgcccgcccgcgcgcgcggtcgtttaaccttttttctcccaccgctcgccccgtcccgctttccccccggcagcgacgactcctgcggaggtacagagagatgaggacgaggagcgggtcccggtattccaacggcggcgaggtggttgccttggtgggtcagaagaggaagaggtcgccgtcggccgtcgccggagagtgcgactgcggcgggcgcaggaagcggcctgccggcgagccggactacctggacgcgcttcccgatgaccttgtcctctccatcctgtccaagctcgccgccgcctcctcggcgccgtccgacctgctctcggtccacctcacgtacgtctgcctgcctgcccgagcatcctttgcgttttgtcatcaactcctcgtgtttcctcgcacggcgagcgcaccgtctccctcgcgctatggagtaatcgaaatgcgtgggggggagcgacggcagttgtgctgttttcggaaacataagctggagggagaggccaaggatcgtgcgctgacgtctttcgcgtttgcaggtgcaagaggctgaacgagctcggcagccatgacatggtgttcgccaaggcctcgccggcgtcgctggcggtcaaggcggcggcgtggtccgagccggcgcagaggttcctcaagcgctgcgccgacgccggcaacctcgaggcctgctacaacctgggcatggtacgccacgcgacccaaaccctaacgagttgcaagtagacttgatcgggtcgattccgttgcttcctctcgactcaagcgcgcatggcatggtcatggtggatatgggcgctgacctgggacgctcgcttccgcagatccgcttctactgcctgggcagccgcagcggcggcgcggcgctgctggcgagggcggccgtcggcgggcacgcggcggcgctccactcgctggcggtcatccagttcaacggcagcggcggggccaagtcggaccgcgacctgcgcgcgggggctgccctgtgcgcgcgcgcggcctcgctgggccacgtcgacgcgctccgcgagctcgggcactgcctccaggacggctacggcgtgcggcgggaccccgccgagggccggcgcctgctggtcgcggcgaacgcccgcgagctcacgctcgcgctctccgcggccgcctcgcgccacgccgtcgccgcgctgcccttcgccgcggccgccggcgtcgtcggcggcggcggggggtgccccctcctgtccgacttcgggtggagcctccccgaggcggagccccacgcggcgaaccagttcatggtggactggtgggcctcccgctgcgccgcccaggcgggcgggaagaaggacggcgacggcagcggcgtggacggcgacggagacggcgcggagctccgtctttgctcccacgtgcggtgcgggcggcgcgagacgcggcggcacgagttccggcggtgctccgtgtgcggcgcggccaactactgctcccgcgcgtgccaggcgctggactggaagcgcgcgcacaaggcgcagtgcgtgcccatggaccggtggctcctcgccggcgttgccgttggcggcggcgtcgaggcgcagcagcaccagcagtgagcgaggaaacggctcggcggctgacatgacgtaccagcaccgagtcccctacaggcccacggctccgctgcgtggaccgggcgtagcggaaagcggcgcagggggggagaaggcgtttcggctgttttctctttctttttgcctctttttcacctgctgatgaattgaatgaggtgtatatcgctggcgctgcctgccgttcagatgcgcattttctactaggtagtaccagggaagcaaagagccaaagagcagtggagatccagcagccgcgcctctcctttattttcttgtaatgttctggcatttccaagctagaaatcgtagaattccaatttccaagccgttttgtaatggagctttggagctgaggttttccatgggggtttctgtcgccttgtgtgctggtgttttggatggatgctgtgcaggtacggccaaacggctgttcggttcgggcgccgcgaccgcgagtgggtgtgtgtgggttacccgcggcggtacaatcggttggggtgcgtgctgtgtggcaaaagccttttccgtctcgggcgctgcgaggcttggagctttctctctggctgctcatgctgttgggagcggtggcggtgactgcaaaagtgacgcggatttcagtggctctcggctaggtctagggctagcaaaagacgcccccaagatgatgagtgcgcgctgcctttttgccgctccaaatacacgcgatacgcctgtctagcactcgtacacggtaatgtatggcgggccacgctggaaatacaagaaacctacgagtacatgtttctttttcctttccttttaaaactttgtggacgtggagttgcagcgtggaacagcccgatgctggtgcagagcaaagctgcgtgaagacctatttggagggcatacaaaacctagagagagtacctgtggagtaccatgcattctgtggacacaggagataagacctcgatgatcagcaaaagaaagcaaggatgagatcatgactcatgagatagatagagagagagagaactgcactgctccatggagtacgtatattgacacccacgttccaccgtccagcaaaccgaaaaaacaacggggcaagcaacaacggcggccgcacatagtggtacgaaacttggaggctccgaactctgagcaaacgcgggtgacgtagatacgcacgcacgcgatgcacgagccggcagggaaaaaacgagagagagagaacgaaagatgtatgggcgcgtccagaccaggctcccactcccagcaccggcggcaaaccgctggtgcacctcgcgcgccctccccctatccccccgtccgaaggcgctgcgtgcggtggagaccaagccaacaggcaggacgcgcggcggcgtggaccgacgcaacagcgtggcgttcccgcgacgtgacacctgcggcatagacagtgtcgccaatcaggagccgctgcgtgcgtgcgtgcgtgcgtccacagtcaggcgctgctagcttcgttcgccgtcgcgtgcctttgcctgtgcttgacctctgctacccggcgtccacaggtcgctctcgctgctcgtcctacagagcttgctgctggcttctccggggccggaggagccttgcctggaactggagctgtacgccgcggcggagcggagcaaatggcaccagcaagcagccaggcagccagccaggcagctggtgggaaccgggggatcgtgatttcctttttctccaatccctgtggtggtgaggaatcgaatacatgatgatgggccggcgacccttgggttgttttcgtggcccccgcggcgtgtgtgcatattcacatggcatgatcgtcagtccctttggttattatcattatttttcgtcgtaagtgtggagcaagtgtgcgaatcgtgctctcgtctcccacacacggccacacccacatccacatgcgcgtgatgggctccgtatcggtttttacttcctccgcctgacaactaaccatcggctgtaagtaacatcgcgtgccgttgaatagcatggagacgttactcgttcgcgcccgtgcaattcgcggcgtcgtctgaaggaaaatctgcgccgcccgtgcatgtgcgtatgcacgcgaccttcatcggctcaccgtcgtcggtcgtcgcctgtcgtcctccgatctaggccaccgcgcggtagctggtcgagaccgtgcctggtctcgcggccctggcgccgccgccccccacccctctcctgtgtgccgctgtggctcccgtcccggggatctgcctccgccacctgctacttacggcgaccgtacgttgctcgggatctaggagaacagtgtttgagttgcagtagagggatggacgggaacaaaagagaatagtgcttggagttggagccggacacgaggagatgtggtaggctgcttctcagcccttcagaatggtgctgggagtggacccactggtttcgatggtgggagtgatgggagtatgggacgacacactagtcccacacacaaaaaaaaaggattccccatatatgttgatcatattccggtatcccaaacagctccactcgttgtattcctgtagtttttcgatcctctggtttctcctctcattcttttctctttcctccacttctttttttcccctctcgttcctacatcttacattcctttgttccaaacacgcttttaatataggttgcctctccttacgactctaaagcctattttgtatccatgtttttcgcactttgcatggctgcccatcttttttaaacgaaacatatgtcagtctgatataaaagtttaaagtacaactatgacatagaagcgaccataaatctgcaaatcaaatattccaaattcagaatttcccgaattaaatttatgatttaattaaaattatcaactattctaaaaacaaagtttaaaatttcaaaacaaaattcaatttcagtcattgaaaattctaaacgttttggaaatttccaaatttaactcaaaaatttgaatcgggttttcaaattgtttgaagtgtttatttattgaaaaataacatttatttttttgaaacaattcaaaattttgtattaaaccataccaagtatttgaaatttatggttggaaacccttgataataagaggggcaatgatgcaagggtataaacccatttttatgggttgagttaacaccactatgtgcttataacggaatagaggcaaatggaggtttcgtttcaaaaaagaggggcaaccatgtaaacttcaaaaaggggtaaaaatggagttagggtcattagtaggggcaaccttgcaaatgccccttttaatataactttagatcagtatacgccttttaactcatctctcacggtaataataactataatgttaaatcttagaggcaagcacctctagaaccaataataaaagtcctcatcatctgtgtgccccaaatttcttagctcaactataattatatcattttcgtcacactctcatcttcgtttatctagaattttgcttttttatctttaaaggtatatatctttgttcctttaacaactgatctacattcttattaatctccaagactttacctcactttatatgcaaattccaaatctttgatcgattcaaagacctttggatcaagagcttcatatatcacattgagggattgatcacttggtcctacgctctttatatgtagcactacaaaagaatcatgtatgacacaaattttctagctcatggacttttgttgtaaacatatccccttctaataatcataattagttctacaaagtgaggtggtttaccaatatgattacttgtcacatttttaaccgtaggttgttaagccttgaaaatggtgtccttgctacaataccaattgaatggatctatatggctagcatgggacg

SEQ ID NO: 10687 - DNA, 896 bp, Zea mays
gcacgagaccattacctagaacatcctaatcgaaaaacaagcacaccgctccgcacttctccctgtcgtctcgcccgcccgcgcgcgcggtcgtttaaccttttttctcccaccgctcgccccgtcccgctttccccccggcagcgacgactcctgcggaggtacagagagatgaggacgaggagcgggtcccggtattccaacggcggcgaggtggttgccttggtgggtcagaagaggaagaggtcgccgtcggccgtcgccggagagtgcgactgcggcgggcgcaagaagcggcctgccggcgagccggactacctggacgcgcttcccgatgaccttatcctctccatcctgtccaagctcgccgccgcctcctcggcgccgtccgacctgctctcggtccacctcacgtgcaagaggctgaacgagctcggcagccatgacatggtgttcgccaaggcctcgccggcgtcgctggccgtcaaggcggcggcgtggtccgagccggcgcagaggttcctcaagcgctgcgccgacgccggcaacctcgaggcctgctacaacctgggcatgatccgcttctactgcctgggcagccgcagcggcggcgcggcgctgctggctcgggcggccgtcggcgggcacgcggcggcgctctactcgctggcggtcatccagttcaacggcagcggcggggccaagtcggaccgcgacctgcgcgcgggggctgcgctgtgcgcgcgcgcggcctcgctgggccacgtcgacgcgctccgcgagctcgggcactgcctccaggacggctacggcgtgcggcgggaccccgccgagggccggcgcctgctggtcgcggcgaacgcccgcgagctcacgctcgcgctctccgcggccgc

SEQ ID NO: 10688 - DNA, 2046 bp, Zea mays
cattgggtacctcgggccccgcggggttctgctacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattccatagcaatgctgatgagtctatcgcccattcatctccattggcaacattaatacaacgttcacagcgccattgctatggggatggatccccaggcgaatttccccttgctgtgagcccctccattgttctccatgtgctctcatcttgtgatctaggtccgaaagatctcgccaatctggaggctacatgcgtatttttcggcaaacctgcaagttttgcaccagactttgcattgtcacttccggagcttgcggcatttgatatgtgccagaaaaggaccatgtttaagcagatgaagcaagaagatcaggagtgtctgaaacaacggtgtggaggctcttggaagcatgttcttgggtacattctggttagggagaagaatggttctcgggtgattgccgggccaggccatagcatcattatcacctcaaatggagatgtatattcgtttggagcaaactgctccggtcagcttggccttggggattcagaagaccggttcaagccatgtgttattaggtctctacaaggcatcagaatcacacaagctgcagttggttcgagatgcacaatgcttgtgagtgacacaggaagcgtctactcatttgggaaggaggatttcagggtcgcagaactagttgacggtgctcattttcagatcacaactcctaggattgaggagtcactgaagggtgtgtttgtagttcaagcagccatagggggttacttctctgcagttctgtccagagagggtcgagtgtacaccttctcatggggcaaagccgagaggcttggccacagttcggatccttcagatgtcgagcctcgtcttctccctggactcgaggatgttcctgtcgcatacatctctgcaggaaattgctaccttcttatgctggcctaccagccaaatggaatgtctgtgtactctgtaggctgtggtttagggggcaagcttgggcatggatgcaaaaccaacaatgggatgcccaaattggttgaacagttccagtccatgagcttcaaaccagtttcaatagcagctggcacttggcatgccgtggcccttggcgctgacgggcgtgtgtgcacctggggctggggccacaccggttgtctggggcacggcgatgaggagtgcagggctgttcccacagtggtagaaggattacgcgacgtgaaggcggttcatgtctccacgggtgaatacacgacgtttgtcgtcgctgagaatggggacgtctactcctttggatccggtgaatccttggctttccagttggacgatgaggcggaggaggaaccggattcctcgacaccgagcatagtcagctcgctcaaggatctgaacaagaaggtcgtgcagatcagccacacaaacgcctcgtactggatgaactcggaaatgggccacccgcacacatttgcggtcatggactccggcgacgtctgtgccttcggaggaggggtcagaggccagctcggcgtgaagctgcatgagggcgtcgaaaaagtgcgcgtcccgatgaatgttccaatcggtctcaattgatccccttccaccagcattcgcctgaacattttgcgatggcactctgcttccgcgaacattctgtttgggccttcagaccagtggcgtaagcttagacatgctaggatgtgaatattagggatgatttgtttttatctgaactcttcgaagtgatatagatcgtctgcataaagtttacctaaaaaaaaaaaaaaaaaaaaaacaaaccatttcgagccccccgcaaaaaaaaaaaa

SEQ ID NO: 10689 - DNA, 496 bp, Zea mays
atatctatatctggattgttccggccctcccccttcttcgattttgtgggcggcttctcttttttttcttcttcctgttgatgtgcgaatttagaggggataagagcttttggggggaatctgatggaatccgatcgattttctcgccgttcttggtcgatctgtcggggaagaccgagtcctctgcttctgctctcatccatctgtagagtgcaacatgcagtgccccatggacactgctgctagtggaacctcgccagtgatgcaattccatagcaatgctgatgagtctatcgcccattcatctccattggcaacattaatacaacgttcacagcgccattgctatggggatggatccccaggcgaatttccccttgctgtgagcccctccattgttctccatgtgctctcatcttgtgatctaggtccgaaagatctcgccaatctggaggctacatgcgtatttttcggcaaaccctgcaagttttgcacc

SEQ ID NO: 10690 - DNA, 1978 bp, Zea mays
cgccttcgccatttctccgctcctccgcctcgcctcgcctcgcccatcgttccatgtctttctcctccggcggtcaccacccctcccggccggaccaaccccggatcccatttccagttagatgcttccccttcaccaccaccccgccgccgcgccggagtcggcggccccggcgacagaccctccgcccccgccggtcctcgatccgtcctccctccgcatccacatcccgtcaagcccgcaccacgcactgccctccaccccgcacaagcgccccgtcgtcatgacctcgtcgtcctcctcgtccacccccacccgcccctcaccgttgcccttcaccccgcctcggaggcgcaaggtccccgcgcccgctgctcccgcggggacagcggcggccaggcatctccttcgctgcctgcacctccgcctgcgtgtcctcctcctcatctcgcttccctccctctactttctctccccgacccctgccatttttccgcgctccctcctcgccgacttcctttccgcggcggccttctcctgcgcgctcctccttctcctctgcctctccctgccgcggcttcccttcgcgctgacgctgccgctccccctccgccgcgcgcgccgatcccccatcctttggtccatcggttcctcgccatccgcatctgcgaccacccccacaaccggccatttcgtccaggtttatagcaacggtgacgtctacgagggccagttccaccgcggccgctgcactggcagcggcgtctactactactacatgagcgggaggtacgagggagattgggtcgacggcaagtacagcggcttcggcgtcgagacatgggccagaggtagccggtaccggggccagtaccggcagggactcaggcatggctacggcgtgtacaggttctacactggggatgtgtatgccggggagtggtcaaacggccagagccatgggtatggtgtgcacacctgtgaggacggtagccggtatataggggagtttaagaggggcgtcaagcatggtctcggccactaccatttcaggaatggtgacacctacgctggagagtactttgctgataggatgcacggctttggaatctacagctttgccaatggccatagatatgagggagcatggcatgagggtagaaggcagggtttaggcatgtatagtttcaggaatggagagacacaagctgggcactggcaaaatggagttcttgatactttaagcacccagaacttcatccctggatcacctattgctgtgaaccattccaaggtcctcaatgcagtgcaggaagcgagaagagctgcagagaaggcctatgacatcccaagagttgatgataaggtgaacagggcggttgcagcagctaataaagcagccaatgcagccagggtggctgccgtgaaggctgcacaaaagcgcatccccagtaatggtgacgatctaccactgtcagtagtgtgacaatgaagccaatatatgttggcatggagctgcttcgcgatgccatcgcatcaccaattgcccgacataaccttcaacttcccagtaggtgaagccactgctcgtccatcaggccatggcgtgttggcgacacctgagtcattgccagcagcattcaagcttgcgggagaagaccaagttttcagccatcccttccatacatctttgtgatgtcttttgcgatgcagcagaaccactgctctgaggactttccattgtccaaggcagccggtcgaggtcagcagtaggttttatcctgccttttctgcagtgtaatactcacccgatgttagtagagatatgatgaatgtacaccccaacatcagtcgataaaaaactgtgtttattttctctcttggactatgtacagaacctacaaatttagcggttgttggccgtgctggttggagaaacgacaggtgccttcgggttcggtcaaaaaaaaaaaaaaaa

SEQ ID NO: 10691 - DNA, 2340 bp, Zea mays
  misc_feature (745)..(745): n is a, c, g, or t
  misc_feature (791)..(791): n is a, c, g, or t
gaaacactgatgcttgaacaagtgtctaaccttcattggcatcatgggtgccacatgatcccaaattatgttgtaatgaatgttttactccccatgtgtattattatatagcttttccatgttttaaccgtattttgtaaatcaagtgggctatatttaatttggtggagacttgtaattctatttttgggatcctcttgctggcaataaggcaagatggagttcatttgtactgcatctacgactcatagtcttagcgtctgattagtttactgtgcccacacatccagtcccacgcgagcctgaccgactaggtacgatcatttctggtgtatgtgcagatgcaggtaaatggcctcagaatgacttattttgcatctactcatgcagtcaccgttcctcacgtacatgcaatcaaacagacgatcaaccaaagtcaacgcacgcgatgattcaggatagaatggtgcgggtaaccagtctggtggttaaagtatgctcctagctgttcatgtgaaatatggtagaattttttgtttttcttcctttaacttaatgatgtagcatgtcatttgatgttttattactaccattaaatagcccattactgtacaaactttgaaccatcacaattgtccaaatggcttgttgtaagttttgttggatttatgcatcttattggtctctatattgtatccacttatcttcaattttgatttttttgtgcacttggctctcttcttcntggatctaatgaagtagttagaagtgctctttataaatcttagtgntatcttattgtatggtttttttaatccatcaccaataaatatttgaatgctctgttacgctatcaaaggtttaacatgccttgctatgtcattattcattatcaccttgttatatcatggcgaattggatagacaatgccaaatatttttagtaagttaattattatttaatatattatatgcattttggtaaatattctacgtcaagtctatcacgcttcgcacaaatatacacccaggacaacctcctgctctttatttaacatcaaatacctggaagtaattatgtagccacatcaacttctctggccctttgctcggagttttctgggttggcaaaagaagtatcttccattcctccttaaattaattatgtttccatcatatggtgagtttgtgtatgagttttgaaatttgtatataaatatattattatattataaaggtttgagctgcagttatacatggacattgtagttattttttatgaacaattgatgcgttggatagagacctctcggattggaatatgtttaaataagtatcctaattaaacaagctctacatgactgatatataaaaaccgtagggacatttagtaagtattattattttgaagatgcaatccatggatgtggtcgtcatttcctggaagtcggcggtgggcagaaggtgatgaggtaccggctggccttgcaccggttcagcgaggtggcgtcgtcgtacgcgtagctgtaggccttggggcacacggccttgaagacgtgggcgaagatggtggggcggcacctgtccggcgacgcgtagtcccccgtgcagcagtacctgtcccctcccatggccttgcaggcgctccggcagccggccaccctcccctcgcggtccctcacctccagcgccgacgggcagcagacgttcaggtccgcctggcatccggccacgccgcacccggcgccgccgcccacgggggccatggacaccggcgcgttgaagccgtccaccagagacacgtcgtagaagtggagcggggacttgggggtgcccagcgtcatctccaccaccgtggccggggcggcgccgggccgcccgtcgcagcggagcacgccgccgcagtcccccgtcgcgcactgcccccgctcgcgctggtcgaaggagcagccgcgccgcggccacacgcggccggaccaccccaccggcacgtcgaaggccgcctcgtcgccgggggccaggtggaggccgcccgactgcggcgtcggctggccggcggtgcccagaagcccgggccagatggattccgcgcagttgttcaccaagatcagctggatggtgccactcccacctgcgtgcatgcacagtctgaatgaaataatgctgctgctcatcgcagctcttgtgatgtcatataagtagaacacgtacgagtgctggcgactaagaatgccaccgtgacgaagctgtacttgatgaggagcttattagaggccaaggccatggtggtggctttcgatcttaataatatacgtgcagcagtggctcaagcttgctgctg

SEQ ID NO: 10692 - DNA, 770 bp, Zea mays
acctcgaggccggccggggaaccgaacagtccctccctcggcctatccggctactcagcaccaagaacagacggccaagtgcactcgcgcctttatataaaggaatccaccagcagcatgagcgggggtttcttctccttgtatgcacacaaacccatcgcagggcattctcgagcatagcttctctgcctctctctcccctcctctcctctcgtccactcctttgtccaaagcttcgagatggctcagcagcagaaggtggtggtcagggttccaaccatgacagatgacaagatcaagcagaaggccatcgaagctgttgcggacatttacggtattgactccatagcagcggatctgaaggagaacaagatgaccatcataggcgagatggatgcagtagcgattgccaagaagttaaagaagattggaaagattgacattgtgtctgttggacctgcaaaagaagaaaagaaggaagaaaagaaagaggagaaaaaggaggaaaagaaagaagagaagaaagaggagaagaaagaagagaagaaagaagagaagaaagaagaaaagaagtgataaacctataaaacatatatatcatcgcatggcctcacttatcttcagttgcattgactttgcactgttgttgctatgtggagttactatgtaatacttatactacagagtacatattagttaataataaaagtgcaatttgtgcatttcttttaaaaaaaaagaaaaaagcgcggccccttatgttcataagt

SEQ ID NO: 10693 - DNA, 1829 bp, Zea mays
gggatcatcgtagacatttctggactttctatattaacatgatttgttaagtctgatttaaaggggctgttagcaatatctttgttgtttgggttgtcatagtgaaaaaaaagggtttaggcccctgcaaaaaaaaacagaagaagaagaaaaaaaaaagaatagaaaagaaaaaaaaaggaaaagaagaagaagggggctgaatctctaaatctgttgtttctctttgtgctgtgctagttgttctttttcagtgactacctttgtgcctaggctcacgtctctagcctggtttagcctaggaccagcacagtaccaccgttgaacgattattcagcttgcttttgtaactaacgtggtactagtgtattccttgcttcagcccacctacaactctacatatttcgactacagtttgacaggtcgtgttgctgcggcaccgatacacttattccacggttgcagacttgttggttgctgacccctcctgttgtgcaaggtaagaattggtaagagcttgtgtggcaggttgagagtgagcgccttgcagtagctacatcctaatagttgtagagtttttattccttcacgttttttttcttgttgcctctgttcgtctaaccatggcaggattggaggttgatgatgcttctcgtaatatgccacactctcctcgcaccaagggtatcatacaacactttgtaaggctggtgaagacgcacacggaaggtcttgataatgacatgcaggtgacgaatgaaaagatggggcaattggaggccacacagatcgacacaaacaccaaacttgcaaatgtggaaatgacagttgctcatattgacaagagccttgtcgcactcttgaggcgatttgatgagatgcatgctaataccaatggtgggcgtgatgagggcgccgaaggtaactgggatgactatgttgctgatactgaacaagatgaccaagaagcacctaatcgccggcgactacgtactaaccgtagaggtatgggtggttttcgccgacgtgaggtacatggtaatgatgatgcttttagtaaggttaaatttaaaatacctccttttgatggtaaatatgaccctgatgcttacattacttgggagattgcggttgatcaaaagtttgcatgccatgaatttcctgagaatgcgcgggttagagctgctactagtgagtttactaaatttgcttctgtttggtggatagaacatggtaagaagaatcctaataacatgccacaaacttgggatgcgttgaaacgggtcatgcgggctagatttgttccttcttattatgcacgtgatatgctaaacaagttgcaacaattgagacagggtactaaaagtgtagaagaatattatcaggaattacaaatgggtatgctgcgttgtaacatagaggacggtgaggaatctgctatggctagatttttgggcgggttaaatagggaaattcaggacatccttgcttataaagattatgctaatgtaacccgattgtttcatcttgcttgcaaagctgaaagggaagtgcagggacgacgtgctagtgcaaggtctaatgtttctgcaggaaaatctacaccatggcaacagcgcacgactacgtccatgaccggccatacaccagcaccaactccctcgccgagtcgaccagcaccaccgccttcctccagcgacaaaccacgtgcatcttccacaaattcagcaaccaaatctgcccagaaaccagcaggtagtgcctcttcagtagcctccacgggtagaacaagagatgttctgtgttatcgatgcaagggctatggacac

SEQ ID NO: 10694 - DNA, 2749 bp, Zea mays
tattcaactccgtaccctgatggaagcattctctattgagatcctaatcatggttatcaagactaaaatctgatggaatcacgcatataggagctaaggcatctaactcatcaacttgcctaatagagacgtaaaaaatcactacaataacttcatatcgtagtgatataaggatatgaaattattgtagtgttcatatgcgtgattgtggtcaacggggtgcattgcaatacacattctaggtggttgtggttgtaattatacactttaaaatagatgaatgatacttctctaaactttgtaaactataatgataccaataaaaaagaaaagaaacccttcaaaaaaaagccagattcatcaggctgccacaaaaggacaggacatgcactacgttcaggattacagagcgaagtagcaacggcagcaggatagcttggttacgttacgtgcgcccctgtccgactccgcccagtgggcggaaagagaaacagcatcaacagcacccggctcttttggcttttccattcgcggtgccagtggtgggctgtttgcttttgtcgtcactggtgaacgggactatttcatttcgactcgtgtgttcgtgagctctgtgagaaacaaagaccatgacgcaggagaagacggtggtgctgtacccctccctgggcgttggccatctgaaccccatggcgcagctggccaaggccatcctccgccacggcagcgtcgccgtcaccatcgccgtcgtcgacccgcccgagaagcacgccgtgctagctgctgcgctggcccgcctggcagcggtcagtccctccatcacggtccacctcctccccatcccgccctgcgccaccagcaagcagcattcccaccccatcatgcccatcctggatgcgctccgcgccgcgaaccccgcgctccgggcgttccttgccgcgcgagtccctgccgtcgccgccctcgtggtcgacatgttctgcaccgacgcgctcgacgtcgccgcggagctcgcgatccccgcgcacttcttctacccgtccgcggccggcgacctcgcggtctacctccaggttccagatctctgccgcgccgcgccgtccccgctaagggacatgggcaaggcggcgctgaacttcgccggcgtgccggcggtccgcgctctcgacatgcccgacaccatgcacgactgggagagcgacgtgggcagcgtacggctgcggcagctcgcccggatgccggaggccgcgggcattctggtgaacagcttcgagtggctggagtcgagggcgctggaagcgctacgtggcggccactgcctgcccggccgctcgacgccgaaaatctactgcgtcgggccgctggtcgacggtggcggcagtggcaccgaggggaacggcgagaggcacgcgtgcctcgcgtggatggacgggcagcccaggcagagcgtggtgttcctctgcttcggaagcctgggcgccttctcggcggcgcagctgaaggagacggcgcgcgggctagagcgttcaggacacaggttcttgtgggccgtgcgaagcccaagcgaggatcaggactctggcgagcctgatctggaggcgttgcttccggatgggttcttggagagaaccagaggcagaggactggttctgaagaactgggcgccccagacacaggtgctgcggcacgaggccgtgggtgcctttgtaactcactgcggctggaactcggtgctggaggcggccatgtccggcgtgccgatgatctgctggccgctgtacgcggagcagaggctgaataaggtgcacgtggtggaggagatgaaggttggggtggtgatggaaggctacgacgaggagttggtgacggctgacgaggtggaggccaaggtacgactagtgatggagtcggaggaagggaagaagctcagggagaggacagcgacggcgaaggaaatggctgctgatgccatcaaacaaggcgggtcgtcttacgtcgaacttggtgagtttttgaagggtttaggacgcaagtgatggatagctatgcgtatgaatgataataatctgtctgtatatcagtataagatgaatgcttaacgcagtctggaagataagtattatatggctacttatcattattattgttgtttacactccatctcaccaaattataagttactttggtcacctaagagcaactccgatggttctctaaaagactttctaaatcaataatttagatagttaaattaaaaactcttctccaatatctctctaaatgaacttcataaattcagccacttctcatttaatctcattttctctctacatttatcaactatttaccaactctctaaaaaaaaacttacgtgcttttccactttgtagtagaagatatatattaatagagctcatgcgttggacgccagagatgtacaattgtgtcagatagtcagctaaaggttaaacaatgcaatagccgcatgcgtacatgacggaaataatcaattgtgactgtaaatctaaagaccaacacagctcaccaaattgaatttatcatcgctaatggttctatttaaattggtgacccgttaaattttaatatatttggaaagtaatatatggagaccaattctcgtataatcgttaagtccatgtagtatacctcaatggttcaggggaaaaaaaataagaaaacaattcatatatatttatctcttacatcaaaatgtgcgttacatttttat

SEQ ID NO: 10695 - DNA, 982 bp, Zea mays
ccggccgggccgggattcgccaactccggggttgccccctcccgtgcccctagctaccccggccgggcccgggccaactccaggcgccccctaacgcaatcgctcgctcgctcgctcgatatttagccgtggagaggggccgagggagggagcctgctccgctctgcagcacgaacatgatgaagccatcgtgtgtactgcttctttccagccttcttgtagccactcttgcagctacttcttcgtcctctcctccgtattccgtcggcaagcacccagggtggctgctggttctaggtcgcaaaggcagagaactcggccagtcgtcagggtaccattattaccagcatcagagcaagcagcccgagctgcagggagtggctatggaggtaaagaaacccgaggaggaggcgacggcgaggcgaacggccgatcagagcggggacgccgagacagggctgatctacagcgcggactacagcagcgtggccatgcatgctgcctctccgccgacggcgaagcccaagcacaggcaccccaccagaccataggaagctgtccttatgtaagccagtcgtatgccgtccgtttcgtgtgtttcttatctcgctggattgtacgagcagaagcacccctgctgtctctgtaaaatataggccctcctgatgtgctgcttctttccttctgttgctctcgctctctgtccctgccattgctgatgagtgctatggcgatatgttgatccaaacacacaaaatgggatggcaacacaattgtacgtcgaatcgtcgttaaagtggccccaaaaaagcaccgtgaaagaaggtagctatgttaggtggcatgctgccgacacacttgcacaacgccgacaagtctactgacatattacattttaaactaaggacctgtttgacgagattataaatctatatgtagccttttggatgactagattatataaatggagattattgattac

SEQ ID NO: 10696 - DNA, 642 bp, Zea mays
  misc_feature (11)..(11): n is a, c, g, or t
ggtaccctccnagttcggccctcgaggccggccgagggagggagcctgctccgctctgcagcacgaacatgatgaagctatcgtgtgtactgcttgtttccagccttcttgtggccactcttgcagttgcagctgcttcttcgtcctctcctccgtattccgtcggcaagcacccagggtggctgctggttctaggtcgcaaaggcagagaactcggccagtcgtcagggtaccattaccagcatcagagcaagcagcccgagctgcagggagtggctatggaggtaaagaaacccgaggaggaggcgacggcgaggcggacggccgatcagagcggggacgccgaggcagggctgatctacagcgcggactatagcagcgtggccatgcatgctgcctctccgccgacggcgaagcccaaacacaggcaccccaccagaccataggaagctgtccttatgtagccagtcgtcgtatgccgtccgtttcgtgtgtttcttatctcgctggattgtacgagcagaagcacccctgccgtctctgtaaaatataggccctcctgatgtgctgcttctttccttctgtagctcttgctctctgtccctgccattgctgatgagtgctacggcgttatgttgatcc

SEQ ID NO: 10697 - DNA, 675 bp, Zea mays
agaatattgtccatgttcgtccctctgaatcagacggataatatcgttcttctcgggacaaggcacctcacgagcccttctcatccacatcagatctagcgccgcctccttcatcccgctggccggcgagctcctcagcgcgggtgcggtgagtcgcctatcctctgctctcattttcctcctttatcccgctagccggcgagctcttaagagccaggcgcggtgagttcctttccactctgctctcttcttcccctctgctctcttccgcgtggtgagcccggcgcggcgagctcttcccccacaggctcgtgaccagcagacgcatcaggatcaggctccatggacaacagctctccgacccctttctgatgcctgatgcttggtgtagtcgtgtaggtgagagagggagagagccatgctacagccggccagcatcaaggaaaagttcttgtcaacttgtacagcagttcttattgtttagccatgtagctggtgcctggtgtagccgtgtcggtggtgtagcatcctttatttttttatcaaatctacgacatactcatccacaagctattgctattataaattaatctccttattagtgaacttagcatcagttcttaaaaaaaaaaaaaaaggcatactcatcgtttatggttcttgacttacaaatgc

SEQ ID NO: 10698 - DNA, 4358 bp, Zea mays
  misc_feature (3781)..(3781): n is a, c, g, or t
  misc_feature (4236)..(4236): n is a, c, g, or t
gcaccgcgcggccgcccggtctctctcgcccttctcccgtctccgctccgcctccgcgcgtccggcgagaccgcgagagcgagacgatgggaatgctacaaattccccttctgagtccgaccctcctcatccaatagtaccacctgctcgctgctccgccaccgctctcgctcgatcgcccccctcgttcgtcggccttcgcttccagacctccgagtcctcaatctgcagctttggtaattggtcgtatagtccctcatcatcggaatggtggggtcacttatctttcccacacctaatgtggatccgaaggcagagaatcctaatgagatggttacagctggtgtgctttcaagccttcagaatttcctacgcaagtgcctcatagccatcctctcatatggcccaatgccgaagcacattgcatttattatggatggcaatcgtcgatatgctaaattcagaagcatgcaagaaggagcgggtcacaggatgggtttctctacccttattgcaagtctgatgtactgctatgaaatgggtgtgaagtacatcactgtctacgcattcagcatcgacaattttaaaagggacccaagtgaggtggaatccttgatgcagttaatggaggaaaaaatcaacgaactcttagagaaccgaagtgtaatcaacaagattaactgtaagatcaacttttggggtaacttggacttgttatatgagccggtgcggttggcggctgagaagctgatggcgagcacagctgggaacacagggctggtcttttctatctgcatgccatacaactcgacttctgagattgtcaatgctgtcagtgaagtctgtgcggaaaggatggaaatgtttcagagtgaacatattggcgactgcaatggtcatgctgcaaataacggtgtgcgttcagagatttcagtggcggatttggatcgccacatgtatagtgccggatgcccagatcctgatatcgtcatccggacttcgggcgagactcgattgagcaatttcctcctttggcagacaacgtttagtcacttgcagaatccagatcctctgtggcccgagttctctttcaggcaccttgtttgggctatcttgcagtatcagagagtttaccctgctctggagcataacagaaagttggctaagaagcagttgtgattccatgttacttgcaaggaggtatcatgaagggctattaacatcaaacttttccttctcaatttcctggtaatggtaaatgcaaagaagaacatactagcatataacattatgaatagatcaccatgtaacttaagtgtgattgctaccgtaaccatgtaacttatttgagctcgtacaaatgctgtgattcctacatatatacaaaaaaaaaaaaaaaatggggtaacatggtgtgcgagagcatttctttgttttgcacgacaaagaccggatgcttcaaagcgcccatgtttgacaagtgaaaagaaaggagttcgaagtaaaacaataggccaatgtctgttttccatagtccaataagtagaccactgataatgtctgttgatcatattttgcatccagccaagtagaccactgaaaaccaaggtcatgcacgtacagaaatatatatgcaagtttaacgtctgatggctatctacttggctctggatacatcaaaggtccatttaaccaaacgctgcctgatcctgaggttagttaggggaccggcacgccaaaaaatcttatctgccacgagctaattactgagctccgccgccgtccgccggcacgacgagctgctccgggtcgaggtgcgggtacctgcgcagcacggctcgcttcatatcatccattcccttctcgtacccggccaacgcgtgctccgcgaaccggaccacctgctccgtggagccccggaagtcgcgcacggcagcctccctggcgcccctcaccccctccgcagccgccttcttcgcgccggcgagctcggccttggcctgcgacagctcccgccgcagcgcgtccgcctcgcgctcccttgccgcgagcttatcctcgagctccagcgcgtagcccagcgagaacgacgcgtagttcgcggcctgcgcggtgcgtcgcccacgaccagggcatgagagctagttggttagaacgagacacgcacgaacgaggcgtcacgtcactgtctagagcggaagcgaacctgtagcgctgtcgtgtagctcgaggcgatgacgtcggagggcttcgccaccgagaacgtctgctccagcgccggcgtgacgatgctctgtagcatccgccgcgcccgctcccagtcggaggtggcgccgccgtcaggctcacgggtaaccttcggtgacttgtgcgcggagaagaagcccggaggggaataatgcggtggctcggggcgcggcggatcctgtttcgtggcatcctccaccaccttcctctttttgcaggacgacggcgtatcgctgctgggctcagtcttcaccgtcactcccgacgcctgcgcggcctttgccgcccgcagattcttcatcatgtcgtagacgcaagggtccattcctgtcacgcatccacagcaatagcaccttaccttaccttaccttgttttacaaaccaagtgatgggagattgggagttccgggcgtgctcgagttacctttggcactagcactgcttgtagtaccaatcggcggcggcggcggcttcgctgatgaaccagcaatcgttgcagcagcaagattgctctcggaaagatacgtcatgatatcgactgccgcaccgtgaacacggagcagcttcttggccacgctctgctcctctctggtgagcgccggctcaacagtggagcccatggacagcccgccccacttcacggggcacggccacggcgtcggcgacttgaggaagaagaaggcctccttccacccagcaatggaaagcggcatccccttgaagagcaagccggcggcgtccttgccacggaagtagtaccaccccttgagcttgaacgcgcacagtgagaagaagtgccggaacacggggagagacggggccacgccggcggagtgggagaggacgacgaagccggccatggcgcgccacccgttgggcgcgatctggctcggcgcgacgccgaagtgggcgagcacctcgcagaagaagccgtgcagcgggacgcgcatgccggcctccagcgcgtgcgcgtacacggagacggcggacccggggggcgaacacgcgcgctggtggccggcggggaggaccgccgagtactgctccggtactccatacttcctgcagagggcgtcaatggacccttgggtttcgaaggacgatgcgaagcgctctgccactaaccccgagagcgcgccgccgctgctgccgtcctcgtccatgtcaccgacctcgatgatggggtcgtcacggagacgcgaggagtcgccaatgatgtagagggaggaagacgaggacgaagaagcagaaggcatcgcgcatcgttcgttgaggtgctgtgctggtgcacaacaacaatgtcagcaggattgtggaagagaggacaggattagggactgaaattgaagcggctaaaatctttaaatagcaatactttgtttagacgtagacattagagtatagaatcagggaactgaaattagctttccaaaatttctattgtttggttatacatgaaattaagatttggaatcagagaactaattccacggaattgtactataactagaaactctatatttcaatatagagnatcactcatctgtattgcgtggaattagaccacacaatttcaaacttcaattcattggcatctaaataatataattagaattacatctcatttgaatatcaaggctgatcctttaatatcgactttcaaacgaagcataagggaattttagcccctccattctatcatgtatatttgctactaaagaagctattgtcggtgttcggccgacgatggtagatatgtgcctcctaggattcctttctacacacatgtttggactcgatttgcaaaatgcctctttctgagttaagttagatggtctaaatagcactcctgatgttctaaatttaaatttcagtgaaagagaacagatttcaagtcagttctcgtagttatgtacacacgagatagaatggcctatgaaccggatcttcgtgtacaaattaggagggtcggttttcataacctttctngtttagagttccgattgaggtttttcataccgagggacgatctttccccgaccggcctagtttttttgtttaggatcgatttaatactagaaatcaaatactattcggtatggctccactca

SEQ ID NO: 10699 - DNA, 2345 bp, Zea mays
taactccatgcacaaaactactccctgcgcaaaacacagagtagaatagaggctcaattaaccaatctttattaactccctgcgcaaaacacacggaatagaatacatgctcaattaatcaattaaccatttttttattaactccctgcacaaaactagcctaagcagtgatttttacagtaattttgataccttggcaccacgcttatattttgataaatcgtaccatatctatgatttatcttttgttaaatcatagatccctaacacttatattttgttgttatggacagtttgcatgaacacttgattgtacacctatatatcaattctacatgattgttgtttgcttgagattatttccccaaatattgatatgattccagattcatcatgacatgccatatgtttttttggatttgatgcttacatgtagatggataagaagaccaaggttatagtttgtgttgctgctgcacatatattactgtcatgtcaatgatggctatgattattcattctagaaaaagaaaacgaaatgcaaggaggactgggattacctatgcaccaatgcatgaaagggatagaactagaattgaatatctcaacacaaagatttggagggatgacacaacatgtataaacatgattagaatgaaaagggcttgtttctttcacctaactaaacattttagagagcgtggtttacttcaggacactatccatatgtgtgttgaacaacaagtggccatgtttctaaatacagttgggcataaccttagaaataggttgattggcatgaattttggtagatctggggaaacagttagtcgatgtttcaataaagttcttcgtgcaattggtgagctacgtggggaactaattaggccaccttcattggacactccaaccaaaatagcagggaactacagatgggatccgtattttaaggattgtattggagctattgatggtacacatgtaagagccactattcctagagatatggagcatgcctttcgtggtaggaagtcctatgcgactcaaaatgtaatggcggctgtagattttgatctacgcttcacttatgtgttggctggttgggagggaacatctcatgatgctaatgtattacgggatgctttagaacgtgtgaatggccttcgcgttccacaagctttggtaattggtcgtatagtccctcatcatcggaatggtggggtcacttatctttcactcacctaatgtggatccgaaggcagagaatcctaatgagatggttacagctggtgtgctttcaagccttcagaatttcctacgcaagtgcctcatagctatcctctcatatggcccaatgccgaagcacattgcatttattatggatggcaatcgtcgatatgctaaattcagaagcatgcaagaaggagctggtcacaggatgggtttctctacccttattgcaagtctgatgtactgctatgaaatgggtgtgaagtacatcactgtctacgcattcagcatcgacaattttaaaagggacccaagtgaggtggaatccttgatgcagttaatggaggaaaaaatcaacgaactcttagagaaccaaagtgtaatcaacaagattaactgtaagatcaacttttggggtaacttggacttgttatatgagccggtgcggttggcggctgagaagctgatggcgagcacagctgggaacacagggctggtcttttctatctgcatgccatacaactcgacttctgagattgtcaatgctgtcagtcaagtctgtgcggaaaggatggaaatgtttcagagcgaacatattggcgaatgcaatggtcatgctgcaaataacggtgtgcgatcagagatttcagtggcggatttggatcgccacatgtatagtgccgaatgcccagatcctgatattgtcatccggacttcgggcgagactcgattgagcaatttcctcctttggcagacaacgtttagtcacttgcagaatccagatcctctgtggcccgagttctcttttaggcaccttgtttgggctatcttgcagtatcagagagtttaccctgctctggagcataacagaaagttggctaagaagcagttgtgattccatgttatttgcaaggaggtatcatgaagggctattaacatcaaacttttccttctcaatttcccggtaatgggaaatgcaaagaacatactagcatataacattatgaatagatcaccatgtaacttaagtgtgattgctaccataaccatgtaacttatttgagctcgtacaaatgctgtgattcctaaatatatatatatagagtgcccggggt

SEQ ID NO: 10700 - DNA, 2440 bp, Zea mays
gattgaaattccttaaccacgaagatgaaataaatatatagcatttttcagaaaaacacaaacagagacgtcacatcaggatttaagggtaaatccggccgcgtattaaggatgtgtttggttgcgagtcaggacgggatggaacaggacgatcccacacactagactgtttggttgggagtcaaggttcagatgagaccgtccctacaaaaatattatcactagaatattgtccatgttcgtccctctgaatcagacggataatatcgttcttctcgggacaaggcacctcacgagcccttctcatccacatcagatctagcgccgcctccttcatcccgctggccggcgagctcctcagcgcggtgagtcctctttcccctctactctcctcttcccctatgctctcctcttcctccaatcctgctgaccggcgagctgctcagcagggtgcggtgagtcgcctatcctctgctctcattttcctcctttatcccgctagccggcgagctcttaagagccaggcgcggtgagttcctttccactctgctctcttcttcccctctgctctcttccgcgtggtgagcccggcgcggcgagctcttcccccacaggctcgtgaccagcagacgcatcaggatcaggctccatggacaacagctctccgacccctttctgatgcctgatgcttggtgtagtcgtgtaggtgagagagggagagagccatgctacagccggccagcatcaaggaaaagttcttgtcaacttgtacagcagttcttattgtttagccatgtagctggtgcctggtgtagccgtgtcggtggtgtagcatcctttatttttttatcaaatctacgacatactcatccacaagctattgctattataaattaatctccttattagtgaacttagcatcagttcttgacttacaaatctacggcatactcatcgtttatggttcttgacttacaaatgcacgacagttcttgtcaatttgtgtttcttgcgctactgaattgtttttagacttgagtaatgtaaataattctatgcaaatagtgtatgtagatcataatgtattaatgtgcagatcgtaattgctattagttcctttatattttgtttgcatgaacacttgattgtacacctatatatcaattctacatgattgttgtctttttggatttgatgcttacatgtagatggataagaagaccaaggttatagtttgtgttgctgctgcacataagttactgtcaatgatggctatgattattcattctagaaaaaagaaaacgaaatgcaaggaggacagggattacctatgcaccaatgcatgaaagggatagaattagaattgaatatctcaacacaaagatttggagggatgacacaccgtcgcgtggccggacgcgtggggaaagggcttgtttctttcacctaactaaacattttagagagcgtggtttacttcaggacactatccatatgtgtgttgaccaacaagtggccatgtttctaaatacaattgggcataaccttagaaataggttgattggcacgaattttggtagatctggggaaacagttagtcgttgtttcagtaaagttcttcgtgcaattggtgagctacggggggaactaattaggccaccttcattggaactccaaccaaaatatcaaggaactacagatgggatccgtactttaaggattgtattggagctattgatggtacacatgtaagagccactgttcctagagatatggagcatgcctttcgtggtaggaagtcctatgcgactcaaaatgtaatggcggctgtagatttagatctacgcttcacttatgtgttggctggttgggagggaacaactcatgatgctaatgtattacgagatgctttagaacgtgtgaatggccttcgcgttccacaaggtaaattctaccttgttgatgcgggatatggagcaaaaccaggattcttgcctcctttccgtggtgtgagataccatttaaacgaatggggcaataatcccgtacaaaatgagaaagagttgtttaatctaagacactcatctcttcgtgtcacagttgagcgtgcattcgggtcattgaagagaagattcaagattttagatgatgcatctcctttcttcccttttccaacacaagtcgatattgttgttgcctgttgtatcattcataattgggtcatacaagatgggagtgatgattttattatacaagattctaattggcctagtcatagccatgctacatctttagttggccaagcaagtgagcatgctgctatggttgctttgaggcaaggaattgcagaccagatgtggacagaccatcagaactacaatgaaaactagtatcttgtaatatttgtaagaactatttgtaaggatgctatgttattgcc

SEQ ID NO: 10701 - DNA, 1561 bp, Zea mays
cattgggtaccccggccccggccgggattatctcgacggctcgcgacagagggcaaaaaaactcagaaacccaactcgctcgttcccgcaactcgcatctttctcgtcgacagctccaactccggaacccttgtcgccggcgccggcgatgtcgtcatctaccgcccccgccccggcggcggcgatggccgtggacgatgcggaggacgaccagctcgcctccatgtccacggaggacgacatccgggcctcccgcctcctcgacaacgagatccgcgtcctcaaggacgagttgcagcggacgaacctggagttggagtcgttcaaggagaagatcaaggaaaaccaggagaaaattaagctcaacaaacagctaccctacctcgttggcaatttcgttgagatcttggaaatgaatcctgaggatgaagctaaggaggatggtgctaacattgatttagattcacaaaggaaaggaaaatgtgttgttctgaagacctccacaagacaagatccgaaggcagagaatcctaatgagatggttacagctggtgtgctttcaagccttcagaatttcctacgcaagtgcctcatagctagcctctcatatggcccaatgccgaagcacattgcatttattatggatggcaatcgtcgatatgctaaattcagaagcatgcaagaaggagctggtcacaggatgggtttctctacccttattgcaagtctgatgtactgctatgaaatgggtgtgaagtacatcactgtctacgcattcagcatcgacaattttaaaagggacccaagtgaggtggaatccttgatgcagttaatggaggaaaaaatcaacgaactcttagagaacccaagtgtatcaacagattaactgtaagatcaacttttggggtaacttggacttgttatatgagccggtgcggttggcggctgagaagctgatggcgagcacagctgggaacacagggctggtcttttctatctgcatgccatacaactcgacttctgagattgtcaatgctgtcagtgaagtctgtgtggaaaggatggaaatgtttcagagtgaacatattggcgactgcaatggtcatgctgcaaataacggtgtgcgttcagagatttcagtggcggatttggatcgccacatgtatagtgccggatgcccagatcctgatatcgtcatccggacttcgggcgagactcgattgagcaatttcctcctttggcagacaacgtttagtcacttgcagaatccagatcctctgtggcccgagttctctttcaggcaccttgtttgggctgtcttgcagtatcagagagtttaccctgctctggagcataacagaaagttggctaagaagcagttgtgattccatgttatttgcaaggaggtatcatgaagggctattaacatcaaacttttccttctcaatttcctggtaatggtaaatgcaaagaagaacatactagcatataacattatgaatagatcaccatgtaacttaagtgtgattgctcccgtaagcatgtaacttatttgagctcg

SEQ ID NO: 10702 - DNA, 2771 bp, Zea mays
  misc_feature (1171)..(1171): n is a, c, g, or t
  misc_feature (1621)..(1621): n is a, c, g, or t
  misc_feature (1964)..(1964): n is a, c, g, or t
  misc_feature (2100)..(2100): n is a, c, g, or t
accattgtgaatagccttaagggcctgcttagtttctttaatctagggactaaagtttagttagggactaaaatttagtccctaccataccctgtttgtttatagggactaaaaatattcagagcacattaaataaatcataagaagaccaaaataactcttagcattctcccgcaattagtgcaactaaaataaatgagagacaaaaattgaaattaatatagtttagtcctttttagtcacctctttagggactatagactaaatcagttttgtccctgttttaatcacgcagtttgacaatttagatactaaatacgactaaaataaaggaactaatcttcggttactcaaacgaaacatagccttattttactttctatacgtaaggcctatttcctttttatgacatgaatagattattaacgtctccatctatttccaaatctcagcaagaacgatatatagcagtatactaaaaggagccattatattctatctatactattataaattatcgtagtatactagtattatatattcccgttgtaacgcacggtcattcaactagtatataaattaaaaaggagagttacctgcactcatgaacactaaacaattgcgccaagaacatacagactttgtgtgtggcgatcgaaacgagagttacctgcactcatgttgagatcaaaatgtgttcggtcttcactgatcaaggctgcattatcttcttggtcttggacaacatggatttgtccatcctcaaactcagctgatatatcatcttctccaccgtttacagcagaagcttggttcagatccggtggtatcgcagcttcttcagttcaaaattcagcagtacatacatttttattcaaaactgtcatttcaagcatatgcgttattactcgatcgatcacctgatcacaaatttcatcgaccacaatagatggagaggactctcttttggagtagtatccagttaagtacacgatggacgtgatatgcatactatatattttgaataaaccaatgtataaagttgttttagtgtgttggtatgtatacggtaatcttttttgccagttgaagactgagtcaactccagtaataaatgagctgattggtgtacgtatccctggaccctgatgcaaagggatcgtagcaatgnatctgaaaaacacttcctttctttattttttggagcaggaagaagaaagaaaccttgaactgaaaacatacgttaaaaaaatctgagccacatctaacaaagaaacaaaggtggtctagtggtttgaaagggtgagctaagcgtgtgtttggttgcgggtcaggacgggacgggacaggatgatcccacacactagactgtttggttgggagtcaaggttgagacgggaccatccctagaaaaataatatcactagaacgctgtccctattcgtccccccgaatcgggcggatagtttcatcctccacgggacaagcccctcacgagccctgctcatcctcatcctcagatccgcctcttcaccccactggccggtgagcagcaaactccatccaccccactggccggtgagcagcaaactccaggtgcagagcagacaagttcctcacnagcggtgagttccctttcccgtttactctcctcttcccctctgatctcctcttcctccatccccgggcgtggagatctcgtccagtttagtggagatctggtacgtggttgagcgaagcgctggctggaccgggatggatgggtggtaggcggcggcgacatggatgggcgcctgggcgccgccagtgttgctgacagcatcttccttcatcacggcgtacgtgaccgtgagacgtgagtagctgctggactttatttcggtcaaggagagctagccctggccaaccccaagtgtttcaccagataagaacatcaaactttaacaacgggtagaaatcatttngtgatggcgcagtttttcaggtaaaactgagctgtttttggggggaattttttgtttcgcaaaacagctctatcaaaagcttcgtacatggctgaaaaagacaacaaacaagagagctatttttcctctgtatgantgtgagagcataaaaacataaaaagaaccttcgcctatctatagtttgtgttgataaacataaaagccacgactagcatggtgaaaaacattttggatgagcacctatacatgtctcaacacacacgcttatattttgataaatcgtaccatatctatgatttatcttttgttaaatcatagatccctaacacttatattttgttattttggacagtttgcatgaacacttgattgtacacctatatatcaattctacattattgttgtttgcttgagattatttccccaaatattgatatgattccagattgatcatgacatgccatatgtttttttggatttgatgcttacatgtagatggataagaagaccaaggttatagtttgtgttgttgctgcacataaattactgtcaatgatggctatgattattcattctagaaaaagaaaatgaaatgcaaggaggactgggattacctatgcaccaatgcatgaaagggatagaactagaattgaatatctcaacacaaagatttggagggatgacacaacatgtataatcatgattagaatgaaaagggcttgtttctttcacctactaacattttagagagcgtggttaactcagacactgtccatatgtgtgttgaacacaagtggccatgtttct

SEQ ID NO: 10703 - DNA, 1435 bp, Zea mays
atcactagaacgttttccttattcgtccctctcaattgggcggatagtttcatcctccgcgggacaaggcccctcacgatcccttctcatcctcgtcctcagatccgcctccttcaccccactggtcggcgagcagcaaaatccattcaccccactggccggcgagcagcaaactccattcaccccactagcaggcgagcagcaaactggagatctcgtcctcacgagcgctttggtaattggtcgtatagtccctcatcatcggaatggtggggtcacttatctttcactcacctaatgtggatccgaaggcagagaatcctaatgagatggttacagctggtgtgctttcaagccttcagaatttcctacgcaagtgcctcatagctatcctctcatatggcccaatgccgaagcacattgcatttattatggatggcaatcgtcgatatgctaaattcagaagcatgcaagaaggagctggtcacaggatgggtttctctacccttattgcaagtctgatgtactgctatgaaatgggtgtgaagtacatcactgtctacgcattcagcatcgacaattttaaaagggacccaagtgaggtggaatccttgatgcagttaatggaggaaaaaatcaacgaactcttagagaaccaaagtgtaatcaacaagattaactgtaagatcaacttttggggtaacttggacttgttatatgagccggtgcggttggcggctgagaagctgatggcgagcacagctgggaacacagggctggtcttttctatctgcatgccatacaactcgacttctgagattgtcaatgctgtcagtcaagtctgtgcggaaaggatggaaatgtttcagagcgaacatattggcgaatgcaatggtcatgctgcaaataacggtgtgcgatcagagatttcagtggcggatttggatcgccacatgtatagtgccgaatgcccagatcctgatattgtcatccggacttcgggcgagactcgattgagcaatttcctcctttggcagacaacgtttagtcacttgcagaatccagatcctctgtggcccgagttctcttttaggcaccttgtttgggctatcttgcagtatcagagagtttaccctgctctggagcataacagaaagttggctaagaagcagttgtgattccatgttatttgcaaggaggtatcatgaagggctattaacatcaaacttttccttctcaatttcccggtaatgggaaatgcaaagaacatactagcatataacattatgaatagatcaccatgtaacttaagtgtgattgctaccataaccatgtaacttatttgagctcgtacaaatgctgtgattcctaaatatatatatatagagtgcccggggtgaaaaaaaaaaaaaaaactcgcgggggggcccggtac

SEQ ID NO: 10704 - DNA, 1431 bp, Zea mays
  misc_feature (898)..(898): n is a, c, g, or t
  misc_feature (1047)..(1047): n is a, c, g, or t
  misc_feature (1056)..(1056): n is a, c, g, or t
  misc_feature (1082)..(1082): n is a, c, g, or t
  misc_feature (1097)..(1098): n is a, c, g, or t
  misc_feature (1103)..(1103): n is a, c, g, or t
  misc_feature (1129)..(1129): n is a, c, g, or t
  misc_feature (1133)..(1133): n is a, c, g, or t
  misc_feature (1159)..(1159): n is a, c, g, or t
  misc_feature (1168)..(1168): n is a, c, g, or t
  misc_feature (1183)..(1184): n is a, c, g, or t
  misc_feature (1194)..(1194): n is a, c, g, or t
  misc_feature (1216)..(1216): n is a, c, g, or t
  misc_feature (1321)..(1321): n is a, c, g, or t
  misc_feature (1341)..(1342): n is a, c, g, or t
  misc_feature (1350)..(1350): n is a, c, g, or t
  misc_feature (1353)..(1353): n is a, c, g, or t
  misc_feature (1355)..(1355): n is a, c, g, or t
  misc_feature (1396)..(1396): n is a, c, g, or t
accctcctctctcctctacggctcagccggccgccgccctcctctctcggtctctcctctcctccaacggctcagccggcgccaccgccctcctccctcctatcctccaacatctccggcgcgtctctcctcagccgcggaggcaaagccggccgccggccgtggaggcacagcagacctgcgccaccgctggccgcctaccccacagcagatctgcactcaagaccagcagccagccagccatcctctgcggctccactctgccagcgcccaagaccagcgctagcagccagccatcctccacctccactgctctccatttgatcatttgctttggtaattggtcgtatagtccctcatcatcggaatggtggggtcacttatctttcccacacctaatgtggatccgaaggcagagaatcctaatgagatggttacagctggtgtgctttcaagccttcagaatttcctacgcaagtgcctcatagctatcctctcatatggcccaatgccgaagcacattgcatttattatggatggcaatcgtcgatatgctaaattcagaagcatgcaagaaggagctggtcacaggatgggtttctctacccttattgcaagtctaatgtactgctatgaaatgggtgtgaagtacatcactgtctacgcattcagcatcgacaattttaaaagggacccaagtgaggtggaatccttgatgcagttaatggaggaaaaaatcaacgaactcttagagaaccgaagtgtaaatcaacaaagattaactgtaagattcaccttttgggggtaacttggacttgttatatgagccggtgcggttggcggctgagaagctgatggcgagcacagctgggaacacagggctggtcttttctatctncatgccatacaactcgacttctgagattgtcaatgctgtcagtgaagtctgtgtggaaaggatggaaatgtttcagagtgaacatattggcgactgcaatggtcatgctgcaaataacggtgtgcgttcagagatttgagtggcggatntggatcgcnacatgtatagtgccggatgcccagancctgatatcgtcatnnggacntagggcgagaatcgattgagcaattncctngtttggcagacaacgtttagtgactngcagaatgnagatcctatgtggcnngagttatctntcaggcaccttgtttgggctgnattgcagtatcagagagtttaccctgatatgagagcatagacagaaagttggataagaagcagttgtgattgcatgttaattgaaaggaggtatcatgaaggganaataacaagaaacttttcannctaaattnatngntaatggtaaatgaaaagaagaaaataatagaatataaaaanatgaatagaacaataagtaaaataagaaagataaa

SEQ ID NO: 10705 - DNA, 1837 bp, Zea mays
gcggcattcatccgtcgaggacaagccaggctcagatgcggcagaacatccgtcgacgtcgccgacaggcgacacgaggctcacggctcacggctcaccagtcacctctagctcttttccaaaaaaaaaagaagcccctcctatccatccctatccctacccctacgagtatccaagtccaaccagcaagaggggaggcgctgcacgcaggtcacgcggcgatggacatatgcgatgtttgagcaggcggtggcagatttctgctggcatgcgagggaagtagtgtcgtcagggatggggctctggggttggccgtgggggcgacgtgggccgtcgggcttcggctccgcgtccaccgccgaggaggtcaccgccggcgtcgacgcaagcaacatcactgccatcgtcacaggagcgacgaatggcattggaaaggagacagccagagttctagcactgaggggagccaaggtaatcataccagctaggacactggagagtggcctcaagttgaaggagagcctcgcagatgaggtcccaagctccaaggtacacgttatggagatggacctgagctgtctcagctccgtccgcgacttcgcacggtccttcaattcatcccacaagcatctgaacctcctcataaacaatgcagggatcatggcctgcccttaccagctgtccaaggatggaattgagctgcaattcgcaacgaatcatgttggccatttcttgctgacaagtctcctgctagacaagatgaaatcaactgctgcagagacaggtgtgcagggaaggatcataaacgtatcatcggtcgcgcataaaagaagtgatggtacatgctttgagctgaacaagctaaacgataaggctaggtaccaaccgttcattgcatacgcgcattcgaagttagccaatgttctccacacaaatgagttatccaggcgttttcaggaagaaggatgcaatctgacagcgaattccctgcatcctggagtgatcgtcaccaatatcattcgctatgttgctggaaacagtgcgctgatttcggctctctcccctgtagcaaatcttgttctgaagagcgtgccccggggggctgcaactacttgttacttggcattgcaccctaatgtcaaaggtgtatctggtaaatacttcgctgattgcaatgaagcaacaccgactgctgtcgcgagagactcagagctggcgaagaggctatggtcgttcagcgaagaacttgtcaagatctatgctgatatgtcacagacgacacaggcaagcgaagaagaggaaaccacggttacgaaagacgttttccaagacaagtagcgtaatatatgttgctgcgttttctacgttttgtacctgtcctctgggcccgaatggccagtgactgtaatagcacctaagtgcccgagactggtaagacaaggggtattcagacaatcaagaaaccacggtgcggctgaggcctgaggcagtcctctccgtcgttcacccaaatctgagatcactcgtgtgctcacgtcgacggtgattagccggtggccccgggtgttgcaagatagaagaccaaaattatacgatcatatggaaacaagatgtgcctgcaatcatatgatatgagagtactagtgttggataatttttattcttcagaaagcgccaaaatcataaacgtttgatagttttagcattaagagcagccttggttgtttatttgtttccatgcttcttgaattgtcaggaagatcatgacttgtgacgacattaacagctattacactattggactggacttctttgtcgagtgtcccaaatgtttggc

SEQ ID NO: 10706 - DNA, 2858 bp, Zea mays
tgcatgcctgcagcttccatagagttaaaattattagcgaagaatatgatgccttactattctcatcttgtaataagttaccgtaatttactcttgcagaagaaggagaagttgctaaaaaagcaacaaagagaagccatcctccttgacagctgcttgacagtgaatggattgacatctggccgctctcgacgtgaaagaaaacatgtgacttatacttttggtaattccaaggctcaagttaatgttgttattaattaatttagctagctaaatcagggcatccctgattttgctgatgggctgctacagttttctgttcatgtagtcattcctttactttagacgtttgatttatcatttcctgcatgagtattgtcatgctaatactgactcctaatcatactgtgatttgaacttgctaagcttagtcacatggctttaattattaaccaagttctgtatttattctaccttgctggtcccatttcgtagtaaccttttaaagctgctttggtaccatgttactaacctttgaggtttgagaagatgagcactccattaatggagctgactacatatagggaaacccatcggccaatgggcctataggctatagtaaaatggccttcatacactcaacaaaatcttgtgttaaggtcatgacattttttaaggggacatcatgcttgttaatgtgctgtagaatttattctacaagcattctatctttatgttcattctatgtattttgcagtgtatattgggataagactagtgtgtatacatttttctagttttcttatttttttctctaacacgcaggagaggtgtgtatcattgcattagtagaagaaaatcaagttttattaatgattttcttaatttatcatgcagatgattatgagcgttcaataaatgaagccataaaaacaataaggtaagtgtattttctgttctcagtagttccattgatttatgaatttataaacagaaatttacaggaaaaatgagaatgctgttgaggttggcccctccccattatgcaaaggattttatggagaaactccagagaagttgtattacaaagcaaaaacagatgaaggaaaggctgaaactctccatcgcaggtaattccttaactcatgatatttatctgtttctgttctagaacagattagactcttaacttgtgttgtgccaatgtagctacaggcagagaaaaagatcccaaaggtacacaaaggactatgttgaggccatatcagatattgacctagattttgacagcgatgatgatatcatgggtgaagcagtctatgatgaggaatatcttagaagaaggaaacgatacaaggcaagcctttctgaaaatgatgatgagtttcagttggatcaagtcgccaatgatggtgatgatgaagtgggtacttctttgaatgttaatgaagacacaaaagatctccaatggtacaaaagatttccacttctcacccctcaagggaccaagttgaaatctattgatgaaatccaaactggcatccgacgcagtaagcgctccacccgttcccgtattaactatcgacagcttgatacttttggcgcaaatacaaaatatggaaagtcagagaaatgcaatgcatcagatccggatgctggttctgatgcactaaatgatacggagctctcaacaagtcaagatcgagaggaagaagacgatggagtaaacaaagcacaacagcagtacacagagaaaccaatcgttcctgtcaaggagagtagaagtgtccggagaaaattcctcgtcctaaatgagcttgtgcctatagctggttttgatgatgcttcagtcttagtgaaagataagcacgtgaataacaacggaggaaaatgttctgcagcacattagggcgttggggaagctctttttttttggtcacatgggtagcaaatactgggtagaactgctcgcttaagcatggaccaacgagaatccaatgagatggtgatgcaacattggtcttgtttgggcagactgctgcttactacttccagtgtcatgccagcgaggagatgagatggtccatgggtgctgtgtggctgaattcccagcccataaagccaagtccctctctgatacttggaggtcttgctgagatgtgcactaggcacaccgcgtcgattggcgctgtacaattgtcacagctgtacgtgtatctcctccatgtatatacagtgattgggagcaatagcgtcttctggtttcaggatgcctatgggtagttgtctcttcttccttttcccctcttctgagcatctgaagttcggcaataaactcgattcaactgtggcatttacttatttctgtatgcggtaattaatatcgctcgatcttacactactagttactcatagttttttgtactagttacttggaaggtgaattttcgcatagtacttagggttactgctcatcgcggtgtctctgttcgcctgcccgtgtagactccccaaaatgcgtgaccgtacaggacaactggtcgtgcgtgctgtggtttctacgatgtcgtctagctacggtgcgttgttgtatccccaggctgccatgcacccaaaccgcgttcctcggttccgacggcgacgtcgcgcagcaggcgacgaccccggtggcttcttcgtctcgtcgcggtcacgcggtggcctggccttgtctcgctcgcgcactgttgcaagagcaagctgcagcctgcagatccattccattcggattggacaccatcatcgcgcggtccacgtccctccagggcacggcagtaccgcacgccaagccgtcgctttcagtcagtggcttcaggggt

SEQ ID NO: 10707 - DNA, 1153 bp, Zea mays
gagctcaagacgtcgaatccgggtcaccaccgtcgcgagggacggacgcgtggggagattatagctgtctgcaagaaatacaagacttacacatatcagcatgaggcccatagcattggtgctgttggacagtctggccgcggtgtttgtgaactccttggggttgacccagctgatgtagatataatgatgggtactttcaccaagtcttttggatcatgtggtggatatattgccgcatcaaaggagataattaagcacctgaagcatagttgcccagcccatctgtacgctacgtccatgtcaccaccagcagtccaacaagttatctctgctattaaagttatccttggggaggatggctccagcagaggtgcccaaaaacttgcacgcatccgtgagaacggtaatttcttcaggtccgaactcaagaagatggggtttcgaggttcttggcgacaatgactctcctgttatgcccataatgctttacaatccggctaagatccctgcattctctagggagtgccttagacaaaaggtcgccgttgttaccgtggcgtttccagcaacacctcttcttcttgctagggcacgcatctgcatttcggcttcacacactagagaggatttgatgaaagcccttgatgttatcagcagagttggtgatcttgtgggcatcaaatacttccctgcagaaccaccaaagattgctgaagctggtcatggtaagcgggagtaggagcgaaccctgaatcgccccatgagtgattgaagttgttagaatcccttccggagttatcaacagatcattatggaagcaagcatatatggagccgtattaggcagctgacagttatttgttgattgtacaactgttcttgcaattgtgtatagctggttgaaatttagttgttctgttgctaatctgttccaaatacgtagtagattcggaggcaatataaactttcagcagagcattactgagtttcccctcgcagaccactgacgacaatgaaggcctcttgctttcatgtatttttctttctttctttttgtaaccagtctgttatatgggatcagtaggtgtccctttggatgaagttataagctactttgctgaaaaaaaaaaaaaaaaaaggcccctagggcc

SEQ ID NO: 10708 - DNA, 5073 bp, Zea mays
ttttcactactacaaaggttgtgaagagtaccaatggtttggtaaaatttagcttgtgtttgttgttatgcttcatcctattatcaaactatgtcgtttttatggttgggggctagactttcttgaccaaattcatcctccatcattaaatggacacctctttgtcttggttactacggattacttcactaaatagactaggattgtttctttgaagaatatgacacatatggagataattgagtttattagtgagcatatcgacctatccctcaattattgactaccaattgaaaaacatcattctgtatccaaatatgtatgagattttgccaaattatataagatcaattgatcaagttgctcaattcatctctatagtatgctcaagctgaatctagaaacaagactttgatcaagattataaaataaagttgaggatattctcaagaggtggcatgatgttttatctgaagctctatgggcacatcatggctagacatggtgctactaaagttactctttttaacctagtatataggcaagggttcatgttacccattgaagtaaatttaggtgcatataggattgctaagaaaaagagttatctactgttatgtatccgacaaaggacagactcgagttgccagagcatacaataagaaactcaaaagcaagtcattttaaattagatatctagtaaaaaactacactactaattgaatcaaagagcaataaatttggcacgtggccaccaaactaggaaggtccttatgaaatgatcaaagtcatatttgaaaattcatatatgctagagatgttacaatgtgataatctccaaagagcaatcaccagaagatatttgggaaaaaaatatttgacaagtgttggccaagaaggctagtgtgtcttctaaataatggccaacacttgtgtcgtccttagaacaaatacgatcaatgtatatatcacatttaatgctagataatcgatgacttggacatccccactatttaatgttttatattcaataaagtctcatataaaaatagaagaacatatgtcgatataaaaagtggaataaggataataaggatgttacctctgcctggagtcggctaggtcaaatccctaacatgggcagatcaggtctctgaagctggctaggccacccttgaaacctgattaggccgacttcctagagcaaagtcggccatgccaccttcttgactcgggcaagttagctacagtggttgtctttctttgtgaaaccggatctagccaattttggcggttggcagggtcgactatgttgattttctgaactgattgttttctaattgctttttaaaaccaaaacttgtcaaacgtgttttggggtgattttctactaggccaaggccgtttttctctatgatcaattgagttatcaacatccaatgattaaaaaatatatccattaattttgtaccatttttcttaatcttgttgtttatcgcttctcattgtgagatttagtgatgttttagatggtattgtggatcctagggcaccctttttgacaggataaacatcgacttaacctttttggtagtcattctcatgtaaccaaacaagcctctcgtatgtgaagcagaggtgtggaacaggaggagcaagtgaactgggaacgaatatattcactagaatgagaagaacaattttttttttttttttacagcttatcactttgcattgcaagaaggtacaatttttctcattgcatcagtatctgaacatggataaaagaaaaagaatcagaaagatcaccaccaccaaggggtaaaaaaataaaaaaaaaggagtggagtgaggagcggttggaaggccgcggtgggtcgaatcattgcatgcaccgcgaccgcttgaatcttagccgtcggttcttgagatcgaactcccagaggtgctcctgctgcatgatgttgccgatgacggacaccccgggccagtcgccctcctgcaggccgatgcacttgacgccgggcgccgcgtcgatgacgtagctcttgggcggcggctgcagccgcgccgaccccgcgaagtgcagggccagctccggcacggccacggcgaggtcctcgcccgtcgacggcgacgtccagttgtagcagtagtcgaacgggtccatggccacccggggcagcccggccagcttcctgctcagcgccgccaccacggcgcggtacgccgggctcacgaggaccgtcaggctcgtgccggagtcgaggatggcgccgccgcccttctcgacgtcccagacgcggcgcgggatccggaggagctccccgtcgacggagacgccgttgacggcgaccgcgtagaacgggcgcatccggcggtcaagcagcagcggcgtctggcgcgcgccgggcgccgccgagcccgagcccgagcccccgcaggccgtctcggaggccgaggacacggccgggttggggccgaaggtgaggtagctggtggcgttccgcggggcgaggtggtcgaccaggcagtaggagaaccggccgccgaagcgcgccgcggcgcgggacgcgaaggagacgttgctgtagccgaggctgagcaccccgtcggaggccaggaagctctcgccgtcgtaggacgtggtgcagcccagcacgacgccctgcagcttggcctgcgcctgccgccgcttcttgccagccggccgcgccgacgacgacgacagcgcgatggtcgccgagtcggtgcccaccgtgccgcgcgccgccgacccgtccttgtacctgcacgcccgcaaggaaaatgggtggcggttagtcactcacggtcacggcatgtgtggcgcgattcagggatccgtctgttttgagcccgcccggcgcccgccggccgccgcgctaccgtgcctcggtgaatcctcatctaccccgactaaaaaaaaaacgtttcgtctgcaaattgcagttaaacaattgcttggtttagctgcctgtacgctaatcgaaacatctcctgagagcgactacgaaccaagtttgaccaaggaataacaaaaacccgtgcaagattgtagcaacagaaacaaacatatatatgtatgtacctactatacggtatcatggagcatgcttgcgcgctttcgactcgcagggaacatgagtggcacggcaacgccatgactcacatcgagcagatgcaaaccctcttcttgagcaaaatgattgaacgtcacggacagggagactgtacaaaagcatccaagatggacatggggcctagcctggcaagcgctgtgccaacctgatttttagcagccttattacgttacctgcctcagcagagagccggcgatggcaatcatcgccgtagcagctcacagaatgcagaatgccaagctatctttgttcagtggcaggatgtatttgcttttgaactagaggagattagctattctgttccagccaggagagctttgacaaagagaggacgtggctcgggtacggcacggtatatggcccacgagaatggattgtgtctttcacaaagagaggattatcatgaagttaaggcattactcctaaacacaatattatcagcaaaacggaagggaaagaatttttcgagacatgagaccggggctttcatgatcaagttgccaggcaaagggacatgatgggaccggaccgcatgtcctttttggccatgcagcgagagcgacacatgttgctgagctccagggccagtccagccgagcgaatccgtggaatcccgaagcgttctgtaccgttgccacagcccacagcccctgcctgcttgcttgcttgggcgccaccgcgccatgcatcccttcttctcgtggctcttggcggtgtcagtgaaaagcaaatttcaggataaacaagggcctagcctagatatttcacaccgtcgcttttgccaaggaatatgttcaatgccctgacaagctgacacggtcacccatgagtggagcgcagcggatggagtacgctacactacacactacacccccgatccggcgtcgcgctcgcacatggaggagcacgggggcgcagcgtggctgccgcagcggctcgcggccacccgccatgttcgggtgccggctcgctttccgcggcgccgctgttggcaggacgcggcaggcaacagcgagcgcccgcccgccaagtctgctgcctgcctagatacgaatgccaccactgttcactgcccagcattcagcagcactacacaaccccaccccgcgcgtcgacgcaaggcacggaggaacagaggagggcggactgacacaccattggcaccgatcgatggatggatgccctcgtgcccgcctgctcgccatcgccatgggcgtccttctgtcgagctaaggatccagcgcacatgcgcgcgcgcgcgtgcacgcaacgtgatgcttatcgggacgccgacgccactgaggccgatgggtaaaggagatcggtcggcatcgcatcgaggggcaagcgtcagtgtcattgttgtttgtccgggacgctccgcttttgggtgagcaggggcgctgaatgcatgatggccgctcactcagtgtctccgtgactgggaaagggccggggcggggcggcaagacgttgatgaatggatctgcttggtccccgatcgagaaacgaaagcgacgatccgccgatcgccatagctccggcgcatggcaagcgcaacgcaatcgtcgtccacccacaaaccgccccccaatctcaagagcccagtgctgctacagtgccccgtctatcctgccgcggcgatagggcgggcggcaaagctgtggcgcattgaacgcgcgccctcgatgcccaccccgcgctgcttcgccgttgccggcggcacggcctgcctggctttacaacctctcccccccgagatctcccgactcactcacccaccaaccaacaaggcagccactaattgcaggctgctgctgcgggcagctgctgttgcctcttgcatctcatcaatgccaggaccgaattaaccacgcacgccccacacagccccgcccccgccccccccccc

SEQ ID NO: 10709 - DNA, 1445 bp, Zea mays
  misc_feature (852)..(852): n is a, c, g, or t
ccatggccacccggggcagcccggctagcttcctgctcagcgccgccaccacggcgcggtacgccgggctcacgaggaccgtgaggctcgtgccggagtcgaggatggcgccgccgcccttctcgacgtcccagacgcggcgcgggatccggaggagctccccgtcgacggagacgccgttaacggcgaccgcgtagaacgggcgcatccggcggtcaagcagcagcggcgtctggcgcgcgccgggcgccgctgagcccgaggccgagcccccgcccccgcaggccgtctcggaggccgatgacacggccgggttggggccgaaggtgaggtagctggtggcgttccgcggggcgaggtggtcgaccaggcagtaggagaaccggccgccgaaagcgcgccgcggcgcgggacgcgaaggagacgttgctgtagccgaggctgagcaccccgtcggaggccaggaagctctcgccgtcgtaggacgtggtgcagcccagcacgacgccctgcagcttggcctgagcctgccgcttcttgccggccggccgcgccgacgacgaagacagcgcgatggtcgccgagtcggtgcccaccgtgccgcgcgccgccgacccgtccttgtaccggtagtcgtaggcgcaggggctgccgggggtggggcaggccgcgagcgagaagggcagggacgccgtgcaggtgtcggaggagcacgagatgggcgcccacgtccgggacctgtccggccggaacacgcgcgcgtgggaggatgccgccggcgcgagcgaggaggaggaggacgaggagccgttcgacgctggggcgctgtagcccggggctggcgcgtcgtgncggcggcggcggcacttcacccaggtcaggtcgctgccggtgtcggccacgagcaggaacggccgcgctggcgtgcccacgcggaagcgcacgaagtactggccggtgcccgtgtatgcgcccgacgagagcggcatcgcgaaggcctcgtccgccggcggcgtggccttcgccctcgccctcgccttgggcttggcaccggcggccgcctccgtggcgcggcggcgacgagcgtgcgaggagatgaacgccgtgcgctcctggtccatgcgcgccacctcgtcccagggcgcctgctcccggtggatgagctcgaacttcgccgagggcttgctgcctgctgctgcgccggcggcggccaggaacgcggccgccagcagcgtcagcgtcgtcgccagacggcgggccgccatccgcggggacgccgcgtttcggcttcctgacggcgcagcaagctggcttaagctgttccgccaacacaacgcggtgacgggggcgccggcgatcggcggcgatgggccacgccgcgggcggcgccaatgcgcgcgctccttgaagctctgctcaggcaagacgagccgccattgcgaact

SEQ ID NO: 10710 - DNA, 2488 bp, Zea mays
attggttggcggtctgtgtccttcctcccgttcttcccttgcttccccgtcgcgctgttcaacgttcaaacccttacacctcctcctcccttggccgcgcagtcgccattgacgaccccctctcactctcccctcccttaaatccctcctctccccgcgtccttctccccatcaacgcttcattcgctccagtctcatcgaatccaattcacagccagccagacagggcgggagatctccaagaagctatcttggaatccgagaacaccttgcattcgcggtcagtcaaggattcgaattctgacggacgagctctccggccaaaaaagtcagataattttcgggatagctcgggtggcgtctcggcaaccggaggagaccccggggggattaaggaaggggcaagatggtgaggctgccttacacaacggcgctgaccacgctgttcagctacgggctgctcttcgccttcggccagctcagggatttcttccgcaagttcgtcgactggttcaaggccaagaacgtcaagggctacgcgccgatctgcctgggcctggaggatttctatgtgcgacgactgtacctgcggatccaggattgctttggtaggccgatcgcaagtgcacctgattcatggtttgatgttgttgagcgcacctcaaacgacaataacaagacattacagcgtacctcaaataccactaaatgcctcaacctgggctcgtacaactaccttggctttgccgcagcagatgagtactgcactccacgtgttattgattctctcaagaaatactcagcaagcacctgcagtgttcgtgttgatggaggtacgaccaagcttcacactgagctggaggagttgactgcacgttttgttggaaagcctgctgctattctctttggcatgggttatgttacaaactctgccatcattccctgcctaattggaaagggtgggctgataattagtgactctctgaatcataactcaattgtcaatggtgcgagaggatctggtgcaactgttagggttttccagcataactcccctgctcatttggaagaggtcttgagagagcagatagctggtggtcaaccacggacacacagaccatggaagaagatcattgtcattgttgagggtatctatagcatggaaggggagctgtgtaaactccctgagattatagctgtctgcaagaaatacaaggcttacacatatctggatgaggcccatagcattggtgctgttggacagtctggccgcggtgtttgtgaactccttggggttgacccagctgatgtagatataatgatgggtactttcaccaagtcttttggatcatgtggtggatatattgccgcatcaaaggagataattaagcacctgaagcatagttgcccagcccatctgtacgctacgtccatgtcaccaccagcagtccaacaagttatctctgctattaaagttatccttggggaggatggctccagcagaggtgcccaaaaacttgcacgcatccgtgagaacggtaatttcttcaggtccgaactcaagaagatgggtttcgaggttcttggcgacaatgactctcctgttatgcccataatgctttacaatccggctaagatccctgcattctctagggagtgccttagacaaaaggtcgccgttgttaccgtggcgtttccagcaacacctcttcttcttgctagggcacgcatctgcatttcggcttcacacactagggaggatttgatgaaagcccttgatgttatcagcagagttggtgatcttgtgggcatcaaatacttccctgcagaaccaccaaagattgctgaagctggtcatgataagctggagtaggagcgaaccctgaatcgccccatgagtgattgaagttgttagaatcccttccggagttatcaacagatcattatggaagcaagcatatatggagccgtttcgctgggattttgtggatacgcaaagagtccatgatctgtcctattaggcagctgacagttatttgttgattgtacaactgttcttccaattgtgtatagctggttgaaatttagttgttctgttgctaatctgtttcaaatacgtagtagaatcggaggcaatataaactttcagcagagcattactgagtttcccctcgcagaccactgacgacaatgaaggcctcttgctttcatgtatttttctttctttctttttgtaatcagtctgttatatgggatcagtaggtgtccctttccatgaagttataggctactttgctaagttatgaattgttttttttttgtgtgtgtgtattcagtggatgttaaatgcggccaatgacaatggttatttcttagcattcttgtgggatttgcatacttgtagatgtagacagttgtaagactcataatcctgtcaaagatatatcatatgctcaacattcatccacaaaaaaaaaaaaaaaaaaaa

SEQ ID NO: 10711 - DNA, 2340 bp, Zea mays
ccggccgggcggtatccgaattgcgtggcggtctgcctcgtccccttcctcccgtttcttcccttgcctccccctccccgtcgcgctgttcaacgttcaaacccttgcagctccctctcccttggtcgcgcagtcgccattcacgaccccgaccccgacccccgtccccctctcttaaatcccacctctccccgtctacgcctcattcgctccagctcgcatcccacagccaagccagttagcccgggagatctccaagaaaccatcttggaatccgagaacgcccagcattcttggtcggccaaggattcgaattccgacgaacggcttctacggccgaaaaaagtccgataatttccgcggggagctcaggaggtgtctcggtctcgggaaccggaggaggaggccgtgggggattgacgagggggcaagatggtgaggctgccgtacacaacggcgctgaccacgctgttcagctacggcctgctcttcgccttcggccagctcagggatttcttccgcaagttcgtcgactggttcaaggccaagaacgtcaaggggtacgcgccgatctgcctgggcctggaggatttctatgtgcgacgcctgtacttgcggatccaggattgctttggtaggccgatcgcaagtgcgccagattcatggtttgatgttgttgagcggacctcaaaggacaataacaagacactacagcgtacctcgaataccaccagatgcctcaacttgggctcctacaactaccttggctttgctgcagcagatgagtattgcacaccacgtgttattgagtctctcaagaaatactcagcaagtacctgcagtgttcgtgtcgatggcggtacgaccaagcttcacaatgagctggaggagttggctgcgcgttttgttggaaagcctgctgctatcctatttggcatgggttatgttacaaactctgccatcattccatgcctaattggaaagggtggactgataattagtgactctctgaatcataactcaattgttaatggcgcaagaggatccggtgcaactgttagggttttccagcataattcccctgctcatttggaagaggtcctgagagagcagatagctggtggtcaaccacggacacacaggccatggaagaagatcattgtcattgttgagggtatctatagcatggaaggggagctgtgtaaactccctgagattatagctgtcgccaagaaatacaaggcctacacatatctggatgaggcccatagcattggtgctgttgggcagtctggccgcggtgtttgtgagctccttggggttgacccagctgatgtagatataatgatgggtacttttaccaagtcttttggatcatgtggtggatatattgccgcatcaaaggagataattcagcaccttaagcatagttgtccggcccatctgtatgctacttccatgtcgccaccagcagtccaacaagttatttctgctattaaagttatccttggggaggatggctccaacagaggtgcccaaaaacttgctcgcatccgcgagaatagtaatttcttcaggtcagagctcaagaagatgggttttgaggttcttggtgacaatgactctcctgtcatgcccataatgctctacaatccggctaagattcctgcattctctagggagtgccttagacaaaaggttgctgttgttactgttgcgttccctgcgacacctcttcttcttgctagggcacgcatatgcatttctgcttcacatactagggaggacctgattaaagcccttgatgttatcagcagagttggcgaccttgtgggcatcaaatacttccctgcagaaccaccaaagattgctggagctgatcatgataagctggagtaggaatcaacccttagttgccccatgagtgattgaagtagttagaatcccttggagttgtcaacaaatcattatggaaagaagcacatattgagccatttcatttggatcttgtcaatacacaagagtccaggatccgtcatattaagctgactactgtttgttgattgtacaactattcttccaattgtgtatagctggttgaaattcagttgttctgttgttaatccattcccaatatgtaatacaattagaggcaatataaacttcgagtagaacattactgagtttcccttgcagatcactgacgactattggtctcttgctttcatgtatttttttaccttttgatatgggattagtagatgtctctacactttatatgaagatacgaattattttttattcagtgaatgttatatgtgaccaaaaaaaaaaaaaaaa

SEQ ID NO: 10712 - DNA, 1942 bp, Zea mays
gaggatgtcgagcgagttatctccggctcgaacccgtactcctcaagaaaaaccactggaggagcaccaagagttatctccggctcgaacccgagccaggtcctgactcctgatccgcaccgcacacggcaagggggcatcgccgacgggccgtcagcggcgagacccaagccaacacagcccagcgatgtcggcgcgtgaccgcgagacggccgaggcgctggtgcgcctcgccgcctcgctggacggggcggtgctcggcctcggcacggctgccgtcgccgtcgcgtcgtgggtcaagtacctcgccgtctcggggcagctacgcctcgtcgcctccgcggcgacggcctccatcgccgacgcccgctccctcctctcaggcgacggcgccgagccgcggatcgccgcggtgcggggctacgtgcgggcccatgacaagttcttccgggccccgttctcaggcgaggcgggcgtcgtcacgaagcacacccagatgtgtttgttcacagaatggagaggcatctttggatggacctttgatctgcatgctcttcttttcagatcatggaaagagcaaattgtgacgtcttttagatcggttccatttgttctggttagtactgaattaggaaatcctacgggagtggtacatataaatgtggataaggcggatcaaccgttgcctcttaccacagtgtttcataaacttatcccacttgagacgactccttacacattgtttcaaactattattggcaacggctatccgattgcgttgttggatgaagaaaaaatactaccgattggtaagaaaattacagcaataggactatgtcaagcaaaggatgcagaaagtgttgagataacatcgtgcccagagatcccctttttcttatctgaactaaccaaggatgagatgcaagctcagctggcttcacgtgctaggatactcttctggggtagtattgttttgggaaccttgtcggtttgcctagtgggccatgccatttacaggggctggacgagaatcaaactacgaagagaggctaggcatgcacgacagatgtttgaggaggctgaagatgctattcacagggatgactctagtgatgatgatgaaataggagacgggcaactatgtgttgtgtgcttaaggaagagaaggagggcagcttttattccatgtgggcatcttgtctgctgttccgaatgcgcattaacaatagagcgtacacctcatccattgtgccctatgtgtcgtcaagacatcagatacatgatgagggtttatgactcttgaggtatgctgctgataagatctacacgcttccttgctgacccatgcaaacctgaggagcacaactgttcgtcctgctgggcgttttcctagtcaaggtggcctaccctggatttgtgaatataatgtcttgaccctccaaattatgctcttgattgcctgggacaaatagcttagctgaagtcatgaactaacgtagagttattttttgtttgctttgcgcatatgtctatccatcatgtaaagcacagggtttactgcaaataggttaaagatttggacattttctgccaactgatcgtcacctctagtgctgtggaacaggttgcctctaaaaaaaaaaaaatgctgctcgtcgtgatgaacgcaatgctgttcctgctctacggtaacctggcaccagataacagcggtgtcggagccttatgcttgccagcggataacatcgccgaagcgtgaagtcttgttctgatgctggctgcgtggtgtttggtttgctagaacagtggtgtccactctacgccgaatcattgagaaactctagtgttagcaaactgtaattttagaacaggcgtagagtggagtttttaaaactctaaactggctgcctggtgaatgctgttctagcaatactatggtttt

SEQ ID NO: 10713 - DNA, 1955 bp, Zea mays
tcacctgttgactgttgcagccgggggagatcgcgcgcggatcgcccaagtgaaacaatcgacgcggccgggcgcagcgcggggcggggcatgcaacattttgcccccgccgagacggcgaggcagcagttgcgtgtcaccgtcgcccgggcgtgccgagtgctccccgaccgtacgtggcaaaccggaggcaccgtgtggtaccgtatatcttccggccgggtcccgttcggcaaagggctactggatacacgaacgggcgcactcgaactcgtggcatgcagccactacgcttcctgcccgcacccggaatcgggaaacggttgccgtgcgtgctgagccgctgagggttaggctccccggccgggctcctgctatagagagagagagagagagagagagagagagagagagagcacgtttctgtgttctggcaaaacactaccgacttgcagttgcacatcatacatcacgggggacgatggacgaggacgacgcagagtcagggtgaggtgtggtgcatgctttccacccggcgccctccacttgattgacttccggtatatatggcattccgaatagacagttacccggcacgatgcgaacgcggcaggcacgaggcgatcgtccgttcacccacccgtaccgcccgcatgcgtacgtggttgtttccgtgaacgggagaggaccttttcaaacgcaccgcttccgccctcctctccccccacttgcggtggccacgttttccctgagggccggcctcctctcgctctcgcctaccactcgcggcgcgccgaggcctgccaacctctcgtcgtctcctcctcctcccctcgtgttgcgcagactcatgactatatatatagagagccgtctccacaaccacaacggtccatccatcgacgacgagtcacacgagtcacggctcgtgcgtgcgtgcgtacgtacgcagcccagggacaccgaccgccgccgccgcccgcagctcctcctcctcctccgaccctctcatcaaccgcacgtacacgtcctcgctccatggcgggcatgcccacggaaagcgcgacccggcgcttcgccgccgcgtgcggcgtgctcagccagtacgtccggacgaccggcgcgcccgcgatgacgccgccgccgccgttcctgaagccaccagccgccgcccaggagacgacggtcgcgccgcgcacgcagcagctgaccatcttctacggcgggagggtggtggtgctggacgcctgcccggccgacaaggcggacgagctgatccgcctcgccgcctcggcggcggccgcgcagggcccgctgcagcagccgccggaggagcaggcgctggtggacatgcccatcgcccggaaggcctcgctgcggcgcttcctcgccaagcgcaaggaccggtggtcctccgccagctctacggcctatgacgaccgccgccaggacgacgacgacgacgaggcggaggaggaggaggagccgccggcgcccaagaaaggcaagatggcggcggcggcgcgcgaggacccttcttcctcttcctggctcgcgctcggcagcatgtgctccatgcacggccgctgatgagggagccagcggtggttattagtagtgcagacaagagctcgggcgcccgcccggccatgggatgggatgggaggcgttgcagcagcaatttatgtgctacctacgtactagtatttattataattgttattactaacaacaacgactggtagtatcgatcagagaccgacgctattcgatcgttggttcgtttcattgtcctttccttccttgctagctggtggtgtatcgaccatctaaatctaacaggacacgtggacctggacggcaagagatgtccggtccagcagtgtggaacgtaaaaaaaaaaaaaaaacattaattgctataagtttgtttcatatatacatatatactactgt

SEQ ID NO: 10714 - DNA, 616 bp, Zea mays
  misc_feature (616)..(616): n is a, c, g, or t
ggccccccttttttttttttttttttgacacaagcaataatacaaatttaaatagaacagttcacaatacacaagtgtatgattgacaattagacatagactgacgagcaaacaacatagtcttcacagagttaacaaggacataagtcttcggtaagacatagcaggctgcacagcagcaaattctctgaagtttgaagcacaataacagcagtcaacacatcctgttcatcggcaagactccgttgcgattgcgagctaggacctttcagattttgagcgctacgcaaacacgcaacttcagcaggcactcaggactccgggaagtggggcgcgtggccgtggggcacgccggcaacggcaacgaacaaggcgatgagcagcacagatagatagcagtcgtcgaagtttgacaagaggcgttgtgagctgccggcttcggatgcagccaatgacagtgagccggcgaggcggcgagggccgagggagagtccttcgggctctaacggtgacgaagctaactgacgatgcgccgccgccactccttggggctggagactggaggtggaggcgcggagacatgagaagctagggttacaacttacaatgttctttn

SEQ ID NO: 10715 - DNA, 661 bp, Zea mays
aaatagaacagttcacaatacacaagtgtatgattgacaattagacatagactgacgagcaaacaacatagtcttcacagagttaacaaggacataagccttcggtaagacatagcaggctgcacagcagcaaattctctgaagtttgaagcacaataacagcagtcaacacatcctgttcatcggcaagactccgttgcgattgcgagctaggacctttcagattttgagcgctacgcaaacacgcaacttcaacaggcactcaggactccgggaagtggggcgcgtggccgtggggcacgccggcaacggcaacgaacaaggcgatgagcagcactacagcaggcactcaggcagaggcagcaacgcattagacattattcatcaaagactcgaagtttcacaagaggattggtctttgggaagaaaactctagtaccagatagatagcagtcgtcgaagtttgacaagaggcgttgtgagctgccggcttcggatgcagccaatgacagtgagccggcgaggcggcgagggccgagggagagtccttcgggctctaacggtgacgaagctaactgacgatgcgccgccgccactccttggggctggagactggaggtggaggcgcggagacatgagaagctagggttacaacttacca

SEQ ID NO: 10716 - DNA, 1143 bp, Zea mays
caacaagaataaaaataaataaaattttttttttttttttttgtttaacatcttgctgttactgcatagtcacacaaaactgtcttcctcgctcttattcatgtcatagttaaaattaagaaaaatcttatacgttactcggtatacatatatatgatccgtttgtttattaaacgacccgtttagactatagcctcttctagctagactcctttgcattattgctcacagagtcatagcggatcggagcagctcgatcgagggcgagtagtccatctactagactactaggctgctgcgacgctcggggagaaggccatcggggcggagtgcggcgacacggagtagtcgccggacctgatgagggcttcggatgatccacacttggcagcacggtcgtccagtagcatctgctggcatcggcactctgagctgcagaaggctttgtcccctctgtacatgtagatatcgagcccatcaagcctcttgtcacagaggcagcaccggctgaggaagtcgggcgccggcgccggcgccgcgtcgtcggcctccacgagccatccaccgccgccgtcgccgaacccaaagtacacccgcttgcggacgctggcggccgccggcgccggccacgtgcttgatgacgcacgtgtagctctcgtcgtcctcgcgcgcgcgccgcctggccgcggcgccgatggcgatcggctcggccccgtggcccatggccgcgacgatgccgagcccgacggcgccgcgctcgtcgaagctccgcctcggcggcggctgcctcgggtctggggaggagttgttcgcgctgacgaaggcggagaggaggttggccaaggacgaggaggccgtcgtcagcttggccacggagctccgctgccgggtaggcggcgccgaggccgccgccttctgctccgctgccggctcgtgcgaccacatcatcttctgcgctctctctctctcttgccagagacggagatgggagaagagcttgttacgttacgtgcgtgctcagtctagctctcagctgccatctctgctctctcactcccgtctctctctccctaaagagcagagcagtagagcactagcgctagcggtggtggtatcgttgaggtctagcgagaaagagggggg

SEQ ID NO: 10717 - DNA, 2740 bp, Zea mays
gcacgacgtcgtagtctagtcaagcccgaggcctttacctagatccccctcctcccggaaaatgcttctcctgcacaaatctgttcccctccgcctgctccttccacgccgtcctctcaaaacctttctcctcccgccgccgtctcgcccccgctgtctctcgctcctcccacgcgctgccatgggctccgtagctggagacaccgccgcccgcctcgcgtacccgccggcccgccgcgacgattcggtcgtcgacgactaccacggcgttcggatcccagatccctatcgctggctggaggacccggactcggaggagacgaaagagttcgtggcgcggcaggcggagctggcggagacggtgctcgccgggtgccccgacagggagaacctgcgccgcgaggttacgcggctcttcgaccacccgcgccacgccgcgccgttccgccgcgggaacaagtacttctacttccacaactccggcctccaggcccagagcgtgctctacatgctggatgatttggacgggaaggcagaggttcttttggatccaaatactctaagcaaggatgggacggttgctctttcaacatattctatcagcgaggatggaaactacattgcttatgggctaagtgaaagtggtagtgattgggtctctattcatgtgatgagcattactaacaagcagcctatgcctgataaattatcctgggtaaagttctcatctatcagctggacgcatgacgggaaaggttttttctatggtcggtatccagcacctagaggaggggaagtggatgctggaactgagacaaacatcaatcttaatcatcagatatattaccatgttttgggatctgatcagtcagaggatatattgtgctggaaagatcccgaacacccaaagtattcctttggtgcctcagtcactgaagatggaaagtacatcatattgggcatctatgaaggttgtgaccctgtcaacaaattatactattgtgaaatttcttctcttcctcaaggaatagagggctttagagggacacaggatttgcttccgtttgtcaagcttattgacaattttgatgctcaatatcaagttgtggccaatgatggtgatgaatttacatttttgaccaataaaagtgcccctaagaataagctggtaagggtaaatatcaaaaatccagagctgtggactgatgttctctcagagcatgaaaaagatgtgctcgaatcagccgacgccgttaacaataaccaacttttggtgaattatatgtcagatgttaagcatattctgcagataagagaccttagaactggaaactttattcatcagttgcctttggagatcggttctgtttcagagatctcgtgcagacgagaagacaaggaagtatttattggcttcacaagctttctttctccaggcattattttcaggtgtaacttagcatctacaatccctgaaatgaagatgtttcgagaaatttcagttcctggatttgatcgcacaagttttcaagttaagcaggtttttgttcctagcaaggatggaaccaaaattcccatgttcataatgtcgaagaaagatatcgatcttaatggatcgcatccaactttgctatatggttatggaggattcaacataagcataacaccttcatttagtgttggtcgcgttgtgctatgcaagaacatgggctttgttgtctgtgtagcaaacattcggggtggtggagagtacggggaggagtggcacaaagctggagcacttgcaatgaaacaaaattgttttgatgactttgctgcctgtgctgaattcctcatttctaatggttacaccagttccagacgtttatgtattgaaggcggaagcaatggtggtcttctggttgctgcttccattaatcagaggcctgatctctttggatgtgctctcgctcatgttggcgtcatggacatgctccgttttcacaagtttacaattggtcatgcatggactacagactatggttgttcagataaggaagaagagttccagtggctcattaaatattctccccttcataatgtacggagaccttgggagcaaagctctggtaataactgccagtatccagcaaccatgttgttgacagctgatcatgacgatcgtgttgtgccattgcattcactgaagttattagcaactttgcagcatgtcctgtgtaccagcactgaggacagcccgcagacgaatccaataattggtcgcattgatcggaagtcagggcatggagctggcaggccaactcaaaaaatgattgacgaagctgcagacagatatagctttatggcaaaaatgttaggggcttcgtggactgaatagtgaattttgtccagcttagtgtggagatggtgagcaagattactctatgcagtcaaagtaaagtggctgtaaaagttatattgcttatgttttgctcttgcttggatgatcatccaccaaatagtatagtgtttatgcttcggtttgagataagggttcagggagcattgtcatgcttggcgttggtgcaccatttctttcatatatatcttttgattgttaaattttatacgttactacttcattgattctaaattataagatgttttggttttttcagataaaaaaaaaaaataatgctaaatcgcgaggggggccctatgtctaaaagaaaggtgaattgagattttttctttctttcat

SEQ ID NO: 10718 - DNA, 672 bp, Zea mays
atttagcggtgaccgcggttccctcgggcgtgcaagcggtggagatatcgggggcgggcggcggtggtgccccgaggtgggtgacccacgccgacgctcccgaggcagcgggcaggcagcggtggttctcccctaagactgagtgatggcgacgctccagaggcgggcgggcaagcggcgacggcagtcccgagtcgaacgagtggcggcgtcgcaccctaggctcggtggtaacggtgattgtgcgaggcacgataggcttcggcagtgacggtggtggccatgggacacgcgggtagctccgacgggcgcgtgaggcgcggtcgtctccagcggtggtggccacatgaggcgtggttggctccggtgtccttcgatgaccaactccttcgatctgatggcctcggcggcggcgtcctccgatgacctcctccaattctttgtttatgcatgcggctgttggttgagcccatactaatttttcattaattatgatgtacggtgtaggtgtttatgcaactttatgtaacgatttatgttttgcatgatatcagccatctaacttttgtgtatttgctatgggaacgaaaataccattcaaaatttgtgtgcatgcaggggcggccaaaaaaaaaaaaaatataaaaaaaaaaaaactgggggggggcccgg

SEQ ID NO: 10719 - DNA, 2026 bp, Zea mays
ttgcactctagactcagattgaaattcttttattttatcaaacatacaccctcaatgcacatggcaaaattgagacgtgtacttgcagtgaaaaagccaaccaacaccgctgccactacgcacattagtacctctcaataacgttgccgagtgcagcaacagtggcgtaggtccgaagacagtgacatagaggcagttgaagagaacggctagggtttttttgctgagagcttttccattatatagtatacaaattagtaccagttcttgtgtaaaaccggtactgatgcttagtaattagtaccggttcttgttgtgaaaccggttcttacaaaaaaaaaccaattctgtcagtcgtttcttttgttactaaagattatcttcagagagttcaacttaccggttctataaaagaacccgtgctaaagatattagtaccaattgaattgaaggcaagaatcaatgctaaataaattaatatcagtatccgtttttggcttcaatccgtattaatattctctgtataggctagatgttttaaaacggtactaaatcttatctaaatatccccattctccaaattgccaccgcagttcttccggactcaaggcacggcttcttattttacggtttcctccgtcatcacattatagtctgatcaattctgtcagtcgtttcttttgttacattattccattgtcttgccccctccccttttgtaatcttgtctaacgttccatatatgtatttttatactccctagactaaacatatactcgtcttaaaattgtagttgttttaggtctagatttttatgtccacgttcatatggatgattataaataaataaatatatatataacacatacgttaattatgaatttaaatttagaatggaaggaatatttattaattaacatatgaatatagatgaaaaaagagagttaaaagaactatatttttgggaaggatgtagtatacgctacgatcgacatgctaaacgcgatacggcatacaactgcatgagcattgtagcatgcaatacatgcaagaggttagaagaaccagtgaccaaaatctcttcttgtacagacgacgacgttcctaaatagactgcatgagcctgccctgaagcgaagcgtccgcaagggcaaggccgcgcgagaatggtgggcacgccacgagaaatcatgtcagtagcgttgtggcttgcccatcgttctcgcccggccttctcctctacacacctatatatatatggtaatacgcgccccccccggctgaataactagacagacaatggcgcgcaacctgtctgtcacattgttcattctgacggcctatgtcgccgcgacggcggcaccgaccgtctgtgcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaaccccttctttaaaagcgcacctccatctggtagcgaagacggcctacccattgaccccactccagaaggcagcatgaactaaattaaataccaattacgagaccgaccagatatgcatggagcatgcaagaatgttgtcgaacgaatatatgctatgaatggttacatgtactggctacatttagttcagcttaatttctctagtacgctgaaagtattcgatcgatcgagtaggattaggattgacgacatgattatttgtgcaccgtttcagacagcaaattaactatatatatgtttttcttgttgttacaaaaaagtttgaccgattattgtcgttgtgatccttgtcagtcacgatccatgattcacacgaagagtgggcctatctgtagaatcactcttgcggcaaacccgtggacctcgcctgtccacaccaaatcgtgtaaattacgtgatttgccctaaagcaatagcag

SEQ ID NO: 10720 - DNA, 1702 bp, Zea mays
gactatctgtacgacccaagtgtgtgatcgcggttgtataaatatccccaaaggagtatctgagtaccaacgattagtgtgcgttggtttataaaaaaaaattaatgaggaaacgtcgaacggaatggtagtgtttggactatgcgggggaagctaacaacggcgtgcacgttccagacttccagttagacaaaatctgttgattccaaaggaaccactttgaataccaaagaacaaagaataatatccattcgagacatggtgatgcaaacttgcaccagcctctctcacagacagagaagcttccgatttcaactcgtccgaatccaatgcaatgacgccacaaacacgattcattctggttctacacatcacaattcacaagccaccacactagcgaccatggaggaacagtttccatgcgaaccagagaacatccagatgacgatgccctcgagctcgtcacacgcatttcttggaccagcgcacgcgcgcgcgcgcgtgtgcctgtgtttgaattgatgcgcatcttgttgctctgttcttgcactgagatgaatccatgaaccacgaaccactggtacaccatcagttagctcactagctgctggacggggccggcggcgaaccacggacgggccgggagggtcagctggacgggcgcctgcgccgccggcgggggcggcacaagggccatggccatggtcgcggcagcggcctcgcctctcttcctccgcttcggtgtcgcagaggaggccgaaggggaggagtcggagctcgcggtcggctctggggacgcccgcttgtctcccgcggcaggggcagtggccgcgacggcggcggccgccgcggcgatctcggagccgatgcggagcgggaagttgaggagcgcgcgggagccgcgcatgcggtacgcggcgcggtcgtaggccacggcggcgtcctcggcgctgtcgtacgtgcccagccacacgcgcgcgccgctcttggccgggtcccggatctccgccgcgaacttgccccacggccgctgcctcaccccgcggtagtgcttccccctggacaccgccgccgcggcctcctcctcgctcccgggcgtcgtcgccgcctcggtcggcgtctcaggcccctccgcgagaaggaagccaccaagacagggataggatccgcgctcgtagggggagtccgggaacgccaggggctcgggcttcacggcggcgaaggagccgtcggggagccagccctgggagaaggcgtcgcggagcgcgccgaagacgaccatgtcgtcggcgtcgtcggggcggaacgggagcgactcgctccattggtccgccactaggctgccgaagctcgtgctgcggcagtacaccggccgcggagccgcgctcgcggtcgccgccgccgccggctcgtccaggaggtgatgccggatgctgtccatcggcgctgccgcctcgcacgccgggttaagcagcatctttgttgggtctccggtgcccctcacgtggtgtcgtggttcggagggaatttcagcacttgatttggaaaattttggttcggaaggaggctggccacggcccaggcttatatagcggggactggagaggtggagctgcatcaccatttgtcgtcgcgcttctagatgaccttccttgaattttccggtgttactgtcacgtggttcgatcgttttcgaagctac

SEQ ID NO: 10721 - DNA, 1179 bp, Zea mays
aatgggcggcgcggcgatatagctagggtagagtagttcacccccccgtcaccctctctcggtctcggtctctcctcccctcctacgccaattgctacccgtcgtcgcgtcgcccccctcctaccgtcctacgtcttccacctctccccgcttcctcttcctccctgctgagcggaagcgcgcaagcaatcgctgccttttcttggcgtgcgcagctcctggtcggcacggcagccccccgcgggatctcgcttgctggcctggccgcgcgacattgaggcggggcgcctggagctcggagccgccgtagctggtgttggtgcctcggagccgatcgggtgtctggttcctgatttgatctgcagctgcagctgcggcggcggcggccgacatggcggcttcgggagggctcgagcagtggcagaaggacgggttcttccaggcggccgaggaggtgcaggagtccgcggacttgatggaatcagtctatagaacttggatgcgtgagcgtagtaatggatctggctcagaggaggtagacgatttgcaaagggagcttcagacagctttaggaactgcaaaatggcagttggagcagtttgagagggctgtaagttcaagcaacgataagtattcattggaagaaggtacagtagcacggcgtcggcagtttgttgtagccatcgaggatcagatttctcgtgtagagaaagaaataaatggttctttaatggacaatggcgggcaagggctcaactgggtgaagttagatgacgaagagcgagatgatctagttgctttcctttcagcacctgcagagttctattcagaaatgaagagcacagacatcagtgaccgtgtcccatctagacaaaagaatgtgccagttggcaggaacgatcagagtgatccacctttaatcattaaagacatatatgaagtggcacgcacagaaatttctactgttaagagtgatgtttgtggtctagctgaggagttacatggccttagaaggaatttgagttcagctaatgatcattggaagattgaccttggttacaatatggatgatgatagaaaatcgtcaactggggttcaggccgcaagtgagacaactgctttatcaagcatccggagaagcgcagaatctataacaagagtgagatggttttggaatag

SEQ ID NO: 10722 - DNA, 5280 bp, Zea mays
  misc_feature (446)..(446): n is a, c, g, or t
  misc_feature (458)..(458): n is a, c, g, or t
tagtggattgagtgggaaattaactaatttcccccttcaactccctccaatccccccatgatctctagtcaccaaatcagccctttagaagatggaggtgaccggacaattatatttagacttccaggacccatgatcttctaaatctatgtcgtcaccatattataggagactatgttatcaatcaaggattttaattaaaatatcctaaaacgcaatcaaccttgtttatattataatttaattatataacctgattattgtaatcaataggatatttgaacagtatcctacctagttatgttcctcgtattaacattttcacttacataagccctaaagcttattttaactcagagcttatttcttgtaattgataccaccacaatgagcttattttaactcgttaccacattgactacccataatttcttcacaaaattaancgacatatacgntccgcgaaaacgtatgtatccttgtcattgataccaccacataaacatcatcaagcgataaaacttactgcatcgggaaatccgcttatgtagcaacatgctttcacctttttctccatgttgtgacttgccattatatatcatcaactctcgcgtaatatgttatccaagtcgcacaacctaacatttttccaataattttcattggctagaggttgacaaaataagaagtcaataaaatttagttattttatcaaaatagtcttatttttcatcgataactggctattatatattaacggaccgaaattagctaatttacatcagtagtcaacattatcaggttaattgttgtcaacaatagatacatattcatccacatgacatcatatacatccataaacatgcatcacaaagatcatccatattaaataggaatcgatttataaagacgataaaaaaagaatggagggagtaccactttcaagatgtttacctctaagaatcgatttataataaagacgaacgatcaattcatatatgttaatcgacgatatagaataactctggctttgaacccaacttggacttggacttgaattcacatgtgatggtttatgaagtgcaacgtgctgagcctctagcagtttcgtggtcgagtccttgagtgtctcaaattggtgtctctaagagccttcaacaaccctatcaaataagatctacactagatcgcttagagcatctctaacaataccttaaattggtgtctcaaatatgaggatctacgcagaaaaaactactcggacaatgtcttatttcataaaatttgatcaaaaaattataaagcactctctcaagtactttaaatatactacattatagtgagctactctataatctaaattttatgcttcactgttggagcgagatgttttattggtgccttaaattttataaaatataaaatatactcatttttaaattataggatatttttataggtcacgtttagcaactttggtacttacaataatgcacatgatactttggaaccacataagcaaggaggaccaacggacgacactacgattggatcaatcaaacctcatgatatcaactaacccatagtctcatctcagacccagaatcaaggctgacttggactcccgagcctgtttccaaccccaaattatgtatcaactggctcaccactcaggtttggatctaactcatcctaacccaagtcttgacactgattcggttgaggcagatatctaatgcatgcacagttctcgtccatgattagtttggttggtgaatgccaagagggatctctctctctctctctctctgattatgaaaaaggacgatgtcgataaaacagggtcgactcgagacatgccagattacacgcaagaaatccagagtcatcataatggaggatagtggggttgctctcgcaaaaaaggacagggaaacggaaacctgtccgcaccctggcgtggccccatccgaatatcctggaggataaacccagggacgaagatggcaccggggaatattcccgccactccgcgcccgcttcgattccaatccccaccatcggcctcggctgcctatataaagacgcctcccggttcccttccccgtcgcgacctcgccacccaaattcatcaagctcaacacgatctcaattcgattccagttcatccatccaacgcctcccgcctgtacgtatagaagaaagaaggaagaaccgtcaccgtacgtcctcgccagtacaaataatggccctgctcaaagccgcgcgcgtcgccgatgtgcccaccctggacgtggtggtggcccccggcctggtggcggttgccaaggcgaggagcgccgcggctgtgggcggccggttctcggtgatcggccaccgcggcaaggggatgaacgcgctggcgtcggaggacccgcgtctgcgggatgtgcgcgagaacacggtccgctccttcaacgacgccgggcgcttccccgtcgactacgtcgagttcgacgtccaggtactaataaactgatgattcattcattcatggcacggcctaccaatgcaaataaatctatctcacgctatgagaagaaaaccgagagagagagagagagagagagagagggcttgccttcccggccggccgttagtgctcaattgggcacgcgattaccgaggcaagcagaggcctcgggtcgggtggggcttgtttgacggggacggcagatccacgtctctgtcacgtgactccaggcggtggtcgcttgctccatgtgccgcgtcgcatcccgatctctggctgtggttgcctggctggcaagggccaaccgcccgtcgtcagcgatgaggatgcttgtagtgtcgtgtcgacttttgcaaaaacaacgtgcccagccctgggtttgtgcgccgccgcaccagccaaaacaaagacgaaaccgaaagactcgtcaaaaggcaaaaccaagtgaggaaagacaactgaccatagcaaaaaacacaactttgctagttggtttccacgtatctttgccgcatgaactggtcccggccgtcacgtttgcttatagttccaccacaataatagtcgacccgtggtcccgttggttttgattgagagtagagagcatccaccggacagttaaaagtgtgtttcattgttttttcccctaataatctagtacttattctctacgtccacataatttagtcgttttgggtttattctaaattaaactattttaattttaatcaacaatatatataattaaattattttaaacttaaaagaattatatattatgatagtttaattcatgataaatttagtaaaattacttttgtattgtaaaaccttataaaaggttcgatatatatataactggtcaaaattgatagggaacgacttagaacaaacttaaaataactaaattaaactaaattatatggacgaaggggtaggtacctactccacagtacttaatttcctctagtagttaaccgaaacacggtagatactgaatgaatgtgttgcaagaaacatactgatctgtctacttttgcttctcccctcttcgcctcttcaataattcggtgtgcaaagatgttgagaagagaaccgtgaataccgattttgcaggtcaccaaggacgggtgcccaatcatcttccatgacaacttcatcttcacacaagacgatgtgagttcatgtatacgtgcttcatatcatatatatataacgtgttaaaataagatagcggaactttattttactccggcaccaatgtagaggctaaacctctccgtttttggtccttctcagggtaagatttcacaaaagcgtgtggccgatattcagctggaagacttcctgcagtatgggctccagaacgagcaggggaaggtacggcgagtcaccatgcatcttgcttatgggactgagtaaccagtagccactaccacctcccgtctcctctcaaaaaaaaaaaaatcagcaccatctgatgatgttgttttctttgtcactcaatgaaggttggcaagcccctgcttcgcagattgaaggatggcaggatggtgaactggaacgtgcaatcagaggacgctctttgcacactcgaagaagcgttcgagaaggtcaatccaaggttgggcttcaacgtcgagctgaaatttgacgacagtcttgaatacaccgaggaagagctcactcgcatcctccaggccatcctgaaggtacgtgtatatatatatatatatatatatatacaagtaaaacacttcatacttctttcaaatgtggttccctatctaacagcatcgtacatttggttttcgaccaggtggttttcgagtacgccaaggacaggcctatacttttctccagttttcagcccgacgctgcgcagctcatgcgcaaattgcaaggcacataccctgtgagtgagctggacacagtagtgcaagcatgcgtggagcgtcatatatatatatatatatatatatatatatatatatatatatatagcatctgtttctcatgttttatgaacactattgcgtcaggtctacttcttgacgaacggagggacggagctatacgccgacgtgaggacgaactcgctggaggaggccgtcaagctgtgccttgccggtggcctgcaaggaatagtttcagaagcccgcgggatcttcaggcaccctgccgccgtgccaaagatcaaggaggctaacctctccctgctaacctatggaacattgaagtaagtggtggtggtggctcgcaaaaatagatagataggattaatttgtggcactgcctgcctgtgtgtgcatgtcctggatggatttagatgctgagagttgccgtctgtgtatccttctcgcagcaacgtgccggaggcggtgtacatgcagcacctcatgggagtgaacggggtcatcgtcgacctggtgccggagatcaccgaggcagtctctgagctcatcgccctgcccgagcccgacctcgacctggaagtgggcagcttgagcaaccaggcggcagctagaggagccacaacaccgaatttctcgcagcgcgagatctcgttcctgctgaggcttattcctgagcttgtccaataatgcctagacttcctggtgttctgtctgtctatcatggatgaattgactaatgtgttactgatgtactgatccgcatacaagaaaagaagcccttgtgcagggtattatttgtagtaaaaaaaaaaaaaaaaaaaaaaaaaaaaaaaaagaaaaaaaaaaaaaaaa

SEQ ID NO: 10723 - DNA, 1479 bp, Zea mays
gcaatcgcatccggggcgcgggccggggcgacctcgccacccaaattcatcaagctcaacacgatctcaattcgattccagttcatccatccaacgcctcccgcctgtacgtatagaagaaagaaggaagaaccgtcaccgtacgtcctcgccagtacaaataatggccctgctcaaagccgcgcgcgtcgccgatgtgcccaccctggacgtggtggtggcccccggcctggtggcggttgccaaggcgaggagcgccgcggctgtgggcggccggttctcggtgatcgggcaccgcggcaaggggatgaacgcgctggcgtcggaggacccgcgtctgcgggatgtgcgcgagaacacggtccgctccttcaacgacgccgggcgcttccccgtcgactacgtcgagttcgacgtccaggtcaccaaggacgggtgcccaatcatcttccatgacaacttcatcttcacacaagacgatggtaagatttcacaaaagcgtgtggccgatattcagctggaagacttcctgcagtatgggctccagaacgagcaggggaaggttggcaagcccctgcttcgcagattgaaggatggcaggatggtgaactgggacgtgcaatcagaggacgctctttgcacactcgaagaagcgttcgacaaggtcaatccaaggttgggcttcaacgtcgagctgaaatttgacgacagtcttgaatacaccgaggaagagctcactcgcatcctccaggccatccttaaaggtggttttcgagtacgccaaggacaggcctatacttttctccagttttcagcccgacgctgcgcagctcatgcgcaaattgcaaggcacataccctgtctacttcttgacgaacggagggacggagctatacgccgacgtgaggaggaactcgctggaggaggccgtcaagctgtgccttgccggtggcctgcaaggaatagtttcagaagcccgcgggatcttcaggcaccctgccgccgtgccaaagatcaaggaggctaacctctccctgctaacctatggaacattgaacaacgtgccggaggcggtttacatgcagcacctcatgggagtgaacggggtcatcgtcgacctggtgccggagatcaccgaggcagtctctgagctcatcgccctgcccctgcccgagcccgacctggaagtgggcagcttgagcaaccaggcggcagctagaggagccacaactccgaatttctcgcagcgcgagatctcgttcctgctgaggcttattcctgagcttgtccaataatgcctagacttcctggtgttctgtctgtctatcatggatgaattgactaatgtgttactgatgtactgatccgcatacaagaaaagaagcccttgtgcagggtattatttgttgtcgaaaaaaaaaaaaaaaaaaaaaaaaaaaaaaagaaaaaaaaaaaaaaaaaaaaaaaaaaaaaaaaaaa

SEQ ID NO: 10724 - DNA, 1270 bp, Zea mays
  misc_feature (1137)..(1137): n is a, c, g, or t
  misc_feature (1143)..(1143): n is a, c, g, or t
  misc_feature (1148)..(1148): n is a, c, g, or t
cattgggtacctcgaggccggccgggcacacaagacgatggtaagatttcacaaaagcgtgtggccgatattcagctggaagacttcctgcagtatgggctccagaacgagcaggggaaggttggcaagcccctgcttcgcagattgaaggatggcaggatggtgaactgggacgtgcaatcagaggacgctctttgcacactcgaagaagcgttcgacaaggtcaatccaaggttgggcttcaacgtcgagctgaaatttgacgacagtcttgaatacaccgaggaagagctcactcgcatcctccaggccatccttaaggtggttttcgagtacgccaaggacaggcctatacttttctccagttttcagcccgacgctgcgcagctcatgcgcaaattgcaaggcacataccctgtctacttcttgacgaacggagggacggagctatacgccgacgtgaggaggaactcgctggaggaggccgtcaaactgtgccttgccggtggcctgcaaggaatagtttcagaagcccgcgggatcttcaggcaccctgccgccgtgccaaagatcaaggaggctaacctctccctgctaacctatggaacattgaacaacgtgccggaggcggtgtacatgcagcccctcatgggagtgaacggggtcatcgtcgacctggtgccggagatcaccgaggcagtttttgagctcatcgccctgcccgagcccgacctcgacctggaagtgggcagcttgagcaaccaggcggcagctaaaggagccccaaccccgaatttttcgcagcgcgagatttcgttcctgctgaggcttattcctgagcttgtccaataatgcctagacttcctggtgtctgtctgtctgtctatcatggatgaattgactaatgtgttactgatgtactgatccgcaaacaagaaaaaaagcccttgtgcagggtattatttgttgtcgtgggttgatttgtctgtcctgagagcttgtcctgctcccagttttacttttttcttaagtaaaagttactgtaggaggtctacagtatttttttgcttaaggaaacaagattggggtgaagatacaggagggtgagtatagaaaaaaaatagagttacagaacanataatnttttnaaaaaaaaaaaaaaaaaaaaaaaaaaaaaaaaaaaaaaaaaaaaaaaaaagaaaaaaaaaaaaaaaaaaaaataaaaagaaaagataaaaaaagagaaggtgaaaaaaaaagaagaaataaa

SEQ ID NO: 10725 - DNA, 1850 bp, Zea mays
cattagatggcgttatcgccgacgatcgtcagtgactatcataaataagctaacgccaatggtaaccatcggaaataattcgattttcaactgcttaataccgacgaacgaccattgtgagagatagggtctaaatcatcgaaaataatctatttctgatggttattagcttatatctggcggtttaagcgtaggaatttatgtggtttactacagtgattgagataaagagttgttgggaagcatttatcctaaccttgggaccgctgcatgaaatttagttgacattgtattctcaaatgaaatagtagaaaggtggaaaagaagtaatactttgaacttactccgccgcctccgactagctgctttaagctatttttctagttttttttctcccaagcaaaaactacggcagtacggcgtatggaccataatacctcctttacgttaacatcggcagacattgccttttgagttgtcatgcaatcactattttttttttttttttcaaataatttagcatgaacatacattgtttactcatacgtacgtaaaatcatatacacacatgcattatattgggtttcttatttacatcacataatagtctcaatcttcatcaataatgtcgtggacaatctgaagccaaatttctctgaaaacctccactataacgccatggtactccatcgagttgagggacaagtagcactcaagaagctcctgcagatcctccggcgcgctcatgtcgttctcgacgatcatctgcaccatgctctccttgaaatccctgagcggatctgccgacgccttcacgacggcgaagctcctcctagcagcggttctccgccggccaccaccaatagcactgcccgtagtactgatgccaccggcgccattgggagcaggcggcaaccttctgctcctcagcctcggcgagctcgggcttgttccgcttatagatccggtgagcactgcccttgtgcggatcggacgtagctgcaagtcttggaactcgtgcttggattcgatgaccatggtgcggcttgctgggcggcggcggtggtgatctgtggggaattggatgtctgatgcctttgtgttaagacgatggagggtggaggtggaggtggaggggtgtagcttctcaagtgacgtactatgcgttgtgttcaggtagtagcagtaggatctgtgtggtgatactggaagaagcggtttgggactgatggctccatggtagtagtggcttgttgatctcttagaccacgttcttgttgtttgcctgtttcttgtgcttgctggcctgggtttcttcatgtccctcagcttgtagaaccaagagttaggcatgagatgggatagtttgaacctgtgatggttgctcatctctctctctctctttgtgtccctctctcgatcagtatggtttgatgtgcaccatggagcattacatgggaggcccggccggcttggtcgaggtaatggtctcgtgccagagcggcaataaatataatgggaggtgcatgattttgagccaagtatatgtacacaattccatgcacgcgctacaagtggcagaataattaattctgttcacttcggattaaagtcagctatttggacggttacagccacaatttatagggacaaaaacactgtagaaaaaatagagattatcaagatcatcttatgtgtagcatagctagctagtagtacaccaccatttgagtaggaagaagtcttttcaattgacaaccaattcgaagctagcagcacctttggaaaccgctttcggtatgtcgtacctgttcagtcattatgactttgtagttgaaatgagtagaaac

SEQ ID NO: 10726 - DNA, 4359 bp, Zea mays
gctgccccattattcatgtagctgcagcatcagttaagctggagaatactttggtgacaacccaaatagatgcatcacagaatggtgattctgcaaattcaagtaattactaactgagtgagaatactggtagactcagcggctgcaagcccagtactgaaacacctgttgtgcgagctctgcctcatgtaaacaaggcaatctgcattgaaattgcatttggctaactagtgttcttaagttgcctaggcgagcaagtgcactagcgcctaggcggcgcctaggtgggtaaggcgacaaaggcggccagttttgcccgagcgcctggatgcctaggcgtcgcctaggcaacgccttaagaacagtgtggctaactgatgctgcagctatgtgttggccttctatggtgatgcatctttccttttgaattcagggtcgtgctgataccccaccagctgaaacaaatagtgatagctctactgcacagccaggccttgggaaattggagcagcatgagcaggcaaatcctaataaggagcatgcgacccaccaggaaggaggagtcagcaatgatattggtgacaacaacaagaaggataactcaacagaagtaaccaacatcagaagagatggctccatacagcagccaaagcacaaagatagcatcatgacaaagtcttcacaaccactagatttcttggaagattctcttatcaaggagtgtgatccatcacatagatgtatcattgaaaacaagaaattcatcgcctgcttaaaagtttctggagaaggtaattttccagctgtttggtctttctttattatctatcagtgcgccccgtacacatttttatacaaaaattttatctctatcaagcttctactcttctaagttacaatttgttactggttgtaattgtgttgtcggaattagattattactattctcattacacataaatctgacattcaaaacttgtcatttctgcttcgaaagttattactagtgtaaccaatctaatgtgagtctcagttttgacatcctcttgttctgcacttgcatccatccaagattctgtagtaatttctaattcaggtactgtaaacaatttccaaataggcttcaaattggaaggcaaattaggcaaggacatatattcagtagatatggtataatttaattcatagctaaattttagcgtcaaagcaaaacctggacaactatattagagtttactgtcagcatctgggacaaaaacatggcctcctcaaaactttaaggatattaccttagtgacccccatcacctttttttgctcgaatagcagtttttaaaaaatattttggtcctctttatgtgttctgagatttttctgtttcatattttggtctactcattttccttctttcatgctctgtttatatttttcgcattaactaacattttacgttttacggttgggactagactcattggctctgtcacttctgatggacaacagaggcataaacccactagatgttagcatcatggctccagattatgtcactttagctgaagattccatccatgttgaagcaaatggtcacaatgaggtataaatgtgtaatgtatctttgttattgcgccatctgattccaaatgcgggttgtttcagggttctaatcagtcaaacttctttaacttgatcaatcaatatatgaaaaaagttacatagattgacaacacatgattgatgttcttagtcctttcatggaaaatatttttcataatattgtttatttctctacatgagaaaggttttctagttcaatttttctgtatgttgtctaaaatgcggttaattgcacttgctatgtatttatcaaacctatctcgcgagatatcaacttttagtaatatagtgttgtgattatctttgatatttggttttagtgtcttcaaacgctctactgagcctttgtccttgctcttttgtggttgtttctgcctcagacacaagtgagagtttctgtcaatgatgatgcaaatagcacgacaatagtcatcaaagttgcagaaaaatcctgcaacatcagcattcacagtgcaatcacaagggagacggctggcagtggcagagtcataaggatgccacttacgccaacatacacgctactgccagtcttccttctcctcgttgcggtggcagtgtgcatcgtggtccggaggtggcgcaaccaggacggcgaccctgcgtatcagaagctagacatgtcagacttgccggtttcggttggaggcaagaaagaacatgacgatcggtctgacaagtgggacgacaactggggagatgactgggacgacgaggaagctccggtgacgccatccaagcctctgcccaacccttcgtccaaaggtctcgccccgaggcgatcggcgaaagatggttggaaagattagttagccacatgacgccacttaaaaggagcattgcggaaatagttccagtgcatgcagtatatttttaccttcatctttgttgttaaatatttctggaggatgctaatgtcagagagtgcaatacattgataccaagcagaaaattttgtgatcttcctctgccaaactgagtaactggcagctattgaatatagttattggacttccgacccgtctatgctttaacccataaacgcgaaaatgaaatacacatatgggctgaacctccacccttacatgggccctagcccgtcatctcgacgtcataatatatacttattgtatctcacagctgcaatttctgtacaatttggaaacggaagcgtcgtgtcgttttgggtcactggacggtagcggtgcaaacagccaacgttgcaagttgcaacaagttcatcacgtacgggccggccctgggcgccgccggaagaaccgctggccaggcaaagccggaggtacactgctgctgcgtgacacgtccgtcccatgacgtgccgacggacgccgagcgaaacgaggcctcccctgccactgcgtgcgtgcatgtcgtgcgaggcagggtgcatttgcggttttttcgtgtgcaagcgtgacaagctgacgagtgacagacgacgacggacgctggaacctggcccgctcacgtctggagtactctcctatcccatcgacgcccccacccgtgtccgtgtcaccagctgacctacaaggctgaaagcgaccggagccaggcagcgatggccgtgccgactgggtgacacgggacaaacactagtatactcatagcgacggacggagtataacatatgcatgcatccagcgacaggatgaaaggaatgctcccacccccgcatgtggccccccatgccggcgcacgcacgcaacagaacatgatggcgcgcgcggcggcacaaggattttcaaacaccccgaaacggcggcagcgaccatgcgcatgcggcgcccgccctcgccctccctcctgcctcgcgggtcgtccgctacagcctgcctgcacctgcacagcgagctcgctgaaagtacagtacatggtcatggtaccagcagccgcgccgtggcagcgtccgggcgcctcgatgcccgcgcgagcgaccgagcgcctgccgcctgcgctggaccggacgcgtggtgacgggtgagcagggagcgcttgggaagacatgcagcaggcatggcgaccgaggacaggacgcgagagcgtggacgggccgtccgcctgcgccacccgcccacccctacggcgctccgcaaccggtggtgccgctgccgcgcggcggcgtaggccctccacgtcgcggcgcgctcatagcgtaggtcgcgcgtgcagtgcgtgccgtgtccgtccgggagcggcgccgccgccggggcccgcgtccgcgtcctcgtccgcctctgccactcaaacggcgtaagtagtacatgactacaggagtcgtcggacgcggcggggtcagtgtcagtcacgcgtggagcgtggcgcgctggcgacgggactgcgccacgcgtccctccccggcccaccttgcaacgcaagcctttgtttaaacttcacaatgtgtcagtatgtcactgctgtctgtctgctgctgtcctactactgcattcggtgattcggtcgacgaaacgccggaaaacgctacaggtttggctttggcttcggcttcttaaaaataatgataaatccagagcttttatttatccacagaaaacggcttcggcgtcactatctctgtcttgatttttagttttgatagagcttttgattgaactggtgggaaaaaaaaaccggaaccaaaacgttacgtgctgttcttcgttggttctgttccgtgggtcaacaaggacgtaactagcagtag

SEQ ID NO: 10727 - DNA, 1491 bp, Zea mays
ctcgagggtttcggccgggcgatttgaaaaaaaaaaaaaaaaaaaaaaaaagggtacctcgaggccggcggccactcctgacctgacccgtcccaaatcccaacacctcgtggccttccgccttcgccgcccgtctccgctccgcttcccccgcggggcgggagccgggagtgcgcgctcgcgtccccccaccccctcacctcttcagatctccccggccgctgcctcggttggacctggttgtcgcgcccaggccaagcttggttgtgtccccggcgacggcgatgcggcgaggcgctgcgctgctcctggtggccgtcttcgccgtggtcgccgtagcgaagggtcgtgctgataccccaccagctgaaacaaatagtgatagctctactgcacagccaggccttgggaaattggagcagcatgagcaggcaaatcctaataaggagcatgtgacccaccaggaaggaggagtcagcaatgatattggtgacaacaacaagaaggataactcaacagaagtaaccaacatcagaagagatggctccatacagcagccaaagcacaaagatagcatcatgacaaagtcttcacaaccactagatttcttggaagattctcttatcaaggagtgtgatccatcacatagatgtatcattgaaaacaagaaattcatcgcctgcttaaaagtttctggagaagactcattggctctgtcacttctgatggacaacagaggcataaacccactagatgttagcatcatggctccagattatgtcactttagctgaagattccatccatgttgaagcaaatggtcacaatgagacacaagtgagagtttctgtcaatgatgatgcaaatagcacgacaatagtcatcaaagttgcagaaaaatcctgcaacatcagcattcacagtgcaatcacaagggagacggctggcagtggcagagtcataaggatgccacttacgccaacatacacgctactgccagtcttccttctcctcgttgcggtggcagtgtgcatcgtggtccggaggtggcgcaaccaggacggcgaccctgcgtatcagaagctagacatgtcagacttgccggtttcggttggaggcaagaaagaacatgacgatcggtctgacaagtgggacgacaactggggagatgactgggacgacgaggaagctccggtgacgccatccaagcctctgcccaacccttcgtccaaaggtctcgccccgaggcgatcggcgaaagatggttggaaagattagttagccacatgacgccacttaaaaggagcattgcggaaatagttccagtgcatgcagtatatttttaccttcatctttgttgttaaatatttctggaggatgctaatgtcagagagtgcaatacattgataccaagcagaaaattttgtgatcttcctcggccctactgagtaactggcagctattgaatatagttattggacttcaaaaaaaa

SEQ ID NO: 10728 - DNA, 3886 bp, Zea mays
  misc_feature (465)..(465): n is a, c, g, or t
gtatggcaggggcctgccatcagagtacctggcttgcgaagtggccgtgaggagcagctcatcccacttggaagcctcgtgctcgagccactcggcgcgggcacacagcgcggcgacgtcggcctcgacatcgaagaggtgcgtgtggaggacgttggcctcatttgcggcagtgcccgcgcttcgtcctagcgtgacgtgattgatggtcgcgatgtcggtctcagcagcgtgtggaggaaaaagcgtagggaggcatcgaagaggtgcaatgtgatcggtggtcgcgatgttattggtgcgagcccacgtcgtcgccgtcttggtcggtgccgaggaagcgatggttgaatacgagggagggggtcgctgagataacgatgctcgtgggcgtgcaggaggagcgccattggtttctgtgtgccggttgcgatggtgatcaacagttggagatgatggggcaantctagttgaggtgagggagcgagatcctcggcccagttgcggcgtcagctctctgatggagtgcgggccagcacagatggagcgcatgccgagtacgtgggcggcccggcgagcgcaatgaagcatgtgcgaggatgaaagggagcagggaggaggttggaaggggcgggcgaggccaggaaagacagaggcgggacatgctgtaggggtggacgtccacatacgctcttatagtgtagtagagattgatggctatgactcctaaaaggcattgagtcgagcatcgtatataaagaagtaacaaaaaatgatatattctataaataagatagctataatattgacactttcataggtctatagaataataaccgaggttaccctttttagaaggactaataaatctataacttgtcatcgcttcctatatatattataaaaattactctatttaaattcccaggccgccgggggttttctccttctctccttggttgcggccggcccctagtggttagtgggagtgacgtccgaatcaactgtcaccgtgtggcccccgcgtgcgtgcttgcctccaccaccagcgcgacaggcgccaagcatccatgcttgtcctgtctatttctaccgtctcacctctcgtcccgtcttctccacgatgggccacgccacaccactgagcacccttcctccctgttcttgcctctgtcctatactactactactacccttctttagccgccgcgtgcatgctagaagagatatagccgccgatcgatcagcgctcgaccgacccgtcttccttgacgaacgaccagctaggaaacaggaggccccttctttgcacgtgtcagtgccagccagacgcacccaaggtgaggcctcgctgttcaggaccctttaatgcccccctcctttgtttggcgtgcctctgcttcgtcttcgtggtatataaatgctttcccctcttctgtgatcgcctttgtgcctgcgccattggggcctgtttggagaggggggttgccgtccaaatcgaaccaggctctgaacatccgtaaagcaacccccctctccattccaaacaggccctcctgcctccgttcctgggctagctgtcaggacggctcagctccagctttgcggccctccagctctccccagttcaagttcaatattggcgagcatgcgagtttgccctcttccgtcgtcgtcatcatcatcgtcctcgcgatcccggcgtccctgtttcggcctacgcctcccgtagacaacagttgcgccctgctctccggcaagctatggccaagctgagctgcttccccgctctgctccccggcaagaggaagaagaagacacgcaagatcaccgatgctatcaaggccagcggcaacgagtgccccaaggtgaagccggtcgaagtcgaactcatcgacccgacgcttggtgcaggcgtcgtccaggacgtcgtccccgccgagctctcggtccccgtggaggaccgcaacaataaggaagcggctgatcaactggtgttggtgaaggagagcgatctgtcagatttcgacttcagcttccacgcggccatgaagcccgtccggtccgacagtgacgtggcactggacacctcggccgacgctgcggtggcggacacatcgccgaagctgaagcggtcttgctccaacatcgagactaagcgaccaggctcgcgttccgcgcccgagatgccggcccggtcgcgctcctacggcgatctgggcaacctggtcgccggcctcgccctggacgcgacggcgaccccgcacggcgcgccggaggccagtccggcgtccgtgaagacgtcgcgcaccgccgaccgcgtgatgctgaagaagcggtcgtccagccaggtgctgccctcgcgcagccggaagctctggtggcggctcttcctctggagccaccgcaacctgcacatgccgcggtcggcgcgcacggcccaccgatcgttctcgcctggccgccacgacgggtacacctcggacacgttcgaggagggcccggccgccgaccgcaagaacaagacggtcatggtcgacgagtcgccgccagcagcgtctgtgcccaaccagtgggtcgccttctgcgccgagagctccatccacgaccgcgtcagcgcgtgggtcagcagcatcgaaagcgagcctccgttcgatatcgccgaggaggatgacgacaactacgacggagaggacgatgaggagaatggcgagtgtgcggcgtcgcagccgcgccatctcgagctcggggagccatcgtccgggaagggcggaaacagcaaatccaagcgctgcgcaacgacggccgacgaggtcgtccaggccaacaccgtggtgcagtccctgaacgccttctcgtcggtggcgcacatctcagggatgggcctcaaggtggtgccgatgatcgcgcccttctcaaccctccgggccgtcaacctctccagcaacctcatcgttcatatctcccctggatcgctgcccaagggcctccactctcttgatctgtccaggaacaagattgccagcgtcgagggcctccgggagctcacaaagctacgcgtgctcaacctcagctacaacaggatttcgcggattgggcatggtctgtcgaactgcacggccatccgggagctgtacctggcgggcaacaagatcagcgacgtggagggtctgcaccggctgctgaagctggcggtgctggacctgagcttcaacaagattacgacggccaaggcgctggggcagctggtggccaactaccactccctcctggcgctcaacctcgtaggcaacccggtgcaggccaacatcggcgacgacgccctgcgccgggcggtcacgggcctcctcccgagccttgcctacctcaacaagcagcccgtgaagccgcagcgcatcgcgcgggaggtggccacggacagcatcgcgcgcgccgcgctcagcggctcggacagccggagcatccggaagaggacgtcgcggcggctcacgcagagcccccgctcgtcgtcgttgaccagggcccgtggcggcggcggcggcggttcacccacaccaagaaacacctctcgtcgtcgttgaccagaagaaccaactgcgtgattcgcgttgctctttggagacgggagacggcggcgtgactgcgtgcaggcagactcagacgacaccatgattcggcacggcgccagcatgatatgagacaaaccaagtatataaagcaagtatgatgtgagagaattgcgatgcaacacataatgtacatacttgttagggagatattgcttagattaatactacgaccgatgcatctttgtacctgaaaatatcaatttgagcctggttgaagatgaacatccatccaacatcgcagtactgccgcttcatgg

SEQ ID NO: 10729 - DNA, 1935 bp, Zea mays
tgcagaagatcatgactcacatctcattgatgatgctcaaaatgatatccaaatccctggaggcaaatcagaagacacttgcaaagaatttgataccatgaaagaaactgatcagagtgatagctctgcaaatgtcagccgggacccgcctgccccggtagaagatgatgattctgtgtgtgtcagtgatgatgctcaaaatgatctgaagaataccaagtgcaaattggaagatgcttccaaagaatcttctactgctcgagaagctgaacggagtgatagttctgcaaatgtcattgctgatgctcaaaatggatccgaacctaccacaaatgagttggcagtcattacgatcagtaacgacaaggaaaatgagtccatgcttttcacatgcaactcagaagatggtttcaaagaatctattattggtcaagaagctgaccatgatgatagctctgcatatatcagttatgatgatcaaaatgaatgtgaagttactgcatgtcattcagaaggtgctcaaggggaatcaaatgtaattcaagaaggtgaggataaaactgcaggcgctgaaaataaactggaatttacagcatgtgaatcagtagatgcttctttaaaacctgctatgcctcaagaggctgctggagatattaataccacagatgcaaccaaagacattcgtgttactgaagaaactaatgaatcattcaatgcgcaaatgccagcagaatgtacggatgcaaaagaaccttctattgatgacatatgtggcgcgttcagcggaatgaacctcaagggtgatgtatattttgatcctgctgagtctgccacatgcccgaggaacaagttgatcatctccaggaggagaagaacacctgaagaggaggaatacttgcgaggtttcaatccacgggcaccgaattttcttcctctggaactggatccagacgcagagaaggttgacctcaagcatcaaatgatgggtgagcggaagaatgctgaagaatggatgattgattacgcgcttaggagggcggtgacaaacttagctcctgctcggaagaagaaagtggagctccttgtccgggccttcgagactgtcctaccacatgacgaagctgcacaagaaaaatgtctcaccctcaaggcctgtccaagcctgcaactgataacattagaggcaagcgtttctttctttgaaatgttgttcctggtattagttttgtcatttcaacaaattctttacactaactactcttttgcttttttgtgaatattttgcagttagtggttacactgatgttgatgtcgacgcgcaagctactaactcggaggttgctgcaatattatcgcgagtgacctgctccaagtttgaatgagagagcgctacttactaatttgctagaggtaactagagaattagagatctctagctgagctgtgacagaggagctcactcctgctccacaaggaaggataactactcattagtcattactgatcaaggtatccctatccagttgctgagttgcaaagaggatgctcccggcttgagttatgtaatttaaaagtgtgtatacatgtctcgtgtgctaatgttgtctgatattgtgctggtggatctgtgaggattggaaaatgtcaatggtgatgaggtccatgctcctttggcaaagatcaataaaactcttcttgagtgctccattgttgttactgaggttgaatctgcgtcacaatagcacccatgcacacatgtttatatttgtaaatcctgagagccatgtgcctttctaggtgcacacgctatgaggtttcgtgaacacagtccagtaccagttactgaatcgtctgaaaatcatcaggtcgatgtagccgaaggtgaacacagtaaccgatctgacggctgcagcttagctgtctcaggggtaccga

SEQ ID NO: 10730 - DNA, 1180 bp, Zea mays
gcacgagtgctcaaggggaatcaaatgtagttcaagaaggtgaggataaaactgcaggcgctgaaaataaattggaatttacagcatatgaatcagtagatgcttctttaaaacctgctatgcctcaagaggttgctggagatattaatatcacagatgcaaccaaagacattcgtgttactgaagaaactaatgaatcattcaatgcgcaaatgccagcagaatgtacggatgcaaaagaaccttctattgatgacatatgtggcgcgttcagcggaatgaacctcaagggtgatgtatattttgatcctgctgagtctgccacatgcccgaggaacaagttgatcatctccaggaggagaagaacacctgaagaggaggaatacttgcgaggtttcaatccacgggcaccgaattttcttcctctggaactggatccagacgcagagaaggttgacctcaagcatcaaatgatgggtgagcggaagaatgctgaagaatggatgattgattacgcgcttaggagggcggtgacaaacttagctcctgctcggaagaagaaagtggagctccttgtccaggccttcgagactgtcctaccacatgacgaagatgacaagaaaaatgtctcaccctcaaggcctgtccaagcctgcaactgataacattagagttagtggttacactgatgttgatgtcgacgcgcaagctactaactcggaggttgctgcaatattatcgcgagtgacctgctccaagtttgaatgagagagcgctacttactaatttgctagaggtaactagagaattagagatctctagctgagctgtgacagaggagctcactcctgctccacaaggaaggataactactcattagtcattactgatcaaggtatccctatccagttgctgagttgcaaagaggatgctcccggcttgagttatgtaatttaaaagtgtgtatacatgtctcgtgtgctaatgttgtctgatattgtgctggtggatctgtgaggattggaaaatgtcaatggtgatgaggtccatgctcctttggcaaagatcaataaaactcttcttgagtgctcaaaaaaaaaaaaaaaaaaaaaaaaaaaaaaaccctggggggggggcccggcccccaatcccccctttagggggggggttttaccacccc

SEQ ID NO: 10731 - DNA, 1968 bp, Zea mays
cattgggtacctcgagggccggccgggaggcaagggcactgcacgccaccttatctctagccggagatcaaagaagtagccgttaacgatggcttccgacgagctcgcaaaggccgtcgagcccaggaagaagggcaacgtcaagtatgcctccatatgtgccatcctggcctccatggcctctgtcatccttggctatgacattggggtgatgagtggagcggccatgtacatcaagaaggacctgaatatcacggacgtgcagctggagatcctgatcgggatcctcagtctctactcgctgttcggatccttcgctggcgcgcggacgtccgacaggatcgggcgccgcttgaccgtcgtgttcgccgctgtcatcttcttcgtgggctcgttgctcatgggtttcgccgtcaactacggcatgctcatggcgggccgcttcgtggccggagtcggtgtgggctacgggggcatgatcgcgcccgtgtacacggccgagatctcgccggcggcgtcccgtggcttcctgaccaccttcccggaggtgttcatcaacatcggcatcctgcttggctacctgtccaacttcgcgttcgcgcgcctcccgctccacctcggctggcgcgtcatgctcgccattggcgcagttccgtccggcctgctcgcgctcctggtgttctgcatgcccgagtcgcctcggtggctggtcttgaagggccgcctcgcggacgccagggctgtgctagagaagacctctgccacgccagaggaggccgccgagcggctggccgacatcaaggccgcggcggggattccgaagggcctcgacggggacgtggtcaccgtacccaacaaggagcaaggcggcggtgagttgcaggtgtggaagcagctcatcctgtccccgaccccggcggtccgacgcatcctgctctcggccgtgggtctccacttcttccagcaggcttctggcagcgactccgtcgtccagtacagcgcccgcctgttcaagagcgcggggatcaccgacgacaacaagctcctgggcgtcacctgcgcggtgggcgtgaccaagacgttcttcatcctggtggccacgttcctgctggaccgcgcggggcgtcggcctctgctgctgatcagcacgggcgggatgatcgtctcgctcatctgcctcgggtcggggctcaccgtcgcggggcatcacccggacaccaaggtcgcgtgggccgtcgccctgtgcatcgcgtccaccctgtcctacatcgccttcttctccatcggcctcgggcccatcacgggcgtgtacacctcggaaatattcccgctgcaggtgcgcgcgctgggcttcgcggtgggtgtggcgagcaaccgcgtcaccagcgccgtcatctccatgaccttcctgtccctctccaaggccatcaccatcggcggcagcttcttcctctactccggcatcgccgcggtcgcttgggttttcttcttcacgtgcctcccggagacacgcggccggacgctggaggagatgggcaagctgttcggcatgccagacacgggcatggctgaagaagcagaagacgccgcagccaaggagaaggtggtggaactgcctagcagcaagtaggtggctatcccagagcacaggtcaagtgaagtagatggacaagatcattgtcttttcaactaattagatgggcaagaataactaagactgccctatgaggtgtcgtggttcaaccagagatcattctgctccttttcttttcccttcctttttcgagtaccattcccattcgtcgtggtcagtacgatgttgggtcgttgggagttagtggtgtcagagtccgcgtgtgctttgcaagccagggctgaacccacaatcatcagtaacaaaaattcttccgtttgctttgccggccaaaaaaaaaaaaaaaaaaaaaaaaaccaaaaaaaaaaaaaaaa

SEQ ID NO: 10732 - DNA, 895 bp, Zea mays
  misc_feature (37)..(37): n is a, c, g, or t
tttggggtaccctccgggctcggccgggagtgtatangacgcgttagcccattgctctttgtctactctatatggaggtgctcccccgggcgggccggaacaccccacgccttgtctctgaactctgatcagagatcaaagaggtagccgttaagttaacgatggcttccgccgacctcgcagaggccatggagcccgggaagaagagcaacgtcaagtatgcttccgtctgtgccatcatggcctccatggcctgcgtcatccttggctacgacattggtgtgatgagtggagcggcgatttacatcaagaaggacctgaagatcacggacgtgcagctggagatcctgataggcatcatcagtctctactcgctcttcggatccttcgctggcgcgcggacgtccgacaggatcggccgccgcttgaccgtcgtcttcgccgcggtcatctttttcatgggcgcgttgctcatgggcttctccgtcaactacggcatgctcatggtgggccgcttcgtggccggagttggcgtgggctacgggggcatgatcgcgcccgtgtacaccgccgagatctcgccggcggcgtcccgcggcttcctcacgtccttccctgaagtcttcatcaacctcggcatcctgctcggctacctgtcgaactacgcatttgcgggcctcccgctccacctcggctggcgtgttatgctcggcatcggcgcggcgccgtccgccctgctcgcgctcctggttttctgcatgcccgagtcgcctcggtggcttgtcatgaagggccgcctcgcggacgccagggcggtgctagagaagacctccgcctcgccagaggaggccgcagagcggctggctgacatcaaggttgccgccggggttccgaa

SEQ ID NO: 10733 - DNA, 1137 bp, Zea mays
ttgggtacctcgaggccggaggcacagcgctgcacaccaccttatcatctctaatcggagatcaaagaagcacagccgttaacgatggcttccgacgagctggcaaagatcgtcgagccgaggaaaaagggcaacgtcaagtacgcctccatctgtgccatcctcgcctccatggcctccgtcatccttggctatgacatcggggtgatgagtggagcggcgatgtacatcaagaaggacctgaggatcacggacgtgcagctggagatcctgatagggatcctgagcctctactcgctcttcgggtccttcgccggcgcgcgcacgtccgacaggatcgggcgccgcctgaccgtggtcttcgccgccgtcatcttcttcgcggggtcgctgctcatgggcttcgccgtgaactacggcatgctcatggcgggccggttcgtggccggagtcggcgtgggctacgggggcatgatcgcgcccgtgtacacggccgagatctcgccggcggcgtcccggggcttcctgacgaccttcccggaggtgttcatcaacatcggcatcctgctcggctacgtgtccaacttcgcgttcgcgcgcctcccgctccacctcggctggcgcgtcatgctcgccatcggcgcggtcccgtccgcgctgctggcgctgctggtgttctgcatgcccgagtcgcctcggtggctggtcctgaagggccgcctcgcggacgccagggtcgtgctggagaggacctcggccacgccagaggaggccgcggcgcggctggccgacatcaaggccgcggcggggattcccagggacctggacggggacgtggtcgccgtacccaacaaggggcgagacggcggcagtagtgagacgcaggtgtggaagcagctcatcctgtccccgaccccggcggtgcggcgcatactgctgtcggccgtcgggctccacttcttccagcaggcctccggcagcgactccgtggtccagtacagcgcccgcctgttcaagagcgcggggatcaccgacgacaacaagctgctgggcgtgacctgcgcggtgggcgtgaccaagacgttcttcatcctggtggccacgttcctgctggaccgcgcggggcggcggccgctc

SEQ ID NO: 10734 - DNA, 898 bp, Zea mays
tgctgctggccagcacgggcgggatgatcgtgtcgctcctcagcctcggcgcgggcctgaccgtggcggggcaccacccggacggcaaggtggcgggggccgtggccctgtgcatcgcgtccaccctggcctacatcgccttcttctccatcgggctcggccccatcacgggcgtgtacacctcggagatattcccgctgcgggtgcgcgcgctgggcttcgccgtgggcgtgcccagcacccgcgtcaccagcgccgtcatctccatgaccttcctgtccctctcgaaaggcatcacaatcggcggcagcttcttcctctacgccggcatcgccgccgtcgcgtgggtcttcttcttcacgtgccttccggagacccgcggccggacgctggaggagatgggcaagctgttcggcatgccggacacggacgacatggctgaagcagaggacgctacagcaggcaaggagaaggtggcggaagtggaaatgtgcatgccaagtaagatgtaaagcgcggctgcggctacagcgtcttcgtccccgggcagaggtcaactggaatagacggacaagatttttttttttttttggagcaaatggtaaccagatgggcaggaataagattggcctacgaggtcggtgactcggtgccgtcgtccaaccgggattcttctgctcgttttctatctggaagtaccattccctgtcccgttcgacgtcgtttgcggatagtgcgatgtcgggagttagtggtgtcagagtcgcgcgtgtctgttctacaatgcagggctaatggacccagaataatcagtagcaactgcagaaaagtgccatgtgcttccccgttggggtgggcgttctatttttcatgtgcgtgtctggggggccttgtgagg

SEQ ID NO: 10735 - DNA, 1729 bp, Zea mays
  misc_feature (1703)..(1703): n is a, c, g, or t
  misc_feature (1713)..(1713): n is a, c, g, or t
gccggccgggctgagtgtccacaaagatcccgggctgctccttcctcccagaggaagcgtacaaacctggaggggaactgcccgtctcctcggctgacccgtccacctccttcttttcccctcgtgtccgccgctacacgcgccgccggaaccctagcctccaccgccacaggcagcagggatggagaaaggagcctcggaggcgtcgcccccttgcgctcgctgcggcaagcccgctcagcttcaatgccccaagtgtgtcgaacttaagttaccgcgtgagaatgcagctttctgcacacaggattgttttagggcagcatggagctctcacaaatctgttcacccaaagcctggtgcaccggcatcccagcagtctccagaaggttggaaatattgtctgagaaaagggcgggaacgtgcattgcaacttcctcgttttgattggacaggtccattgagaccacatccaatatcaaagatgcgtgtggtgccagatgaaattgagaagcctgattgggcgcttgatggaattcccaagatagaaccagatagtgatttgcagaaaagagtagagattaagacccctgatctcatagaaaggatgagagtaacatgtcgaattgcaagagaggttttagatgcagctgctcgtgtaattaaaccaggaattacaacagatgaaattgatagagtcgtccatgaagagacaattgctagaggtggatacccatctccattgaattactatttcttccccaagtcatgttgcacgtctgtcaacgaagtcatttgccatggaattccagatgccaggaaacttgaggatggtgacattgtaaatgttgatgtaactgtatactataaaggtgttcatggtgatttgaatgagacatattttgttggaaatgttgatgaagcttccaaacaccttgtacgttgtacctatgagtgcttggagaaagctattgcgatagttaaacctggagttcggttccgagaggtcggagaagtcataaacagacatgtttcaatgtcaggtttatctgtggtgaaatcttattgtggccatggcataggggaactgtttcactgcgccccaaacattcctcattattcaagaaacaaggccgttggtatcatgaaagctgggcagacatttacaattgaaccaatggtcaatgcaggggtttggaatgatcgtctgtggcctgacgattggactgcagtgactgcagatggtaaacggagtgctcaatttgaacatacacttttggtgacagaaacaggatgtgaagttttgacggcacggttaccctcatcaccggacgtttttccatggttgaagaagccgtgatggggaacgccaccaacagcaagtgatactgttacactgggtcagcaaaaagttttgttctgctctatcagtcggccaaagctgaaattttcaaatattctagatcagagtgattagcatgctactgctgaacagtcgcagcaattgtctatcgtgcggaactatttctgggagtgtgtattgttaagtcggttttcttcgagttatacgagacgtatggcttcttgagatgtgtcaccaatatgattatgccatcagtttacttttgatttcacagaacacaaaaaaaaaaaaaaaaaaaaaaaaaactcgagcccggaaaaaaaaaaaaaaaaaaaaaaaaaancaattaaaanaaaaaaaaaaaaaaaa

SEQ ID NO: 10736 - DNA, 1641 bp, Zea mays
agttcagttcaaaaccgcgcggaatcgactccgccgtcagcacggtagcgagcgcccccgcggcccgcgcgcacgacttcgcttcccctcccctgccccaggctacccgtccccgcggctgactcgtccacctcctgtccatcttttcccctcgtgtccgccgcacgcaccgccggaaccctagcctcagccgccacagtgcaggcatccgggatggagaaaggagcgtcggaggcgtcgcccccctgcgctcgctgcggcaagcccgcgcagctccaatgccccaaatgtgctgaacttaagctaccgcgtgagaatgcagctttctgcacacaggattgttttagggcagcatggagctctcacaaatctgttcacccaaagcctggtgcactggcatcccagcagtctccggaaggttggaaatattgtttgagaaaagggcggggacgtgcattgcaacttcctcgttttgaatggacaggtccattgagaccatatccgatatcaaagatgcgtgtggtgccagatgaaattgagaagcctgattgggcgcttgatggaattcccaagatagaaccagatagtgacttgcagaaaagagtagagattaagacccctgaactaatagaaaggatgagagaaacatgtcgaattgcaagagaggttttagatgcagctgctcgtgtaattaaaccaggaattacaacagatgaaattgatagagttgtccatgaagagacaattgctagaggtggatacccatctccattgaattaccatttcttccccaagtcatgttgcacgtctgtcaatgaagtcatttgccatggaattccagatgccaggaaacttgaggatggtgacattgtaaatgttgatgtaactgtatactataaaggtgttcatggtgatttaaatgagacatattttgttggaaatgtcgatgaagcttccaaacagcttgtacgttgtacctatgagtgcttggagaaagctattgcaatagttaaacctggagttcggttccgagaggtcggggaaatcataaatagacatgcttcgatgtcaggtttatctgtggtgaaatcctattgtggccatggcataggggaactgtttcactgtgccccaaacattcctcattattcaagaaacaaggctgttggtatcatgaaagctgggcagacatttacaattgaaccaatgataaatgcaggggtttggaatgatcggctgtggcctgatgattggactgcagtcaccacagatggtaaacggagtgctcaatttgaacatacacttttggtgacagacacaggatgcgaagttttgacggcacggttaccttcatcaccagacgtttttccatggttgaaaccgtgatcgggcaccccatcaacagcaacaagaaagtgatactgaccggggctgcaaaatttttgttctactctttatcagtcagtcaagctgaacattttcgaaatttttagaccaaacagtgataagcatgctactgctgggcagtcgccctaattgtctatcctgcggaattgtttctgggagtgtgttttgttaaatcggttttctccgagttatacgagacatatggcttgagttgtgtcaaaaaaaaaaaaaaaa

SEQ ID NO: 10737 - DNA, 3235 bp, Zea mays
ttttttgactggtggtgataagtaggttggtagtagattttagatttgcgaataccagattctgactttctagtttcatgttagacacaagtaaagcttttgtttgtttattagttgcacgtcaataataatttcactatcattaagttttgtccaagttggtatatttgattccaattagttttgataattatctcttttcttttaacaggaaacttgaggatggtgacattgtaaatgttgatgtaactgtatactataaaggtgttcatggtaaagcctcctctgcctgatatgatatttaactgctgaaatgtactatggtgtatttttaattagcatatgtctcaacatcaggtgatttgaatgagacatattttgttggaaatgttgatgaagcttccaaacaccttgtacgttgtacctatgagtgcttggagaaagctattgcgataggtgacattctttgtaatttgacattgctgtattatgcctaaacttctaagcagaaataaaaaggatttccctttttttgatccttattacatttttctaagaccatcagatcatacttagaaaggatatacttatgacatttgaacataaacatattcatgtgcagttaaacctggagttcggttccgagaggtcggagaagtcataaacagacatgtttcaatgtcaggtttatctgtggttagtattggctcggtatagaattaataattttagtcactacctcgattatatatttgtatccatgcccttgtgattatctttccttcaggtgaaatcttattgtggccatggcataggggaactgtttcactgcgccccaaacattcctcattattcaagtacgtttcttgcaactatttcttatttatatttcttgtattagtgcagtaaatatgacgctgctgtgcaagctatgtcataaaggcttcacagctggggagatatgctggtgttttttaatgcaggaaacaaggccgttggtatcatgaaagctgggcagacatttacaattgaaccaatggtcaatgcaggcaagtttatgtactatatagccccatcaaatcccatatcttatgatttacagttcaaaaatttttctccaacacctgagcattgagcattactgtagaagtgttcatattctgtaggggtttggaatgatcgtctgtggcctgacgattggactgcagtgactgcagatggtaaacggagtgctcaatttgaacatacacttttggtgagtactatgagtttctagtttgtcttcgaggatcaattctggaagctgtttgtcatgcagatgtttacgttgtgcaagaaagaacaaatgtgtcacgtgcaatgctattaattctgtgggcgtgggaaaatttaaagggagcttttacccccttcaacttgttatatatgctgttctatgctccaggtgacagaaacaggatgtgaagttttgacggcacggttaccctcatcaccggacgtttttccatggttgaagaagccgtgatggggaacgccaccaacagcaagtgatactgttacactgggtcagcaaaaagttttgttctgctctatcagtcggccaaagctgaaattttcaaatattctagatcagagtgattagcatgctactgctgaacagtcgcagcaattgtctatcgtgcggaactatttctgggagtgtgtattgttaagtcggttttcttcgagttatacgagacgtatggcttcttgagatgtgtcaccaatatgattatgccatcagtttacttttgatttcacagaacacaatttccatcatttcgagtaggttattttttattggattcaaaacccacaaccgccgcagcacccgatggttcatgagaaatgttgccatccgcgtcctctaaaaaactgggcaaggacttgtgtagcaatgtagcattacaaccaaggtaggcattttctggaattttttcttgaaccgcaggatcaagagaaggctttctgaaagctggctgtctagaatgcgccagctggctgtctagaatgcgccagtagcactagcacgtgtattatcgctagagtccactgctgtattatcgctcccccttgtcttctccgtccctgctatccgcaactattctctgaactttttttttatgatttttaaatttcagaacttaataccttctcaattttcattttagaacccaggtcatacactcccgacagatctcgtcaaacagtacatatgttcgagctagataaaaagcatcgcacatgacatgtaagagtaacttactactttgatcagacgttccaaaaattacatcgtccagcagtacaactctctcctccccaccccaaccaccagtccaccaccagacaaaataacgaaaatctcaaaacaaccacactcatccaaacagatagcgacattcgacagtgagcgctactgcgctagtacagttaaatgcggagagcaacactcatacaaacttttggtcgaaaataagatggaaggccaacgaaaaccccaatcatccttagtatccactgaaatcgaccaacgacgaataagatttgttctcatcagtcgaagtggcaagcgttcttttttgtttcttggtttccagactcctgtgtagtggtgaccagccatctcgttgatttctgacctcctgcgctgcttccttcacatctccttcccagcatgtctccacaagtaattcccgggctttatccatattctccgacgtaataagaccatcattttgcagcagcacaaggtacacgtacacctggtcggctgcagcttttcggatctgtaagattgcagaatgcagagtatttgagctcagctgagctgatccttgcacggagttctgcgttctcaggcaagaaatgataaatgctatcttggggtatctgtggcctaggaatgtgaggagttgagaaaatgccgtagtgcaaattccatctgactgtgaagaaatgtatccaaggattgagggacctgcacataactttgtgaaatccttggatcccttcatctcaaaacccgccgaatctaccagtccaccgtagaactcactgtacccctgttaaatgtgcaaaaaaaaaggtataactgttggagagagaatcacttactgggccaaccctagagggtggctatacaatattcatacatgggcctcatgggcctaatccatatacactaacacccccc

SEQ ID NO: 10738 - DNA, 2418 bp, Zea mays
gtaccatacaacatatgaggtctaaccatcatcctataaaacttgtcttttagcttctcttatctcacatattctgttttagtcctactaggtcaaataattatatctagagttccttgacataactttagtttcctatatttactcttgtacgacttttatcagctagcaccacatcattcgtaaaaggcatacacatgcatatcctcttatatgttccttataacctcatccattgtcaaggctaaaagataaaaactcaaaattcaccatatagttctattctaatcataaagacacatgtgtttccattacatgtttgaacactagtcaccacattgttgtacatgtatttaatgagtttatcgtactctattgaactctatatgtccaaagcccaccgtataacatttttttaatattttaccacaagtcttctctaagccaatgaaaaccatgtataagtctttacccttatattgttttgttacttattaaaaaatagcttctacgattggtctttcaaacataaaaccaaattgattataaagatcctcattatctctctcaatagatgctcaataacactcccgtagttgtatagtgtggttcatcaacataattctcttggtaaataatataactttatatgtattccttattattcttttagattagtaccaagcgtccactcgttaagcatcttgatatcttgattcatagacttgtctcgaaaataattcaaaatacccttttcagaaggcattgcaactaaccgttgatggagaaaaaacattttttttttttttttgtgcagtgaaactgaatacagacacaattcattcagatgtcagttttcatatattatggcaactagtagaacagagctgcctgtgcaagcatccattaggagatgaataatctgggaacaaactctgtcttgagctggtgtgtcctcgacgcgagcccgcgacagaacaacttttccggtggagcagtcaacgtgaaaaaaaaacgctggaagaacaagcagctaaagttccccgccaaaatattactacaaggaaaccacaagtcttacaggccttccaagttatgatcatcagaaatctgactaacaaaattgctgtaaccccagagctcaactgtgagatacccagtatcaatgtagaacaacttggaacaaaaaagtgcaatgttatacttattgccagacacgaaagaaccagtaccatgggcatcttccagtgcagaagcataaaccatgcgcgcaaatggacgttcatgcggaagtttggactaaattcctgctataacctgaccttctttgcttttatccgcttggaagccatgtaagtcacagcagcagaaagagtgtaccatgtaaacgtgtatttaagatggtcatctggcatcactgagtgacgaatcaaggtgttgacatcttttggaacaggataagggtttgttggagatacatcttcatttatatcttcaatataaacagtattctcaggaagtccacaagcacgagcaatcatgggaacatccacataaaaccactggccactattgggctcattagctggaacaaatatgcttggcttctcacttccacggattactccaataacccttacaggtggcatcctaggtttttcaaactcaggagacgatttaggcttgttagaccaaaacttccaccacgaacctttttcgtctggcttaacagcttttgggggctctgaagcttcatccaggatctggagatccttaacgtttttatcatgccatccacgaggaacccatcctctattcacaaggataggtgactgcaagctgtcaggcgtcgacctaggaatcaatggagtgatcacataatacccattctccgtgacacctgagatgctccgggagcgaggcccgatgaataccgacttctccttgtcgaaatcatcctcgcacacaatttttcggaactccagtgctgacggatcacgaaggaccgaggataaggcggactcgttccacgccacgggctccatctccagcctccgcgtcctgtaatccagcatctctatcttttcctgcctccggaagagctgccatgtgccgagcccgaaggtgatggcgccgggagcgaagaggaagagtttggaccacgcgctggcctcattgcctgcccctgggggcggcggcgcggccgctgcgggaggacgcgatagaaggggaagtggtggcgatgaggtgtgagaagtggatgcgcgagaggggaggaggcagtgctcgccgccgccgccgccgcgcagacggaggcggaggtgcttggagagcgatgccgccatctcggaggtcagcgagggccaggggttggtcgtttggactttggactcgagagctcggactggacgggagaac

SEQ ID NO: 10739 - DNA, 1302 bp, Zea mays
ttttttttttttttttgattctgcaaatcggtttatagcttgagaagcacactctgcaaaaaaagtacagtaaagaaaagttcaccgctgaatttttacacgcccgggcccacgtacacactgctcgtaccgtacggcagccacacgtccacaccacatataagaacgttaccgcagtaactgcgcgccatccagctagcagccggcggcgcgctgcctcctcttccaggcgacgagcaccgcgagcacgagcagcatgaccgccgcggcggtgccagcgaccgtgaacgccggcactcgggcagatcgccgcctcctcccccctctcgggttgtggtgtctcttggctgctctcgaccggtgcccggcgccgttcggatcgctgtcgctgccgctgccgctcagtgtgtcctcatccgaaacggaaccagccacctcgtagtgagcgtggaccccgtcctggggatcagcctcgtcgtggacgtggaccggctcctccaccggaagcgtgaggtggctgcgctccgacgacgccgtggactcggagtcaacgccgttgtcgtcgtcgtcgtcgtcaccggctgcgacgtggaggtgggtgctcaccgccaccggcacatcatcatgctgcggcgcgggcttccgccgccacggccacggcaatctcatggtgacgaactgatgatgatcgatgaaactcccagcttatagagagtaatcgaaggctgaagccaccgcgacacacctcacacctggagaagacgacacggaagaatggcactggactgctggagaacaggagaagtggagagtggagataattaaagattttgccagatgggggggcggccagcggcctggatgaagaaaaagaaggtgctttgctttgtcgcaagggcatgcagatgctgtcttccatctggcagaacagcagatatggagtaggctgctagctctctgtcatgtagaggcgtcgagccaacccaaggcgcgtcggcatgcactcatggaatcattccattcgggatacggaggacctagggatggaaaataaaaatggttagccaaattatacatatccgatgatatagatatccatactcctacaagtttctaatacgatactaaataatagctaaatttatttttcaatgttttctttaactgatttcagatttatattagataataaacctatttaatttttttctctccataatgagtgaccaattattttaattttattattactaatgatgcattgaaaccatttaatagcgtatctataaatgagccttttcg

SEQ ID NO: 10740 - DNA, 2195 bp, Zea mays
ctgtccttagcgattcaggttgggctagcgtgttctgtattgtgatgtggcctacatgcactgttgtggtaactatgtaacagactactgttatttatcaattcacttggctaattttggtgtctacactttactttggtgattcaataactagatatgcacttcttgttttcttcttcttttgggtagggtggggtgacctatgttttttctgtcttgtacttgaaagaaaatcaagaaagtgagttttacagcatgatttactggtgactgattcagtttcatattgcatgcaggcgagccgtactgtaagccacatctcgttcgctgaggatggaaccgatcctcccaaaaagcccacatcagtagctgaggtggcaaagcagcgtgagcttagtggcactcttcaaagcgagacggatagtaagacgaagaagcagatctcaaatgcaaagtccaaggagctcagcggccacgacatctttgctgatactctggattccaggtctaacagggcacggaacccatcgaacggcagcacagcctcacacgcacctgccaaaaatacaaacgtatttgccgctgcaacaaatctggtaccccttttccctttttgctgtccagaatgttattcaaccaatgttcgtcttaaacaacaggccagcaccttctcgtttggagatgccaacactgacagcacgccaaagacggcaaggaagataaccggcaagaaggtcaacgacctcaccggcaacgacatcttcaagggggacgtgccgccagcttctgcagagaagcatctgagcaccgcgaagctgaaggagatcactggaagcaacatttttgcagatgggaaggaaccaatccgcgagcgtgtgggcggaaaccgcaagcctcctggcggtgagagcagcatcgcgctgatttagcataatccgggactcagtgtcgacccctagaggaggatttccaccagcaccaggcagcaggctgttggatcgtcagtttggtgtcttgttcctgatcaaggtgcggcagtgaagagccccgttttagtcttgatgatgtttattaactgttggtgtgtgcatgtttggtttggctgtgagataccaatgccgtcctcatcatggcagtgtgtagtgtgtacggttgatgtgtttttacaaataatagctcgagtctgaaccaagctcacgtcttccaccaccgtcaaattattagcagacgtgtatgtaccaagcgttaccgacaccttgcgtgcactaatttacagacgacggatatatgctatgcgtaacccgataaatgttcatgtcatcaagaatattattcaactgtttttttttttggcagcagcattcgataacgcaaaccaaacaaccaaagggaaacatgtagcctctgtgatcattgatcggagacaggcatacaaccaaaagttctctaaaagctatatgaacaagagaagcatgctgaatctcaaaatcatgatatctgaaacagtaggaccctccaatttatagcgaaacgaaattgtgtgttttgacaaaaaaaattcttttgatgtaaaaataattaaatacagacatatcgccatcccccccctccccctcccccctcttctataagatttcaaaacatgctgtttatatgatacggatataaagaacatgaactagtaggaaacaaatgtaattgcagagagatgaaacaatttgcaattccactggaaactcgggtgtcagttatgtgaatttcagtgtctttaaacaaatttgactgtacaacagtgttttttcaacaagtatccaggtgcatctactagtctctaacaaaaatatgaggtttgcagcactgctcatagcacttttaatccatctaaagcagttcaatcatgagacatcacacgtaaacgaaacatattcttacaaaatgtaaatgggtgagctacaattcatgtagttcatttctttaggttagctgagagtataaaaaatgtactaaagagagtatgttatttactatctagaatcgaatagaaaaaatattttttttggtgacaattgtttcagttttggttctattttctacggttcacttttctagttttaatagtgaccactgaccacccctaatcgatctcttcaaccactcatgttgtgagtaccaaagcgatggttgtagaggcacca

SEQ ID NO: 10741 - DNA, 1388 bp, Zea mays
gggtacctcgagcccggccgcggatgctgccgccgctactccagttccactccacctcacgagtctcacacacctcccccctcctttttagggagagaaagcaacgaaacgccgagagaggcgtgcgagcgggagcaaggagatggagcgggcggcgccggtgaggagctcccacacctccacggccgacctactcgcgtggccgcagccccagggccccgccccagcaacgccgtcgccgccgcgccggcccggtcagccgtcggaggctatcaggaaggtggtgttcgggggtcaggtcaccgaggaggaggccgacagcctcaccaagaggaagccgtgctccgcgcccaagtggaaggagatgactgggagcggcattttcgctgccgggagcaatggagacgctggggaggcagctgctgccgcgaagcccgcccgaacctcctcgcgccaggcgagcagtactgtaagccacatctcgttcgctgaggatggaaccgatcctcccaaaaagcccacatcagtagctgaggtggcaaagcagcgtgagcttagtggcactcttcaaagcgaggcggatagtaagacgaagaagcagatctcaaatgcaaagtccaaggagctcagcggccacgacatctttgctgatactctggattccaggtctaacagggcaaggaacccatcgaacggcagcacagcctcacacgcacctgccaaaaatacaaacgccagcaccttctcgtttggagatgccaacactgacagcacgccaaagacggcaaggaagataaccggcaagaaggtcaacgacctcaccggcaacgacatcttcaagggagacgcgccgccagcttctgcagagaagcatctgagcaccgcgaagctgaaggagatcactggaagcaacatttttgcagatgggaaggaaccaatccgcgagcgtgtgggcggaaaccgcaagcctcctggcggtgagagcagcatcgcgctgatttagcataatccgggactcagtgtcgacccctagaggaggatttccaccagcaccaggcagcaggctgttggatcgtcagtttggtgtcttgttcctgatcaaggtgcggcagtgaagagccccgttttagtcttgatgatgtttattaactgttggtgtgtgcatgtttggtttggctgtgagataccaatgccgtcctcatcatggcagtgtgtagtgtgtacggttgatgtgtttttacaaataatagctcgagtctgaaccaagctcacgtcttccaccaccgtcaaattattagcagacgtgtatgtcccaagcgttaccgtcaaaaaaaaaaaaaaaaaaaaaaaaaaaaaaaaactcgagactagttccctcgtgccgaatt

SEQ ID NO: 10742 - DNA, 5740 bp, Zea mays
tcctgcagatttcggaaggcacagaaaaccgtgtaagcctccatacagtttcccgcatttgcgtctaggtccttgcactcccggtcgcggggacctgtctgggaattcggtgatctggaggggcaatgtgggtacggctggtcaggggctcgaggccggaggggcggcactggtataaatcggcgcggcgctcaaagctcttcctcctcgcttccaccgtcctccgcctccgcctccatccgccccgcgcccactactcgtctcttgctttctccctctctctccgcgcgcgcactcacgcacgcagtttgagagggtgtgcggcgttcgaggggcgaggagcggggtgagccatggcagaggcaggctgttctgcggcgaggaccaggacggcggggctcgccgccgccgccgcggcggcggcgctcctcgtgctcgtggtggtcgccggcagcgcggcgctccctggcgcgcgggtgagggtcctcgacggcctccggtgagtcaagtgctctccctcctcgccgtgcaatgtggtcgcgcccgcgggctctgcttgcttggggttttcggctgcctctgtttcgttcaactttgcttggcaattttgctacggttttagccacttcgctctgctaccgacacctagtaaccgaggcacccggtctccgcctcgcagcggctctccgtttccgaaattgctttccatctgccccgaccccgacgcccgcgcggcaccgcctgcgactgtaccaagtcctaaccggctcaccacatgcgtcgcaggcacaggagcacggccgtggcggcgggcggcgcgaggcggtggctgcgggactcctcctggccggcgccggtggcggcgacgacgacgacgaggtgagcgcgatccaccaattccgtcctctgcttcctccttcgcgcctgtgattgatgtctgccaggtgggacggatccggtgcgtcggcccatgcgctcgcgatctgggccgtccaatcctctcctttttggtttaggttcggtcccccgtttagatccccggggccagcactagcagctgctccgttccgccaacaatcttctcgtgttctaggagggacgttgcttcaaaacatttccggccccaaactctgttcttgtgttttaggagggggggacgttggtggtgcgcggtaacaagcggaattcgtaatttggggctggccgggggactttttgttgttgtttcaatttcggattagagccgtgtgcagcagactgcagaagcgcagagcgggtcgggggagatgctctcccccttgctttccgttgccgagttcgttacagtggcaggtagaggtagtagatagtgagaggccgtctcgtaatttgctgcaaccaaaaccccgacgtgcaggtgccggtgccgtccctgcagtcctgcaccggccacggtaaagtaggggtaaagatttggggaggacaaggggcggacaagaagccgcggaaaagctggccgaggaagcaagcgggatcgcggcgtgtccctcggcgtccccggcaaatgcacacccagtagaggcgtagagcagaggaggcactcatttggtcttgcgcttttggctaccaaaaaagaaaagagaagtccgcaaaagaaaattcgattggataagctgcagtgcagcgcagccttgggtacggtctcgcgtgcgcaaagcgacgctctgtgtgtgtgcgcgcgcgctgcctctgcctgcgctggtttgtttactcccgttgccttttccgtcgcggcacggccacggccacggcgtgcatccactccgctgcccgtccgccgcacacgaaccgtgatgatggaacggcgcacggattccattcacctcgcttcctttttccgcttcacccaatcctgctgttcctactgcttgcgaaaatctgcaactacaccatcattgcgagcgatggattgctagcgctggccggggagtagagtaccattctttaacttgtatataacaacgaagcttttctatttccttgtgtggtggcagcatgccgtacgaaactggtcttttttttttgttgattgcaaaaccatctacacgcatacgtactgactgaaagctccgtgttagctgttgccatcaccagcatgttctgtgtttcttggttgcggcggtgtcgcacatcactcacggacatttttctggaatcgtgttctctctcgcttgcaggggcagggccgacgacggcgacgccggcgggccatcgagggccgtcaccggcgcggtggaggatccggaggccgtggccaacgacgtgcacgtgtaagtcgcactctcctgtcctgccttccctttctctccgcttcaatcgatcgcgccaacgcactgagaaagcgctgctgctgctgatgaaaatactagatctaagcctgatttgcgagctgtttttatagtagacagactagaagtagcctcttcggtccacagccggacaggacgggcccaccggcagtctcacgtgacacagtagtaaaggaaagagaaaggagaaaaaaaaaatgagagaggaacaataatactgttgcctgaccgaagcagatctggttcagctcgtaccagtagcgggcgtactttactctgccacgtgggggagcatgagcgcgcgccgggcccgcctgccatgcacctcccacgcgccctgtctggtctctcagtcacaggtccggccctgtgcgcttttatggcgacgcgaccctgccgcaccgcaccgcaccgccgtggatcggcaactgccgaggccgatcgccataactccgcttgccgtttacgacgtgtccacggcggccgaggacacactgccgggttccgtgctcacaccatcgccagcaccgcgccgctgcggctgccaccgcagaccgcacacaacgcgcgagctgaaccagatcactagcgcagcggtggtgccgggtgcgggtgctggcgaggcacactggcatgcagcagtgacacaccacgttatccgcacgccccatgcctggtcgcccctgcatttgcgacggacgcgcattcatggtgcttcaccgccctctcctttcccaccagccacctaaagtttctatgcaaagattttctggcagcggcagctgatgcacggcacagttgagtatgcactgcagtggagctcgaaacacgtagcgacggatctagaacacaatgctgcaccgacagaaccaaagaaaaaaacaagaagtgttcttgttgagagtttggtgccaacaaggcattattgaccgacatgttagatgcaccggatcggcgtgagcacactgtactggtccccagagaaatagtgcatacttctgtccatgtgttcacttaatcattgtgcatggtgtaaataaatctcctgcaagtttcctggctgcattggccttctaattactgtaactgaatcggcatgagcatttatttagtaagaaatgttctctctgtcatcaaactattactactgctcagtgcatcaattactttgtgattgctccttttttcttcttctgtgtagttagtactagtttctagtataaatcgagttgttaataattggaatgtcgtgcaggtccatcaggaacagcacggcccggcgaaacctcgggtacctgtcgtgcgggacaggcaacccgatcgacgactgctggcgctgcgactcggactggcacagcaaccggcagcggctggccgactgcggcatcgggttcggccgcaacgccatcggcggccgcgacggcaaggtgtacgtggtgacggacccgagcgacgacgaccccgtgaacccgcgcgagggcaccctccggcacgccgtcatccaggaggagccgctgtggatcatcttcaagcgggacatggtgatcacgctgagggaggagctcatcatgaacagcttcaagaccatcgacgggcgcggcgccaacgtgcacatcgccaacggcgcctgcgtcaccatccagtacgtgaccaacgtcatcatccacgggctccacatccacgactgcaggcccacggggaacgccatggtgcgcagctccccgagccactacggctggcgcaccatggccgacggggacggcgtgtccatcttcggttccagccacgtctgggtggaccactgctcgctctccaactgcgccgacggcctcatcgacgccatcatgggatccacggccatcactctgtccaacaactacttcacccaccacaacgaggtactggtactactacatccatcccatcctcctgctagatcctgtgcgtttgtttgttttgtcctcgccggccccgtgtgcgattgtccttttttgttttgttttcttcacccaaggcatcggaaacttggaggattctaattctattctactctactcctacatggtttggcgcatctacgtacgcctgagaattcgtttgttttcttccagtacaagtgtagtttagaatccaaatcagaacatgtcggttgcttgtgctgaggttggtgctgtagtatctgacggtcacgtgcataacgagaccctttcggtgaaactgcatggctggatttctcatcaaacggtggaactgatgcaggtgatgctcctgggccacagtgactcctatgtgaaggacaaggcgatgcaggtcacgatagccttcaaccatttcggcgaaggcctcattcagagaatgccaaggtgccggcacggctacttccacgttgtgaacaacgactacacccactgggagatgtacgccattgggggcagcgcggagccaaccatcaacagccagggcaaccgctaccttgctccgacgaacccgttcgccaaggaggtacagtactgtagacattgtagtagctaggcacgatgcctctgccaatcagcgccggccaggccatttttataaccgaaccgagctgcaggtgaccaagagggtggagactgcccagaccgtgtggaagagctggaactggaggtcagagggcgacctgctgctgaacggcgcctacttcaccccgctccggcgccgggcgcctcggccagctactcgcgcgcgtccagcctcggcgccaagtcgtcgtccatggtcggcaccatcacctcggacgccggcgcactgtcgtgccgcaagggcgcggcctgctagcgcggatcgcgctccctctccagcaacaggaaaagaaacaggacaacaggaaactaagccacctcaacaccaccaccaccatggttacagtttcttcttcccttctttttaggggtcgcttttgacaagggttatattatatatatatatgatggtcctccttgatattttcaccatttgctcaacctcccccctgctcccgacatggaaagctacctggagcagcaggcgtgaagcgttgctgattggtcgctcggtctctctattagtcgtctgatctgagtgttgcgtgttgttccctctgcctacaagcaagtggtgtatgttgagggcagggggtgcgtgcgtgcgtgttgtgtgtgatacttactcacttggttgttgtgttgagaaaaaaagggtcagattgttagtagtggtagtactacatgttacgcctggacagactgggatggaatggatgtacaagacatggaggaatacccatgttcttaactcttcttcttcttcagtgaaaaaagctaaaacgttacagtttagctgaatattttgatctaaaaaaaaaaaaaaaaaaa

SEQ ID NO: 10743 - DNA, 1485 bp, Zea mays
gtcagggcggcgtccacggcgcggctgcacaagcgcaactgccgccgcttcgcgcatcacgtcgggctcatcggcggcctgctggagcagctccgcgtgtcggagctcatgaagtacccggagacgcgggagccgctggagcagctcgaggacgcgctccgccggggctacctgctcgtcaactcctgccaggaccgctcctacctctacctcctcgccatgggctggaacatcgtctaccagttccgcaaggcgcagagcgagatcgacaattacctccgcctcgtcccgctcatcacgctcgtcgacaatgcccgcattcgggatcggcttgagtatattgagagggaccaatgtgaatattcctttgacgaggaagacaagaaagtgcaagatgctctgttgaatcctgacccttgcacgaatcctacaattgtgctcaagaagactctgtcatgttcctatccaaacttgcctttcaatgaggccctccgaaaggaaagtgagaagcttcaggttgaacttcaaaggtcacagagcaacatggatctgggttcgtgtgaggttatccaacacctgcttggagtaaccaaaactgtggaatctacaattccagagaaagaaacaaatgttaaagctccagaaaagaagggttcaaactacagtgaatccaaaggagagactgcaaaatcatttgatgatgatgacgactatcctaagaagcaaaacgatgagtatcctaagaagcaaaaggatacctgcagcacacaacgatgctcttcacaagttccatatggtcatgatcttgtctcaagtagaggatcgtacagcgatgaatggcatgcagatttacttggctgctgttcagaaccggctttgtgtttgaagaccttgttcttcccctgtggaaccttctcgagaattgcttcaatcgccaaggacaggccaatgtcttctggagaggcttgcaatgatattatggcgtactccctaatattgtcctgctgctgttatacatgctgtgtaaggagaaagcttcgtcaaaagttggacattgcgggaggctgctgtgacgacttcctttcacatctgctgtgttgttgctgcgcgcttgttcaagaatggcgggaagttgagattcgcggagcttatagcgaaaagacgaaggttacaccaccagcatgccagtatatggagcactgaacagctgtatgcccgtacgggtagacccgaacttctgtaaagatattaacagaatatctgatatcgtactgcaagagcagtggtactacactgctcctgtgtagtgtttattcttactgtctattgttcgtcctggtcctggaacttgcatgtatatgttggggcatagcagcagagtatgtactctgtaaaaacacatcagttacaggctggtagagcctaacatcggttaacaccgtcagttattggcaaaaaaaaaaaaaaaaaaaaaaaaaaaaactc

SEQ ID NO: 10744 - DNA, 1190 bp, Zea mays
ctgcggcctgttggagggcagcaccaagtatcacagtctagctactgcctggcaccagcaagcttctgccctgccccgccccgccgccagaatccgaaaccagtaaaccacagcggcaacaacctcgcggcgcccgcgtggaggcaggcggcgcataaagccagccggcgctgctcctgctgcttcttcgatcgggccatggctgtcgtcacgagggacgcggcgtgcctgcccctcgtcctcttgctcctagtcttctccgcggccccgtctccggctgacggctgcgaccgctgcgtgcgccggtccaaggccacctactaccaggcctcctcgctcgccctcaacgccgggtcgtgcgggtacggctccttggccgcgtccctcaacggcggcctgctcgccgcagccagccccgagctgtacaggggcggcgtcggctgcggcgcctgcttccaggtgcggtgcagggacagcgagctgtgcagcgccgccggcgccaaggtggtggtgacggaccaggcgcggacgtcgaaccgcacggcgctggtgctgagcgccgcggcgtacgcggccatggccagtgccggcaaggccgcgcgcctcagggaccggcgcgtcgtcgacgtcgagtacaagagggtaccctgcgagtacgcgaaggaccgcaacctgttgatacgcgtggaggagaagagccggccgccaagcaacctgtccatcaggttcctgtaccagggcggccagaccgacatcgtcgccgtcgacgtcgccaccgtggggtcgtccaactggcggttcatggcgcgggaccacgggccggcgtggagcacggcgcaggcgccgccggggccgctgcagttccggctggtggtgaccggtggctacgacggcaagtgggtgtgggcggagtcggaggtgctgccgcgccggtgggaggccggccgcgtctacgacgccggggtgcaggtctccgacgtcgcgcaggaagggtgctacccctgcgacacgcgcgagtggcagtgacgtgacgcgcgcacgggctggattgtagtagattgtacagtttttttttttggtcgggaatgggacgaaagatatgaaatgatgatgagcggagccggagagccgaatcaaaccaaatcaaacaaacgtgccgttgaaagttggttctaaaaaaaaaaaaaaaa

SEQ ID NO: 10745 - DNA, 1261 bp, Zea mays
atcaggctttgacacctgttagagcgcggacccgaaatcggattctaattgagctctgagcagcggtgtcctgagtccgtgaacgtgtcctctcccccgcggttcccttcaacgtcgcctccctagagatccgccgcttctctgccctctgctcgtcgattcggcgcctcctctccttcacgcgcccacgctgccgtcgcctcctcctcactgtcgtccatgccgtgtagccgcctacggccatggccgctggagccagcgactatttgacggtggagtaccactccagagactcccctctttcccctccgacgacgagggagccaccggcggcagcggcgtcctcgtacaccacggtgggcacggtgggcgatcttctcatgaagtggtggtagtgcctcgtggacgtcgacggagacgcggcgtgcctgcccctcgtcctcctgctccttgtcttctccgccgccccgtctcctgctcacggctgcgaccgctgcgtgcgccggtccagggccacctattaccaggcctcctcgctcgccctcaacggtacccctgccttgtgcgtttcaaacgattcgtctgtttctgtggaatttgattcatctttcggtttctgctgaactgcgcagcactcagcaagccggttcgaattcatcgtcgccttccattccatgacgtcgtgcgcgtgcgtgtggttggattttggcaggtggggtcgtccaactggcggttcatgtcgcgggaccacgggccggcgtggagcacggcgcaggcgccgctgtagttccggctggtggtgaccggtggctacgacggcaagtgggtgtgggcggagtcggaggtgctgccgcgccggtgggaggccggccgcgtctatgacgccggggtgcaggtctccgacgtcgcgcaggaagggtgctacctctgcgacacgcgcaagtggcagtgatgctcgcacgagctggattgtacagttttttgttttggtcgggaatgggacgaaagatatgaaatgatgattagcggagccggagagccgaatcaaatctattaaccggtggcgctggaagggagttttttggaacctaagctgtcgttgaagaacatcccgtgccgccacgccggacttgccgcgcgccgcatgcaaggtgctcgacggtttgctgctgcactgggcaggcatggcagcaggccggggctactgggaggacaggtgcgccggatgttctcgccggagaccaccgtcccggagccgctg

SEQ ID NO: 10746 - DNA, 1439 bp, Zea mays
tccccgtaaccgtgagaaaggaaagctcagccgagtggtcttccactcctcccagccgagctctccctctccacgcagctccctcgcggtgctccctccatagcgcccggtgcccaagtccccagccgtgaccctgccgagctccgccccgactccacgtctcctggtcgggctctcgttctatgcctgatgccgctgttccctggtgctccctgctcggtccctgcccagcgcctgactacagctccagctcgcggcgtcccctctgcttagccaggattgtcgtgcctctgctccctggttttccctacgcgcgagctcgctggcgttgcccctgctccgcttggccgcgtccccctcagtccaccactctgctcggccatggaagacacgccgcaccctggttccagctcgcgatactccctgcacgccggagtcgcccagctcggccacctacctccctatgcgcgacctcctctagctccctgtttctccagagtgtcttcctctgttggctcgccggcttcctgctccctgctcacccagcgcacgcttctccctacgcgcccggcctgcgtgctgctcgccccagctcccagccatggcgtcggccaaagctcctgcgcgttatgtgcccagctcccttttccgcgtatgcgcgcttagctcgctttcctggcgcgcccagcgttctgctcccgctcgtccctgcgcgccaagctccttgcgcggtccttccttgagctcggtcctgcgcttttcctttctctgtgctcgtgctcgccgtgccgtgagtcactggccagcagtccagctcgcttcagaatcaatctcgtcgtcgttccgcgcgtcagcaagaaatctcaagagttgggtgaagtcggaggctaacagcatggtattcaccatgtgcgcgacaggaagctcgagccaagatttatccgcattcgtacgagtattgggtcgcgtttgatactggtacgttaattaatcgcgcgatgcggaagacgacccaagtcgaccccaagcacgggctactccacaggatgatgctgatggacaaacctgaagatgatcgtcaagcggacgtcgtctaaccaacactaacatagtgtttattccaggttatagttttgtgctgctgttgatggtgttaagtgccggtgggctcggccttcttatataagtataccccgcctttatcttcttattgaggatggtcacttgagctagcatatatttcaaaactataaataatttataaccgttcaaagtttctttctttgaatcaatgtagtaatcactctgatcatgtacgaagtaaaatttttgtaatttgtaaaatttggtaataagatttccgctgcaaaaaaaaaaaaaaaatgcgtgccttgtattacttaatcccgcggttctggttgtaagtggtttatccggtg

SEQ ID NO: 10747 - DNA, 911 bp, Zea mays
  misc_feature (861)..(861): n is a, c, g, or t
agcttatctccacatcggcttaactggtgattatcttcccacgtacacttctcacatgtggcaacctgggatatttctccatgcccctacccagccattcccctaaaaatctccagccgtctgtcttgctgctcgttcctgcagctcagacgtcgcctcccttctaccccttgctcctcagccaggcttgttagccgagcccctccaactagcgtgctagacctttgacgccgtttccccgtcgtccaagctccaccatgcccacacgtccgtcctgctcctccatgcacacgcccatgcatccttatctccctggaaacttcactcgtgtacggctccctggtgataatattcagcgatgcttcgccagggcaccgttcccctgcgcgctcgctggacgccgtcgcacatgctccctgctcggcctccccggcgtgctgctccctcgccttggtgcccctgcgagctccttctctctggcccggtttccagctcgggcctcgctagatgccgatgccgcttttctgacctcgtctcgatactcaatcgctgcagcacgccatgccgtgtgtgctgcactgtcatcattcgctatcctcatctttgctaatttttctcgtcgtttctcgtctacaaccttgtcagctcctgcgtgtcgtgcgcgtcttgtgttcgggtcgagccccaggattttgaggaaaaggaagctccagtgcattggccggtgaaatgaataaaatggattttgaagaaaaggaagctccaatgcatcagccggtgaaatgaataaaatggtggtaattatggtccttgtgaaatctgagatcaacttagtcgcgtgccgcgcctcgctaacacgtngtatgtgctctccatcaacaagtgaagctcaccgaagaaggatcattaac

SEQ ID NO: 10748 - DNA, 2603 bp, Zea mays
ttaggtgtaaaataatttagtcattgctcgctatttgagcttacatcacatccgagagtttttaattgagatttgattctccaataaatcatctatgacagagcgatcaagtgttcgattggtaggtgaagttatctgattttaagtcaaattaaatatagtttaaaatattagtctcgatctcgtttgagttcattctgtttgtatcttatccaaaatacgattatctctagaaaatcctccctcatcacacgtcatcagcccatacagctgtcgttccttatctgctcagccgtagtgatcaaaaatctacactcatgtacttatcctctccaccatccctatctctattatcctcccacgtcatctcctggagaattccctagccatctctatcttctaactccacgccacctcctttctcaagcatcacgttcaatttctagaaattccctgctatcgctagcttctaggacaaacgttgctggcctcctacgtttccatacgtcggctccctgtggtcttccccgcgtccggtctcatccttatccccatcgcccttatcccctggtctgtgccgctcgtacttggagaaaaatctccagccgccttacctgctgccgccgcttcccatccgacagattatttgtttgcagtcactgatcttctccctcgctcagccgagtggtcttccactcctcccagccgagctctccctctccacgcagctccctcgcggtgctccctccatagcgcctgagcgctctgtcctcggatcggagcttctctgcgtgtcgcagccaagcttccttccccatggcgcccggcgcccaagtccccagccgtgaccctgccgagctccgccccgactccacgtctcctggtcgggctctcgttctatgcctgatgccgctgttccctggtgctccctgctcggtccctgcccagcgcctgactacagctccagctcgcggcgtcccctctgcttagccaggattgtcgtgcctctgctccctggttttccctacgcgcgagctcgctggcgttgcccctgctccgcttggccgcgtccccctcagtccaccactctgctcggccatggaagacacgccgcaccctggttccagctcgcgatactccctgcacgccggagtcgcccagctcggccacctacctccctatgcgcgacctcctctagctccctgtttctccagagtgtcttcctctgttggctcgccggcttcctgctccctgctcacccagcgcacgcttctccttgtgtgccgtgcctgcgtgctgctcgccctagctcccagccatggcgtcggccaaagctcctgcgcgttatgtgcccagctcccttttccgcgtatgcgcgcttagctcgctttcctgcgcgcccagcgttctgctcccgctcgtccctgcgcgccaagctccttgcgcggtccttccttgagctcggtcctgcgcttttcctttctctgtgctcgtgctcgccgtgccgtgagtcactggccagcagtccagctcgcttcagaatcaatctcgtcgtcgttccgcgcgtcagcaagaaatctcaagagttgggtgaagtcggaggctaacagcatggtattcaccatgtgcgcgacaggaagctcgagccaagatttatccgcattcgtacgagtattgggtcgcgtttgatactggtgagccgatttataatttttgtaagtttatttaatgattggattaactagaattattaatcgtaataatcctcgtatttagcgcaggcgtattgtggtagtattaaaaataagtaaagtacgatgggtttagtaatgcgaaaggtgtattaatttaggtgatatctgggcgaagtaacgacgtaaaggatagatttagtgttttatacaactacttgatgaattttgtcattgtcaattgcattaaataaataacataaagagatgtttgattaattgttgatatgtaaaatatgtaaggagtgaaatcaaattaaaatagttccttgtgagccatgtagtataatttataaaacaaggaataaggttagcaattaatcaattagctggtgagttgtgtaggctaattgtatttaatgtgtatagtttgttgttcgtgatgtttgcgttaggttcgaggggcgtaattattgcgtgtagtcgtatattaataactagggattccgtatgaaattgtacaacgcctcgccgctaggtgtttaaattcgccatcacgtaacactatttaggtttgtaatatttccatcgatatgcattcatgtgcataatgcattccattcaggtacgttaattaatcgcgcgatgcagaagacgacccaagtcgaccccaagcacgggctactccacaggatgatgctgatggacaaacctgaagatgatcgtcaagcggacgtcgtctaaccaacactaacatagtgtttattccaggatataactttgtgctgctgtgatggtgttaagtgccggtgggctcggccttcttatataagtatacccagtctttatcttcttactgaggatggtcatttgagctagcatatatttcaaacttatacttttgtaatcact

SEQ ID NO: 10749 - DNA, 2275 bp, Zea mays
gttttttttttatttcttttcttttatttttagaaatttgcagatatttttagaacccagaatttttagcgatagcaaaagagtcaacattaattgcgacagttgattcgattcaaaaatctgataaatttacctgcggtctgaacatctggttccacagccacgaatgatttaccagtgaatcgaagctcaattataattctcggacgcgccgtcacagttttgatttagcggttacttggaatcagatgaatttacacccatcatttatatccaaaacttggatataaattacgggtgtgaattcatctaatcccatttgttcttcagcccacactgtaggataatctcgtcccctgtgttttggtgacgggtaattttttatctgagttcgaccaaaccagtgttgtcttaaatatcgaatcggatctcgtctggtttaatccgtctacatctcgctcccgtgacgatactgacgtcgtccccggaggaattccgattgcgatgccgcattcggctcgcacagtttaaaatttatttaattctaaaagtgtcgagcctagtgccaatttaaaattaatcaagacgaactaaaattgtcacttaagtatttcgctcggttcgagcaatctctatgaattcggtaaatacgctactaggggcagactgtttaaataaactagaacagttgttagctgattcggtgtcctatttcaaagtctacgaaaataatatatgtagccgaactattgttttaatttggtctgttgcttctcgctcagatctacaacttcagatataaataactaattaaaattcatatgactccggagttttcaccaaattaagcatatctaaatattgtagccgataaattttaggtccaatccattatttgtcgcgcaaaccttaagtccagaatctaagattatatttgtaattctgtttagtgaaataaaaacaaaaatcttctctagaatatccttagctgatttttttgtccagctcttatccaggaaacgatctcatccttgagatattcatgcacgacgtccagttgacgtaggctttctgatctttttcctcaagcttatctccacatcagcttaactggtgattatcttcccacgtacacttctcacatatggcaacctgggatatttctccatgcccttgcccagccatttccctataagtcggcgcccgccggcctcgctgccgagctttctcatctcctcagctcaccttgccgcagccaggcttgttagccgagcccctccaactagcgtgctagacctttgacgctgtttccccatcgtccaagctccaccatgcccacacgtccgtcctgctcctccgtgcacacgcccatgcatcctaatctccctggaaacttcacacgtgtacggctccctggtgataatattcagcgctgcttggccagggtaccgttcccctgcgcgctcgccggacgccgccgcacatgctccctgctcggcctccccggcgtgctgctccctcgccttggtatccctgcgagctccttctccctcgcccggtttccagctcaggcctcgccggatgccgccgtcgcttttctgacctcgcctcgacactcaatcgctgcagcacgccatgccatgctgcactgtcatcgttcgctatcctcatcctcgccaattttcctcgttgtttctcggctacaaccgcgtcagctcctacgcgtcgtgcgcgttttgtgttcgggtcgagccccaggattttgaggaaaaggaagctccagtacatcggccggtgaaaagaataaactggtggtagtcatggtccttgcaaaatccgagatcagcttagtcgcggtacgtgaattaaccacgtgatgcggagaacccgagccaagtcgaccccaagcgcagactgattcgcgaggtgatgcgaatgatgaacctgaagatggatagactgaacgagtggcagaacaaaagctgctcgccaaaggatcgccgtctaacaacactaacctagtgttactcaggttctaaccttgtgctgctgtgatggtgttaagtgccggtgggctcggccttcttataagtctaagtaactcccttatatttcttattgaggatggtcatttgagctagcatatatttcaaacttatacttttgtaatcactccgataaaataatataaaatttttgtaacttgtaaaaaaaaaaaaaaaaatttcccgctgcaaaaaaaaaaaaaaagaaaaaaaaaaaaaaaaaagcggcc

SEQ ID NO: 10750 - DNA, 800 bp, Zea mays
aagcatcacgttcaatttctagaaattccctcctatcgttagcttcaaggacaaacgttgctggcctcctagtttccatacgtcggctgcccctgctagctcgcccaaatctcggccatggcgcacggccatcccgtcccggcctccctactcccagcaccgttcgttgaagctggccatgtctcccaactccgttcttggatctgctcagctcctaggcaccaccgcgccgccgctctagatgttgtgctcggccccctgacgtccacccaacgagtagcaacagcgccaccagctggtcctccccacgccgttggggactgctgcgtctttcctatcgtagtgcagatcgtcgtctccctgctctccctgctcgtcttgcgccgtcgttcaccactgttccggccttgtgtcatcgccgtcgtcttaacttgacagcaagcgccgctgctcagttcgcctctgtccgacaccgaactgggctgcccgtcctcaagcttgccgatgtcattttccctggtgcttgctctcgccctaggccatggagcagcagcagcagccacgacactccttcgtgtcgcactctcgacatgttcgatgaaataccgcagcaagctccatcttgatctatccagtctcggtcacgtcgtcgtttaccccgataaggaatagttgttctccttatgttattcatcaccagtacctgtaacccgcattaatttattagatgctatttatgtgtatgttattgtgtgcctttgaggagagtaatctctggaggtttgattgatatgaaagcg

SEQ ID NO: 10751 - DNA, 3773 bp, Zea mays
  misc_feature (1614)..(1614): n is a, c, g, or t
tgggcgtccacagacgcacggttctgccatcgcgcgattcccctcttccatcccgattcctccgcccgtgactccccgcgcccgcagcccccgccgccgtcctcgcgacctgcctaggacagctgtcacgcccgcaaatcacgtgaccatgcccttccatgtcctcgcgtcctccactccgcccgcgattcccctccccgcacccgcagcccccgccgtcgtcctcgcggccagccgaggacagccaccgcgcccgcaaatcacacgaccatgcccttccatgcccgcaaatcacgtcaccccttccatccatggcagtcgcgctccctctgcgcccttccatccatggtcgcggatccctacgcgccgcgattcttcccatacgctccctctgcgcccttccatccatggccgcggatccccgatgttgagatctgggagctgaagctggagatctcgcggatgcgggtgcggctgacggcggacgacggacggcgcaagaattgcggcggccggagctcccagtgctccgacggcaaggcccgcaggcggtagaaggcatccttcgcctatgactgatgcttcgctgctggcgtcgacagtggaggcgcgacaggcggtgatcgtggatggatgcggtctcagcgtctggaggatcggtcggagctaagcagggacggtggctgctgacagctgagtgatacgtgtatttctaggaagatcaagcccagagctgtcgcagagccagaagtgcatctacttccacggcaccgtcagcaaggacctcctcacacacaagttggtcatccagctctctaggaagatcaaggacgacatatgaagactggagtactttgaagtttgatgaacaacaaggacatcctcacgcacaagtttgatgaacagtaagtactctaaagtactcaaccttggtttaatgtctggcgatacgtgtatttcttaaaggctggttatgcgatcatttttgtccagcagcagtaatccacaaagctatatcagctgcttcgttgcaaagcaatcaacaacttttacttttcctctttaattttagcttctcaaccgttcagtaactgcataatgtaaaaaacacataaaatgcattgtgcttgcatgaatgcagagggagttgccgacctttctctaggttcctgcctgatgactcatttctccagttctttgatttcaccacaaattcgaaggttcaaggttggttcagccgtgttgattagctcttacttgagcaacacatggagcacctaaacattagcaactagagaattcagtgtgaatttgtattagaattagaatttgaacgcaacctgtgcagactagcagtctggtcttactctcttagcttggcttgcaggtcaacaaaattcttgagccagttcactccaacccaatgggacaaggatcagtggcatcctttcatggggccactgcggtccatccaagtggtgttcatttgtgttgtcttcgtgatcgtggagatcaacacattcttcctttagcttgcgtcctgttgccgagttcctcaaaaggacaaagtcgttactgtggttcagtctctacttgaatgatattagtgacaangtaaaactattcctttattgttaattattttctatatgcatgatggcagtaactaaaatattggattgtgttggacatacaacaagttctagaagccattagctaaccacataatcactgaccttaacccagtgaccatttaacaacgtatataatataaatttacattagatgctttatttttgcactgtagacctattgcacatataagtgctccttagaacttaggttgttattttcagtctcattattccattctttactaaagaattgtacatcaaacaaatttatgtagtacatatattgcagaggtcctcaaaatctacaccaagttatgtcagggactatatctccactcaactcattttaaccttgtacatttcaatcaaatccaaatacatgtgaaataaatgtagtaggttactctgaccagtgttgcgctcgcgcgccagcatgctcggactaaccaacgaaaaaggtgaagtgggatggtataccatttgcaattgacatttatggtttttgctacgctggcactcagtgtttccaaatatctattagtcaatgtgcgatcgtaccaaattcaacagggctctctacatatggtatgtataactatctcaatttgaactgcattctcgtgggagtcgctcttattgtttagtaatcatttttctcaatgttatgtctaaccgtgttattcagttttgcaatatgcacgtcaatttatggtgctatatctattataggctacctcatgtttggagacaagatgctctcacaaataactttcaatcttctgaaagattcatttgcagcaaaagttgcacgatggaccacgataactattattgtcggtttctctgattcaattaagtgggaacccttggtagtgattcaattaagtgagaagtgagaaccctcattgtgctattttttgtttcaggtgatcattcctttcacaaagtatccttacacatcttagttatcaactctgtaagttgagctatctttaggatgacattgacttttgctttgggttgttatctatctttgtagccgaagaaacaatcctgagaaagaatcgaaagctccttggctaggaataatgtttctaagtggaatcacctgggttatgcgagaagcacatcaatggattccactggtcctctgttagctggtaggagaagtagcagacatggctcaagtgagatgggggactgcatattcagctcaatgagacattttcttcagttggcgaatcaattactaggagaatttgttagatattaagattaatagtaacatgtattaattcaattttatataatcgttgtgcaccaacattttatttgaaagggagaaataaatcctagcaaaattgactatgggagaagggatataggaacaaaaatggaatatgggagagggaacaaactcatcggcctatgcgccttgattagaatgtctcctaaaagttttaggtattgaaaatatgataggacatttattgtaatatgtttattttctgaaatactaattttgatgtatagaatattgacaaaatcttcatgtcagtttcccttcccaagtaagaatagagcaatgcacttgttctgcccgtgaggtggttgtgtgataagtcaatttactccagtgcttgaagcttgcatatctcactatgaatctccctggataatttgttcatcataagaatgaggaactcaagtttttgcaatttagagatatctggtggcaatggtccaatcaaagaattgttggacagatcaacaatcctgagacccggttgagatgaaagaagtattgattccattgaatgggtgctctgaaatggaatagttctagaaaatttatttctagaaagatttaacgcagttaaagttggtgacatgaagaaagtaggcaacacaattccctcgagtgtgttatgactgagatcaaggatagataacttctggtaggtacctatcaccgaagggagagaccctgacaatgaattgttctgcaattttagtgacattaagttctgaaactaggaggcatcatttgggtagcttcctatcaatttgcttgagctcaagtcaatgacctcaacaatgcctgagacacatcctccaatatattgcttttagtccgaa

SEQ ID NO: 10752 - DNA, 803 bp, Zea mays
accaggctcggactaaccaacgaaaaaggtgaactgggatggtataccatttgcaattgacatttatggtttttgctacgctggcactcagtgtttccaaatatctattagtcaatgtgcgatcgtaccaaattcaacagggctctctacatatggtatgtataactatctcaatttgaactgcattctggtgggagtcgctcttattgtttagtaatcatttttctcaatgttatgtctaaccgtgttattcagttttgcaatatgcacggcaatttatggtgctatatctattataggctacctcatgtttggagacaagatgctctcacaaataactttcaatcttctgaaagattcatttgcagcaaaagttgcacgatcgtggtccaccgtgcaacttttattgtcggtttctctgattcaattaagtgggaacccttggtagtgattcaattaagtgagaagtgagaaccctcattgtgctattttttgtttcagggttgttatctatctttgtagccgaagaaacaatcctgagaaagaatcgaaagctccttggctaggaataatgtttctaagtggaatcacctgggttatgcgagaagcacatcaatggattccactggtcctctgttagctggtaggagaagtagcagacatggctcaagtcagatggggggctgcatattcagctcaatgagacattttcttcagttggcgaatcaattactaggagaatttgttagatattaaggttaatagtagcatgtattaattcacttttatataatcgttgtgca

SEQ ID NO: 10753 - DNA, 1633 bp, Zea mays
cggacgcgtgggcggacgcgtgggatcaaattcaaattccttgtgaaataattgtagtgggtcactctgaccagtgtggcgctcgcgccccagcttgctcggactaaccaacgaaaaaggtgaagggggatggtataccatttgcaattgacatttatggtttttgctacgctggcactcagtgtttccaaatatctattagtcaatgtgcgatcgtaccaaattcaacagggctctctacatatggtatgtataactatctcaatttgaactgcattctcgtgggagtcgctcttattgtttagtaatcatttttctcaatgttatgtctaaccgtgttattcagttttgcaatatgcacggcaatttatggtgctatatctattataggctacctcatgtttggagacaagatgctctcataaataactttcaatcttctgaaagattcatttgcagcaaaagttgcacgatggaccacgataactattattgtcggtttctctgattcaattaagtgggaacccttggtagtgattcaattaagtgagaagtgagaaccctcattgtgctattttttgtttcaggtgatcattcctttcacaaagtatccttacacatcttagttatcaactctgtaagttgaggtttttaggatggcgttacattcctgaaattgtttgaatcctttatgggatttcttcatccttaatcacttgcagatattctttagtgataaaaccattagcttagagtatggaagggttgtgtccagcaaggtttatgacggatagtcttcgctgttatgctgcgtactcgatgtgttgcctttctcctgccattctttggtacataactaacacattatgcttaaacatggagtcattatcttataaattctttttctatcactaatcattgttttggttcctatttggcataaattgtctaaatacttataaatgtgttgtcctatattttttgttctggacattgtttggttcccctgcttccagaatttatatgacttgtgaattttaaatgaagaaaagaaaggaaaattatgaatcatggattaccaattcatgccataacattgacttttgtgcagggttgttatctatctttgtagccgaagaaacaatcctgagaaagaatcgaaagctccttggctaggaataatgtttctaagtggaatcacctgggttatgcgagaagcacatcaatggattccactggtcctctgttagctggtaggagaagtagcagacatggctcaagtgagatgggggactgcatattcagctcaatgagacattttcttcagttggcgaatcaattactaggagaatttgttagatattaagattaatagtaacatgtattaattcaattttatataatcgttgtgcaccaacattttatttgaaagggagaaataaatcctagcaaaattgactatgggagaagggatataggaacaaaaatggaatatgggagagggaacaaactcatcggcctatgcgccttgattagaatgtctcctaaaagttttaggtattgaaaatatgataggacatttattgtaatatgtttattttctgaaatactaattttgatgtatagaatattg

SEQ ID NO: 10754 - DNA, 1505 bp, Zea mays
tctatagaccttctgtgaccacaaatccggatcaagtatcactttcaggtcgatcggctgattttttgtgtgtgtgtcgtaaacagttatcagcgagagctagcatatcacgttccatcatgtttggttcggctttggcgtaatcgagagcggtttcagctacccgggcaccccggccgtactcatcaacagccaaacaaacaaatagcagtaattttttttttttttttattttaaagcctggcttactttaaatctggttttaggagtacatgagaacgcaggacaagtctgatgacccccagtgaatttcactctcacactcctaaggctaaaattcggaggaatatactcaggtcggatgtagcgagaacgcacgcgactgatctgatcgcccggtacgtagtgcgcgcggagtgggaatggaagcaagccgcgtcagtaggagatgtcgacgagcaaggccatagcacgcgcgacggcggcatcctcgcgcgtcccctgcacggcgcggagcgaggcgtaccggtggctccgcggcgggacgggcccggcgccggcggccgcgtagcgccgcagctcggcgtcgtagaaggacgcgaggccgcggagcgcgacgcacgcccgcggcaggtggcgcgccagcggcagcgccaggttgaagggccacagcaggaacgcgaactggaacgcgcgcaggaacccggccgccaccgccggcgcggcgaggagcgccacgtggaccggcatcgcatcggtgagcctccctggatgacgtacgacgatgtgcgctcgcggctcgcttgcttgcactggacctatccgtctgtctgtctgtctaatgtctatcgttctatccctctgtgcttttccatggctatatgctggccgacaatatatggcgagagatgttaccgtatataagtgcgccgccactaattgatcgttcctcctgttggatttggatatttccagagcagaggactggtagcagctgacgattgttgtaagcacgtctttgttccagtcatagcttgtaactgggagcgagagaacagcgggccgaagcaaccaaccaacaatctcgcatggatgtccccgtcaatcagcaggccacacagtgctgtttctatttttctggaaggagcaagcaaaatccctgcaaccgcaagagaacagccgtgcagacggggagacaccgtctctttcagaaacggatgaaggcatgcaaggtgatggttttacaccgcggaccgttccggcaaaccgattgcggggatttatacatgtattatatatggatagataagcgtaattatttcacatggatcgccaggcgctgcaactgcaatgcatcggatttataaacaagacgcggatgcatcgaccggcaacggcaagcaccgcgtcgctttccatcggcaccattccattccatggaccatggaccatgggcaataaccggcggatcgggcggtgcatggttttttttttgagaaattcgg

SEQ ID NO: 10755 - DNA, 800 bp, Zea mays
acgaatgcaatgcaagaattgtctgtcatttccttttttaattagtagtattcagtattctattattacaataattacactatactactatattgatcgcagcccgtgtagacgaacagcgagtgtgtttgtcgatgccacaccgcctccacttgctaacagcagcatcctatctggtgtttgatgattctcctccatctccgtcgagcagcactgcaagaagctggtgatacatgccgccagcagggcctggcctggcctggcctgagctcaccggcgggtgaccagcgggaaccacatgtcgcggaagcacgactggtaggagacgaggagcagcaccagggcgagcgcgagcgccacgccccacggcgacgacgacgcgccgtcccgctggccccatccgccgccgccggcgtaccaggagggctggttcccggccagcagcgacgggagggcgccgccccggggccgccgggacccggccgtggccgcccagtactggaccgcgagcaggagcagcagcggggacagcaccacggcgaaccgcacctggtccaccaggctctccaccgcggactcgtagcgcgagtagagcgacgtggcgcccagcagcgccacggtggccaggaacaccaggaggtgggacggcgtcgtcctcggcgccgccgagtagctgtagccgccgtagcccgcgctctggtcgtagtagtagccgccgctcgccatgctagagctgctcgatcggttgggcttgcgcgcctgtggtgtgtccgcgtgtgtgccaatccgcccccgcccgc

SEQ ID NO: 10756 - DNA, 676 bp, Zea mays
catatacgcggtgctgtagaaggatatgtagtcgtctagcatctcctccagcgacagtttgccgtcatggttcacatcagccttcatcaagaacttggcatgtgaggtagcataggagaactcccccgtgacgaggctctgcagtacgcagcgcgcttcttccaccgtcaagtagttgtccttgtcggcgtccagttctgtgaacttcttcgcagcttcggcacgctcaaggtcatgggcatggccaccgtcgtcggcgtgacgcgcgccggagatgatgatgtgagattgagcgacgaactcctcctggcttagcctgccgtctccgtcatggtccatctcgcttagcttgtccttgagtagccacagcatcacgctctcttggctgctgtcttcaggatgcaggaagtcgttgaattcgacggcgttgagcgagccatccccgtctctgtccgcgctcgcaaacttgtgcatccaccaccccattttgtcatgtcccatgttgatccagtctgcgaagaactcgcgcagcgtgacggcaccgtcgcggtccgtgtcgtgcggagccatctccctccgcgtgacggcgtccagccgggcggcggcctgccagcctcgtgccgcctccagctcgccgacgccgacgccgccgcccacgcgtccgcccacgcgtccg

SEQ ID NO: 10757 - DNA, 1447 bp, Zea mays
atatgtttagcttttttatataaagaaactgtagaatagataggcagctggtctcgatgaacaaaattgatgtttgcagctgattgtacatttcccatttcctttggctgcaaaatcctagtgtatttgaaagtaaagaacctccgacttgctgtcctgtcctggcttaactgctcatagctcgtcgcgggaatcactatctacttcaccttcactggcgtaatgatcatccatatacacggtgctgtagaaggatatgtagtcgtctagcatctcctccagcgacagtttgccgtcatggttcacatcagccttcatcaagaacttggcatgtgaggtagcataggagaactcccccgtgacgaggctctgcagtacgcagcgcgcttcttccaccgtcaagtagttgtccttgtcggcgtccagttctgtgaacttcttcgcagcttcggcacgctcaaggtcatgggcatggccaccgtcgtcggcgtgacgcgcgccggagatgatgatgtgagattgagcgacgaactcctcctggcttagcctgccgtctccgtcatggtccatctcgcttagcttgtccttgagtagccacagcatcacgctctcttggctgctgtcttcaggatgcaggaagtcgttgaattcgacggcgttgagcgagccgtccccgtctctgtccgcgctcgcaaacttgtgcatccaccaccccattttgtcatgtcccatgttgatccagtcttagtatatgtatccatcggcgtgcgcgcgaagaactcgcgcagcgtgacggcaccgtcgcggtccgtgtcgtgcggagccatctccctcccgcgtgacggcgtccagccgggcggcggcctgccagcgcagccaggcctccagctcgccgacgccgacgccgacgccgacgcccctgggcgaccggtcgaggatcgcgaacaggtacgcgatccgctgccgcacgtccagcggcgcgtccgggccgaagtaccggtgcacggggccgagctcggcgtcgaagcggcgggaccagccggggtcgtggtcgtcgggaggaagcagccgctcgagcttgccgcggaaggtgtcgatgtccgggaggccggcggcggaggcggggtcgtggaggcggagcggctgcccggacaggccgaagcggaggacgacgttggcggttcctgacccggacggaacgttgctgccatggtggccaccggcgcggcgggggacggctgctgctgctgctgccgggtccgggacggacagggagaggaaaaggaggtggtacaggcagagcagcgcgacggccgacaggaggacgacggccaccgcggagcccgccatggttcagcgagcgggcagcgctcgtgctcacccggccctacccccgcgaccgcgagaggagggtgggtggcacggcggaaggaagcccacgcgtccg

SEQ ID NO: 10758 - DNA, 1357 bp, Zea mays
ttttttttttttttttacaacaaatttccgctcaacagttatgtgttttttttgacatttacaaagcaatacctcggtccaataaacaaataaacttaaacaaggaggcaaagaatatagccgtagttggggctgggcgctcccgtttgacgttttggtctttctgactagccttttcacacgtcgaaggcctccttggtgatgaaagacgcacagctgggttgcacttggcacggcgccgctgttatctccggcgctcctggcgcggacggcaccggatgagggtgtggcccgtgtgggtgcggcactggcgggcgcaggtgctggtgctggtgctgggcgcccggatggggagcgccgtagccgacgaagtgaacgccgccgtgctggtactgctgtcccctcagccgctgtgcctgcacagctgtgatgtagaccacgaagccgaccacgacggtgatgagccccaggatccccgctgccgcgaacatccccgggcgcacccggtggcacacgggccgcggcttccgccagtcgctcatgtggccggactccacggcgatgccgatcatgagcatcacctcggcaagcccgaagcaaatccacgtgaggaagaagaggcagcccgtctgccaggtgagcgcggcggcggtggacgcgacgcgcgggtggtcctgggcgacggccatgccggcggaggcggactccggggcggcgacggcgaccagcatgtaggcgtgctcggcgaacatggcgacggcgaggaggatgaaggcgccgacggcgtacgcgagcgcgaggcggccgctgctgttgtagacgcacacgtccagctggtccttgctaccgcccacgctcatgaggtagtgcgacacctctgagcgcgacccctcggcggcgaggcagaggatgaaggcaacgaggccgcagagcacggagagcgcgacgagggacacggcgacctggccgctggaccgcgtggcgcgccgctcctgcgccttgcgcagggacaggtcgtcgtgggtcacggctggcggcatcgtcgttgctgccgtcggcgccgcgtacatggatgaaaacaacgagacgtgcggcgagctgtctaactaggcaacaatggctacgaagagaaggacctgcggcgagctgctggcctggtgtcggaatatatgggcgggatggatctgtacgtaggcgtacgtagcgttggtgatgcacgggcagtcgggcacggctagctactaagcttgcaggcgacggctgcgggtggatgcggtcggagaaggagatgcgcacgccgggatcgagcgttgcatcggcggagaggaaggaattgtacagcgccgcccaacacaat

SEQ ID NO: 10759 - DNA, 4118 bp, Zea mays
agttaaggtaggtaaacaatatatccttaactcttattctctgaattcctctattattgagtaccgctcaaacttgtcattactctatgaagcaatcatgtggatctagcgtgctagctgatggccggttagcagatttgatacgaagggttgcaacctttggtatggttcttatgaagctcgatgtacggcaggtatatatactaatgaaaactgcatctgctttcgcctgttcaaattctacttttcctattgatataacctcaggaaagcttaggtaaagtcgtttattgcttgctttaggaatctggtcgtcacacagaagcacttgattccgtcacatcctacttggatcttggtgtttatagtgagtgggatgaagaaaagaagctggatttcttgactagagagctgaaagggaagcgccctctagtgccccaaaacatagaggtgtggccttgcatatgtaaattgaaacagccttttccaatctcaatttctacttttctaaatgttgtttagtattattcaatgacacctaagcacattattcagagtaagaagtgagtacttttgttcagggtattccctgctaggtattttcctacaaatcgttcagtcactctagtgagtttcttattcttatgttgcaacatcatgttagaatgtcattctgaagacgagagattataaaacggatcaaagttatcatgtcttgttagaaataaggtagtactttatatggtgtaggcccatagtgaagttactgctgctgatgagatgccaacgccattgctaacatccctggatctgccaatgatgggtttatatatctattgtttcaaattttgttatcacgtctaactgcataaccctttaagaataagaaataaggggaaattctacactaattcgtttacatttgcatttatttgttttgtataggttgctgctgatgtgaaagaagttctggacaccttcaaagttgctgcagaactagggagtgactcacttggagcatatgtcatttcaatggcctcaaatgtatgaaaaggcaccatctgaaatgcagtaaatgataaagaagtgaaaatatgcggccaatattttagagttctgagttctgactgataatctccagcaccgacttatagcagtgctttaaaattgcaaaacatgtcttctatgtcatgcttattaacacctttatgtcttagaccagggcaaaccatacgtggttaatagtttgcacagctgccttatgttagaatgatacgtgtccaatcatgttctttggctcagcattcggttactcttgttcctgcaggcaagtgatgtccttgccgtggagctgttgcagaaggatgcaagacttgcagttagcggggacctaggaaggccatgccctggtggcacgtaagctgattttgttggttgatttctctgaatttgcacagcgtagtgattaaatattgacttgctaatgataaacgaaatcattgaacttcaaagttgagatcaacttcctgttaatttgggtagattgcgaggcaatttgtagggaaaaaactgtatttagtaaactggactgaatccgatccatgaacagaaccatcaataacagtctgtatatattcgtatgaactaaagttatgccttgtttttttgaaacggaaccggcgggagagctaaagttatgccttttgagaagtaactaaacttcgcagaacttcagtaacaaaataaaactggttctgtatgctttttcctactatgatgatacatcatcttgtttcttacaatatgctgcttgtgattactctctcaattcattctgtgtgacaggttaagagttgttcccttgttcgagaccgtgaaagatttgcaggcagccgggtcagcaatcaggaagctactgtccatcgactggtacagggagcatatcatcaagaaccacaacggacaccaggaggtacgcgggagatggaatgttggcacttgcctgccgcctagtgctactaggaccttgagttgtcactcgctttttttttcttcctgaaactcgtgtgtgtgtgtgtgtgtgtttgccgtaactgttgcaggtaatggtgggctactcggactccggcaaggacgccggccgcttcacggcggcatgggagctgtacaaggctcaggaagacgtcgttgccgcgtgcaacgagttcgggatcaaggtgacgctgttccatggccgtggcggcagcatcggccgaggcggcgggccgacgtacctggccatccagtcacagcctcccggctcagtgatggtgagtgggatgactgttgctgcgtttttagttacccaagtccaaggactcgaaaattttctacgtgtcttcttgacaaaaaaagaaatggtggcatggcatgcacagggcactctccgttcgacggagcaaggcgagatggtgcaggccaagttcggccttccgcagacggccgtgcgtcagctggagatctacacgacggcggtgctgctggcgacgctgcgcccgccgcatccgccgcgcgacgccaactggcggaacgtgatggaggagatctcccgcgtgagctgcgcgcactaccgttccacggtgtacgaggacccggagttcatcacctacttccatgaggcgacgccccaggcggagctggggcacctgaacatcgggagccggcccgcgaagcggaagcccgcgggcggcatctcgagcctgcgcgccatcccctgggtgttcgcctggacgcagacgcggctggtgctccccgcgtggctgggcgtcggcacggggctgcaggacgcgctggaccggggccacggcgaggagctccgcgccatgtacgcggagtggcccttcttccagagcacggtggacctgatcgagatggtgacggcgaaggcggacgcgcccatggcggcgcactacgaggagatgctcgtggcgcgggagcggcgcggcgtgggcgccgggctgcggcgggagcttgcccgcacggagcggtgcgtgctggcggtgagcggccacagcaagctgacggcgcacaaccggagcctgcggcggctgatcgagagccggctcgcgtacctcaaccccatcaacatgctgcaggtggaggtgctccgcaggctccgccgcgacgacgacaaccgcaggctccgcgacgcgctgctcatcaccatcaacggcatcgccgccggcatgcgcaacaccggctgacagcggagtgctggtgaccgcggcttcctgcctcgttggctcgttgtttgatcaaccgagaagccgccattttggacttcgtcgtgagctcaactgacagctttggtttttcttttctttcgtgaacggccccacccagagaccagagtcgcattttttttgctgctcgatcgtctgcgtctaaataattttaagtcttgttcgtggaaatatttttgcgcgtctgttgcggtcaactgtttcatgcgcgcggcaagggtggagcgtggagttgattgatgcgcgccgacacggcgacacggccgttgctggagcctgtgtgcgcgagaaatcccgtgggccaccaccggtgcagacggcgacgcggttacgtttacgtgagcccttgattccagggagcaaggagacgagacccaccgaccagctgccccagcagtcgtctcgtccgtcggtggctcggtgcacgcggctgcgtgcgcctcgtcccatcgcggcgcaacggatagcaatccgcaaccatgggccatggccacggtggactgactgtacttactcctatcgacctatcctattatatacagtttgcccttggctacgctacgcttacgttgctaatttgtttacttgtagcagtattacgtatacttatttttgccagggtcgtctcgagcttccaacacggcaacacctactttgtttatgtttattacacacataattttgtttttcgtggcactactagtatgcaccaacgaggagccagcgatggatgggccaaagacgcgtttagggccaaaaaaaaaaaaacttgaggctcagagccagctcgagctcgtagcgcttcgagcggctcgcgagcctcgagcgagttgagtc

SEQ ID NO: 10760 - DNA, 2827 bp, Zea mays
ccggccggggagcgagcccccgcacgtcgccacttcaccgcccccacccaaaatcgtctcgatggaaccgctgcggcgcgtgctgcgcctccgactcggacggcctctcgctataaaccccgcccactgaatacggccgttccatttttgactctattccccgcttcccgattcaagtcagcggtttttagggttcgagatctcggcatcgtgtcgcggaagccatggcgacaagcatgcttagtaccgtgaaggtgagcaatgtatcactgaaagcagcacaacgtgatataaaggaattcttttccttttctggtgacattgtgcatgttgaaatgcagagtttcgatgagctttctcaagttgcctacattacttttaaagacaaacaaggagcagagacggcaatgcttctcacgggggccaccatagttgatatggctgtaatcgtcacaccagcaaatgattatgagctaccatcttctgttttagctgctcttgagcccaaagacacaaaaccttctgcccttcaaaaggccgaggacattgttgggaccatgctggcaaagggatttatcctcggtagggatgcactggacaaagcgaaagctttggatgagaagcatcagctaacgtcgactgccacagctagagtatcttccttcgacaagagaatcggtctaagtgagaagatcagtgttggcacttcagttgtaaacgataaagtgaaggaaatggatcagaaataccaagtctctgagaagacaaagtcagcactggcagctgctgaacatagtgtctcgactgctggatctgctatcatgaagaacaggtatgtgctaaccggagctgcatgggtaactggtgctttcagcaaggtcaccagtgcagccaacgaggccggtgcaaaggctaaggaaaaaatagcagtcgagcaggagcacaagaatgctgagggtggacctgcacaagcgaacatctcagagacccatgaagcgcacaggggtttggacggcggattctcaaggctacatgactctgaaacccctgaagatatccccatctctactgcgagtgtcccagctgttacggatgaggagcccagcaaggcttctccaccagctggtgttcctgaaaagccagaagctgcgcacgaattggtactataattgatgcggttttgcttcatacatgcatgtaaatagacatgaaatgggatagccctggaactcattctgtggtcttgtggttggcatcttcagattgaaaacctctttgaaggttgaaagttattgggatctaaaggagtttgcaatttgtacctggtctttttgatcaattagtaatcagtattacccggcagtggggaaatgaactttaatgcttgtgtaattgtactgttgttggtcatctattgtttcctggtatagtaactgcttctgtttaagaaattattctggctgttaacgagggagctctagtacccagggagaggaaatggaattgtactccatttacccagctcgttacggaactgtactgccggaatgcacatgttcatttttccgagatctgttgtgggagcttgccgagtccgataacattagcacacctgcccagctcgttattgttttcgttctgcgtctcttgaccttcaggcaaaaaggttggattctgcaacagcttgtggtcgtgttgtgtatacctagcgcctgcgccgaggatagtgcctggaaatcgtagccacacaaagcatcgaagatatacatttaggctatcttctccagcagtttactcatatccatattcaaactctagtatgtgaacagtatagtctacagtacggcacgagaattcggcggtacgaggtgctggcgccttcttgggcttcgcctcgacgacgacgacgtcgccgccgccgatcgagggtgccttcctccggcaggagcttgggcatcgaagagatgctcagctgctagcgatatttttattcatgctttccccgtcgtcacgcatgcctcactttgctttatttctgccgctgttaacatcgctttgcttcagctaacaacaggcctaagcttgcttttgaatacacgggacatacagcatgttctgaatacacacggaggtgtttatctaaagcctccctagctattaggggccttttcattttctgaaggaaacccaaaaagcgctaaccactgacttgtactaacccaattgcacgcgtccgagtaccggcgatgactgttgttgagcagtggccgagaacgtcaccggcccggcgtttccaacgtgcgagcagagtggttcgttcgacgttacaaaagcaatcaagcgcaggtgaaagaaaggaacagcaggacggcgacttcctctgcgtgggtggccgccgccgccgcttaaacaaacggtccggtccgtaggctcgtagccatagcttgccgctaccccattaatttgactgactgaccggccggccgggatcgcaagtcgcgagctcataaacacgctacgaccacgccgtgacgcgcgcgcgcggcaccagggctcgagcccggcggatccggttggttggccagaggcggctcaagtcaatacggtatggacgcccggcgacgtgccgcagttggcgttgatccgtagcgctcagctcagctacgtacgtggctgattgctgctggaaaaaggatcgtggtaccagttgaggcggcactaggcttcctagctcgtctttgacctctgtgtccatacgtacgtctacactagccaagtagcaaagggcggaggaagcgaaacccggaacatcatctggagactgcag

SEQ ID NO: 10761 - DNA, 1508 bp, Zea mays
aaattttagactctactccccgcttacgattcaagtcagcggtttagggttcgagatctcggcattgcgccgcggaagccatggcgacaagcacacttagtaccgtgaaggtgagcaatgtatcactgaaagcagcacagcgtgagataaaggaattcttttccttttctggtgacattgtgcatgttgaaatgcagagtggcgatgaactttctcaagttgcctacattacttttaaagacaaccaaggagctgagacggcaatgcttctcacgggagccacaatagttgatatggctgtaatcgtcacgccagccaatgattatgagctaccagcttctgttttagctgctcttgagcctaaagacacaaaaccttctgcccttcaaaaggccgaggacattgttgggaccatgctggcaaagggatttatcctcggtagagatgcactggacaaagcaaaagctttggacgagaagcaccagctcacgtcaactgccacagctagagtgtcttcctttgacaagagaataggcctaagtgagaagatcagtgttggcacttcagttgtaaatgataaagtgaaggaaatggatcagaaataccaagtctctgagaagacaaagtcagcgctggcagctgctgaacagagtgtctcgaccgctggatctgctatcatgaagaacaggtatgttctcaccggagcagcatgggtaaccggtgctttcagcaaggtcaccagtgctgccaacgatgttggtgcaaaggctgaggagaaaatagcagtcgagcaggaggacaagaatgccgagggtgggcctggacaagcaaacatctcagatatccctgcagcacacagggagttggacagtgaattcgcaaacatacatgtctctgaaacccctgaagatgttcccatctctaccgtgactgtccccgctgttacagatgaggagcccagcacggccactccagcagctgaagtttctaaaaagccagaagctgcgcagggattaatactataagtgatacagttttgcttcatacatggatgcaatgtaaatagacatgaaatgaggtagccattgaactcatttgtggtgttgtggttgacatcatcagatcgaaccctctttgaaggttgaaaatgattgggacctgaagaattttgcaatttgtacctggtactttttatcaaattatcagtcttacccggcagtgggaaactgggaaaatggaatttattgcttctggagctgtgctgatactggtccatctattgtttcttggtatagcaattgcttctgtttgagagattattatggctggtaacgagggagctgtagttccacgtgtgctgcacatttgcgttcctgaagcagcagctttctggaacatgaccgaattatttggacgatcgtcctgtttgaatgtcgtagttctaaaataccatggtttcagagaccaatctcgtatttgaagcatttatatcatatcctgtcagtgag

SEQ ID NO: 10762 - DNA, 3540 bp, Zea mays
taattgatttgaatgtggacgaaaaagggctataaagatagaacagaggaagtatatattatagcatctctaacaacgcattaaatcattgccaaatcttaaaatataggatttacagtttgtttgcttggttttaatccgtatcgacttctacattgttttgtctttatgaattacagctgcaacagttcaaacaactgattgaatccgaagcgaacacgccaactcataaaaacagctcaacgtaccctattttacgaatctttatgtaaaaagggtggcgcaccatgaaaacacccaagactagtgtcctatccttattgtatacatcattatgaatatttttttctaataatataatttacttcctaaattactggctttagtgttctaaacacctaaacattttaagtgatgtagtattttaatttttatatactattttgagtcatctgattgtacataatcttagagcatcttcaagagctttttagaagtctctcctaaattaagtttttcttggtaaaacacaaaaatgtgtcttcaacaattcccttaaaacgctccgaattttttcatagtccttaaaacttcctcatttgcaatacaaatgagaggttttttaggctctctagaaacaatatgtcgctttaatggatacgttggagaatagattaaaatctacctctaataattttttagatgccttttaaaattgattttgatgagttattttctagtgaactgctggagatgctcttaatcgtcaaactcccgttaaatagcacatgacgtgcatttttttttcttgcagaccttcactttccacccgcagctcctgccgtgcatgcccacgtccaagcgttctgtcgtcagcactgactgaagccctcaggcgcccgatgcccaccacgtgtctccgttgatggtcgctatcgcttggcgcccgcacagcgtccctgcgcgctatatatggcgcgcgtgcagcacggcgcattgtttcatgcctttcgcgagagaaaggggtcgaatcggcggctgatttgacccggctcgctattagagctgcgaaagtgatccgagcagtcacggtttcggaagcggcgcgtcggccggaggagaaacgcaaccagctgtcgaggagctatgagcagcggtggcggaggcagagtgccggcggcggcggcggcgcagtcgcaggagctgcagctaccgccggggttccggttccacccgacggatgaggagctggtggtgcactacctctgccggcgctgcgccgggctgcccatctccgtgcccatcatcgccgaggtcgacctatacaagcacgatccctggcagctcccaagtacgtgtcgtccgccgccgctccacgcagtcgttgttccaggtttcttagctcgccctgtacctgctgctgactcctgatctcggtactactgctgtctgtgcagggatggcgctgtacggcgagaaggagtggtacttcttctccccgcgggaccgcaagtacccgaacgggtcgcggccgaaccgcgccgccggcgccgggtactggaaggccaccggcgcagacaagccggtgggcacgccgaagccggtggccatcaagaaggctctcgtcttctacgccggcaaggcgcccaagggcgacaagaccaactggatcatgcatgagtaccgcctcgccgacgtcgaccgcaccgcccgcaagaagaacaacagcctcagggtacgttgcgatcgatcgagttccggccggcgcgtccaccagaatatctcattcgtttctgtgcagaaaattatctcttgctcgtatatattattatttgttaataatatatatctcctgtcactgccgtatcaacaaagaaaaagttgagataagaacgtaacgtatggatcacaaagaataattattagcagtcggattttcactagctagctagtcgccgataaaaaggacggcgagacccatttctctccggtgtgaaccctggagatgctgcgccgtgcgtcatctccttcaaccgccaattatctcttgcgcttttgcgagctacgacagcgatccgatacggtcgaaagcgacgcatcaatagtgcctatacatttcatcgccctggttctcgttcgcgtgttctacctttttgttggatggatagatttggtggtatgggcgtgattaagatttttttcctctcggttttttttttgctgttgcagttggatgattgggtgctgtgccgaatctacaacaagaaaggcgcgctggagaagcccaccggagccggcggcagggccgaggccagcagccagggcgcgctggggtccatgtccatgggctcgccgccggagcagaagccgtccgtgctgccgtctgccacggcaacggccgcggccgcggccgggacggggtacgcgccgctgccgttctcggagctggcggcgtactacgaggtccggccgtccgactcgatgccccgggcgcacggcgcggactcgagctgctcgggccacgcgctggccgccacgtcgtcgtgcggcggcggcggcggcgagcggcctgaggtacagagccagcccaagatctccgagtgggagcgcactttcgccgccggcgccggcccgggaatcaacccggccggctcgatgctggggcttggcgggcatcagctcggcccctcggcggtgggggtagggctgcccgcgggcgacccgctgctccaggacatcctcacatactggggcaagccgtactgagaaagatgactggtccgagccgccggcgatgaggccatgtcggcttgtgaatgatcatggagctggactacaggattattgctgctacgagttgaattaaactgtttatatgcgattgatttggtactgggatttttgtatacttgaattagtactctctctatatagagagacatacacatactcgagtatatatgttttgcttatatagagtatggagtaataatatttatatctgctggtccaaaaaaaaaaaaaaaaaccagttgccatgggacatttttttaaggacagttgccaccggacatctgaacatgcagggagggatccaccggtggggcgggcggggctcaagccccccctaccgctttggaacccatggagcctcactacagcttaacataatctaaaatgtatacaatataatataaaatgagtttttatactgcagaaatttagtttagtcttgcctaaaattttttctggctctatccctgccccgggccccccctgtgaatccgtcagttattattcgatctttggctgtacggccgtgtcgatgacagcggaaagcggcggtaggtcgtggacgttgacccagctgtgctgccgcaacacacatgcagttttccacatgtacgtgtacgtcgtgtactgctgctagtactacgacgtcgtgtacgtgtcctgcgcccgggtccacgtggacagcagcaggcagggcgcgtggctgcgacatacgtacgtacgagtacgactactctgcaggcatgc

SEQ ID NO: 10763 - DNA, 1435 bp, Zea mays
cattgggtacctcgaggccggccggcatgcctttcgcgagagaaaggggtcgaatcggcggctgatttgacccggctcgctattagagctgcgaaagtgatccgagcagtcacggtttcggaagcggcgcgtcggccggaggagaaacgcaaccagctgtcgaggagctatgagcagcggtggcggaggcagagtgccggcggcggcggcggcgcagtcgcaggagctgcagctaccgccggggttccggttccacccgacggatgaggagctggtggtgcactacctctgccggcgctgcgccgggctgcccatctccgtgcccatcatcgccgaggtcgacctatacaagcacgatccctggcagctcccaaggatggcgctgtacggcgagaaggagtggtacttcttctccccgcgggaccgcaagtacccgaacgggtcgcggccgaaccgcgccgccggcgccgggtactggaaggccactggcgcagacaagccggtgggcacgccgaagccggtggccatcaagaaggctctcgtcttctacgccggcaaggcacccaagggcgacaagaccaactggatcatgcatgagtaccgcctcgccgacgtcgaccgcaccgcccgcaagaagaacaacagcctcaggttggatgattgggtgctgtgccgaatctacaacaagaaaggcgcgctggagaagccgaccggagccggcggcagggccgaggccagcagccagggcgcgctggggtccatgtccatgggctcgccgccggagcagaaaccgtccgtgctgccgtctgccacggcaacggccgcggccgcggccgggacggggtacgcgccgctgccgttctcggagctggcggcgtactacgaggtccggccgtccgactcgatgccccgggcgcacggcgcggactcgagctgctcgggccacgcgctggccgccacgtcgtcgtgcggcggcggcggctggcgagcggcctgaggtacagagccagcccaagatctccgagtgggagcgcactttcgccgccggcgccggcccgggaatcaacccggccggctcgatgctggggcttggcgggcatcagctcggcccctcggcggtgggggtagggctgcccgcgggcgacccgctgctccaggacatcctcacatactggggcaagccgtactgagaaagatgactggtccgagccgccggcgatgaggccatgtcggcttgtgaatgatcatggagctggactacaggattattgctgctacgagttgaattaaactgtttatatgcgattgatttggtactgggatttttgtatacttgaattagtactctctctatatagagagacatacacatactcgagtatatatgttttgcttatatagagtatggagtaataatatttatatctgctggtcc

SEQ ID NO: 10764 - DNA, 885 bp, Zea mays
tcgaggttctggccggaaaaaaaaaaaaaaaaaaaattgggtaccccctcgagggcccggccgggacacacaccacagttagcttcctttcaattattgtatttcagtcgagttgctaaacaacacgaactcctcagtcgtttgagttttgaggaggcaagcaagaggatccatcgatggcctccttgaactcgaagggccactgtgccgtggtggcagttgcagtggcgatctgcttcgtcgtcctcgccgccgcgctcccttcgcatgcgtcgacggcggtggacgagccggcgaagtataagcccagcaaggcgccagcgccgtcccctgcatctgcatcatcatcctacgtcccgtcgccggtccagcccgtgatcgtcgtccagggcgtcatctactgcaagtcctgcaagctcaggggctacaacagcggcatggacgcgtcccctctccccaatgcgacggcgagcctggtgtgctacggcgacgcggagagcaagtaccgggtgctgaaccagacgagcacggccaccgacacgaacggctacttcatcgtgatggtgtacgacgtgggcatgttcgaccgccgcagctgcaggctgtacctccgctcctcgccgacggcgctctgcgccgcgcccttcatcccgtccaaccccaagctggggctcaccctcgtgagggaccgcgcggccacggcgcccaggggcgcgcgcggcatcttccaccccaagactgcgctcatgtacgcgccgggcaccggcggcaagtgcccgccgtactgatgtgatggtgcgtacgtggtctggactcgggagtcggagcggcgcccatgggggggtgttcactggtggtgcatgggcggcatgcatggatcgtcgt

SEQ ID NO: 10765 - DNA, 1110 bp, Zea mays
ggcccccgcggcccgcccggcccgcacacaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatcctacgtcccgccgccggtccagcccgtgatcgtcgtccagggcgtcatctactgcaagtcctgcaagctcaggggctacaacagcggcatggacgcgtcccctctccccaatgcgacggcgagcctggtgtgctacggcgacgcggagagcaagtaccgggtgctgaaccagacgagcacggccaccgacacgaacggctacttcatcgtgatggtgtacgacgtgggcatgttcgaccgccgcagctgcaggctgtacctccgctcctcgccgacggcgctctgcgccgcgcccttcatcccgtccaaccccaagctggggctcaccctcgtgagggaccgcgcggccacggcgcccaggggcgcgcgcggcatcttccaccccaagactgcgctcatgtacgcgccgggcaccggcggcaagtgcccgccgtactgatgtgatggtgcgtacgtggtctggactcgggagtcggagcggcgccatgagggggtgttcactggtggtgcatgggcggcatgcatggatcgtcgtcgtgggtttggactttggtcaagaggacaatgtcagaggcaaaaaaataaaaataaaaaaggagaagtatgtggtgattgttgtcacgacgtccgtattgtgtcctcgttttagtcgatactcgatggagtatctgttgactgttgctgttcgttgagtctgtgtaaccgtttcttcgtcaatcggtcaatcctgcctttggacaaaagaacgaaatagttgcacgtccttttaatttgttgtgtgtttaatttaaactgaaaagttgcaggattgg

SEQ ID NO: 10766 - DNA, 1575 bp, Zea mays
cttaccttttgtgtgtcgtttagcaacaagccgttgctgctcggatgccgcagggctgtgtcgttagatggcagcacatgcatgcatgcatggatccagctttaatttgatacgcatgcatgcagtcattgttccttaattcactgtaattctgcagcagtcgtcgaagacataattcagctcagaaattaacccgcagttccctgccctgcgttgatctttaacttttacaaacctagctgacgcactcatccgttgcggcctgcgggtaatgccagacaaaagattgcagtaacttgaaacggaatctgcctgaccgcgcgcgctctccatctcaagctgcctagctggttcagtttgtttgtttgtttgtttgatgagaaagcgcaaacgggagagaaaccctagctggctagctctcccgcctctctataaatcagcgcagcctgttcgtacagcgccacacaccactggccccctcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatcctacgtcccgccgccggtccagcccgtgatcgtcgtccagggcgtcatctactgcaagtcctgcaagctcaggggctacaacagcggcatggacgcgtcccctctccccagtcagtctctcgaaaaattaatccacagaccactcatcgttttgcaggcccagctgtttctctactcacccagttgacgccagaactgaagctaatatatagctagcgttgtgaacgaataaaacatgcgtgcatgcagatgcgacggcgagcctggtgtgctacggcgacgcggagagcaagtaccgggtgctgaaccagacgagcacggccaccgacacgaacggctacttcatcgtgatggtgtacgacgtgggcatgttcgaccgccgcagctgcaggctgtacctccgctcctcgccgacggcgctctgcgccgcgcccttcatcccgtccaaccccaagctggggctcaccctcgtgagggaccgcgcggccacggcgcccaggggcgcgcgcggcatcttccaccccaagactgcgctcatgtacgcgccgggcaccggcggcaagtgcccgccgtactgatgtgatggtgcgtacgtggtctggactcgggagtcggagcggcgccatgagggggtgttcactggtggtgcatgggcggcatgcatggatcgtcgtcgtgggtttggactttggtcaagaggacaatgtcagaggcaaaaaaataaaaataaaaaaggagaagtatgtggtgaattgttgtcacgacgtccgtattgtgtcctcgttttagtcgatactcgatggagtatctgttgactgttgctgttcgttgagtctgtgt

SEQ ID NO: 10767 - DNA, 831 bp, Zea mays
cggcccagacaccacacttattagcttcctaatttcaattattgtatttcagtcgagttgctaaacaacacgaactcagtcgtttgagttttgaggaggcaagcaagaggacccatcgatggcctccttgaagaaccactgtgccgtggtggcagcagttgtagtggcgatctgcttcgtcgtcctcgccgccgccctcccttcgcatgcgtcgacggcggtggacgagccggcgaagtataagcccagcagggcgccagcgccgtcccctgcatctgcatcatcatcctacgtcccgccgccggtccagcccgtgatcgtcgtccagggcgtcatctactgcaagtcctgcaagctcaggggctacaacagcggcatggacgcgtcccctctccccaatgcgacggcgagcctggtgtgctacggcgacgcggagagcaagtaccgggtgctgaaccagacgagcacggccaccgacacgaacggctacttcatcgtgatggtgtacgacgtgggcatgttcgaccgccgcagctgcaggctgtacctccgctcctcgccgacggcgctctgcgccgcgcccttcatcccgtccaaccccaagctggggctcaccctcgtgagggaccgcgcggccacggcgcccaggggcgcgcgcggcatcttccaccccaagaccgcgctcatgtacgcgccggccaccgccggcaagtgtccgccgtactgatgtgatggtccatggatatggtgcgtacgtggtcgggactcgggagtcggagcgcggcgccatgaggaggtgttcactggtgcatgggcggcatgcatggatcg

SEQ ID NO: 10768 - DNA, 1370 bp, Zea mays
ttttttttttttttttcaaaattgcttttcaatcataaggacaaaaaattccacgaatagaactttaaatttgttagcttgtttcttccaattactttccaacgacatgaaacatttattagttaaatatactagaatctgtccaggtgattccgcaaggttctgacactactgcaactccttccgcatgtgagatatggaaattgagagttgagacgacgagcaaagccgttggccactaccattggcatgagatcaacatctgcacagtgtcgtcgctcctccagcggcagccggcggcaccaccatgtagacgctcggcgagcccaccggctccggcgacagcagaggtctgaactcgctgctctccaacagcagcagctggtccttgagcctgtccagagcttcccgcatccagtcgtaccggcatagaccatacgcctcctccacgggtacccatctcctgccatgggtgacctgctcgggccaggtttccagcagctccgtgacctgcagtccgaacatgaagcccttgcatgccccttgcagaccgcaactattttgcttgctcttgctcttgaagatccattcacccagcggtgtcgcgctgataatgcccttgacgcctgcttcctcgaaggcctccctgcaggcagcttcgtcgatgctctcgtcgtcctcccatccaccctttgggaagatgagatcgctccgcttgggcgtcgagatcatgagcacttgcagcctccctaccacgtcctgctggcagctgctttgctttccagcaccctcctccacagcatcctctttgagcgtgtaaggaatgcatcctgatacaaggcggtagcatccatcgtagcgctgctggaggcgtccctgccttgcccaaaccatggcgacgggcgacggtgatgcaggaggcgccatcttctaccttctccactggaacaatctccttgttagctgaacaggaacctacgcacacaactcaagaagagaaatccaagagcgattcagcttctacctcatcagagccagagccagagaatggtatccttccagctaattaagcttcacccatctgcatgccaccgacccaaagaatctctccctttgcatcagtccactactggctctgataaagttggactactggatggagccaggctctagtctagattggggagagagatcgatgatatgtctgcaagaggctgatgaccggcggaacccaattctcctggaatctattctattccttctatccgctgcctactagaccttaatctatatacctagataccaactagagatttggaaattcatgagcagatagggatcatacacgaagtaccggcctctctctcttc

SEQ ID NO: 10769 - DNA, 942 bp, Zea mays
  misc_feature (930)..(936): n is a, c, g, or t
cggtccctgactgcgagcacatggaagaccgcctcgacctcccatggccgctgggcacccccgggccggccgggcttcccctccctgcctcctcgtctcctcggtctcccctccctgtcttccagagacacagagcagggcgctcttcggtcggaggagaagcgcgaccacgaccatgggctttatctcgttcgtcggccgggttctcttcgcctccctcttcctcctctcggcctaccaagagttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctgctcatttacttggcgtttataacccctattgtgtatgacttctacaaccatgaaatggagtcaacactgtttgtcgatctttttttcaagttcatacagaacttggcgtttatgggtgccctgcttttcttccttgggatgaagaactcaattccaaaacgtcgctccaagggaaggacaacaaaaaccaagacaaactgatgtcagtggttgtaggaggggaagcaattgggctcattatgtttgcatactatacaggaatagatgtcccacttttgttcttggtgcgccaattgaattgtgaattgggacttacagaacttagcatgtaggatatttaagttatcttccgcaattttattttcttatgttgcgatgtgttcttatgtcacattccattttgctacaagaactgctttgacagtaaaaaaatatattaagtcgcatagtctaaaaaaaaaaaaaaaaaaaaaaacctaaannnnnnnaaaaaa

SEQ ID NO: 10770 - DNA, 2969 bp, Zea mays
taaaagaattaaccaacacttgtgacttatctcaaaaccaagaaaacccaatttagttccatcttttagtttagttatcatgtgaggttatatactgctcttaaccatcagtactaatgtacgactgatatgttagttttacactctgtagaggtagttcacttttaccataaattgtgtctcccttgtagtctgggattggaaagcccttaaatattgtcgaggtgaatgactagggattcattatgaggttttcaccaagatttacttaatacaaaataatctgttaaggtttcaagtcatggtggagcacaaatcctccttaaagggcgcagtatactacccaaagagaaccgatatataccccatcaatcctacccgtcttgcccttttcaggtaagattatcaagcactaagtttatcaagttaatagccaaaatcagagccatgtgacaattatggttgcattgttttctcgagtagttctccatgtttcaattattatctatgatcttgtgattatcaaaagcataccaaaaaatatatttgccattgtttgttataaaccacaaagaaactaaattataaaaactaatatatctattcaactttgaaagataaacctaggttgacaaggtaggacccatcaagggcatcaattgtgtaaatacaatacaaaagtaaagtgtattactatgctaagtttatcaagttaatagccaaaatcagagccatgtgacaattatggttgcatcgtttccccgagtagttctccgtgtttcaattattatatatgatcttgtgattatcaaaagcataccaaaaaatatatttgtcattgtttgttataaaccacaaagaactaaattataaaaactaatatatctattcaactttaaaagataaacctaggttgacaaggtaggacccatcaaggcatcaattgtgtaatacaatacaaaagtaaagtgtattactatgctattcttggttgaaaagaatatgcatgggtaaatccacttgccttttccgtaaatctgttgtggttctgctgagcttgtaaattctgtatggaggcgatgagattctgcagtaactgcatttgggttgctatgaactgttccattttcggatttagtggtggaggtggtaattcagtacgtctttgattcaaaaatattctgtcgtactccggtcctaccttctggtttattagagaggtggagtttcagacaagaaaggggaacttgataaagctaataaaatagataagtgggacaagctttgaacttaactagactttaacttatttatctaatgatgcatttgtggccatcacttcacaaaacatcacaatcattacaatggctcaaatcaaacatttgttaactcaaaagcattacattgcacgtcctcacaagaacggttctagtcgaaacatccgattaagataaccaatcctaagagcctggtctagaagactggtgatggaacaaagtgatccataaaggagcttcttacaaagtggtgatatggcagggcaggaaacatcatccgtaaccttccgtggatcctgtccagcgagctgagcctctagctgagcaacctggcatgagcatcctgtagctctccatgggtctttgctagctctgaggtggcgccgtcgaggtcggtgttgagggcagcaactactcgggtgagagtgttgatgcgatcctctctagcttctcccaataagatggcactgtttgtaatttttgttgcctcattgggacagcagctagcactgttggtgcaaaatccttgattgagcaacccaataactacttgtcacaccaaaataaagtagaatgccattgctgaccattgattccatagctatattgaacaaagccagggctttagaattagttgggatttcaagacctgtccatggccgattatggtcagtttctggagccataaccagcaaatctgcagcgcccaactcataacttcaaccgctgttcatatcatcctatccaataaaaacacaatccttagcttcggttgcatggttatggtcttatcattaacgcgttatgcattctctccttttggcttgtgcttttggtgaagatccattttttattgtaaaactgatgtatccctttaaacatatcactctgctaactgctagtgttgttttttggtgtccaaccagatatttcaaatactgaagttatggtttgctaaccaaaaactgatacatggtagtgggagaaaatgcattaaaaacaactcagcagtactagcttgtatgccacatttggcttgtgcttttggtgaagatccattttttattgtaaaactgatgtatccctttaaacatatcactctgctaactgcttatcagatatttcaaatactgaagttatggtttgctaaccaaaaactgatacatggctgagttgaagagaaattctgttgttactattatattgctcatttttcttatgtttgtctgccaaaaaaaatgcataccattaatgaggtagtaagatttctatgcagcttacacttaattagacccataatctttttatcatcaagacctgtgcacttttgggtttcatttttgactgttacaactcttgggtcttcaccaatgatctttagtgccaaagttatgtgcatctatgttctccaatccccaagatgcttttaagtttctctctttcaattgtcgcacaattacttcgttcttttgatgcaccagtttatggttgagaatgttgaaataatgcttttcgctcatatatttaggttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggcttggtggtct

SEQ ID NO: 10771 - DNA, 1202 bp, Zea mays
ggcctgccgggaagccggctattcgcgagggtttccatccaccgcccgagcccagcgtcctgtgcaagcctcagctctctccctcaaccgccgcctgctcctccgccgcatcggggcggcgacctcgaccagactcccttctccccttccgcggcattcgctcaggtcttccgtatccgctcgtcccccgttcacgtcgctagggttttcacctcgccgccgccaggtcttccgcaaggttggacttcggtgattcgtcgagcagcgattccgacacatggccgccggcggcgacggcggtgagtcccactgccgggaggcgctccgcgaggccttcggtgattcgtcgagcaacgattccgacacacccgccggtgtcagcctcggagcaggccgcgtgcactggaggtgggaggcggtggctggggtcagggggctgtggctctgcgccgccttcctctccgccgacgagcaggcgcgcctcctcaacgccatccagcgagaaggatggtttattaatgcagacaaccaagcgatgagatttggcgacctcccttcgtgggcagtcgaactttctgcacttatcctcgaagctatctgcgtcggcgacgccggtgccggtcttggtgcggaggcgacgaacgaggacgaggatgcgtgccctctgccatcagacttgttgtggcgggagccattttttgatcagatgatcgcgaacagatacagaccagggcatctgtgctcacgtcgatctgatgcgctttgacgatgggatcgcgatcgtctcgctcgagtcagcctgtgtgatgcgcttcagtcgagcagaagcagcctctgacaccccgaagcaagggggcagtgccagtgaatctactgcagaggtccccgttctgctgaacccgggctcccttgcgctcatgtctggcaatgcaaggtatttgtggatgcatgagatcaaccggaaaccaggcaggcagttgtgggatggcagggagctcgaccagcgcaggaggccctttgttacgttgagaaaactcctgccttatccggactagatccctggtcatgccagtgaacaaactgttttgcagttacaggccagtaccctttttgtggtggaaaattgtaatatgctgttgctaaagccagccatcattggataatcaaaaggcgcagcctaagaggagtattgttgagtgcct

SEQ ID NO: 10772 - DNA, 968 bp, Zea mays
ccggccgggccgcgcgtccgctggaggccggctattcgcgagggtttccatccaccgcccgagcccagcgtcctgtgcaagcctcagctctctccctcaaccgccgcctgctcctccgtcgcgattccgacacacccgcctgtgttagccccggagcaggccgcgggcactggaggtgggaggcggtggctggggtcagggggttgtggctctgcgccgccttcctctccgccgacgagcaggcgcgcctcctcaacgccatccagcgagaaggatggtttattaatgcagacaaccaagcgatgagattcggtgacctcccttcgtgggtagtcgaactttctgcacttatccgcgaagctatctgcgtcggcgacgccggtgtcggtcttggtgcggaggcgacgaacgaggacgaggatgcgtgccctctgccatcagacttgctgtggcgggagccattttttgattagatgatcgcgaacagatacagaccagggcatctgtgctcacgtcgatctgatgcgctttgacgatgggatcgcaatcgtctcgctcgagtcagcctgtgtgatgcgcttcagtcgagcagaaccagcctctgataccccgaagcaagggggcagtgccagtgaatctactgcagaggtccccgttctgctgaacccgggctcccttgcgctcatgtctggcgatacatgttaaaaagtcgacttagtggtggtcgtccgacaacagagggtcatgttcgctattatgttgttgttcatgttagtcgtctcagtgttatcagtcttgtcgtgttacaaaataaacatgtcgtacgcataattttcccttatgaacaattttgcaattattcgagttgaacatgtatttgaataatcagagttgtatgtttgtgaacaagtcaaactgtgaactttgtgtcactaatgttacacaaaaaaaaaaaaaaaaaagcggcc

SEQ ID NO: 10773 - DNA, 1744 bp, Zea mays
catgtgtaggcgatgagcaagctccgtcagcggtatgatgaactgaaagagcgctatggggtttctgatattactgtttcagtacaaagtaaagatagatcctcaaaccgcctgtccttcccgttgagttatagttagtgctcatttgggttgagttatagttagtgctcatttggagccacctgactaaattttagtcccgttagatcaaatgtttgaatactagttagaatttttaaatatagtataattacaaaattaattacgcagataaagactaaagataaggactaaacggtaagatgagtcaattaggcctgattagtctattattcgtccatgtgatgctacaataaacatttgctaaccatggagtcattaggcttaatgaatttatctcgtcgtttagtcttcatctatggaattagttttatagttagaccatatttaatacttgtaattggcattcaaacattcaatatgacacagactttagttaggggaacaaacacccctttagtaaatggtgaatataatcgggtgaactttttctgagatgcctcaacacctttcagatgtggcttctcagcgggggtacagtagcattgacttggtgacgcttgaggacatggtccttgaagtaagtcagtgacattttatttctttgcagaccacatgtctttatcttggacaattaggcacagcaccttgtaacttctgaatacaactgattttaacactgggcacattctcgtgtaatttttcttcccagatcgtgaggcaaatcgagaagctgatccgtgcaaaggagatgatggaagctgcagggaagccattctaaacaagatacacatacacaatagttctgctccggcatacctattttctggccagttaccagacctccgatgcttcgctgttcaagaaaccgattgcagttgcctacggctcaaagcacaagcgcgtgaaatctaaggaactgaatctggttgttccactcgaatatgcttatattgtattgcaagatcacttgccaattgatagtgcaaaaaatgcattttgtagtttggattctctagtattgactttaatccatatgtattgaagtagattggagtgtaacttaaactaatttacacactaatttaccttaacatatgtggattaggattaatactagagtgtccaaacaaagccttacgtgttaatctgccatggttgaattttgcaatggcagtttttcctatgcatggcctggccgccgaattagtagaatttagtgcaagaaggaaaaaaaaaatccgggaacacttttacaatcaacatgttgcaatgctaaacgaaggcttttacaccgagagattgacttgatcaatttacacggggagagaggtttcacgtgtttttgttatcagagataaagagggacgagaaaaactagcaaaaagtgtgtatgccagtgattacatgagtttcaatagcatataggtgctgtttggttcaagaaatgtaacgcaaagggtaataataatgatttacattcgattactgtcggtacgtttaaatagtccggtatcaatttttagtataatatctgattacggtgggactaaaacaaacatgatttaacgttattacttatccattacgttacaaatatctgaaccaaacggtacccagatcctttgacttcccgtggagagaatattttaggatcgatgagcgaatattttagaatttaaag

SEQ ID NO: 10774 - DNA, 1429 bp, Zea mays
gggacctcgagccggccggaaaaaaaataccgtccactctcacatcaaaggcggaggtgagctccttcggctctgcccctcgcccgttgcggataacggggaggaggcggagcgaccaacggcacaggcaccatggcgatgcgagcagctacagcggcggcgacaggcttcttctctccatccaccgtccctccgaggcgcttctcgtccgttacaccgccggcgtcactctgcaccgcgcgctgcatccagcgtcaccgtctccgcgccttcccaagcttggaaatacctctagaggaactcaacccatccgtcgatctacttaggagaactgcggaggccgttggcgatttcaggaaaacgccaatctatattgttggtacggattgcacagccaagcgcaacatcgccaagctgcttgcgaattccataatataccgctacctcagcagtgaggaactgcttgaggatgttcttggtggcaaggacgccctcagagccttcaaggaatctgatgagaagggttatcttgaagtcgagaccgaagggttaaagcagctcacgtccatgggtagccttgtactgtgctgtggagatggcgccgttatgaactcaaccaatctagggctgctgaggcatggtgtctccatttggattgatgttcctcttgaaatggcagcaaatgacatgttgaagagcacgggaacacaagctactacagatccagactctttttctcaggcgatgagcaagctccgtcagcggtatgatgaactgaaagagcgctatggggtttctgatattactgtttcagtacaaaatgtggcttctcagcgggggtacagtagcattgacttggtgacgcttgaggacatggtccttgaaatcgtgaggcaaatcgagaagctgatccgtgcaaaggagatgatggaagctgcagggaagccattctaaacaagatacacatacacaatagttctgctccggcatacctattttctggccagttaccagacctccgatgcttcgctgttcaagaaaccgattgcagttgcctacggctcaaagcacaagcgcgtgaaatctaaggaactgaatctggttgttccactcgaatatgcttatattgtattgcaagatcacttgccaattgatagtgcaaaaaatgcattttgtagtttggattctctagtattgactttaatccatatgtattgaagtagattggagtgtaacttaaactaatttacacactaatttaccttaacatatgtggattaggattaatactagagtgtccaaacaaagccttacgtgttaatctgccatggttgaattttgcaatggcagtttttcccatgcatggcctggccgccgaattagtagaatttagtgcaagaaggaaaaaaaaattcgggaacacttttac

SEQ ID NO: 10775 - DNA, 796 bp, Zea mays
tcgaggccggccgggtaccttcacaagcaggccaagttatggattgtctcatagggatttgaagcccaggaacgtcctgttagatcatgacatgaagccaaagcttgctgattttggatcggctagaactctgacttcggattccgctgaagagtgtacaagcagggttgtggggactagtggctacaaagctcctgagtacacgtctcgaggtgtctattcactgaagacagatgtgttcagcttcggggtggtggttctagtgaccatcagcgggcgagagaacaccatactggagaagcaaggagactctgttggcacccttgtacgagatgcctggcagctatggaacgatggaaggctgcatgagcttgtagatccagtgctgggtgacggattcgaacttgctgaggtggtgcagtacgctcaagtggcactgctctgcgcgcaggaggagccagcagatcgtcccaccatgtccgacgtcgtgtcgctcctgaactttgaaagcataggtctgctgccagatcctaagcagccgtctgagctttgtaagggaggtggtggtacttctggtgacaggttgccgacatgtggtagccagtcgagcaggaccatagacatcacaatcacaagttcggctcctgtgtcaactagaactagggtccgcatcattgtggacccagagacctaaaatgtagacataaaccgatgttaatatgtaaaagaacatggacaacttttagggcgaaaaaaaaaaaaaaaaagccgcccaaaaaaaaaaaaaaaagcggcc

SEQ ID NO: 10776 - DNA, 1220 bp, Zea mays
aaatccaagtcctttctccaccgaacctcaggaactagccgttgcccgcacctctccacgtcgcgcttcccatggactccgccaccgtggcgctcgccagccccgcctccgacgaccgacggttctgggaccgcctccgcacccgcgtcgacaccatcctcgaggaccgccgtggcctcccgccagccgccgccgccggtgcccccatgcgcggggtggaatctgagcgggggaagcggctccgggaggactccctgatgctcgtccgtggcctcgactctgtggcggagtctctggcacagctctccgacaccctcaccgccgcgcagaagggagtgagtgctctcgcgacctgctcttcgcaggcgaggggatgcgaaggcggcgcctgcccctgccccgaggaggtgaaggcagaggaggaggagcccagggcgaagcggatgtgtggcggctccacggaagattctccacggaacggcctggacagcaattctccggccgctggagaggaaacggcggctggtcctgatggtctggggaaggggaatgtccaggcctctgctgagatcgcacagagcactaacctgaagcgggccagaagtctggcggtgtcaatggcaagcagagccgctgcactcgctagggagctcaagaacatcaagtcagagctgcacttcatgcaggagaggtgcggtttgctagaggaggagaacaagaggctcagagaggggtgtgacaatggagttgcccctgaagaagatgacttggtgaggctgcaactggaggctctgcttgcagagaagtcgcgtctggcgcaagagaacgccaacctgacgagagagaaccagggcctgatgcagctggttgagtatcaccagttggcatcccaggatctggatgagtcctatgaggatgttatgcaggggatacggcttgacttctcgtcaccgctggggaagatcagcgacgatgaagaaggcgagcgcgacgatgaagttccggtcaccccagctgaggtgccatgctcccccgacgagtaggcaggcgaacgggaggaataagatgggttttccatcgatggaattcctttgtaccaggtgccaacagtaggcagtttttttttcctatgtgatcactaccggtggccagtttttgatgtttctatgatttatataaaaacttctatgtgtagcaattttatatgatgcatcttgcac

SEQ ID NO: 10777 - DNA, 2492 bp, Zea mays
aaattcggcacgaggcgcaccgctcggctccccgccaccgccgcagccgagatggaggacatcgaggacgtgctgggcgcggccggcctttctggcggcggagcgcctccggggctccgcctcccgctagccgccgtcgcggtgaagcccaagcgccggtcgtccagggtcgcacaggcgccgcctcagcccgaggccgggatccccggcacgcagacgatttacgtcaagacattcgggtgctcacataaccagagtgacagtgaatacatgtcaggtcagctctctgcatttggatatgcgatcactgaagatcctgaaggagccgatttgtggctaattaacacatgcacagtgaaaaatccaagtcaatctgcaatgacaaccctcatatctaaatgcaagaatgcgaacaagccacttgtagtggctggatgtgtaccccaaggaagccagggcctcaaggagcttgaaggtattagtataattggagttcaacagatagaccgggttgttgaagtggttgaggaaactttaaagggacacgaggttcgcttgttgagtcggaaaacgttgccgtcacttgatttacctaaggtaagaaagaacaagtttattgagattcttcctattaatgtgggatgtttaggcgcctgcacatactgtaagacaaagcatgctcgtggccatttgggaagctatactattgacagcttggtggatcgtgtgaaaactgtcgtctccgaaggtgtccgggagatctggttgagcagcgaagatactggtgcttatggacgggatatcggtacaaatcttccaaatttgttaaatgcgatcgttgcggagcttcctgttgaccaaagcacaatgctccgcataggcatgacaaatcctcctttcatactagagcatttgaaggagatagctgccgttttgtgtcatccctgtgtttactctttcctccatgtccctgtgcaatctggaagcgattctgttttaaaggtatagtttaactcgaactcttgttctcataagctttttagcagcaaacgcacaacatgaataatctttgtctctaacttatatcctgtgccttcacctcgatctaactcagtctatgattgcacatataaggcaatgaatcgtgaatatactgttggcgagttcagaaaggtagtcgacactctgtgtgagcttgtccctggaatgcaaattgctacagatattatctgtggctttcctggtatgccaagcaagttctcagtttagcgattcgctctgagttatttttttatgagtacatctgaataatatttgattaattgaatgccacaaaagatgttgctgctaatagtttgcactgaaccgacatcccattttcaggtgagaccgacgaagatttctctgagactgttaacctcgtaaaggaatatcaattccctcaagtccacatttcgcagttctaccccagaccaggtaaattgttcttccccaagccgcaatgttctgtaaaactacaagtcgtggttgtcgatatccttttcgtacacatacatctacaacgtgatctttgtagggacgcctgctgctaggatgaagaaagtaccaagcaacgaagtgaagaagcggagccgtgaattgacttcagtcttcgaatcgttttcgccataccaaggaatggaaggcaaagtagagaagatctggatcaccgagattgcgtctgatggtgttcacctggtcggacataccaagggatacatccaggtgctggtaactgctcctgatagcatgttgggaacgtccgcggacgcgaagatcacgtctgtcggacgatggtccgtcttcggtgtagtggtagaaggatccgttgcagtcatagaagcaccaatacaaactagtgccgaactgcaggaggaacacgtacagaatcaggtggaggaagctagctgctgtgccaccgactcctgtggcgcctgcgcgtgctccaatgaggcgcaaccgtgtggcccagaccgatgtggagacgcacctcgtgccccgcagacctgtggtggtgacgttgttacaactcgccaggaggcactccagcctacgctcgtgaggagaagcgtagatggaaccacgaaaggaagcgacagtactgcggcgcattcagcagggaaggaagtagtgactaggcgtggggtagatatcgacacggttctgtggtgcggtttggccgcgagcttcgctgtaacggtagccctgcttgcactcctcaccagcaagattttgtcgacgacatcacactagggctaataaggcgaagctttgtaacttgtggtttggttcttgagcgtgtcgctggatcgatttttgcggtctctttctttacttgatccgcctgtatgtcgttgcaaaaaaccgtgccactgtatacaaaaacacatggttgcaaacgagttttctcgttgttttaaaaaaaaaaaaaaaaacccgaggggggaacccgg

SEQ ID NO: 10778 - DNA, 2548 bp, Zea mays
  misc_feature (986)..(986): n is a, c, g, or t
tccaaggtgtccggaagttctggttgaccaccaaaaatcctggggcttttggtaatctcattgtccagtcctttctgggtcttctaatgatagatgcatggtacctacatggtaatttcctacttctggcttgcaaaattttcaggacgggatatcggtacaaatcttccaaatttgttaaatgcgatcgttgcggagcttcctgttgaccaaagcacaatgctccgcataggcatgacaaatcctcctttcatactagagcatttgaaggagatagctgccgttttgtgtcatccctgtgtttactctttcctccatgtccctgtgcaatctggaagcgattctgttttaaaggtatagtttaactcgaactcttgttctcataagctttttagcagcaaacgcacaacatgaataatctttgtctctaacttatatcctgtgccttcacctcgatctaactcagtctatgattgcacatataaggcaatgaatcgtgaatatactgttggcgagttcagaaaggtagtcgacactctgtgtgagcttgtccctggaatgccaattgctacagatattatctgtggctttcctggtatgccaagcaagttctcagtttagcgattcgctctgagttatttttttatgagtacatctgaataatatttgattaattgaatgccacaaaagatgttgctgctaatagtttgcactgaaccgacatcccattttcaggggagaccgacgaagatttctctgagactgttaacctcgtaaaggaatatcaattccctcaagtccacatttcgcagttctaccccagaccaggtaaattgttcttccccaagccgcaatgttctgtaaaactacaagtcgtggttgtcgatatccttttcgtacacatacatctacaacgtgatctttgtagggacgcctgctgctaggatgaagaaagtaccaagcaacgaagtgaagaagcggagccntgaattgacttcagtcttcgaatcgttttcgccataccaaggaatggaaggcaaagtagagaagatctggatcaccgagattgcgtctgatcgtgttcccctggcaagtgcataccaattctttcttgccattaattgctgactatgttcgtgccggtgcaaaagcttaccctgaaacgatcttttttcctgcacaggtcggacataccaagggatacatccaggtgctggtaactgctcctgatagcatgttgggaacgtccgcggacgcgaagatcacgtctgtcggacgatggtccgtcttcggtgtagtggtagaaggatctgttgcagtcatagaagcaccaatacaaactagtgccgaactgcaggaggaacacgtacagaatcaggtggaggaagctggttgctgtgccaccgactcctgtggcgcctgcgcgtgctccaatgaggcgcaaccgtgtggcccagaccgatgtggagatgcacttcgtgccccgcagacctgtggtggtgacgttgttacaactcgccaggaggcactccagcctacgctcgtgaggagaagcgtagatggaaccacgaaaggaagcgacagtactgcggcgcattcagcagggaaggaacagcgggtggaagtagtgactaggcgtggggtagatatcgacacggttctgtggtgcggtttggccgcgagcttcgctgtgacggtagccctgcttgcactcctcaccagcaagattttgtcgacgacatcacactagggctaataaggcgaagctttgtaacttgtggtttggttcttgagcgtgtcgctggatcgattttggcggtctctttctttacttgatccgcctgtatgtcgttgcaaaaaactgtgccactgtatacaaaaacacgtggttgcaaacaagttttctcgttgctttcgggtgctggctgcatcaatgatcagggttccatgaaggtgaagtacattatgtgtgtttgccaccgtgctaaaaatagccgaaaaggggagcaggtgctgccaaacgaacaggtcggagaaacgattgagcaggagggaaccagacaacagcagcaaacagactgaagcacaaaaaatcggaagaataaaaaaattctttatcggagccaggtttcgatcctgggacctgtgggttatgggcccaccacgcttccgctgcgccactccgatctacgttaaacagcttgaacataatattatatatgcgatgccaacagcccacgtacagatgtacatccccgccccgccgtcaagactgaaaatctcacttgcctattaatttgtgattcagtaggtgctgctcggtctccataaggtaccatgtgaaacaagaagaaagaagtcttggccttttttctgacttggtcatgactcatgagtacacagttcaaacaatacactacaggaagtgaacgaacagctggggttaacatagatgtcgccgcaggttgcatgatgcaattttagcagagatgcctctagtagcaactgcaacagataatcgccagcaggggatgtagaaagtgacaga

SEQ ID NO: 10779 - DNA, 1582 bp, Zea mays
ttttaaagggacacgaggttcgcttgttgagtcggaaaaattgccgtcacttgatttacctaaggtaagaaagaacaagtttattgagattcttcctattaatgtgggatgtttaggcgcctgcacatactgtaagacaaagcatgctcgtggccatttgggaagctatactattgacagcttggtggatcgtgtgaaaactgtcgtctccgaaggtgtccgggagatctggttgagcagcgaagatactggtgcttatggacgggatatcggtacaaatcttccaaatttgttaaatgcgatcgttgcggagcttcctgttgaccaaagcacaatgctccgcataggcatgacaaatcctcctttcatactagagcatttgaaggagatagctgccgttttgtgtcatccctgtgtttactctttcctccatgtccctgtgcaatctggaagcgattctgttttaaaggcaatgaatcgtgaatatactgttggcgagttcagaaaggtagtcgacactctgtgtgagcttgtccctggaatgcaaattgctacagatattatctgtggctttcctggtgagaccgacgaagatttctctgagactgttaacctcgtaaaggaatatcaattccctcaagtccacatttcgcagttctaccccagaccagggacgcctgctgctaggatgaagaaagtaccaagcaacgaagtgaagaagcggagccgtgaattgacttcagtcttcgaatcgttttcgccataccaaggaatggaaggcaaagtagagaagatctggatcaccgagattgcgtctgatggtgttcacctggtcggacataccaagggatacatccaggtgctggtaactgctcctgatagcatgttgggaacgtccgcggacgcgaagatcacgtctgtcggacgatggtccgtcttcggtgtagtggtagaaggatctgttgcagtcatagaagcaccaatacaaactagtgccgaactgcaggaggaacacgtacagaatcaggtggaggaagctggttgctgtgccaccgactcctgtggcgcctgcgcgtgctccaatgaggcgcaaccgtgtggcccagaccgatgtggagatgcacttcgtgccccgcagacctgtggtggtgacgttgttacaactcgccaggaggcactccagcctacgctcgtgaggagaagcgtagatggaaccacgaaaggaagcgacagtactgcggcgcattcagcagggaaggaacagcgggtggaagtagtgactaggcgtggggtagatatcgacacggttctgtggtgcggtttggccgcgagcttcgctgtgacggtagccctgcttgcactcctcaccagcaagattttgtcgacgacatcacactagggctaataaggcgaagctttgtaacttgtggtttggttcttgagcgtgtcgctggatcgattttggcggtctctttctttacttgatccgcctgtatgtcgttgcaaaaaactgtgccactgtatacaaaaacacgtggttgcaaacaagttttctcaaaaaaaaaaaaaaaaaaaaaaaaaa

SEQ ID NO: 10780 - DNA, 1699 bp, Zea mays
gtcctgtcccaaaccttgaccctgaaccaatcaaacttatttggcaaacttatttgagggatcgtctcatcccgtcccgtcctgtcattgcaaccaaacacatcctaaaaaggctaaataaaacaaggctttgcctgtgctactatgattcgtattatggtctatcaggagatggcatataccttattgaagctacccagcattttttttttttttttgctcctaatactccactagaggcacttcagcaagaaaattgttcatgctgtccagtttttgccacatctactgctatcttcttgcagaattgttcctttacatccaacagagattaaagctcaatagtttgttttgcatatgtcaagtgaaatcacttaaggtactctgtcagagatcatgtttgaaccacgctgccttcccacaatctgcaacaattctgcctcaatacaatcctcatccttacaaacgcacctgatcactgaactccagctctcaacatgcggaaccactccaagatcaagcatccgactcataatttgtgcagcctcttctactttcccaactgtacagcaacccctgataactgaatgaaacaccgagaaatgtggcacaagccctttaccaaccatgtccaccaggtaggcctccgccttatcgtataatccgcttacgcacagcccattcaccactgtgccatatgtcactgcattcggtgtacatccattgtccatcatatcaacaacaaccttgcaggcatccagtggccggccctcgcggcacatgccaacgatgaccgtgttgtaatgcacaatgtcaggggagactccacggcctcgcatgagacagagcaggcggtatgcctctcggagctgcttcttgcggcagagagcgttcagcacggtggtgtacgccagcggatcggcagggatgcccctgtgcagcatttcgtcgagcagtgtagccgcggtgcggacctgggccttgcggcagagtgattgggtaagaatgcggtaggtgtcggcgtcgggggatacatggagtgagcggaggcggtggaagagcgagagtgacacggcgacgtggccggatcgtgccgcggcgtcgattagcaggttgtgggaggcgaggacgagcggagcggggagaggtagccgcgaagagacgaggcgaaggaggtgaagcgcggacgggaagtgggatggggtggaggatagaacgccgaggaggcggaggaggagatgggggtggagcggcagggggcttggccccgagacgaagagggagttgaaggtggagagaaagagctgaggcggccggcggagacggagcgccgcgaggagaagcgggagaaggaggcgcggggacggcggggacgggaggcggcggaggagcgcgagcgcgtggggtaggtggtcgcggcggcgggcgaggcggagcaggagagagtggagcgtggcagggtgcggcgtggtagtcggggaggtgacgttgacgagctccagcgcgaggagcgggtcctgctgcgaggtcaccagcttgtgcagccgcgccggcgaggtcgccggcggcgatgggagcatcgcatcggtgtggagtagcaatgggttggacggttggctatacctatacagacgccgcgcccggccccgccggcttcgagggttggttttgtgggctggtagcattacggacgcgtggg

SEQ ID NO: 10781 - DNA, 974 bp, Zea mays
tattgccaaaaaaaaaactacggttccggctttcggtggctattcttgcatctgcaagctccaccagtcacagccacacggcggaaaaacgaaccgaggaacaatccgggttctgcaggaacccactccaactgtgcggcgcgtccaaaaatacaaaaggcaagcgagcgagctccaagttcggctgctccaatttcactcggcatggctcctcaggcgtgggtcgtggcggagaacggcgaggacctccaacaacccagggaattcctgccgctctctaagcttgaagatgttggcgtgttgtattggcatttggaccctaagaagtctgaaagcgaggaggaactagcaaaaatccgcagagacagaggctacagttacatggatcttattgagatatgtcccgacaaactggaaaactatgaggagaaggtgaagaacttcttctgtgagcacatgcacgctgacgaagagatccgctattgcttggagggcagcgggtactttgacgtccgcgacaaagatgacaagtggattcgaattcggataagagaaggagacatgatcatcctaccagctggaatttatcatcggttcaccctcgacagcgctaaatacacgaagctcatgaggcttttcattggggaaccagtctggaccgcgttaaaccgccctcaggaggaccacccggcgaggcaagagtatgtcaagaatgtgagtgcgggcactggatttgctcttgcagcacactgaatatgttttttccctttcccgtgtataagaatatatggtcacttggattcatgtaccacgtcatagtatcatcatatggtatgacgcaaccgtattttatcatcaggagtcatgaaaccttgctgcgtgttcagttaaatctgtgcacataaaactgcaaattatgggaacgcacggtgtaactcaggagtcatgaaatcaggagtcatgatcttatggtg

SEQ ID NO: 10782 - DNA, 1765 bp, Zea mays
ggaggaggaggcgcgcctcgccgagatcgccagggaggaggcgctattcggcacgaggggcgcgggcgcgggcgcgcgggggcgcgccgcccgagctcctcgacgtgctgtgggaggcccggcgcagctccgtgcgcctccgcgcgctgcagcagcgcaaggaggccgcgcacgtcctcgagctcgagaggcggttcaggctcttcgacgacctcatccagcgggcgtcgcgtcttctgtcccccggcggtggtgccggggccaggagcggcacgggtggtgccgcggtggaccacgacgaggtcgtcgaggtcgacgccacccggaacacggagctggacgccgcgccagccgagattggtcgcgggagcaagggcggcttgggactggaacccaagtccgtctcgtcgctgcgtcgtgctgcttcggcaggtactgacacagaaaagctgggccttatccaagtggcaagccttatagagtcatcggcaaagaaggggactacagagctcaatctccggggtaagctggtggaccaagttgaatggctccctgtctcgcttgggaagttacaggatgtgactgagcttgatctatctgagaataggatcatggcactcccatcaacaattggtagccttagatacttgacaaagctcgacctccactcaaaccagctgatcaatctgcctgataccttcggggaactttccagcctgattgatcttgacttgcgtgcaaaccagctaaagtctcttcctacatcatttggaaatctcacgagcctcgccaatcttgacctgagctcgaatctgttgaaggtccttcctgattgtttaggaaagttgaaaaacttgagaaggttaattgctgagacgaatgagcttgaggagctaccctatactattggatcgtgcacctctctcgtggagcttagactggattttaatcagctcaaagccctcccagaagccattgggaagttggaaaacctggaaatcctgacgttacactacaacagaatcaaaggcctgcctacaacaattggccatcttaccaggttgagggagctggatgtcagtttcaacgaagttgagactatacctgagaacatttgctttgcagccagccttgtgaagttgaatgtcagcaggaactttgccgacttaagagccctgccaaaatcaataggggaacttgagatgctagaggagctggacatcagtagcaaccagatacgagtgcttccagactcttttgggcatctctcaaagctacgtgtgtttcatgctgatgaaactccactggaagtaccgcccaaagaagttgtaaagctaggggctcaggagctggttaattatatgaagaatatggttgctgcaagggaagtgagccagaatcaaacagataagaggagcttctggacctggctccgctcactgtttggttgttacaaaaagaatcaaggattgggaccagttccagcctagctgaaccatatcgtccgcatgtattgtcatgaattattcagttttgctccatctctcaagtcagcgacgaaatgaggcatgactactattattatttcaactttatgtttgtgtatacaatggataaatattgtagcgctttcttgtacataagattaggttatgtgtaagttcatctgtacgaaacactatcatgttaatccatgaaacacgagctgccgaatattactagcaagtactacagccgtgcagaaaagaattccgttccaatagaa

SEQ ID NO: 10783 - DNA, 1324 bp, Zea mays
gcgaacccgatggcgccgcggtacggggacgaggaggtccggtggctgcaggcgtcgccgcaggcctcgccggagatggactacagctccggcggctcgggcacgccgtcgccgcagctgtgggcgcaccaccaccagctccaccggcagtacccggcgtcggcgggcagctcgccgtcgcgggcgcaggccatcgcggggtaccgccgcgagatgctcgacctcgtccgcggcctcccggagtccgcctacgagctctcgctccgcgacatcgtcgagcacccgtcgcccccgtcccctccccacgcccctaccaaccctctgccgccgcctaccaccgccggaccacgcgcgagtcgcgccgtccccgtcccggcgcaggagaagggcgagtccgccggcgccaggaaggacgccgtcgcggcggcggacgccgaggacggcggcggtagcaggaagcagggaggctccaagggcaagaagcaggggaggaagcagaggacgatgcggaagcagcggagccggagcctggaccgcagcgtcagcctggacaccggcctgctcatcaagctcttcctcccgctctccctcggcggcaagaagaaggtctcgcccaagcccgacgccgccaaggacagcaagaagaagaagaggaaggagaagaaggaggcggcggtgcaggaggaggagtggtggaccaagagcgagttcagcgaggccgggaacagcagccggaccagcagcagcaacagcaacagcagcgccgccagcctcaggaatgccaatggcgccgccaatccgagagcgccggacaggagctggagcaggaagcggaccgggtgctacgctttcttcagggcgaacaagggcaagaagaacgaagccaaccaggactagagctagtgatgacgacacggcctctccatgaaacacggaaagaagaagtgtttctccggtgaaacgttggtggtggtcgtagccatcagcagcggcgtcacgcatgcagctagcacaaggaagctcgagcaagcagcagatctccatactgccgtaccgtaccctaaaattgatgctgttcagtgcctggtttctgcacacgagtagtggcggctccggcatcgtcgtcgtcgtcgtccttttcctttctgttctggcatgtgatcttcatggtataaacagagaggacatgccatgtgtagcgtacaatagttttgactggttcgcacagctcgtacagaaatactgtattgatatggacggcacgccggaggcagtgacaccaatggattaatacttgcaatcccaaaaaaaaaaaaggccccta

SEQ ID NO: 10784 - DNA, 1049 bp, Zea mays
  misc_feature (140)..(141): n is a, c, g, or t
  misc_feature (143)..(143): n is a, c, g, or t
ttttttttttttttttgcgctaaaatatgtctcctttttttcattcattcacagagtgattctcaaattccatcaccacgcatagctagccctcgctaattcaagcttgacaccgaaagaagaagagaaaaaaagaagannangaggaagaccagcagctagaactgaacatgacaagacgcactagaagatcgaagcagagaagacgagcaggccaacaggccgcgggcagtgagtggatttcaagcatctctagggtccaccgcctccggccgtttggccagcttcaccatgctccgctcgacggcgccggcggagctcttgcaggagaggccgaggcgcgcccacgcgaaccggctccagccctgcctctgcctcggcgcgccggtgccggtgccggtgccggtgccaccggcgtccccgccccctcctcctcctctgctgccgctcttggtgcacgccaggtacgcggccaggaacgggtcgtcctccggccgcacggcgcggccgccggccctcgacgacaggctcctcgccgcggcccggcccggcggcggcggcaccgcgagccgccgcgccgccttcgtcgtcgggctccccgccggcgtgatgacggcggtggtgtccccgacgccgccttccggccttttggcggtgacggtgacgacaggctcccacgtgaagaccacggcggcggccggcggcttctgcacggccgctacttcctcctgctgccccatcgttggcacgcgaaggctgtgtcctgccgtcctgtttgtatattggaatggattgtctctctgccgcgtgtgtgtttcttggtgtgaggagacccagacggaggtggaggaaggggggaaaaacggtggttggcgctcaagggagaggaggttatcggcagagcactggcatttagggctagtgcaacaagtgatggcgatggtggtggtggtgatggtggtcatgcaaagcaagcgtcgaatggatgccttcccttcccttgccttctcttctctcctgcacgacaaacgtgtgaccaaatggtaatg

SEQ ID NO: 10785 - DNA, 2316 bp, Zea mays
  misc_feature (1997)..(1997): n is a, c, g, or t
  misc_feature (2223)..(2223): n is a, c, g, or t
gtccctgtccatgaactcaagtttgaggagctggcgcagacccaccccgaggtcttgttcctctacgtggacgtcgacgatgtccagccctcacccaattaagcaattttgatgagcaagacaatgtcccaaacacaatcgtgggagcagcgcacggacatgtacatgagccccttcgtacctatggttgcagtgcagtgacactcatctagtgatacaaaagcccccgtcattacctttgacttgtccgattgtactaagttgggccaataataccaggcccaaaggcctaggaggaagaagataagggtgcccgtttctctcctcgacgacgacattctcaactctgaaacggcgatgtcacggctactcccgcccgtgctctctcctttaccggcgttctcgctgccgccgccgcttcttcctcgcatccacatccgcacgtcggcggtgagaggcggtgcggcggagaacgcgatggcgtccgggacgacggcgagggagcggcgcctggtcaaggtgcgggaggagcgccgccgccgcgagtacgaccgggagcacacctaccccggatgggccaaggtactggagaacgcctgcagggatgatgaagagctccgcgccattcttggtgatagcatcggcaacccggagctcatgaagcaacggatccaggaaagggtgcgcaagaaaggcagggcccaattcaataaatccaagacaggctccattgttgcttttaaagtcagctttcgagactttaacccattgaattctttcatttggtttgagctctttggagaaccaacagatcgagatgttgacctgcttggtggtgtagtccaagcttggtatgtcatgggaaggctaggagcttacaattcttcaaatttgcagctggccaactcaatgatggactacgacccttcatatgattctgaagaagcttccacagtaatgccatcatctttccatgatatcagtgatgttgagttccaagacaattgggccagggtttgggtggaccttggaacctcggattaccttggcttggatgtattactaaactgcttaacacagttgagctcagagcacttgggtatcaaacaagtggtttttggaggcaagaaaatgggtgactgggaagagggcatgacgagctctgattatgggatacaggcacttcaagatatgactcgagacccagctttcttgtacaaaaaaaaagcaggctcctgcaggaccatgtcacggctactcccgcccgtgctctctcctttaccggcgttctcgctgccgccgccgcttcttcctcgcatccacatccgcacgtcggcggtgagaggcggtgcggcggagaacgcgatggcgtccgggacgacggcgagggagcggcgcctggtcaaggtgcgggaggagcgccgccgccgcgagtacgaccgggagcacacctaccccggatgggccaaggtactggagaacgcctgcagggatgatgaagagctccgcgccattcttggtgatagcatcggcaacccggagctcatgaagcaacggatccaggaaagggtgcgcaagaaaggcagggcccaattcaataaatccaagacaggctccattgttgcttttaaagtcagctttcgagactttaacccattgaattctttcatttggtttgagctctttggagaaccaacagatcgagatgttgacctgcttggtggtgtagtccaagcttggtatgtcatgggaaggctaggagcttacaattcttcaaatttgcagctggccaactcaatgatggactacgacccttcatatgattctgaagaagcttccacagtaatgccatcatctttccatgatatcagtgatgttgagttccaagacaattgggccagggtttgggtggaccttggaacctcggattaccttgggcttggatgtattactaaactgcttaacacagttgagctcagagcacttgggtatcaaancaagtggtttttggaggcaagaaaatggggtgactgggaagagggcatgacgagctctgattatggatacaagcacttcaagatatgactcgtgtcccggcgtcctgcctacggtggtggatgcaaggctggccgagaaatttgatcaagactgagggccatctcgatgtgcccttgtatgtaaataaataaatttgtcatggggttttatttacatacaagggtncatccgagttgccagccaattttgcatccccaccaccaatccaccaccccacacccagtgaaagagacagaaaggccgggcagggctacgcga

SEQ ID NO: 10786 - DNA, 1483 bp, Zea mays
gtccctgtccatgaactacaagtttgaggagctggcgcagacccaccccgaggtcttgttcctctacgtggacgtcgacgatgtccagccctcacccaattaagcaattttgatgagcaagacaatgtcccaaacacaatcgtgggagcagcgcacggacatgtacatgagccccttcgtacctatggttgcagtgcagtgacactcatctagtgatacaaaagcccccgtcattacctttgacttgtccgattgtactaagttgggccaataataccaggcccaaaggcctaggaggaagaagataagggtgcccgtttctctcctcgacgacgacattctcaactctgaaacggcgatgtcacggctactcccgcccgtgctctctcctttaccggcgttctcgctgccgccgccgcttcttcctcgcatccacatccgcacgtcggcggtgagaggcggtgcggcggagaacgcgatggcgtccgggacgacggcgagggagcggcgcctggtcaaggtgcgggaggagcgccgccgccgcgagtacgaccgggagcacacctaccccggatgggccaaggtactggagaacgcctgcagggatgatgaagagctccgcgccattcttggtgatagcatcggcaacccggagctcatgaagcaacggatccaggaaagggtgcgcaagaaaggcagggcccaattcaataaatccaagacaggctccattgttgcttttaaagtcagctttcgagactttaacccattgaattctttcatttggtttgagctctttggagaaccaacagatcgagatgttgacctgcttggtggtgtagtccaagcttggtatgtcatgggaaggctaggagcttacaattcttcaaatttgcagctggccaactcaatgatggactacgacccttcatatgattctgaagaagcttccacagtaatgccatcatctttccatgatatcagtgatgttgagttccaagacaattgggccagggtttgggtggaccttggaacctcggattaccttggcttggatgtattactaaactgcttaacacagttgagctcagagcacttgggtatcaaacaagtggtttttggaggcaagaaaatgggtgactgggaagagggcatgacgagctctgattatggatacaagcacttcaagatatgataaatttacaggtgacaagcaacggtggtgatgcaaggctggccgagaaatttgatcaagactgcatgcatctcgatgtgcccttgtatgtaaataaataaattgtcatgggttttattttatcgtcgtgatagcagtgaattttaactaacagctcaaggcaggctagcagaatagaaaaatataatatggatgcatgtcttgtttcagacacgtctgtttcttgatgatgatgatgataatgatgatgattcttgcaaaaaaagggaaaaaaaaaaaaaaaaaaag

SEQ ID NO: 10787 - DNA, 2922 bp, Zea mays
ctcggaacccgctgtatcctctagtttcgacctgcaggttagtatgtcgaaaacaatctcgtacaagctgtaaaagtttcccattgcctgtgaggctttcatttgtattataatggacgaatccctttgaggaacaaaaggcccttttgaaagccagctcgtagccctttgctagctacactgtgaaactgacctgtttttcagttatctctgttctttctctgattttcccctcttttctatagtgtccttcagaaaactcgcaggatggctatttcctgattatacaagtttcgttcactaatatttttttttaacaatataggtcatgtttgatacatgagttaattactaggtagttaaaattagttctagcacgtccaaatagaagggttaaggcgggctgattctttagccaagtcttcagttaggaagtacacaactagctaactgaccatagttagtttggactgatttttagttctagctagtagtgaggctatacgcagctgcaaacgaagatagcgttagatatgcagtcactctctctcctacttgaaatctttctctgtgcgtgtctcggaggtgggagagaagagagaaaagcgacagtgatggaggagagttggaaaaaaatgataaaatatatgattgttgatatatagttgagatatatagtaaatatgagtacagatgattgtattatagagtaaatgattttgcgacaatgacaaaatattttttttcttttagaatagaatgagtgtggatagcctaactagctacatatccaaacagactgttggttcatcgtatgcagctgatttcgacatcccatgtatgtctgtgcgcgccaacgcaaatattgaacgtgtcgcgtgtggtcctccactagatggaactatggacttggtggctggattttgttccatcaagggatgtcgaaatcagccttggatcttagcgctgtctgtactaatacaaggacgacacgtccgtcgtgctttatcttggcatgaaacgactagaagcaaagtagaaaatatacacggaagattcaggatttgttgtttctgcaataagttgggtacaagacagcttctttctaggtgtccttttattaatgttgatgatgattccctggatgactttactctgcatctgattaaggccataagcattgataatacgacatgcctctggtgctttatccagttcacgtaattacatgattttggaatactgcataaaaataagatcctcctgtctcaaaaaaaaaaaaaaactcagaagtccgaaccggcaaagcttcggcggacccaccaggcaccagctggcaggatatattcccatgcttatcttggcgttggcggagagtggattggcacacgctttcctttcctgcagacaagctgtaaatctcgccgagctcgtcgtcggagaccaaggagaagagcaagggggggcgcagaggcagaggcttgccagcctacctagctcgtcggggccctatggagatccagcaccaccgggggctgggcaactccaaggttgtgaaggtgcagagcgaggaggcgtgggatctgttcactgatcaagcgagcaacgagggccggcccgtgggtgtccccttccttccccctccctccctcccaccctccggcctgcttcttcttctgctcttgttgaggggtctccctttgttcagttctcgaagctgcaatgatccccctgttgatgatttgggggtctcaaactcccaatcgctttcgattcggaccgttctttatccctgttgtttacagtcgtgctagaaacggtagatgcgcataccaatcgtaacgccattgcttctgtgtgagattacacgactccgaagcgacctgacctctgcagatgtggccgtgctccttgctcttcatgttcatgcagtgtacatctctctccgtttccacggcagaatcagtagaattggggggaaatagtagcctgatggcaggtgctgtattgctagtgaacagcgattctgcaccgacgggttcttctttttttttttttttttttggatccaaagagcctgacaaacctatccggctatcttgtgcaggttgttgcccatttcggggcgtcatggtgcgtgacgtccctgtccatgaactacaagtttgaggagctagcgcagacccaccccgaggtcttgttcctctacgtggacgtcgacgatgtccaggtaaacaaacagcgctttgatcctgtatatgtatatgcaggtctcatgtcttggttttccttaggtcccctttcggattcttaggaaaaactggttgaatcactgtgagacggattagacgagaaacatttcacctggaaattactagaaacgcctctcttgcttttatgcctcgcaaacgcacgattctgattctcgtctcttttctccattggcaaccatagctttttggttagttcttctataatttagtaagttcaaatacgttgcatttagttgttctaggaacaccaaaaactgtataattatttgaataatatatttatatgatttttatgggaaaaatatattcttttgatcataatctaacttaccagccagattgttttcatggagtacttctgattctaaaaacgtttttttaagagaatataatctacccacgcactcttagtccagacttctaacaaaaaagcagaagataaaacataaaagcagttgtttagactgctgcagcggtaatctatatagacaaaaaccctataaaaacagtagaagccggtacagattaaaactaagcgaacagtctgaaaagaaatgctaaacttttatgtatgatagtctggatggtttatatatttgattaataatatttttttgcgttcaaaaaacaataactatacatttcccct

SEQ ID NO: 10788 - DNA, 4163 bp, Zea mays
  misc_feature (1002)..(1002): n is a, c, g, or t
  misc_feature (1850)..(1850): n is a, c, g, or t
gattcctcccagtctacgactcaatagccgtggaatccatcccggccacggtcggaggaagtgactccgccgcgggccgccatcttcgtcggtgatcttttctcctcaagtcaacaatcaaggcaacgatctaccacaaaactttgttgatctaccagatggcgatcaagacaacgatcaagaaaatgtacaaggcaataatcttagagatgcaatagcacaagaaacgtggaatgattaccaacaacataaaaattagtggtacatttgttgagctatttgttcgtagaaactgtctttgtttattgttgcttcctaatgaaaaacatgttacagatgagcttactttgaagatatggttccctgtaaccactatgcctcctaattatgtcatgttgctgtttatgtcatatttgttgcttcctaattagtggtacatttgttgtggtattgttgcttaaacaatctgttgtgtgtgtattgcttactctgaagatctggttggtttgtaactacaagtaggacatagattctttattttgtgaaatgtttcagttatagcaggttttataaacagcggcattcatcgttttcggcccatgcagtgccacatttcataatatgtggtgcattgatctttttatatgcatgcaacatatgaatacacatggtgtaagcgaacattgaaaaatgagtcatgtagtattaaatcctagctcctagctgtaactgaaatacacatggtgtaagtgacatgggatgggattcactccatcccaatgtgtattggattcaagtgtgtattaaatactagtatgtcgaaaaaggcctaaatgagccatgtcttgaggggtctaatgaataagatacaatgcttaaaatacatcgggttgtatgaacgagtttcttagaagtatctaatacttagagaaccacaacatagtatctaggttatacatacccttacaacgcaaaatcggcttcggagttcagacacatggnacataggcagtacaaaccagacacgcaacacttagacaagcacggaatggacgtatggacagagtttaagagggtatgtttggatcatctggcaaacagtttgtcgggtagcaccgtacactccaaataggttagctaataaattggctaattgttagccagagagctggcaaattatttgctcaccatttgatcatgctaataggtgctaatagatcataaaaagagaaaaggatgatccctatcctagtcggtttctttcatttatctcttggttcattgtttgacatgcaaggataaacaaaatatttactatgtttagacatatattagctaagactccaaacataactttaataattatttgccatataattatttgtcgccttgctggctaattaattagctatgaggatccaaacatggtcttagactactttgatgatatttaatcttgcgaccaggtagccattgttgaagagggttagagcaagacgagaagggtccgtggcgatccaatcgctcccttctgctatgatttttcggctggctcaagcctgccgctgaagaaaaccgacagtcatgcagctagactcgttagaaccagtttataatatatactgatattaattatgctacgcgtcgaaggtatttatgcattgcggtacactacgtaaaaatcaacaaaggtttacataaaatgtgaataaaaatatcataaacatacaaaagatggaagaagagccatgactgacaatgtatcataaaaaatatattgactttggtataaatatgtatacaaaatatcataaaaacagggccgccgatccatcaccactcgcgcctanagaatttcgtcgtcgtcgctctcgcccggagaaggccggcgctgttgtgggaggtgagacgccagcgtgcgccactccggagcgcgtgcctccgagggagccgacatcacatggacgcctctaggaaactatcgacgccacgcctctagatcggagagccgctgtcgctacgcctctggatcgaggaactgcagtcgtcgtgccaccggatggaagctacgcctctggatcggagagccttcgaatggaagctattcggttttcagtcagctgtttggttgtagtcttaatgccttttctatttcccgtttggttgtgtagaattgaggcatgtcgaggtgtacgtccaaatgcatatgctggaaaggtatatcagctgcaactgtttgtcagcagaaccagctggtggagacgatctagagcctcgagttgtggttgcttcaggcgattcatctgaacccgtcctataccaagtactagaaagctctgctatagcaaatatacgtgtagccttttgtctcacaggtatcgtccatgcgcattctagcaggcgacgcgtccgtcgtacgatgctcgtgctttgccgctcctccactaacggtgtcaaccggattactccaacaacatttttttcaccaaatgtgagaatgctaagaactttgttatatctcatccttgcagccctcacccaattaagcaattttgatgagcaggacaacgtcccaaacgcaatcgtgggagcagcgcatggacatgtacatgagccccttcgtacttagaaaaaattgctattttagtccttctaacgtgggctctctggtattatatgaccttctgtctatgacttgtgggaccatttgtgtctatgatttgtaggcctgatggtaaaatagagaagtccacaactgagagtgacaaaatagcaaattcccctcgtacttatggttgcagtgtagtggtaaaatagctagattaaaataacaaagtttatgtataactaagatcataaatggattatgaaacatttcctcgtaacaatgtaacatatttatacataagttattgtggtaatatatattcccgttgcaacgcacgggtactcacatagtaaagaattatgaggtaaataaagtaatatatgagatctaggtgtggccattttctacattcctccctcatagtatgattcttaccggcttatagtggcgggattgtgtctgaccacatgacccgtcgacttcagggtggatccattcctccgacgagcaatgccacggttccccgatgatgttccctcacggagaggttgcagacatgcacggtgtataccatcgaccacccccgcccgcatgctgggcgtagatcaatgacatagtcgaatctccggtacgatgctccccttctctctcccagttttcgctcgagaacaacgtcatctaatctctattggtgcggcacacagcagcctatctaggctggcgaggtgatcacagggcatctataaataagcaggatgatgattgaatcccaaccggctcctaacaattcgcttggttgttacagcctagaagcagctcgttccgacgggaatatatatctggctaacatgccccatctcgagtaaccgttctaggaaactagtgcgtcagggccgagcgcatagttagggccagactccgattcatgcgggagagctaagttgtggtccagccatgtagcaaaatgaacaaagtatggctgacacacaaaccatgagcatagcgtatgttcggtggaattaaagggaaaaaatagaaaagggaatgtgggccgaaacgaggggtgaggtgggccagccattttatttcttttttatattttatattttcagttttcacttcttttttcattccaaatttaaatttcagtgaagtttcaaagtctaaattaaattcacaatcaaactaagcatgatgcaaaatcttaactttatttatttattatcctatttaagaaaaatgcttttaaatgtgtaatgcaaacaccaaaactggtatttttaagaattttttatgcataatccctattaagagatgatttaacttaatatttatggtcctaaacacaaagttcataagaggtattatttcctcaaataaataattaaggaatctttctatttatttatttaatattccattaattgaatatgcacaaagaaaaggagataaagaagttcccaaaactctagcatataagcatatttatttatttatcctatcatatttctcttatacaggttttgggctttacatatgtctagaaagaaaaaaa

SEQ ID NO: 10789 - DNA, 2149 bp, Zea mays
tggaatttcttgggaaggactctgcagctgccatgattcagaagcttcctgatcaactcaattacaactcacagttgaaattcattatctctgcattggatgctttgcatccaaccaaacgtctccagctgcctcagttgaatatgcctcctaagcgtacagcttatgaagtgatgagtgaagtacactcgaatattgctcttgggaaggctgtaagcattttaaaatactgttctatatttctatggaaaactagtttattttgaatacatgcttgatgtactaatatatataaaaaatccttttagattggtgtgggatttgacaagcctctgagggttgatggtagtttgtcttacctgaaaaaagtactgcacatgtatcctgactgcagtttagtgaggtgattttcttgctgggaatggtcatatcaggtgttcaaaaggttactaaacttgaggctcgagtcaaaatgttgctcaccattttctcatgatgcagaaaccaacttggatccctgctgctgtggagtggagattggatggcttctcacaaagcaataagggttacctctctgtcacatgggcacacatccagtatgggcctaagatcaccacatcacattcaagcctgtgcaatggtttcttgctatgctacctgctgcacgtacacaaagttctcttttgcaacatgtgaacaccagtacctaagtggacctgatgcaatacaccacctgccaaggtacatcttctacttgttgcattgacaatgtatgcctttggtaggagagctattcatgttatttttttgccttcaaggtgggttcattgtgaaccatggaaccaagatgcacgctacctgcttgtacttgccattttccaaaaagcacatgaagagaagtaccccaaacatacctgtgttattctgaagaagctcattatgcaagtgttgtccaatattagcaatccacatgagaaagaagctatgcagtatcaggtgttcctgctacttcttctgtcatcagaggtctgtttgcaatctttagactatgaaaactgcatcaccgaagctaaagaagctctaaaactcaccccgtcaagccgtgtggatactttttttgcaaatttgcaactgtgtcgggcctatgtggtgcatggggatcttttgaactccaggaatgagtacatgaaatgcttgagaaaccatacaaatactgagattggctgggtaatgctgaagcgacttgaatctgcatgttctttggagggcttttctgacgaaatagatataaaactgcatgaatgtgttaaaaggaatggcagcgactcatcaaaatggacatcccttttcaatctggcgtgtgctcagtgctttctgtggggtggaaactttgaaagcgctgaaaaagctcttgctcaggcatgtagtcaagtagatccggatagctgcatcttgttccttaatggtgcaacctgtatggaaatcgctcggaggtttgtagctcctcaatttatatcccgtgcagcttccagcctcagaaaggcccagcagaaatcacatgcttcactacctctcgtgtccctgctactggcccaagccgagggtagccttggctccaaaaccaagtgggaaagaaaccttcgcctggaatggttctcatggcccccagagctgaggcctgcggaggtgtacttccaaatgcatctgctggcgaggcagtcgtctgcagctgtttctcagcagaaccagctggtggagacgatccagagccccgagttatggttgcttcgggcgattcacctgaacccgtcctgccccaggtactggaaggctctgctgcagcaaatatatgtgtagccttttgtctcacatgtatcgtccatgcgcattctagcgggtgacacgtccgtcggacggtgatatattagttgagatcgctggggataagttcgtggctcgcatgtcgtagtgctttgtgctttgcgttgggatagtttgcacctgcaatgttttctgtcctttccaaaaggatactactggatcttggaggattattgtttgtcttttgttaattattgtaacttaagtttgcaggaaaaaaaaaaaatcatctcttggagtgtatctaacaattgtagctattgctagc

SEQ ID NO: 10790 - DNA, 880 bp, Zea mays
aagagtggattggcacacgctttcctttcctgcagacaagctgtaaatctcgccgagctcgtcgtcggagaccaaggagaagagcaagggggggcgcagaggcagaggcttgccagcctacctagctcgtcggggccctatggagatccagcaccaccgggggctgggcaactccaaggttgtgaaggtgcagagcgaggaggcgtgggatctgttcactgatcaagcgagcaacgagggccggcccgttgttgcccatttcggggcgtcatggtgcgtgacgtccctgtccatgaactacaagtttgaggagctagcgcagacccaccccgaggtcttgttcctctacgtggacgtcgacgatgtccagagtgtttcatccaggtacggagtgaaggccatgccgacgttcttcctcatcaagagcaaggaggtggtggggaagatcgtcggggcgaacccagacgaggtgaagaagctggtggatgcttccgccgaacccttggagactcagatagtcgtggagtagtagtcgtttcagactttttttttttttgaagagtcgttcgtgtcttccgaaactgcttcgggagactgtgcgaccgtgagtgcttcttggtcagggtctggatcgtcccggactgtccagtgtcgcccgtgtgcgtgtgcgtgtgcgtgtgatgggtttctgtcgctttgtagcagtagtagcacgaaaaatttgctattttagcctttttaacgtgggctaaatgttattatgtgaccctctgtctatgacttgtgggaccatctgtgtctatgatttgtgggtctgaatctaaaatagagaagttcacaaaaaaaaaaaaaaaaaaaaaaaaaaaaaaaaaaaaaaaaa

SEQ ID NO: 10791 - DNA, 895 bp, Zea mays
ggccggccgggccgggcggccgactggccgattggcacacgctttcctttcctgcagacaagctgtaaatctcgcctagctcgtcgtcggagaccaaggagaagagcaagggggggcgcagaggcttgctggcttgctgcctacctagctcgtcggggccctatggagatccagcaccaccgggggctgggcaactccaaggttgtcaaggtgcagagcgaggaggcgtgggatctgttcaccgatcaagcgagcaacgaaggccggcccgttgttgcccatttcggggcgtcatggtgcgtgacgtccctgtccatgaactacaagtttgaggagctggcgcagacccaccccgaggtcttgttcctctacgtggacgtcgacgatgtccagagtgtttcatccaggtacggagtgaaggccatgccgacgttcttcctcatcaagagcaaggaggtggtggggaagatcgtcggggcgaacccagacgaggtgaagaagctggtggatgcttccgccgagcccttggagactcagatagtcgtggagtagtagtcgtttcagactttttttttgaagagtcgttcgtgtcttccgaaactgctccgcgagactgtgcgaccgtgagtgcttcttggtcagggtctggatcgtcccggactgtccagtgtcgcccgtgtgtgtgcgcgtgtgatgggtttctgtcgctttgtagcagtagtagcacagccttgcctgttgggctggtagtggtactgctagtgccaggtgccggctgactgtagtgtgactctgaatgctgcatctgttctggggttgaaaaaaaaatagaaaccaacaaaacgagctcccttcgaagcgcatttgcagggcagcttccctctttctcgattct

SEQ ID NO: 10792 - DNA, 3539 bp, Zea mays
aggcgtgcgggcggagaacgcgatggcgttccgggacgacggcgagggagcggcgcctggtcaaggtgcgggaggagcgccgccgccgcgagtacgaccgggagcacacctacccccggatgggccaagtacgcagcttgcgcctcctttccctctctctctctctctctctctctctcctctctctctctctctctctctctctctctctctctctctccctctctctccctctctctctctcactatgtattggctggatgccatcgtttgtttgttccgtttctcagttgttttcgtctcggccttctattcctgtcgaaatccaaatgcttggctgctgtttcttaatgccgtgatatggtaatgcagggtactggagaacgcctgcagggatgatgaggagctccgcgccattcttggtgatagcatcggcaacccggagctcatgaagcaacgggtaagtgctgttgctgagttcaattcttttgctcttcctatttcgctgttttactgggagaatttgctgaccctggtaaacagtactcatgccatgccttgtgtactacgcgattcacagatccaggaaagggtgcgcaagaaaggcagggcccaattcaataaatccaagacaggctccattgttgcttttaaagtcagctttcgagagtgagattctcacccgctatagtcacgtttgtgtttctctgttttccatttcgaaggatcagaagtggagtgtgctaatagttcctacggcacatatgatactgtgataggatcagcttagtgggactacctgagctgctaaacacatatgcttctaatgaaatggctccatgtttctgtaaaaatatacatttgcacatatcttttgattctgtataactttagtggcccttggataatagatgatcatctcctcactttacatcctcaaccaacttgtatttacatgctaaaacgtttgtacctcgtttataaatccgaaactagcacatgaagacgaatcaacactcaataactcggtgtctggattaatggcactcacatttcacaggcaatagatttgatgcttgttgtcaccccatttcttcccttgctctatgtatgtctgattctcagtccaaatgagctgtgccaatgtctgaatattcatgttttttttcttgtttattccactttcaaatgtaatagatcttagttcttgtcttccgtagaagcagggggtttatgaaatcgttgttttttttttctaaaacggaagagctttaacaagttaagcttgaatgacatttgttcttttattgttgcagctttaacccattgaattctttcatttggtttgagctctttggagaaccaacagatcgagatgttgacctgcttggtggtgtaaagtggcattgtacaatttcattggattctccttattcagaaaacaacatactgtcttgacgtgaagtgttctttacaggtagtccaagcttggtatgtcatgggaaggctaggagcttacaattcttcaaatttgcaggttgggttcattcaaatttatctttttatttcctttgttggctacttaattcgtcagttctttcgagaacatgtaacgttgccagtttcaatgtcagctggccaactcaatgatggactacgacccttcatatgattctgaagaagcttccacagtaatgccatcatctttccatgatatcagtgatgttgagttccaagacaattgggccagggtttggtgagcgttggaaccatttggcagtttgggcacttgtaaaaggatatgtgcagactctgaaattcccctcactgttttttcctttcagggtggaccttggaacctcggattaccttggcttggatgtattactaaactgcttaacacagttgagctcagagtaagacatatttcacttatcatgtaaaatacacttgcaactttgtattccttgagcactagctttatgatatgacatcacttctgagcgggccacatgcataatgaaatgctgtatattatttttcagatttggaagcattcctccttataactcagccttgttgccttgactggttctgcaggcccttgggtatcaaacaagtggtttttggaggcaagaaaatgggtgactgggaagagggcatgacgagctctgattatggatacaagcacttcaagatatgataaatttacaggtgacaagcaacggtggtgatgcaaggctggccgagaaatttgatcaagactgcatgcatctcgatgtgcccttgtatgtaaataaataaattgtcatgggttttattttatcgtcgtgatagcagtgaattttaactaacagctcaaggcaggctagcagaatagaaaaatataatatggatgcatgtcttgtttcagacacgtctgtttcttgatgatgatgatgataatgatgatgattcttgcaacgtcaggaaaacttgacgagtcaatcaggtgttttttttacgtattgattaggatttttttttttttttccaggtgtcacagttgatcacattcttaaacttgggaacaagtagcagacaaactaactagtagcatggtgaaaggcattggcacctgcatttttcatagtattccacaagctgatactaacatgaggtcacaagtacaccgctcatcccatccatgcatatttgccgccgccacacccacataatagatcagctctcgtggaaccctaaatgttgcacaactctacaaagaaaacatacaagttcagcctatacaccacttcccaaatcaacgaaacaagatgccgatccttgcatcctcgctagctactggtcctctccatgctgttggtcctagcattctctcgcatcttctccacgatgtgcctccctttctcttcgatggtccgcctcttctcctccagcttgtcccccatcctcttcccgaaatccatcatccgagctcgcctcccgctttttcgcttcgcgtcctctccaatgggtgatgctgacacctgcggctgctcccctgctggtatcaccgccctccgagatgtggacatgggagacatggctataccttctgaagcttcttcctggagtttctctgtgatcaacagcggtttcctcagctcatcatttgcatcgctgtgggcagattcactgcctggagcagatgaagactggccgtgcaatgatgcctctgccttgggctcttgttttgcctcgtcaatggatgccactactctcgatgattcctcactcccaccatccttcaagccaccttccctcggactggagttgatgctgtagctgtggcatggattctcatctcagtgggctcatgatttagccaaataaaaggagcatccttgcgaggtacccaatcatccttttcagccaacatccacggcatggagatgctttcacaattcggaagcactaagctatctcgaagcgaagcctgaacagtgaaccatgttttacaatcaaaacaactttaccaaagcaagaatatatcagagcag

SEQ ID NO: 10793 - DNA, 2208 bp, Zea mays
gccccgaaaatattccccggcccacgaaaatacgtcacattttcgtcggtcacgaggccgacgaaaataacattcgaattttcgtaggtcggccgacgaaaataaaacggcccacgaaaatttatgcgtttcctgtagtgtaacaaggggaccggatacaggaataaactcttagttggggcggcgacatattttggtctatttggctttataacaatgatgtggtctttgtttttaaacctataccatcaattatacgagccctttttaagggatcatactcgttccggttctgaaggttgttgcagaaaaaagatcactaagatgtccttgccatatatcgatctacaaagatggtggccatagcgattttttttaagaaatggatggaggtataatgatagattacggtgtccttgattcgttgatgtgttttttttatattcttaatggcaaaataacttattttgcttatttttgacggatgaagtactcattccaggcttacttttctgagcttcccacttcacgatttcagacgaaataaaccgactcgtcaatcgcactggataccaaccttagggcacaggcttgtttctgtctctggcactgcattaacacgcggatacgtctttgctcccttaccactgcctgccgctaatggcagaacaacacacgcgtaagcagtctcacgggacggagccgtaccgcgtacggattgtatatatacatatatcccaaatccgctgcactaattaatatatgagtataatcttgcggatcgaacctatgacgtcgaattgctgctgctttgcatcttccagaacaataaagctgaatacgatcacacaatcatagaggtatagctagctttaccattccgatcttttccagcaagatagacgacgatgagaaccatcggacgattccaccttcctagccccgagcctgcactgttcgtcgagcacttggaccactccttgcctctcggcatctgattccaggctcactagctctggagaatctcctttattagctaggtcacagtccaatccaatccaatgcgcaccactagaccaatagtcctgtgtggatacatacatacataaatcatgcaagagcaagacaacctgaacatgttcctctgcatgcatggcacgaatcaatgagcagtcagaagctacacggccgtattaatagtgatagataagcataacaaaaggttctctccttgcgtccatctgaagactggttggttcgtcccctccggcccgccgccgaacatctgctcctagctagcataaagaagcgttattctctttctcaagcagcaagcagctacacgcttgctacatatataggcaccggactcggagagcgagagagaggccgcgcgtgcacctcgtcctcggtcgtcgccatggggaggtcctcttccacggagaagctggtgtgcttcgtcctggcggtcctggcggtgctgtccccgctgtacatcgaccggcggcccgtggcggagcgagaggaggaggacgaggacgacggcggcggcccgtcggcgctgtggctgccggcggtgctcctcgcgctcatcctcgccatcaacgttacgtgcttcatggaccggcgcgtggtcaggttcgacccttactggatccaccgcgtgtgggggtcctccggcggcctcctcgccatgctgctgctcctcggcttcgtgctcaggtgcaaggcgtccctgctgtataccagctactaggtggtagctcggtcggtcgtcgtcatgggtctttttttccttccaccccccaccccccgcccgcggaccggagaggatgcgtgcgagtgcgacaggatcacaacgtgttttgccacacaaatttgtacgtaccagcgagcagcgaccttggatcctcagcaagtcttgttcaggttcaggctccgcgaatgtgaatttgtttcagacattgacttcaaaaaaaaaaaaaaaaatcagtgccaactctccccttgttagtagtccgcaattcgagctgtttcatctttacctttgctactatatattgctcactttatgtagtaatatatgctataatatcatacagctgcaaaatgaaatagcaatagagtggacgactgtacggagaattaagagttactggcataaaaacaaagttatttattacaacgatggattggccatctccatag

SEQ ID NO: 10794 - DNA, 938 bp, Zea mays
attgggaccctcgaggccggccgggaaccccagcacagcacaatggacgccgccgtctccctctccctgcccctgcaccaccacgcccacggcccgctcccgctcccgcacccggcgccccaccacctccactgcgcggtcccgctcaggcaccacgccacctccgcgtccgccgtaaccgcgccgccgcccaagcctgacgttcaggctcctccagcggcgcgcctgagccccgccctcgccgcgccagcgccaccccgctcgtcctcgtccccggccgccgcgcgctcctccagccgcgccgccacgggatacgcggcagcgctggctgacgcgtgcgtccgcgcgggcacgctgcgccgcgccgcgcgccacgcgcgcgcgctcctccaccttctcctccggctagagcggcccctggaagagggcgccgccgcggtcgaggctgccgtgacggtcgcggggcagcagctggacgcgcgggtggccgcgctcgtcaggatgctcgtcgccaagggcagggccggggtgctcgccgaggccctggccgagttcgccgccatctgcgaccacctgctgccgacgcgcccgcgcgcgcgccacgcctactagctaggcatgctgcttaattaatccagtacagtgcccaacaaacagcacgccttttcgacacgaaacacttcatccaccagcgtagcgtttgtactcgtgcatggccttcgttcgccatggatgcatgctctgtactcttctacaagcaacttctgctacatggcgcctagccaacgttgtgtacttgtgttgccattggttatcagtacaacgctacggagcccataaagcttcaataaaaactcctctaaaaggccccttgtacacaatataatgtagaaaagacttctctacagtagtttagaaaaaaaaaaacaagagggcgg

SEQ ID NO: 10795 - DNA, 787 bp, Zea mays
aaaccccagcacagcacaatggacgccgccgtctccctctccctgcccctgcaccacgcccacgcccacggcccgctcccgctcccgcacccggcgccccaccacctacactgcgcggtcccgctcaggcaccacgccacctccgcgtccgccgtaaccgcgccgccgcccaagcctgacgttcaggctcctccatcggcgcgcctgagccccgccctcgccgcgccagcgccaccccgctcgtccccggccgccgcgcgctcctccagccgcgccgccacgggatacgcggcagcgctggccgacgcgtgcgtccgcgcgggcacgctgcgccgcgccgcgcgccacgcgcgcgcgctcctccgcctccggctagagcggcccctggaagagggcgccgccgcggtcgaggctgccgtgacggtcgcggggcagcagctggacgcgcgggtggccgcgctcgtcaggatgctcgtcgccaagggcagggccgggatgctcgccgaggccctggccgagttcgccgccatctgcgaccacctgctgccgacgcgcccgcgcgcgcgccacgcctactagctaatacccaacaaacagcacgaaacacttcatccaccagcgtttgtactcgtgcatggccttcgttcgccatggatgcatgctctgtactcttctacaagcaaattctgctacatggcgcctagccaacgttgtgtacttgtgttgccattggttatcagtacaacgctacggagcccataaatcttcactaaaaaaaaaaaaaaaa

SEQ ID NO: 10796 - DNA, 1524 bp, Zea mays
accaacctaggctacgcagtgccgcacaggccctatcggcagtgagagtgagagcaggagcacgctccgcgcaccaaacccccgagacgcctcgaaacgcgggcaaagtggaagtggaatcgagtcaaatcgaccacttctctggcaagcccgcaggccgcagcccctcctctctccaagagccgccgcggctgctccccccctagcaaacccgccatggccgagcgcctcgcagcatccgccgccaccctccgcgcctcggccgccgccaccccattcgcccgccgcgcggcgccggccaaccgcgccttcttctcgccttcgctagctcgcgcgcgcgtcggcctccgcgccgcgccctcttcgctcccacagaaggcgagggcagtgaggtgcgcggctgtggcgatggcgtctgacgcggctcaggtgaaggccgcacgcgaggacatcagggagcttctcaggacgactcactcccaccccatcctggtccgtctaggatggcatgatgctggtacgtatgacaagaatattgaggagtggccacaacgaggtggagctaatggaagtttaagatttgatgttgagttgaaacatggagccaatgctggtctgataaatgctctaaagcttatccaaccaatcaaggacaagtaccctagtatcacttatgcagatttatttcagttggcaagtgctacagcaattgaggaagctggtggcccaaagattccaatgaaatacggacgagttgatgttacaggacctgagcagtgcccccctgaggggaaacttcctgatgctggcccaagttcacctgctgaccacttgagggaggtattctacagaatgggccttaatgacaaggaaattgttgccttgtctggagcacatacacttggaaggtccaggcctgaacggagtggctgggggaaaccagaaacaaaatatactaaaaatggtcctggtgcacctggtgggcaatcatggacagttgaatggctgaggtttgataacagttacttcaaggatatcaaagagaaacgagatcaggatcttctggtcctacctacagatgctgctttatttgaggacccaaagttcaaggtctatgcggagaaatatgcagaggaccaagacgcattcttcagagactacgctgaggctcatgctaaactgagcgaattgggtgcgaagttccaaccaccgcagggattctctttggatgattagtgcggcaccagaaccctaaaccctctccttgaaaaggatcaagagggagcatacaattcattgttcttctcatatcatcgtacaagatggactggtccccctttttcatgatgctatatggagtcttctaatttagctagatttctgaaccgagcttgcaaataaaaaagaaccgacacagtggcactacataattttcagagccattgggagaactgacacagtgctatcagatttggttttatcccttcctaaaaaaaaaaaaaaagctgctgtcaattttctact

SEQ ID NO: 10797 - DNA, 1433 bp, Zea mays
tgggaccctcgaggccggccgggaaatctttcccttctctggcaagcccgcaggccgctgcccctcctctctccagagccgccgcggctgctcccccctagcaaacccgccatggccgagcacctcgcagcatccgccgccaccctccgcgcctcggccgccgccaccccgttcgcccgccgcgcggcgccggccaaccgcgccttcttctcgccttcgctagctcgcgcgcgcgtcggtctccgcgccgcgccctctccgctcccgcagaaggcgagggtagtgaggtgcgcggctgtggcgatggcgtctgacgcggctcaggtgaaggccgcacgcgaggacatcagggagcttctcaggacgactcactgccaccccatcctggtccgtctaggatggcatgatgctggtacgtatgacaagaatattgaggagtggccacaacgaggtggagctaatggaagtttaagatttgatgttgagttgaaacatggagccaatgctggtctgataaatgctctaaagcttatccaaccaatcaaggacaagtaccctagtatcacgcgggcagatttatttcagttggcaagtgctacagcaattgaggaagctggtggcccaaagattccaatgaaatacggacgagttgatgttacaggacctgagcagtgcccccctgaggggaaacttcctgatgctggcccaagttcacctgctgaccacttgagggaggtattctacagaatgggccttaatgacaaggaaattgttgccttgtctggagcacatacacttggaaggtccaggcctgaacggagtggctgggggaaaccagaaacaaaatatactaaaaatggtcctggtgcacctggtgggcaatcatggacagttgaatggctgaggtttgataacagttacttcaaggatatcaaagagaaacgagatcaggatcttctggtcctacctacagatgctgctttatttgaggacccaaagttcaaggtctatgcggagaaatatgcagaggaccaagacgcattcttcagagactacgctgaggctcatgctaaactgagcgaattgggtgcaaagttccaaccaccgcagggattctctttggatgattagtgcggcaccagaaccacagtccgtgaaacaggaaaaccctgtccttgaaaaggatcaagagggagcatacaattcattgttcttctcatatcatcgtacaagatggactggtcccccttttcatgatgctatatggagtcttctaatttagctagatttctgaaccgagcttgcaaataaaaaagaaccgacacagtggcactacataattttcagatccattgggagaactgacacagtgctatcagatttggttttatcccttccacaaaaaaaaaaaaaaagcggccctcgaggggggg

SEQ ID NO: 10798 - DNA, 1445 bp, Zea mays
gcacgagaccattacctagaacatcctaatcgaaaagagttggaggagtcccctctctctctctatacctttcttgcccaagcagtcaatcaagctgggaaacttaaacagaaagcgaagaaattaaaggccaccaccgccttcacttgttccttttggttattttcctcttgctgtggcttaacttgacaagaagaagaggaagaagatgctacgtcggcaaggccgaggtggaaaatttctggaggaggtgctcatcgtcggcgggctcctgctggtgcagtgcgtgctctccggctacgtggtcttcaccgaccacctgctcgccctcggcgccgacccgctggccgtcgtcgtcgtcgccggagccgcctacgccgccttctgctttcccttcgccttcgccctcgagaggaagcgatggccttccacggtttcggggactctggtggcgcaatacctgctcattgctcttggagggacaaccgcgttccaagcgctgatgctgctggggatcaagaagaccacgccggccatcgcatccgccatgcccaacctcagccccggcctcatcttcatcgtcgcagcctgtttcaggctggagaggttcgacagggcgtgcaagtacacgcaggcgaagatggcggggacggtggtgtgcctggcgggagcgctggccatgggcttcctgcacagcccaacttctacgtcctcctctctgcaggcagcagcaggaggtggcgactactactacgactggatcctcggctgctgctgcctcgtcgccgccgtcaccgtcttcgcgctcgtcaccgtcctgcaggccgccacgctcgccgccttccccgcgccgctcaccatgtgctgcgccacctccgcgacgggcgccgctctcaccgccgtcctgcggctcgtcctggaagggaggttcctcggcatggggtcgcccaggatcgacgccacgctcgtcgcggggatcgtcgtcctcggcggggccgcggtgggcgcgtgcatggcgttccaggcgtggtgcctgggcaggaagggcccgctgttcgtctccgtcttcgggcccgtccagaccgtctgcaccgccatcctctccgcggctctcctccgccaagtcctcagcctgggaagcctcgcagggatcgtgctcatgttcactgggctctacattgtcctatgggccaagagcaacgagatctcggctgacgacgaggaacagtcgttgcagggtggcgacgacgccgagaaggcactcctagcctagcctagcaaaatccagagcgaatatcactgcacgctctgtatttgtaaaaatggaatggtgtctacgtacctgtatacatactcgagaggatttagagaaaaaggacatggctacgtttgttcataatatgtaaatactggaaatactccctcccaactatgcacttctttta

SEQ ID NO: 10799 - DNA, 1914 bp, Zea mays
tcggtacccctgcgccctgcgtgccagtgtcagcagtgcaggtcttctccacgcgtcacgtttccaactcccaactgaaactagctactgccacgcgtcaccaccatatccctctatcgtctcttcccttcgtcctccgatgacatcagtccgtccttccagaaccggtacggtaatacaataatgagtcacaaaagtttaaacaatatttaggaggtgtttggtcccctcatttttagtctctaaattactaattttttagtttggtaattgagactaaaaattagttcttttagatcaagacattgtcaattttaaacaatattgtacttattttcattcaataatactagcatagcctaacttgtactagctagggtttcgaatttatttaactagtacactagtagctagtagtacttgagagttcgtagagttgatgctgaatgggtggacggtgccgctcctccctcctatatataataactatattgtacgccctgtcaggtggaggagtcccctctctctctctatacctttcttgcccgagcagtcaatcaagcggggaaacttaaacagaaagcgaagcaattaaaggccaccaccgccttcacttgttccttttggttattttcctcttgctgtggcttaacttgacaagaagaagatgctacgtcggcaaggccgaggtggaaaatttctggaggaggtgctcatcgtcggcgggctcctgctggtgcagtgcgtgctctccggctacgtggtcttcaccgaccacctgctcgccctcggcgccgacccgctggccgtcgtcgtcgtcgccggagccgcctacgccgccttctgctttcccttcgccgtcgccctcgagaggaagcgatggccttccacggtttcggggactctggtggcgcaatacctgctcattgctcttggagggacaaccgcgtttcaagcgctgatgctgctggggatcaagaagaccacgccggccatcgcatccgccatgcccaacctcagccccggcctcatcttcatcgtcgcagcctgtttcaggctggagaggttcgacagggcgtgcaagtacacgcaggcgaagatggcggggacggtggtgtgcctggcgggagcgctggccatgggcttcctgcacagcccaacttctacctcctcctctctgcaggcggcagtagctgcggaagcagcagcaggagggggcgactactactacgactggatcctcggctgctgctgcctcgtcgccgccgtcaccgtcttcgcgctcgtcaccgtcctgcaggccgccacgctcgccgccttccccgcgccgctcaccatgtgctgcgccacctccgcgacgggcgccgctctcaccgccgtcctgcggctcgtcctggaagggaggttcctcggcatggggtcgcccaggatcgacgccacgctcgtcgcggggatcgtcgtcctcggcggggccgcggtgggcgcgtgcatggcgttccaggcgtggtgcctgggcaggaagggcccgcttttcgtctccgtcttcgggcccgtccagaccgtctgcaccgccatcctctccgcggctctcctccgccaagtcctcagcctgggaagcctcgcagggatcgtgctcatgttcactgggctctacattgtcctatgggccaagagcaacgagatctcggctgacgacgaggaacagtcgttgcagggtggcgacgacgccgagaaggcactcctagcctagcctagcaaaatccagagcgaatatcactgcacgctctgtatttgtaaaaatggaatggtgtctacgtacctgtatacatactcgagaggatttagagaaaaaggacatggctacgtttgttcataatatgtatatactggaaatactccctcccaaaaaaaaaa

SEQ ID NO: 10800 - DNA, 3024 bp, Zea mays
gcataataggagtgaagctctgtattggggagaaaaagttcctaattatagtataattccaacaacaaaattcagtctcttattctaaatcccaatttaatgtgcaatcaaacaacataatttagaaaagctgattacaattccagttttgtattcctgtatctatatccaaatgtgctgctaaatctttccgaccataaatccataaatttgaatttatatttacgtacacgtaaaggctctcacatgcccgcccatgaagagagagagagggagagagaggagacctctgcacctctcgtcggttccggcaagataaattgctaaaacgggatgacatagaggccgttccaagcgtaacgtgcctggtgtctcaactcccgcgcaaaccggctctctctctctctagcctccacctcaccccgcctcttctctttctctctcttgctctgcatgcctcctcagccatccgtgcgaacaaacaaccactgacctcgccattgctcattccttcctcccttccacccggtcgggcacccaccggagatggacagccggagccaagcgccctacaagtccagcagcttctcgccggcaaccacccgcgacgacagcggcggcaagacgcgggaggtcgaccgcaacttctccctcggtgccctccgcgacaaggacgctcagcacggcggctccagggagcagtccatcaaggaggagaacgagcaagagggggatggtgaccatggggcgcgagtcggcggcgaggatccgggcttggtgggagggggatgcggcgagccggacctcgcctccttgtcggtggaggtggacgcgttcctcgcgggtcaggacgaggacgcggcgccggtgagcatcacggagacgacgctggagaggttcgcctccgccgtcgagctgctggtcgccaggtacgagggagtcgaggacaggtgggcgtcggaggccggcagcgagccgacggcgctgctggccgcgataacgcgcatcgcggcgctcgcgtccgcgctcggcaagacacccgagggcggcggcaagcacgccgccgccgtgaaccgcgtcactgccgtgctgcaccgggccatcacgttcgtcgaggaagagttcctcgcgcaactcgaggacccgcgcgtccccagggccgggcccgggggcgagcagcagggcggcgcgcacgagcccgaccggtgcgccctcgcgccgccgtcgaacgccggcgccgggatagagtccgcgccgccgtacccgccggagaccgtggagcggctccgcgccatggccgacgccatggtcgccgccgggtacgtgacggagtgctcgcagatgttcctggtggcgcggaggaacgccttcgacgcggcgctgcaggggttgggctacgagaagtccaacatcgacgacgtggtgaagatgacgtgggaggccctggaggcggtgatcgtgacgtggaccaaggcgttccggcacgccatcaacgtgggcctgtccacggagcacgacctctgcacccgcgtcttcgccggccgccacgccggcgtggggcgcggcatcttcgcggacctgtcccgctgcgtcatgctgcacatgctcagcttcacggaggccgtggccatgaccaagcgcgccgcggagaagctcttcaaggtgctcgacatgtacgaggcggtccgcgacgcgtcaccggtcatcgaggccttcctctccgccgacgagccggccgccgagcacagccactccggcctggcggagctcaagtccgagatcgccgccgtgcggtcccggctcggcgagtccgccgccgccatcttccgcgagctggagagctcgatccgcgccgacgccggcaagcagccggtgcccggcggcgcggtgcacccgctgacccgctacgtgatgaactacctcaagtacgcgtgcgagtacaacagcacgctggagcaggtgttccgtgagcaccacgacggcggcggcggcggcgacgacggcggcaacccgttcgcggcgcagctgatggaggtgatggagctgctgcacggcaacctggaggccaagtcgcggctgtacaaggacccgtcgctgagcaacatcttcctgatgaacaacgggcggtacatgctgcagaagatccgcgggtcggcggagaccaacgcgatgctgggcgaggcgtgggcgcggaagcagtcgaccaacctgcggcagtaccacaagaactaccagcgggacgcgtggagccgcgtgctggggctgctccgcgacgacggcgtgctgacggtgaagggccacgtgcagaagccggtgctcaaggagcggttcaagcagttcaacgccgccatggacgagatccaccggacgcagggcgcatgggtcgtcagcgacgagcagctgcagtcggagctgcgcgtctccatcgccgccgtcgtcgtgccggcctaccgctccttcctcggccgcttcgcgcagcacttcagcgccgggagacagacggagaagtacgtcaagctcagcgctgaggacgtggagaccatcatcgacgagctcttcgacggcaacgccacgtccatgacgaggaggaagacatgacaacaataacaacaacactagagcttcttgcttgacagtgccgcggcacgtccattggccggtccagcttatccatccattatcgatttgagcaatgtgttgttcctttttttttgtttcctcttcaaaaattcttctttttatttgtcttctgtcaactaaaaacgttactgtactaattttggtccagcaacagtcgatccatgtactaagaactgtacttactaccagtgcttctgtcaggagccagggcagctagatcatctctctgtaactctttgtacccatatatgtactgcttgcctgatgacactgttctgaacccgtgttcttccaaagcgtccacgcggttccactgatctgttcggttcttcagtctgaagtttgaacctcagccgagtttggtgtagagttgtagacctgacg

SEQ ID NO: 10801 - DNA, 2350 bp, Zea mays
ggtaccctgaatgcgttgcttttactacgtagttgtgcacggtgcacccatggactagtgggttttggccagcggcctgcttaccgagtctttggtgaaaccagtacgtgcatgctctccaaggtttttggtaatcaagtacagttatattacgaacagaaacgacaggtagtcattggttattgtttcaataaaagttttttcttaatttatctccttccttctggtgtctggaaaactgacaaacattcttaaaagaaactaagggtatgtttatttactgtctaacttatcacactttgtctaattttttttatttaagattagttctttaatttaaatgatcaaccttagtcaaagtatgacacgaactaaatagatcctaaaccataggggctaacgcctactgaacttctttgactagaagaaagctgaaattacctcatgatcagctctggtggaaatacgccaccttgattgcccactctccgcccgtcgtcgccacaactcgcccgcggtacaacggcccggctaaaacgaggcagggcgcgcacttaaaatagcccggcacggcgcgtacccaccaccacccgcccgccccgcgccgcgcaggcaccacccgctctcctgcggcctcctcctgtttgtgttttcaccgtggtgccgccgccgctgtcccctctctccagctgcggcgaccgcgaccgacaggcggtagagggcaaaggctagcgagatgacgaagctgccgtggtggcgcgccgacgcgtcggagctggtggccgtgacggcgatgggagtgtgggaggccgtgctcgccggcggcggcaggagattcatcaagcggaaggacagcgacgccggcgagaccggttcgcatccccaccaccctgtgttgatcctgaacatttttttcaaaaaaaaggatctttccgccggctctgttggggttgatggcgaaagaagagctcttcctttggctttgcgcggtcgggcactggaggagttgcgaagctccttgtacaatgaaatgcatagcgcagaaggtgctaagcgccagcagcagcgattctgtggaccaagtgttgcattgacattcaattttgctgttgctgttgggattatcatggcaaacaaaatggtgatggggagtgttggatttaaatttccaattgcactctcattaattcattatgcagttgcatttgttctaatggccacccttaagacattatccttgttaccagttgccccaccatcgaaatccactcctttctcatctatatttgctttgggtgctgtaatgtccctgtccactgggctagccaacgtgagtttgaaacataacagtgtaggtttctatcaaatggctaagattgctgtaaccccaacaattgtcgtagcagaattcatgcttttccagaagaaagtttcctctaaaaaggctgtcacactggcagttgtgtcatttggagtcgctgtagcgactgttaccgatctggagttcaacttttttggtgcttgtgttgcattagcatggattgttcctagtgccgtgaacaaaatcctttggtcaagtttgcaacagagtggaaactggaccgcccttgcgctgatgtggaagacaactccgattacgatatttttcttgttgacattgatgcctttgctggacccccctggcctcttgttgttcaattggaacttcagaaacagctgcgctgttatcatctctgcattgttcggtttccttcttcagtggtctggtgctttggcactcggcgcgacgtcagctttgtctcatgttgtgctgggccaattcaaaacgatcgtcatcatgctctccggctacctgatcttcggctccgaccctgggatcaccagcgtctgcggtgccgtgctcgcactcggcggcatgtccttctacacctacctgggtctgaagaaagaccccgcgaccagcggcaaaaaagcaccatcgagacagaactccttcatggcgagacctaaggtcgctgctgacgacagtgacgacgcggattcagagcaagatgatactgtataggttggggaaactgtcgtctaggccacttaatgcaaagatcaatccgagctcagttaattctcggttggttgtaatctgtcggtgaccgagtccatttttgtacatagatgctacctttaagccttacggattgtctattgcgtagtgacaagtagttcgagaggtattgcccctaatttatagcctgtgagattcgattagcgatgtacgcaggaacggggaacccaagtcatctgtttttttatgtcgatcatcagttatttacaatgaaaatcatgcaactct

SEQ ID NO: 10802 - DNA, 842 bp, Zea mays
  misc_feature (688)..(688): n is a, c, g, or t
  misc_feature (704)..(704): n is a, c, g, or t
  misc_feature (737)..(737): n is a, c, g, or t
  misc_feature (747)..(747): n is a, c, g, or t
  misc_feature (754)..(754): n is a, c, g, or t
  misc_feature (772)..(772): n is a, c, g, or t
  misc_feature (787)..(787): n is a, c, g, or t
  misc_feature (798)..(798): n is a, c, g, or t
  misc_feature (807)..(807): n is a, c, g, or t
  misc_feature (817)..(817): n is a, c, g, or t
  misc_feature (826)..(826): n is a, c, g, or t
  misc_feature (830)..(830): n is a, c, g, or t
aattcgggcacgaggccagcaccagcggaactgtgctgtgcaagcactcagcttcgcctccattccgctcacttcccgcggccactccgctccccaaaccctaacgccctcgagcggagcgatctctttgcttcgccagtgccgcgcccgggcatgccgccgccactgggtggcgcggtcaaggccgactgatccgtgcgcttgggagccgccaccgccgccgccgccgccgctgccattcctccctcggtgcccactggggtggagcggagactggagattctgccgtctgtcgcaagtcacacactaggtttctcgggcgctgacattgttggaagatgtggaggatcaagctcgcctgtttgcttcttatctttgtgcaagtgcaacgagtggtccttggaacacatgacgtgtacatcgtggtgatggaaggggatccggttgtgagctaccgaggtggcgttgacggatttccggcaactgctgtggatttggacgaggaaatggacgttaccagtgaagctgttacatcgtatgccctccacctccgagggcaccatgacaagctcctagactcacatttagtagaaaggaacgtatgagaagctttatagctaccaccatcttatcaatggctttgcagttccacattttcttcactgcaggctgaattcttgaagaaaanccccagaatttaaccnttttaaaaaaaactgaaggttccaaattgaatncccccccccncctttcnccgattgccactgggttntggcaacagagtganttaaaaaccgngaaaatttntaacggtttntgaatccgnattncccaattcaact

SEQ ID NO: 10803 - DNA, 1737 bp, Zea mays
acactctcgcaaaccgggcgtcgtccgcgcagcaggccaacacgttgtcatgaggaacagcgccgtgcagatctttgaacatagccaaccgctgtgctgccgtttcaggaagaaaggccggcggcgggtccttggagagcgtcaccctgcacatgtccacatgcccgggcagcaagttcccagccaagtccgagatgtaactgacgccgtcaccaaggggagacatccctccaatgctgctcctcagggccttgcaccacacccttggatcccggtgatccctgagcacccctccgacgatcttggcgccgaagaatgagccgttcagcttcctcgctatcgctttccccgcagagatgagcctcgggttctcctcgacgtctctgccggcgaacgcgtgggccttgaagaagaaccagaactctgggcacggcaacggccttagcaccatcggctccaccgtcccgacgtcgttcgcgacacgccggttgttcgtggtgacgatcatcttgactacccccgccgcctctctgcgttggtggttctgcaagaactcctccagcatctgcttcctgcacatgtccacgtcctcaaatatcatcaggcacctcctgtgtctgtcccaaaaactgtcgtcactactcttgatcaactccagtgggtcgtcgcttggagatattccttggttgtttttgacatcgtaggtagatgtgaaactgtacagcatgatcactgggaagtgggcgcgcactctagcgtcgtcgcaggcgtattgcaccagggttgtcttcccgactccgctgtcaccaacaataggtagcacacccagctccgtggctggccggtagtcgtcctcgtgcagcaggaagttgatgatcctctccttctcgacatgtcggccgaacatctgcgcgtcccggaagatgctagtggctagagggcggcggatgggcttgcagccttgcaagagcaggatgaactccctcagatcaccagacatgacctgcagtctctggagcaccctctcgatctcatcaacaccgcccgtatcagtcatggcgccgggacgatgctgcaagtctcacgcgctttgctggattaaacaaggacaaggttgaaacttgggggattgccttaccatcgtcatctctgtcagcttcacctccgcacccgacggagtcgagcaaatagcagccctggtagtcgccgtcgatgagatcggagagccactggagggtgccgtggtttgagatctgccgcccctttgcttcctctaccacgctgtggattctgatgaccagacgcctcatcctttgcagcttgtcctcagcgctctcctggttgttactgatgaaacgcccaatgagaagagaaaccgctctactgaccacatcaccgatgatggcggagatgatggcatctgccattgttgttggtttctagtttctacaggagggagagacaagcagtcttccagcaggaaataaatgtacatgtgacgtgtggccggcctcggtggacccagtcctgtactaattcttggtagaaccctgaagtcaatatagcagatcaaccatccataaaagaaacatagcgaccaagctttatttcatcttcgaaaggaaagtgaccttgttttttataataagcaaggaaattgaccaggaagaccataggtgtcacggaatgaatggtcgctgttcatgggaaaaaagtctttgcatccacgacgaaaag

SEQ ID NO: 10804 - DNA, 1803 bp, Zea mays
ctaaaacaaaaaattcggctgatagaaccatagagggtaaaaaacttgggtgtattccatggttggtaggtataggtacaagcatatccaacattctagttatacatagatcaacactgatcggcaagagttcactgcagcttcggtgcttgtgcaagagcaacgagcaatatagtaatggttaaagaacggcagtactgacttgcacaacaacacactcccaaaccgggcgtcgtctgcccagcaggccaacccgctgtcatgaggaacagcgccgtgcagatctttgaacatagccaactgctgtgtcgctgtctcaggaggaaaggtcgggttagagcgcgtcaccgtccacatgttcacatggccgggcagcaagttttcagccaagtccgagatgtaactgacgccgtcaccaaggggagacatccctccaatgctgctcctcaggaccttgcaccagacccttggatccgggtgatccctgagcagccctccgatgatcttggcgccgaagaatgagccgttcagcttcctcgctatcgctttccccgcagagatgagcctcgggttctcctcgacgtctctgccggcgaacgcgtgggccttgaagaagaaccagaactctgggcacggcaacggccttagcaccatcggctccaccgtcccgacgtcgttcgcgacacgccggttgttcgtggtgacgatcatcttgactacccccgccgcctctctgcgttggtggttctgcaagaactcctccagcatctgcttcctgcacatgtccacgtcctcaaatatcatcaggcacctcctgtgtctgtcccaaaaactgtcgtcactactcttgatcaactccagtgggtcgtcgcttggagatattccttggttgtttttgacatcgtaggtagatgtgaaactgtacagcatgatcactgggaagtgggcgcgcactctagcgtcgtcgcaggcgtattgcaccagggttgtcttcccgactccgctgtcaccaacaataggtagcacacccagctccgtggctggccggtagtcgtcctcgtgcagcaggaagttgatgatcctctccttctcgacatgtcggccgaacatctgcgcgtcccggaagatgctagtggctagagggcggcggatgggcttgcagccttgcaagagcaggatgaactccctcagatcaccagacatgacctgcagtctctggagcaccctctcgatctcatcaacaccgcccgtatagtcatggcgccgggacgatgctgcaagtctcacgcgcgctttgctggattaaacaaggacaaggttgaaacttgggggattgccttaccatcgtcatctctgtcagctttcacctccgcacccgacggagtcgagcaaatagcagccctggtagtcgccgtcgatgagatcggagagccactggagggtgccgtggtttgagatctgccgcccctttgcttcctctaccacgctgtggattctgatgaccagacgcttcatcctttgcagcttgtccttagcgctctcctggttgttactgaaacgcccaatgagaagagaaaccgctctactgaccacatcaccgaggatggcggagatgatggcatctgccattgttgttggtttctacaggagggagagaagcagtcttccagcaggaaataaatgtacatgtgacgtgtggccggcctcgttggacccagtcctgtactaatttttggtagaaccctgaagtcaatatagcaatcaaccatccataaaaaaaacatagcgaccaagctttatttc

SEQ ID NO: 10805 - DNA, 1851 bp, Zea mays
  misc_feature (888)..(888): n is a, c, g, or t
gagatagcatcagtgacagtgatgccacacggcaattttagccgcaacgctccagctgtaccgagaaacaaaatttctctacttttcttcgaccgtcctaccctatccgctcccctcgccggcgccgccgcgcggcggcgagaaagagagaacgcgctcctcttccttctcgactcgatctgccccttccagcccgctcgcccctcatcgagcggcctccgtagccctaggtgatccgcgcctccttccgccgcagcggaacaggacgcctgaccgtcgaccgtcgaagcgattcctctctcgcgggcgtcctcgtctcgccctcctcgcctcctcggtgccagtgggtcggcgcggggaggcatccgtccgggctacggtcgatttgttctccacttgctgttgaactttaaatagacaatggatctggagacagaaaatcgtcttgcttctttactacttgaagaggcccgaagattacaattagaggctaacagggaaggtgttcaagcatatctgcgaaaacctaatgttaggcatcgtccaaactctcggttcctcacagccacagttcgtggagttcagcaagcaaatcgtgttgtggggggcatgaaatgtaaggatcaaggaaccctaacttgtcttgttgcttctatggattgattttttctatgttgcgacctgtgagaatcaaatccagtagcttagtaaaatttccgaagaaattaattttgtatgccaattgaagttaaggttcaactggatccccacggctacacgttctttgctgtgctcgtcatatattgttcttgcggtgcagcagcatcttcatctatgtgtatgatagacctgctctatatgtggacgttactagcttggtacacagtnaaaaggttggaaggatcagtttatgctttattgcagagtgtggacaattctaatttatgttcagtgggatatatatacttgcccacgcctgttgacctatttgtgacaaattgcttattaactcatccatgtagcgaaagggcctttagctgagttggctaggtctgagtagttaaaaaaatcctctcgtctgtcctatgccaaagcacaggtctaagacctggttgcggtcgttctcacatgggctacagtgttgctgtgtatgggtgagataggggttttcttgacccgtgtgagaaggccttcttctcaatacaatgctcgtgcgttgtcttaccctcggcaggtcgagtttttttaactcatccatgcaaattaacctattttggacaaattgctttattaattcgttgcttgattctagtcttctttcatcacaatagcatcaccaccattagttatttcaaaaaaatctggggttttcaaattaagcccttttgccacatttgatactttcattcttgatgagcagttttagacacatctttttggctaataatgctttgataagttgttttatcgggatggaagcatatatatggggcacctgtactccattattgtaattactcttcaatggactgttcctggaatatctattttcttagtgtttgtgttataatttgtgagttgtattggctcccatgtatgttcagatcatttgtgaaactatatttgtgccgttcacattagtacacaacctgataacaaaaatagcatactccaaacaatagtgtatggttccttcgcaaccagtgttgccgtgcctgtcagcctgtgcatggttcagatctatgcatcaaccttgtcacgtcactacggtctagtttgggtactctagtattgaagtggtttggaggggttgaaaagtgtataaatcccctatagatcaaaaactcgcac

SEQ ID NO: 10806 - DNA, 1579 bp, Zea mays
aatgctgtggaggtcaatgaaatgtggcgtgccagggaaaaggaactggagttggagtcaaaaatgatgggcccccgggccgcaggtattcggcagcgtgattttacaggtgagaagcgcaaaagtgaaagaaaccatagctccagctcaaggattgaacaagaagggaccacttatgatacttcgtactcagaccaggaggatggtctcagggatgatgaaattgaaagatttctttattcaagggcgaagcgaggacgtggggctgttggttccaggatggacgagcctggtccataccttgattctctgtcccatcatcaggacaatggacctagcccggacatacgtgtggaagaaaaatgggaacgcagagtacaaggcccagagaagcctccattttggggatgcaagtctctcgatggtcattggcgcttgggcacattggatggaaggccatcaagctctgaaccacagagcaaaaaagaaaagaaaagtaagctggataaaaaagataagatagagaaaaggaaggaaaagggcaagaagaaatccaaacatcgccaccaccgccatcgcagaagcagcaggagtgagtgagtgatgttgcctgttagcagaacagaaaaaatggacacaacggttctgccatggccatgagacaagctagctgactgttcctgtgtcttgaaacctgtattgtatggaaacgggatattgtgtaggcttatacaatacaatgttgcgatgtcacatcgtttgttgaagttttatcactttgattaacatctgcaacaggaagttttttttccccaaaaaaaaaaaaaaaaatattgggcgtcgaatattggagtccgaggagcctgttcttcaagcagggcagcctgtcagttggggtttgtagctgaataaaactgtgtatggatgcgtaggccatcaatagctcttagtcatattagtgcacattttctatgatcatgaggatgagttacttctcaggttccatcgaaaagagcactgatgactgaggtgaaaagggcttaagattcacagcatgtcgtaatcatgctttggggtgtcatgaaccagtcgccttctaaagctgatccaacatgggcatttttctgcttcatgggacattgcgctaagttggggctagttaggatgcacccaatagtctgagggcgtgtggcctcacgccacgcctaagttgcggcggccgaggaaaggtgctgccggtggcggcggcttaggccagctaccaaacacgccctgaatacacctatttgccacggtgattggagattattgagaataaaattagtttatttcatcctcaatctccgtggaaaattatggatccaaactagcccttagacggaagaagatacattcaccaaggcttcataatatgcccaaaacatcaagaattgcatagttatcagatttacagttgtaggcttagctgagtactgattgtcaactcaaatgcgacgctattaatttggcaccaaatcctactagttaaaaaggaaaaaccaaatctgttgagcaaagagctccgtaatgatgcctaaat

SEQ ID NO: 10807 - DNA, 1430 bp, Zea mays
ttttctgaattcactttctgcagagggggcaaaagggtaaagttcttctaccaccgagcgaaccccagcacaccggtccagtgcccagcctccgtccctctccttcccttacctcgcctcgtctcctctccttgagatctccagggtacgagcgcattcgcgattttggccgcctccgccgccgtccgggaagatggcgggtctgggaaaggcgatgtacgcggtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtcttaagaggggatgcaaacatcatacaaattggatctgggaccaatatacaagacaattctcttatacatgtggctaaatctaatctaagtgggaaggtctttccaacaaccattggtaataacgtcacagtaggtcatagtgctgtgttacaaggatgcacggttgaggatgaggcttttgttggcattggggcaaccctattagatggtgttgttgttgaaaagcacggaatggtggctgctggagccctcgtacggcagaatactaggatcccttgtggagaggtatggggagggaaccctgccaaatttctgaggaagctcacagatgacgagatcagtttcattgcggaatcagctgccaactattccaatctgtccaaggtccatgctgctgagaatgccaaacctcttgaaaagattgagtttgagaaggtgttgggcaagaagtttgctcaccaggatgagtatgattcctcgattggcgtcactgaaggggcaccaccagagctcacgtccccaaatccagcccaatgaacctctgtttctgttttctctttggcgccttaatcattttctgttggacagtgctggatcgttgatcggggtactgttccatgacactggtggtttatgtttacttttcctccccaataatcttggatcgagcgatgttataaagctggccatgcacttcttccagattctgtattcggtatgtttaagatgtgctccctttcataacctctgaagagtagttttagcaccgtccatattcgtcatgagttctgtactatgctttctggcccggcgtgtatgaaccatctttataaaaatctcttaagcacacattactcctatgaaatgattgatactggatcgacacagaaaaaaaaacctagtgtatccctgctactcttgtggacatccttaaatagtatgagaggaaacatcacgtttgcaatcaaaaaaaaaaaaccccacc

SEQ ID NO: 10808 - DNA, 1299 bp, Zea mays
gccggccgggtcggggtaggctgattgtcactgcaggggaaactagcccctcaaatggggcaaaaaggcaatgttctttgaccaccgagcaaaccccagcctccgttactctccttcctcttggctcgcctcggctcccgtcgtccccttccttgagatctctaggatacgagcgcattcgcatcgcttcgcctccgccgcggcctggggagatggcgggtttgggaaaggcgatgtacgcggtgggattctggatccgggagaccggtcaggccctcgatcgcctcggctgccgcctgcagggcaagtacttcttccacgagcagatttcaaggcatcgcaccatcatgaatatctttgacaaaaccccacatgttcatagggatgcatttgttgctccaagtgcatcccttattggtgatgttcaagtcgggcaaggagcttccatttggtatgggtgcgtcttaagaggggacgcaaacaacatacaaattggatctgggaccaatatacaagacaattctcttgtgcatgtggctaaatctaatctaagtgggaaagtctttccaacaatcattggtaataacgtcacaataggtcacagtgctgtgttacaaggatgcacggttgaggatgaggcttttgttggcatgggggcaaccctattagatggtgtcgttgttgaaaagcatgggatggtagctgcaggatcccttgtaagacagaatactaggatcccttgtggagaggtatggggagggaaccctgccaaatttctgaggaagctcacagatgacgagatcgcatttatcacggaatcagcttccaactattccaatctgtccaaggtgcatgctgccgagaatgccaagcctcttgaaaagattgagtttgagaaggtgttacgcaagaagtttgctcaccaggatgaggagtatgattcctccatcggcatcactcgaggggccccaccggagctgacatccccaaatccagcccaataaacctctgtttttgtttctgttttctctttgacgccttaatcattttgtattggacagcgctggattttgaccgggccatagttccatgacttaggtggcttatgtttacttttcctccccaataatcttgggtcgagcgatgttataaagctggccatgcacttcttccagattctgtattcgttgtgtttaagatgtgctccctggagagttccaccaaataaactgaaatgcattgttttgacaggtaaaaaaaaaaaagaaaagcaaaactagagggggggcccggtaccca

SEQ ID NO: 10809 - DNA, 1500 bp, Zea mays
gcactactgatgctttctagcttagtagttaactcattattgtggtatgctcataatttccattttctctagcaaatttttgatagtattctgagagctagctaaattagctttaagtttttcattctttttaacaagactgtcatcgataattgaggatacagctttagaatctaattgcttaattttagttgttatctcacaattcaaatttggaaaagtttcaaattttaacaagacttttacaaattaagcttaaaatgacctattttgaagagtgccatcttagagtgacccattttatcaaatttgtctaccttttgacattaaacctttctaaatttactctcaattagggctagtttgaaaacctaattatttcagataatttttatttccaaaaaaatagttattttatcttggaaaaataaaaatcacttgataaaaagaggctatcaaactagcccctcaaatggggcaaaaaggcaatgttctttgaccaccgagcaaaccccagcctccgttactctccttcctcttggctcgcttcggctcccgtcgtccccttccttgagatctctaggatacgagcgcattcgcatcgcttcgcctccgccgcggcctggggagatggcgggtttgggaaaggcgatgtacgcggtgggattctggatccgggagaccggtcaggccctcgatcgcctcggctgccgcctgcagggcaagtacttcttccacgagcagagggacgcaaacaacatacaaattggatctgggaccaatatacaagacaattctcttgtgcatgtggctaaatctaatctaagtgggaaagtctttccaacaatcattggtaataacgtcacaataggtcacagtgctgtgttacaaggatgcacggttgaggatgaggcttttgttggcatgggggcaaccctattagatggtgtcgttgttgaaaagcatgggatggtagctgcaggatcccttgtaagacagaatactaggatcccttgtggagaggtatggggagggaaccctgccaaatttctgaggaagctcacagatgacgagatcgcatttatcacggaatcagcttccaactattccaatctgtccaaggtgcatgctgccgagaatgccaagcctcttgaaaagattgagtttgagaaggtgttacgcaagaagtttgctcaccaggatgaggagtatgattcctccatcggcatcactcgaggggccccaccggagctgacatccccaaatccagcccaataaacctctgtttttgtttctgttttctctttgacgccttaatcattttgtattggacacctctgtttacttttcctccccaataatcttgggtcgagcgatgttataaagctggccatgcacttcttccagattctgtattcgttgtgtttaagatgtgctccctggagagttccaccaaaaaaaattttttgcattgttttgacaaaaaaaaaaaaaaaaaaa

SEQ ID NO: 10810 - DNA, 1481 bp, Zea mays
ctcgaggccggccgggacgactctcggcaacggatattctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgcacacccgccccagggccctggggcccctcgaggccggccgggacctcgcctcgtctcctctccttgagatctccagggtacgagcgcattcgcgattttggccgcctccgccgccgtccggggagatggcgggtctgggaaaggcgatgtacgcggtggggttctggatccgggagactggccaggccctcgaccgcctgggctgccgcctgcagggcaagtacttcttccacgagcagatttcaaggcatcgcaccatcatgaatatctctgacaaaacccctcatgtgcataaagacgcatttgttgctccaagtgcatcccttattggcgatgttcaagtcgggtcaggagcttccatttggtatgggtgcgtcttaagaggggatgcaaacatcatacaaattggatctgggaccaatatacaagacaattctcttatacatgtggctaaatctaatctaagtgggaaggtctttccaacaaccattggtaataacgtcacagtaggtcatagtgctgtgttacaaggatgcacggttgaggatgaggcttttgttggcattggggcaaccctattagatggtgttgttgttgaaaagcacggaatggtggctgctggagccctcgtacgacagaatactaggatcccttgtggagaggtatggggagggaaccctgccaaatttctgaggaagctcacagatgacgagatcactttcattgcggaatcagctgccaactattccaatctgtccaaggtccatgctgctgagaatgccaaacctcttgaaaagatcgagtttgagaaggtgttgggcaagaagtttgctcaccaggatgagtatgattcctcgattggcgtcgctgaaggggcaccaccagagctcacgtccccaaatccagcccaatgaacctctgtttctgttttctctttggcgccttaatcattttctgttggacagtgctggatcgttgatcggggcactgttccatgacactggtggtttatgtttacttttcctccccaataatcttgggtcgagcgatgttataaagctggccatgcacttcttccagattctgtattcggcatgtttaagatgtgctcccttgaaagacagaccccaaatagacagaaatgcattgttttgacaggtaacatgcactgaattactttgtttcataacctctgaagggtagttttagcaccgtccatattggtcatgagttctgtacctgcccgggcggccgcgcgagtatgaatcatctttataaaatctcttaagcacacattcctcct

SEQ ID NO: 10811 - DNA, 2927 bp, Zea mays
  misc_feature (205)..(205): n is a, c, g, or t
  misc_feature (1582)..(1582): n is a, c, g, or t
ccagtaattccattggcatatttgctctgtatgccgagctagagcacttaaaacagttcaccgaggaaaaaaatgtactaaagttacattttccaactctgtttggcaggtcatagtgctgtgttacaaggatgcacggttgaggatgaggcttttgttggcattggggcaaccctattagatggtgttgttgttgaaaagcacngaatggtggctgctggagccctcgtacgacagaatattaggatcccttgtggagaggttgagcacacttcctcaactgtcctttgctttgggttcttaattaagccgtctcaagcacctttaccttttttatttcatcgactagtttcaccaagacagggttttcttgtgatgatggaaccccaatgacacagactgcatcgagcactaaattattgttcttcggtgtctaatacatttccatgtggcatacatatttacaggccttgtgcagtggtgactgatgagagagctgtctcactgggtcgcaggttcgaagcagtctctccccatttacggggagaagacttgcctccgtttatgccttcattggatcccactcatgtgggaacctcgggcactgggtctgccctttatacatatttatagtgtccatgagtgggaagtggaaccgataatatgctctagaggccttgttttgtatcttatttctgcatgatttcatgactatgctttgttggatttaggtatggggagggaaccctgccaaatttctgaggaagctcacagatgacgagatcagtttcattgcggaatcagctgccaactattccaatctgtccaaggtccatgctgctgagaatgccaaacctcttgaaaagatcgagtttgagaaggtgttgggcaagaagtttgctcaccaggatgagtatgattcctcgattggcgtcactgaaggggcaccaccagagctcacgtccccaaatccagcccaatgaacctctgtttctgttttctctttggcgccttaatcattttctgttggacagtgctggatcgttgatcggggtactgttccatgacactggtggtttatgtttacttttcctccccaataatcttgggtcgagcgatgttataaagctggccatgcacttcttccagattctgtattcggcatgtttaagatgtgctcccttgaaagacagaccccaaatagacagaaatgcattgttttgacaggtaacatgcactgaattactttgtttcataacctctgaagggtagttttagcaccgtccatattggtcatgagttctgtactatgctttctggcccggcgtgtatgaaccatctttataaaatctcttaagcacacattcctcctatgaaatgattgatactggattgacacagaatgtcttccctagtgtatccctgctacccttgtggacatccttaaacagtatgagaggaaacatcacgtttgcaatcaactattaccattgttggattgaaactcagtgcttgtttgaataaacctatttggcgttgtggatcggagtggattcaagctgtgtgcatctccaatagctcntccaatggcaacaacgcaactctcccaacagctccctcaatgcatgtctcctaataaggtgctaatggagatcgttggggaagatgttgcaggtagatgcctagatctgatcaaacgccaggtctgatagagctggagaatgttaggttaaaacctttggccaaagattgtcgagacatattggtggttaggctatttcttacatttttccaaaaccatgatcccatgctctggtctagttgcagggattctcccaggctttttcttttttttatagtaaaagttttaaaattatatacttcggaactgaaacattgcagaaatgagtgcatgccgccttaccatgagcggcagtgactcaaatgagaatatttttgcaccgagggccctggaggatctgccgtccgacagaggggcggtaggtactcatgtttttttattattaaatacctcgttttaaaacattagtcattttagcttttaatttttatattatatttaatttgataatgataaatttagacagatatataaaataaatatattaattattgtacgaatcaactaaaagttaaaacaaattttattttggaacaggagtaagatgtttaatatattttatataaaaaacatattagagacggtctgatataaattatttttagagtacgaccaattatactatacagagaagattacatataattataatataaactattctattttatagaggctcgacctatatttagtttcgcaagttaaaatcgtgatacagatcatgtacgatatccgcgtgattggtttacagtgtccacccagccagctcgtccgtagcccggctggctggatacggagatttctggcgtacaagctcatgcaaccatataatgtcaaaataatttattttgtatttactcatgcagtccactcctctcacatacaggtaaacaaacatatgctcaaccaaagtcaacgtatgaaatggtccagaataagactatgcggccaaccaatcatatgatatatgtcgttgtctgcttattgttaatttgacgtgttagtgaggagtgcaaccataattcccaggtgatcacgacctacttttcagcaagtttcataagttgtactacctcttttttctaaattaaattatttaaggttcaactaagtttgttcaaaacaatatcgatgacttggtattttcaagatggagggagtacacactattgaactcaacgtgcattggccgacaaagcgggaaagctagacaatgcactaaagtgtattactagctagcattatgtccattagagcaaagtccactcaactcttgcacacataa

SEQ ID NO: 10812 - DNA, 1694 bp, Zea mays
cattgggtacctcgaggccggccccgccgtccctctccttcccttacctcgcctcgtctcctctccttgagatctccagggtacgagcgcattcgcgattttggccgcctccgccgccgtccgggaagatggcgggtctgggaaaggcgatgtacgcggtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtcttaagaggggatgcaaacatcatacaaattggatctgggaccaatatacaagacaattctcttatacatgtggctaaatctaatctaagtgggaaggtctttccaacaaccattggtaataacgtcacagtaggtcatagtgctgtgttacaaggatgcacggttgaggatgaggcttttgttggcattggggcaaccctattagatggtgttgttgttgaaaagcacggaatggtggctgctggagccctcgtacggcagaatactaggatcccttgtggagaggttgagcacacttcctcaactgtcctttgctttgggttcttaattaagccgtctcaagcacctttaccttttttatttcatcgactagtttcaccaagacagggttttcttgtgatgatggaaccccaatgacacagactgcatcgagcactaaattattgttcttcggtgtctaatacatttccatgtggcatacatatttacaggccttgtgcagtggtgactggtgagagagatgtctcactgggtcgcaggttcgaagcagtctctccccatttacggggagaagacttgcctccgtttatgccttcattggatcccactcatgtgggaacttcgggcactgggtctgccctttatacatatttatagtgtccatgagtggaagtggaacgataatatgctctagaggccttgttttgtatcttatttctgcatgatttcatgactatgctttgttggatttaggtatggggagggaaccctgccaaatttctgaggaagctcacagatgacgagatcagtttcattgcggaatcagctgccaactattccaatctgtccaaggtccatgctgctgagaatgccaaacctcttgaaaagattgagtttgagaaggtgttgggcaagaagtttgctcaccaggatgagtatgattcctcgattggcgtcactgaaggggcaccaccagagctcacgtccccaaatccagcccaatgaacctctgtttctgttttctctttggcgccttaatcattttctgttggacagtgctggatcgttgatcggggtactgttccatgacactggtggtttatgtttacttttcctccccaataatcttggatcgagcgatgttataaagctggccatgcacttcttccagattctgtattcggtatgtttaagatgtgctccctttcataacctctgaagagtagttttagcaccgtccatattcgtcatgagttctgtactatgctttctggcccggcgtgtatgaaccatctttataaaaatctcttaagc

SEQ ID NO: 10813 - DNA, 840 bp, Zea mays
gggtacctcgaggccggccgggccgggatcctcacctaatgccacaacaacagctctactgaacattaccgctcatcatcagggtatacagagagatcgaagagagacctatacagagatggcctccggcggcggctccaagcagctcaaggctagtcttctcatggtggtagcagctctgctcctcctcatctgcacctgcactaccagggggcaagcggcaaggccggatccaggatccgagggccacacgccacagcagctgcgcgctgctgtatccgtctccgttgctgctggtaatgagaaggagagtggctcatcagtggccgcggtggaaatgcgtcggcagcaagagccggaggcggtgagtgaatgtgtggacgacgacggagacgacgaacaggcggagtgcctgatgaggcggacgttgctcgctcacaccgactacatctacacccaggggaagcacaactagctagtcactgctcactagcctgtgctgctggctcatgctcatgtcatgtcgaggaaacaagttcaagggacaaaaacaaaacaaaaaagctcgcatggttcacgagctagcctagccaacctgaagttctacagtgccgtacgtcaactgtgtggattgttttaaaatatatatacctagtcttttcctttctgcagttctgccaggctgtggattattttcatatatacctcgctaattaccccctgtgatttcccatcggcttctcgagatcatgtacaatatattatccatatagatatcatggatattggatagaccttactcttggcctgagaagctaaatggaaattctacaatattaa

SEQ ID NO: 10814 - DNA, 832 bp, Zea mays
cattgggtacctcgaggccggccgggatcctcacctaatgccacaacaacagctctactgaacattaccgctcatcatcagggtacacagagagaagagagagagacctacagagatggcctccggcggctccagcaagcagctgaaggctagtcttctcatggtggtagcagctctgctcctcctcatctgcacctgcactaccagggggcaagcggcaaggccggatccaggatccgagggccacacgccacagcagctgcgcgctgctgtatccgtctccgttgctgctggtaatgagaaggagagtggctcatcagtggccgtggtggaaatgcgtcggcagcaagagccggaggcggtgagtgaatgtgaggacgacgacggagacgacgaacaggcggagtgcctgatgaggaggacgttgctcgctcacaccgactacatctacacccaggggaagcacaactagctagtcactgctcactagcctgtgctgctggctcatgctcatgtcatgtcgaggaaacaagttcaagggacaaaaacaaaacaaaaaagctcgcatggttcacgagctagcctagccaacctgaagttctacagtgccgtacgtcaactgtgtggattgttttaaaatatatatacctagtcttttcctttctgcagttctgccaggctgtggattattttcatatttacttcgctaattactccctgtgatttccccatcggctttctcgagatcatgtacaatatagttagtagagaaaaatataaacgcatatattggagattcgaaaaaaaaaaaaaaccggccgcccgctcagct

SEQ ID NO: 10815 - DNA, 5115 bp, Zea mays
  misc_feature (251)..(251): n is a, c, g, or t
  misc_feature (5094)..(5094): n is a, c, g, or t
  misc_feature (5099)..(5099): n is a, c, g, or t
tgctattgtatattttttttatagaaatatagaattcaagcatatttcttttatgtttgtgcatcttcaacataaaacttgtttgaagtttcattttctgatatggttttcaagaatatatttaacattcaagatatgattcaaaattgcagctagttcttatatatttttgattgatacgtttttaacggttatatgaatgaatttaaacgactgccatattaattatactagttggttgaccgtgcgtngcgacaacttgcaacaatacctatataaactatccatcaaaaaaatttcaaggttttttattgattgtctacgctcttcgtataatattttttttgatttggctaactgatgctattgtttactccatccaatatgtattggtataacacgaccaatgaagtgagtgattagaataaagttcacaacgactgaccgaacgaacagagattataaaatgacataattccacaacacaaagaccaaataagagaaagtttgtgagctcaagtttctaaaataagtcaaatgaactcaaacttataaaaaatagatcgaaatatggagtgattgctaaagtaaggcataaataaaaactggatgcgctctatataaattatgctacttcgtagcaattactaacatttaaaaccaacaaataacctttcattttactgttagtgtgacaaatcattgttgttccatctaattcagcaaccccaaacaccatggagtatattgcgccaatatggtctcagaaacgacctaatgcttgcaagagccaagaacgctgtgccgtgcttgggctgtagcctcggcccgtagtgttggcctggcccgacacgattatgtatatttttattttacaaaaaaacgtatatatatacaatatatattcaatattaaaaatatttgagcataatgttttactggttatacagtttcacccagtgtctcccgcccttcttttatcagggcatgggttcgaaccccacctcatacaccgtttttaacattttatgctaatcaaatgggtcgacagattaacgggctgacccgacacagtcagcagaccggcatgacgtgcctgggccaaagttgtgaccctcgggaccctcgggtgtctagcccgtgccggaccgtcgtttgacatctatgggcgtgtactggaccgtcgtttcacatctataggtgtgcagcgggttaatttgaaataactgtgaggcattaaatcggtgttttaagtataatatagattagaaaaccagtatatcaatgaatatatcaatgaatttaatatcatataggtatatattctatatgtaattatttttatcacgcgcgtgtcgggtatgcactttcactgtttaaatataaaaacaagtttatgtatcttatcggtaaaactgaatacttgagaacaaatcattgaatagtctattgtatgtatacggtttctagaacaaatcaatatttgaggaaccaggttgaggctagaactgttgtcctcaaagtcgaaccgtacgatacgtaatttaattctaccgctgacttcacctggcatcgcagtcgcaccgcaccgtccgttccggtagaacaagtcatcaatatccgcgaaagcagcccgtggaaatggaaaggaatgctacagaaccaatcaacaagccaagccaactgaccccttccgtcccggtgaagtgccaaacgcgtgattccattcgggaggcaggttggtgtgcgttgagccgttgattcctgcgcactgcgctgcgcctcaaggccaacgcccggcgaggacaggatgaggggacagcgggcgacgagagggaggaaaatcccagtccaactctaggcgcttcccttctcccttttcctttcttcttccctgaggcgccggccccgctcaggtcgggacctgccgccatttcagaactcctagcttcttctagttcgtggttgctgcgcgccttgcgtaccctggtacggacctcgatgcgtttttctttctgccccctcctcctgccatctcggttgatggattgctgtaaggtgtggtggatctcggtggattgctgcgaggcgtggcggattcgttgccggctcgtgttccgatgacacgcagtagctagagtttctgttctgctacattcctggctttcttgttatctgtttattgctagttcaccgcttgaatttgatcggacgtctccaccattgagcatgtggagaatacgccaattcggagatcttgcctaccttttccgttcaacggatgttcgtctgtgtacctatcatattcatctgtcagatctattattcttctcccatcccatatgattaattgggacatcatcgaatgtgtcattttcgccgtttatgtacgttatcctgagagaattcaatgggcccttcccagcttatcgagtttctctagtataattgagttttttatcttctctttccttctacgttgttaacagtacatagaacatgtaactatataattagttgctgccggcacctgtacctgctcattttcatattccaattttatatgtccaactggagccagatggtaaatcatctgttgcctttcctgacatggcagggctctggcccacataacaatagaatattgaatatttaatacttaatctaaattatagttttttaacctactttttttcacattcaaatgataatgaatataaacatatatgaaaactacatttatatgttacttaataaatatataattagtctaaaacgaattatattttagaatggagggagtagaagattgtttctttcctggatagcaacaactgaacacgtcggtgttatttgcaaatccagagctgggcccaaatctgggcatggtctattcctcatcttaactcaatcagactccacatatttatgtaaatattctgaaagcgaaagcaagtattactctgcagtgtctcactttgcatactatcaccagtgttgtgtaaaatacctttgaattatgttgtgagattgaattggtggtgtgttattattttgtattgtttaatattttcttatgtgtcatacatcatagggttgagcatcattggagtggaagaaaggaatcatgttcaggagaaagcatgcttctcattccaactcaagtgatgctgagcagcaagaagcaaaggtaactgtgataatcgtcttctcatcatagctcataagtttttgttcacgtgaagattttagagcctcctgtgaattcttatttacttggaagcccatagtaaatcatgctacgagtatgccccatagtccatagatgagtgctttgttcatatacttgttttatgactatgatccacttattttgcaatgaaacaccagagcctcaaggggcttatctatagcatgttatgtttgtgtgtcagtactagttcacacaagcctggatttaactatccaactgtatacatacatagctgtgtgttattgttgcagacttgcccttgggcctttataagcttgacaaacagttttactatctgtattttcctggttgatttctcacataatgtggcctacgaacagataaatgaattaaaatctgcacttggtcctttgtctgcccatggcgagaagtactgcagtgacacatgtttcagaagatatcttgaagcccggaactggaatgtcactaagtcgagaaaaatgcttgaagaaagtctcaaatggagggcaacttataagccagaggatattcgctgggtaaatgtgctcaagttactttgctctctgaatcctggtcaagtgaccaaacaccatgctaactgcctttcagcctgatgtttctgttgaagcggaaacgggaaaaatgtacaaggcaaattttccagatagagaggggagaactgtaatcattatgaggcctacaaaggaggtaagactctctcttttgaactgacatccttgcgtttttttatttcttctccataaagatcatcagtcttctttacttctataaaatttcacgtgtatgtttgtataaaattccagaattcaacgtcccatgacggtcagattcggtttcttgtgtatgttttggagaatgcgatcctggaccaacgtgaaggtcaagagaaaatggtatggctgatagacttcacgggatggacaatggcccatgccacacccataaagactgcaagagaatgtacaagcatcctgcaaaatcattaccctgagaggctggccattgcatttctgttgaatcccccaaaagtattcgaagccttttacagggtaaaggcttttaaacctcctgcttttgtaaatgttatatttgtgtttgatttacttcacaaagattcaaaatctatttgtagaatcgatgcataaaattatgctcctgttttgatatccctatccttactcaagttttccaaattcttacaggctgttaaatatttccttgacccaagatcgatcgagaaactgaacttcgtgtacctgaaggatgaggagagcatgaaggtcctgtacaagtgcattgatcccgtggtccttcctgtggagttcgggggaaagaacagtgttgtgtacaaccatgaggactactccaagttgatgctgcaagaagatatcgaaacatcaagcttctgggaggatgatgcgaaaactgttaaccatgctatcaatgggaccttggttcctgatgttgcatctcagctgtcacggattgctgctaaagccagttaatgagctactacgatgggagctattcagaatgctttaatggagtaactagaaagtcgagcgccaataaaatgttcatagtaaacagaaatagagcaaataacagatgagatatcacttgtccatagtcgaaatagttgcacttatcgaacactttattcagtacacgatgagttacaggagactatcgtaatgatgtaagaggtagaagtgctacctgcttaatgtacctcaaaagcccttaaggctttacttgttttagccgtggctacggagaagctaattctgggttatggcttttaaaaaaaaaaaaaaaatcgcaaaaaaaaaaagtantctgngtctgttaccactgct

SEQ ID NO: 10816 - DNA, 1527 bp, Zea mays
ctcgaggccggccggggcggcaggttggtgtgcgttgattcctgcgctgcgcctcaaggccaacgcccggcgaggacaggatgaggggacagcgggcaacgagagggaggaaaatcccagtccaactctaggcgcttcccttctcccttttcctttcttcttccccgaggcgctggccccgctcaggtcgggacctgccgccatttcagaactcctagcttcttctaggtcggggttgctgcgcaccttgcgtaccctgggttgagcatcattggagtggaagaaaggaatcatgttcaggagaaagcatgcttctcattccaactcaactgatgctgagcagcaagaagcaaagataaatgaattaaaatctgcacttggtcctttgtctgcccatggcgagaagtactgcagtgacacatgtttgagaagatatcttgaagcccggaactggaatgtcactaagtcgagaaaaatgcttgaagaaagtctcaaatggagggcaacttataagccagaggatattcgctggcctgatgtttctgttgaagcggaaacgggaaaaatgtacaaggcaaattttcgagatagagaggggagaactgtaatcattatgaggcctacaaaggagaattcaacgtcccatgacggtcagattcggtttcttgtgtatgttttggagaatgcgatcctggaccaacgtgaaggtcaagagaaaatggtatggctgatagacttcacaggatggacaatggcccatgccacacccataaagactgcaagagaatgtacaagcatcctgcaaaatcattaccctgagaggctggccattgcatttctgttgaatcccccaaaagtattcgaagccttttacagggctgtcaaatatttccttgacccaagatcgatcgagaaactgaacttcgtgtacctgaaggatgaggagagcatgaaggtcctgtacaagtgcattgatcccgtggtccttcctgtggagttcgggggaaagaacagtgttgtgtacaaccatgaggactactccaagttgatgctgcaagaagatatcgaaacatcaagcttctgggaggatgatgcgaaaactgttaaccatgctatcaatgggaccttggttcctgatgttgcatctcagctgtcacggattgctgctaaagccagttaatgagctactacgatgggagctattcagaatgctttaatggagtaactagaaagtcgagcgccaataaaatgttcatagtaaacagaaatagagcaaataacagatgagatatcacttgtccatagtcgaaatagttgcacttatcgaacactttattcagtacacgatgagttacaggagactatcgtaatgatgtaagaggtagaagtgctacctgcttaatgtacctcaaaagcccttaaggctttacttgttttagccgtggctacggagaagctaattctgggttatggcttttaaaatgctggttctatatttggatttgattatggctgaagtagctcccc

SEQ ID NO: 10817 - DNA, 1377 bp, Zea mays
tgaattcggcacgaggtccaaacccaaacatttttcttctccagcgagcacccaaaaaaaataaatagctccttccagctccggccccgctcgcattacttcctcgcctccttttccgcgcccaaacactaccgcctccctcccacccctagtccccctacccccccatccaatcctctgctcgccttgcctcgtcccggcagcggcggcggcttgggcgcgcacacacaccaggtgttcgattggagtcctcgccgaagcggaagatgtacgtggtcaagagggacggccgccaggagacggtgcacttcgacaagatcacggcgcgcctcaagaagctcagctacggcctcagccaggaccactgcgacccggtgctcgtcgcgcagaaggtctgtgcgggggtctacaagggcgtcaccaccagccagctcgacgagctcgccgccgagaccgccgcggccatgaccgcgtcccaccccgactacgcctcgctggcggcgaggattgctgtgtcgaacctgcacaagaacacaaagaagtccttctcggagacgattaaggacatgtacatgcacttcaacaagagatccgggctgatggcccctcttgtcgctgaagatgtttatgaaatcatcatgaagaatgctgctcgcttggacagtgagataatttatgacagggatttcgactacgactactttggcttcaaaactctggagaggtcttacctgttgaagcttgatggtaaggtcgttgaaaggccgcagcacatgttaatgagggtttcactggggatacacaaggaagacatcgagtctgccatcaggacgtaccatctgatgtcccagcgctggtttactcatgcttcaccgacgcttttcaatgctggcacgccgaggccccaattaagcagctgttttcttatatgcatgaaagatgacagcattgagggaatctatgaaaccctgaaagagtgtgctgtaataagcaaatctgctggaggaattggtgtctcagttcataatatccgtgctactgggagttatattcgaggaacaaatggatcatcaaatggaattgttcctatgttacgtgtctttaatgatactgctcgctatgttgatcagggtggtggcaaaagaaagggtgcatttgctgtatacttggagccttggcatgctgatatttttgagttccttgatctgagaaagaaccatgggaaggaggaaaatcgtgcaagggatcttttctatgcgctatgggttcctgatctattcatgcaaagagtccagagtaatggagaatggtcattgttttgccctaatgaagctccagggttggctgattgctggggtgaggagtttgataatttgt

SEQ ID NO: 10818 - DNA, 2618 bp, Zea mays
  misc_feature (159)..(159): n is a, c, g, or t
cagttactcgtcatagtttttttattcaagctaatgtcttaaagatagttactctagttttttctgcatgatatctaaacttcttgatagcttagcctgcatgctgctatcatagaataagtatatcatcatttgcctgccatctgtgtctaacacagnatcgtctgctcaacttatgagtggttagcatcgaaaattctcaaagacctgctattctgaacaatattttaacaggaggaaaatcgtgcaagggatcttttctatgcgctatgggttcctgatctattcatgcaaagagtccagagtaatggagaatggtcattgttttgccctaatgaagctccagggttggctgattgctggggtgaggagtttgataatttgtacaagaaatatgagagccaagtaagctgaaaagtgaacactgtatttgtatgtacgctttattgaaatgggaatgtgctttactaaccttgctttctggattcagggcaaggcaaagaaagttgttcctgcacagaccctctggtttgacattttgaaggcacaaatagagactggtacaccttatatgctttacaaggtacatttagtggctatcaaataggagtacctcctatttttgtctcttttgccaaaagtttccagttaaggatttcttgtaatggctattaactgtatgcaggatacttgcaataggaaaagtaaccagcagaatctgggcacaattaaatcgtcaaacttgtgcactgagataattgagtttacaagccctactgaaactgctgtctgcaacctagcatctattgctttacctcgttttgttcgggaaaaggtatatcttgtcagtcctaaagctcaagtcaatcatgaaggttttattctgatgcaccatataaacttgctttacagggtgttccattagagtcccatccatctaagcttgtgggtagcagtgattcgaaaaatagatattttgattttgagaagctggctgaggtttgttcagatcctttgtcttagatctgctattctgacctatgttgatgaatgttctgatacattatcgattttggcaggttacctcaactgttacttacaatcttaacaaaattatcgatattaattactatcctgttgagacagcaaagagatcaaatatgcgtcacaggccaattggcataggtgttcaaggcctggccgatactttcatattattgggcatgccatttgattcactagaggctcatcagttgaataaggatatatttgaaactatctactatcatgctctgaaatcttctgctgaacttgctgttaaagaaggtccctatgaaacatatgaagggagccctgttagcaagggcattcttcaacctgacatgtggaatgtagtgccatctaccaggtggaattggccatctctaagggagaccatttctaaagctgggataagaaattctcttcttgttgctccaatgcccactgcttccactagtcagattcttggcaacaatgagtgctttgaaccctacacatctaatatttacagtcgacgggttctaagtggggaatttgttgtggttaacaagcatcttcttcatgatttgactgaaatgggcatttggactcctactctgaaaaaccagataatatatgatgatggttctgtccaaaagatagcagaaatcccagatgatctgaaagcaatctacaagactgtttgggagatcaagcagaaaactttagttgatatggcggttgaccgtggatgctatattgaccagagccagagcctcaacgtccacatggagcaagcaaactttgggaagctaacatcacttcacttccatgcttggtccaagggcctgaaaactggaatgtactatctacgcacacgagctgctgctgatgcaatcaagtttaccgtcgataccacacttctaaaggagaatgggaatgggatgaatgatggaaagcccacagaggaagacgtagaagctaaaatggcacaaatggtctgttcttttaacaaccgggaagagtgcctggcgtgtggaagctagattggagctccatctggacactgcaattatttgtgacctcaggccacagcattatatgccgccggctgatgactggagcccaataatcagaacgaaatctgatgtaggatgaggtagaaactccattcccttcccataatgggaacaataccttgcctctgaaatactgttaggactagtttggtaactctattttttcaagagattcatattttttcaagtgaaaatgaattaattttcttttgagaaaatagaaagaaatcccttgaaaaaaatgagattctctaggagccataaaaccggagtaaattggaggagctaaattcatcctttttattcaattttgaataagaggaatttagctcctctggttttgtggcttccaaactaaggttgtattctctaagatatttgtgctgctgctgctgccaatgttgtactgtaaatatctactaccatcaaagttattgatgttctctaagctattttttaactgtgcgcgggcgatccaacaggatgtaatgcatcattttttattatgagaagaaatgt

SEQ ID NO: 10819 - DNA, 2196 bp, Zea mays
cggcgcgtgggatgaagagacagcattgaggaatcttgaaaccctgaaagatgtgctgtaataagcaaatctgctggaggaattggtgtctcagttcataatatccgtgctactgggagttatattcgaggaacaaatcgttcggcacctcgaggccggccggggttacgtgtctttaatgatactgctcgctatgttgatcagggtggtggcaaaagaaagggagcatttgctgtatacttggagccttggcatgctgatatttttgagttccttgatctgagaaagaaccatgggacggaggaaaatcgtgcaagggatcttttctatgcgctatgggttcctgatttattcatgcaaagagtccagaataatggagaatggtcattattttgccctaatgaagctccagggttggctgattcctggggtgaggagtttgataatttgtacaagaaatatgagagccaaggcaaggcaaagaaagttgttccggcacagaccctttggtttgacattttgaaggcacagatagagactggtacaccatatatgctttacaaggatacttgcaataggaaaagtaaccagcagaatctgggcacaattaaatcgtcaaacctgtgcactgaaataattgagtttacaagccctactgagaccgctgtctgcaacctagcatctattgctttacctcgttttgttcgggaaaaggatgttccattggagtcccatccatctaagcttgtgggtagcagtgattcaaaaaatagatattttgattttgagaagctagctgaggttacctcaactgttacttacaatcttaacaaaattatcgatattaattactatcctgttgagacagcaaagaggtcaaatatgcgtcacaggccaattggcataggtgttcaaggcctggcagatactttcatattactgggcatgccgtttgattcaccagaggctcaacagttgaataaggatatattcgaaactatctactatcatgctctgaaagcttctgctgaacttgctgctaaagaaggtccctatgaaacatatgaagggagccctgtcagcaagggcattctccaacctgacatgtgggatgtagtgccatctaacagatggaactggccatctctaagggagaccatttcaaaagttgggataagaaattctcttcttgttgctccaatgcccactgcttccactagtcagattcttggcaacaatgagtgttttgaaccctacacgtctaatatatacagtcgacgtgttctaagtggggaatttgttgtggtcaacaagcatcttcttcatgatctgactgaaatgggcatttggactcctactttgaaaaaccagataatatacgacgacggttctgtccagaagatagcagaaatcccggacgatcttaaagcaatctacaaaactgtttgggagatcaagcagaaaactttagttgacatggcggtcgaccgcggatgctacatcgaccaaagccagagcctcaatgtccacatggagcaagcaaactttgggaagctgacgtctcttcacttccatgcttggtccaagggcctgaaaactggaatgtactatctacgcacacgagctgctgctgatgcgatcaagttcacagtggataccacgcttctgaaggagaatgggaacggggttagcgatggaaagcccgcggaggaagacgtagacgctaaaatggcacagatggtctgttctttgaacaaccgggaagagtgcctggcgtgtggaagctagattggagattccatctggacactgcacttcgtgatttgtgaacacagcattacatacagccggctgatgattggagctcagtaaccagaacgaagtctgtgatgtaggtcgagttggaagttcccataatgggaatagcttgtacctaaataatgctacggcgctacctctggtctgtattgctctaaggtgtttgtgctgctgccattgtactgtaaatatctaccagcgtcaacgttgtcgatgtgctctaagatacagtatgttttaaccgtgctacactctttgcattggatcgaacatgatgtaatgcatcgtcttccataatgataaaaaaactagaaaacaaaaaaaagtaaactaattagtctgtatcctcgatcgcgatatgcacttggtcctttcggc

SEQ ID NO: 10820 - DNA, 6517 bp, Zea mays
  misc_feature (66)..(66): n is a, c, g, or t
  misc_feature (2469)..(2469): n is a, c, g, or t
  misc_feature (2663)..(2663): n is a, c, g, or t
taacttcgcaggaaattgtctctcattttattctgtatccgtgttttgacaagtttcatagctaanaaggctctctaagtggatgcaattgagactcgaaggtaatccttataatctgtcaaacattggatatatgaaactttcacgtagtttaacaaggcatttcatcaaatcagtaggtgatggtaatgtatttagttctggatgattgtatacatcaaaatgataatgtgaaagctagcgctttaattggtgggacctttcttgattgaaaaaaaaaaatcaataggataatttttttctagtgatctgatgtgtatatctttgacatatcaagtgtcagttcttggagccaaacaagcacaaagcgacaaaagctctattgcttgtgagctaaagcgatcgatcttccaattggccccattaaatacatctactttataatggtgaagagttattgtgttattacgattgtttctagacttagtcacatgaatatatagtcattctacgagtccattttactaaagtaaagctgcgacaaatctagcatgcagcctgcatgattaggccccactcaagttttgacgcaataatgggatcccggccggtgatgttccgcatgcctgcttacacaatcagggaacggcttaatttactctatacatactgcttcatgttcgatctggctggccacagtcaggaacgaagggcaaattagtgatggtatacaacacaagatatatataggagttgagttggaggagcatcaggagatgggattaagctctgggcgggttcagcgagtggctagccgaccgatccttgtcctggcctctaattaaaatgccaatcagcaggggcagggcgtcatttattggccacttgctagcctggtgcgttccaatccacactcgattataagctctgctactagaacttgtctagaaagagactggcgcacctgtgtgtgtgttgccggccggccggatcgacttttggttcgtgagtcgtgacgcaaccagcagtagtagtattttcattattctccaccggggcttttgtccttccggatacgcgccgatcctcctctctactcatctgcggatcatattcacgcgtacacgcgaatcaagacaccaagaaccgtacggttgtttgctaatttgccttcgctaaaacgtactgctacttgtcatttaggacaagcttgtctacctcttacctctagctttcagaggttttacatatatcaactctagtttcatgcgaccgattaaacaaattaagggaaatggacaatttatttgtatcttaatatttcagcagtaaagactgagagacaaagtctattttcgacggccaaaaaccaccgaaaataaaccttatatcacctaagttattttcggaagtccaatcccctgaaaataagctattattttcaacgggcagacctaggttgccgagaacaacctattttcggcggttgtctcgtcgccgccgaaaactaactcggctattttcagttgtctgcgtactaaccatcgaaaataagtattttcagaggaaaaaaattagaaaaaaataaaattaatagaaattcactaagaatatatatatatatattacaacaatacaaattcatcacagatataataatttatccataaaagcaccaaaaatatcacaaatcatccacacaagtatcacaatacatacactacgaccgtcgaaaataaccttatcttcggcggcatgtgtcagtcgttgaaaataatgtattattttcgacggtcaaggtctagccatcaaaaataaccctagccattgaaaatactcttcagagctgttatgtgagagagagtatgataagtactgtcatccaaatatcagttactacaattttgaagctcccttggcaaggagacgagacgactagaaccgtcaactccacgatgtgagactactatatattcaagtttcaaatcaaattcaccttcgcctcttccattcccgtttccagataagtaaagcaaaagtgtgtgcaaaagggcacaaacagaccgcacaacaagcatgtctgccgcgccgtgaaaaaagctgttgtacgctgtgagctgtgaaaaaagctgctgtgggctgtgaactgctaacaagctaaaaaatcgttttgtggaaaccactaaaaatcgctaaaaaaatctttcatatatattttcatagtttcacctaaaagctgctaaaagcaggtgcagaggtgttttcagttttgcactacaagaaagttgacttttagaaaaatctgctttccagattcagccgtttagtttgacttttggtttttatagggcaaaagtcaaaagccaaaagtcaaaccaaacacaccctacaaacacacggggctaccgaacgttggcttagttacattacattcttcaactgcaacgtcgtcagggcacgcagggctancaaacgcgagtctgggctgggtcaacgcagacggggaacctgagtacctgaccgagcgcgaacagatagacccgatatgtccttgcgactgagcgtgtatatcataatttggcatcacatatatttatatatattcggcatcaaaattcggtactaaataaatgaaagagaaaagtccatatcatagatcgcantcaggcccgccggccttctgggatggttgtggctgcagagtggccggggagacgtagctttccgcagccgctcgcactgcactgcatcctcctgtattagtatttcccggccctgctgtggtgacggttgcgtcatttatttatatatacacaccaacaaaaaaaaggagagagcatcattttgtcgtagtggtcgacaccactgaactccacgcatgcaaatttcccgcacacgagaggtaacgtagccctgctaatgcttcgaagctcgacgttccatggaacttggatgcagtcgcctctattcgtattctgctctttgctgagtgttaaaataacattctcggtgacgaccacgtttatcaaaagtaagacactcggcatatacagacactcagtaacgatagctttgccgagtgtcaaacacttaatgacgacgttcggcaagggccgtcagcagccatttatagctgatggctgttacctttgccgaacgccagcgttggcactcggcaaagaagctatcttgccaaatgtcgtacgactgacattcggcaaaaaatactcggcgacacgccgataaaaacttcgctgagtgttttacaggctttacgaatgcttcagaaactcggcaagtagatgttttcgatggtgtgatttaatttactcgaactgctttggcagcagactgttcatcattgttgatagataaaaccttcagctctctatgcatgtctggctagctaagtggtatctgcatgcgatcaatcattggcctaggaagaagtttggttgaatctgatgggactgatgatcgggtcctcctcgaacgctgacaacttcagaacagcatgaataattaatggtggtgtttcggccggcagatactgacatgtttgtagctagctatcttagcggtagccaccagttctactgagtttggcaaccacgatcgaagcaacatagctaggcaaagtggcaaacatgcacatatcggctatgagttttttttttttgaagatctgtagcataagagagatgagaccgttgacgattcgttccttgatgtgtctgccaaatgtgtacaataccactcaaatctgatagaagtttgatggcttcttgccacgcacgctggatctgctgtggctcgatcagatagatgatgctacagcgctagcggcctactgaagtcggtctcatccccatcgtcgtctgcttcagaaagaggtactatagccaccccgggccccacgatgcccactcgcggagaactgccgacgtctgcgcacgcacaaacggcttccagatgaccgagatgccactaccacgagcatatataaatagagcagtccccgagcacatttctcttcagctcgaggccttgtcttgagttctctagctcgtccacaggcctggccagctagctagctagcactgacactgaccgagaccctgcagctagcagctgatcgatccatccatggccatgggctgctgctacggtgatttcttcgacaaggccaagccttacctcgccatgatctccctgcagttcggctatgccggcatgaacgtcatcaccaaggtctccctcaaccacggcatgagccactacgtgctcgtcgtctaccgccacgcctttgccaccgtctctattgcaccgtttgctctcatccttgagaggtactactcactacagtactcagtttctcttgctcgatctgtataccagctagccatcactagacttgggaataatataatgtggcatgcatgcaggaaggtgaggcccaacatgacgtggtccgtcttcctccagatcttcgtgttggcactgctcgggttagtgcccaaaatgaaactctgtgccgcctcgtgtcatttttggtgcccagatcgatccaacttaattaatgatttccattctttaaaagaaaaaaaaaacaaaagagagagagcactaggtagctagttgttccaggcttttcgcgaaataattgttagtcagctttaattttgtggagcacttaaaccaacaccacgctattaattaagtaataattaacctcgttaatgtcgttgttgtttaccttacaggcctgtgatagaccagaacttctactacgccggcctcaagttcaccgggccgaccttcgcgtgcgccatgagcaacatccttcctgccatgaccttcgtcatggccgtgattttcaggtatatatggttgctttaattgcttggtacatcaccagctgatcgatcgtcgtctaatctaacattaaccgcgcgcgtgcatgccatgcatgcaggatggagaaggtggacctgaagaaggtgcggtgccaggcgaaggtggccgggacgctggtgaccgtggccggcgcgatgatgatgacgctgtacaagggcccgctgatgaagatggcgtggaccagcagcggccacgcgcacggcggcggcggcggcgccgaggcggccgtcatcgaccccagcggcagggagtggttcctgggctcgctcttcgtcatcgtcgccaccctcgcctgggcctcgctcttcatcctccaggcgcacaccctgaagcagtacgcggcgccgctctccctcaccaccctcatctgcttcgtcggcaccctacaggccatcgtcgtcaccttcgccatggagcaccgcccctccgtctggaccatcggcttcgacatgaacctcctcgccgccgcatacgccgtgagtgtgtcagctagctgccagatgcgatcaaagtacgtgcctgcatgatgcgtatgtatatatactaacaatgccgtccgttcagggcattgtcacgtcgagcatagcgtactacgtgcaaggcctggtgatccagaagaccgggcccgtgttcgcgtcggcgttcagcccgctgatgatgatcatcgtggccgtcatgggctccttcatcctcgccgagaagatattcctcggcggcgtcctcggcgccgtcctcatcgtcatcgggctctactcggtgctctggggcaagcacaaggagacgcaggacaaggaggacgatgagacgacagagctgcccgtcgtggcaataatggcatccaaaaccaatggagtcgtctacgacgacgacgatgacgtcgtcttcgtcaaggagatcgccgccgccggcgctggcgctgttggaggagatgactcggagtgcaggaaggcgactggggtggtgaagtcatcctcccgtggacacggagctgctggtgcagtttgatggaacatgcatggaagaggcggtgtccaactgctaacttcctttccttgcattgccatgtgtgtcccctagtatctactgacgttgcatgcatcacagggtcgggtgattgagagaggcagctgcgatgcagagtggaaggactggaataattttgttctgtgcccttttgaattttgctacctttttgtaccgtaagatgtatctactagtatatttaacttgtattttcttatgctttaatttctgtggagaaaaaagtgatgttccgggacttaagcgaaggacatatatatatgtatgtatcacatcggcttttgccatgtaatatattattgcttttctcaaaaaataaaaaaacatcgcccttgccaacaatatattcaactcgtggtgactaaagtaacgatcaagatgcactaccggaatttggctctttgccgagtgtcatattctttgccgagtgttttatttcgggcactcggcaaagagctctttgccgagtgccacacaaaaaaccctcggtaaaagaaaatactcggcgaagaagctctttgccgagtgttttatttttgacactcggcaaagagtttct

SEQ ID NO: 10821 - DNA, 2273 bp, Zea mays
ctcgaggccggccttcagctcgaggccttgtcttgagttctctagctcgtccacaggcctggccagctagctagctagcactgacactgaccgagaccctgcagctagcagctgatcgatccatccatggccatgggctgctgctacggtgatttcttcgacaaggccaagccttacctcgccatgatctccctgcagttcggctatgccggcatgaacgtcatcaccaaggtctccctcaaccacggcatgagccactacgtgctcgtcgtctaccgccacgcctttgccaccgtctctattgcaccgtttgctctcatccttgagaggaaggtgaggcccaacatgacgtggtccgtcttcctccagatcttcgtgttggcactgctcgggcctgtgatagaccagaacttctactacgccggcctcaagttcaccgggccgaccttcgcgtgcgccatgagcaacatccttcctgccatgaccttcgtcatggccgtgattttcaggatggagaaggtggacctgaagaagatgcggtgccagggcgaaggtggccgggacgctggtgaccgtggccggcgcgatgatgatgacgctgtacaagggcccgctgatgaagatggcgtggaccagcagcggccacgcgcacggcggcggcggcggcgccgaggcggccgtcatcgaccccagcggcagggagtggttcctgggctcgctcttcgtcatcgtcgccaccctcgcctgggcctcgctcttcatcctccaggcgcacaccctgaagcagtacgcggcgccgctctccctcaccaccctcatctgcttcgtcggcaccctacaggccatcgtcgtcaccttcgccatggagcaccgcccctccgtctggaccatcggcttcgacatgaacctcctcgccgccgcatacgccggcattgtcacgtcgagcatagcgtactacgtgcaaggcctggtgatccagaagaccgggcccgtgttcgcgtcggcgttcagcccgctgatgatgatcatcgtggccgtcatgggctccttcatcctcgccgagaagatattcctcggcggcgtcctcggcgccgtcctcatcgtcatcgggctctactcggtgctctggggcaagcacaaggagacgcaggacaaggaggacgatgagactacagagctgcccgtcgtggcaataatggcatccaaaaccaatggagtcgtctacgacgacgacgatgacgtcgtcttcgtcaaggagatcgccgccgccggcgctggcgctgttggaggagatgactcggagtgcaggaaggcgactggggtggtgaagtcatcctcccgtggacacggagctgctggtgcagtttgatggaacatgcatggaagaggcggtgtccaactgctaacttcctttccttgcattgccatgtgtgtcccctagtatctactgacgttgcatgcatcacagggtcgggtgattgagagaggcagctgcgatgcagagtggaaggactggaataattttgttctgtgcccttttgaattttgctacctttttgtaccgtaagatgtatctactagtatatttaacttgtattttcttatgctttaatttctgtggagaaaaaagtgatgttccgggacttaagcgaaggacatatatatatgtatgtatcacatcggcttttgccatgtaatatattattgcttttcttatcgaataaaaaaacatcgcccttgccaacaatatattcaactcgtggtgactaaagtaacgatcaaggatgtacgttcagaaattaagaaacggtttttaactactgcgttaattattcccgtgtatattgatgctccatctattctaacatataaagtatttagtttttttagagagttaagcatcgatcaaaatcatagtaaaaattacaaaaattgtaacacaaaatagatatactatcagaaggagtcggatatggatatattttatcacccgtgggtcaaaaccgtatccgatccgaagtcgagcgagcacggattagaatattatctctcacccacggattatccgttagatatccgaaactaactcatagtttattttttggctagcccatattacataacaaaagcaaacctaacaccatgaacaccacgtctaattctctcaattcctcacggttggccgccctttctagccttgctaacttcatgtggtgtgccttatgtcccttccaattcccataggccgcagcacagctggcgactggccggca

SEQ ID NO: 10822 - DNA, 2725 bp, Zea mays
ttgtgcggcaaaatcatagagcctaaaacactaaagttatatataataaatgaaaaatattgttttgtataaaacattggcgaaaaatgtggcatagagttgcaaccggtaagaacggtgagcattggtcaaagtgtgtcagccatttccctccgggaaaagaatgtatttggttggcgagtggcactacaaagagttacagtcattttcggcggctataagccgccgaaaataagccctttgccatcaaaaataagttattttcggcggtttagggcttattttttgcggttcctggccgccagaaaaaagctgttattttcggcggccaacccttagccgccgaaataacagtggccgccgaaaatcgtgtacagtgctgttgtgtggagaagaatgaagcggctttaaatataaatatgtctcaaattcaaagagtggagggatggaaattgattgtatgtatcttcagactatgattctgctccgcaatctatatcacgttcttcggctcgctcccctaaacagaaatgtagtacataaatatctcacatgcataggcaacaacaatacacaaaatatattttatataaaaccatatcggattaattaatatatacctatattacgattattagaatgaaattcaattccaaggattcaaatgaggcctaagtaagttaacttggttgacacaatccaagtgacgacttgactaaacaactaataactacgggagtagaatcttaaggatatccattggaggttatatttcagctctaacctccaacaaatgaaagaccacaacggaagcccttaatagctccttccgtagctctttacatatatttgtagactaaaatgtgcttgtatttatgtaaatatctacagctacatcgctcggtgatttcgtggacctatggtgtagctatgaactgtagtgtagtgcggtagataagcgtccatttcctgtacctatcggataggaaagcaagagcgcgagaatatctgaatctttcgccactttggcatctgcatcatatatacatgcaaatatctccagctctttatgtgtgcgcactacgtgtctacatggataggatgcaaatatcttcagcaaggcaccgagcgtccgctgtctgcaccaagagataattcgagaagagatgacgctaacagatcagctagctagcataccaaaacttcactcactcaagcccttttctgtagtactccctccgttttttttatttatcgttggatagtgtaaaattgtactatccaacgacaaataaaaagaaacggaggaagtaataatcaccataagcgcttcgatgcgtgctcgtctgattcgtcgctggtcatctaaataatgcttccaagctacgtggtcgactcgtgtgttttcgggaatagattcctctgattgctacctattgttcgaaaagaaaaggaggattccctgatcacttattagtcccttgatcttgttcacattggcggatagacatacgagatactatatccgttcacaggtatataatatcgttgattttttagaaaactttgaccactcatcttacttacttaaagtatttattcaaaatataaaattttaagttaaatataaactatcttaagtgataaaataaattataaaaaataaataataacttattgttttttaaataagatgagtgattatttttttttaaaaaaaggtaacgatgttatatatttatgaatgaaggaagtagtttattcccagtattttttttccttgaaaaagaagatacgtacacaccatgactactccggcagatcatctggcattaagtccatttgtataccgagcttatccaattttgaaactttttgtggaccagtacgtaacttccgatcaaatttttctgagagcttaacttttgacaggatcacttaacattcgaggtttagctaactttcaagagtttcctgctaatttcgtagggtttaggctttataaagttaaccagtgtggtgtagtgatctgcagtaatattcctatatactgaagcacacgtcgcgcacgagaccattacctagaacatcctaatcgaaacaagcaagcaagcaagcacttggcctctcaaccaacggggcgcgcacacgcacactgccaacgaggcaccaagaaggcaggaagggatggagtactgctaccagtacaacagcgtcagcaacgcggagaaggagaagaggccgccgctgaggaggggcggcgtcaagctccagatcgtgaagaccctcagcaacctcgtcgtggcgcccagcaacggcagcgactccaagcaagcggaccgcaacagcttcacaagggagcgaagctacaactgaaacgaactgtatcttcagtatttggatacagatgtcgaccttgtgtctgaagaactccgctttgggactcgagaggttttcttagcttgttggacttccttgtttgcttggtccactagtgatgaaatggaactgtatgataagttcgttcccgtctgtgttttgttttggaaaggaagcttctatggctcatacatagacaaggactaaacggtaagacgagtcttctaagtctaattagtccttacctagtttagtgattaactaagtttgtaggaactatgtgtggcgcaatatgtagcctacgcaatcaaagtaaaaaagttatagctctaaaaaaaaaaaaaaa

SEQ ID NO: 10823 - DNA, 1101 bp, Zea mays
gaaagaagatgggccagctggctgcgctgacgaggaggcacctcttccgacgtcagtcaagcctcgcgagcacgagcacggggaaggccggccgctccgggtggaggcccctctcttgtcctgcgagagcgaggtcgctgacaagggggtctggacgaagctgaaagacgctatccaccagttcatcaaggagctgatggcaccgcccaccatatccgcgataattgggttcgttgttggcctggtcccatggctgaaatccctaatcgtcggcgacggagctcctttcaaagttatacaggatgccctccagctgatgggcgacggcacgatcccttgcatcacccttatcctaggcggaaacctgactcaagggcttcggaagtcggggctgaagcgtgcggtgatcgtcgcggtcctgtgcgtccgcttcgtgctcctcccgctgatcggcatcgccgtcgtccgcgccgcgtacgggctcggcttcctgtcccgcgacccgctgtaccgctacgtgctgatggtgcagttcgccgtgcctcccgcgatgaacatcggaacgatggctcagctgttcgacgttggacaagaggaatgctctgtcatctttctctggacgtacctcgttgccgcggttgcgctgacggcgtggtcgacggtcttcatgtccgttctgtcttgattgaagtctgtcaccggaaccaatgcacagccgcattttccgagcctattgttgctcaaggcattcagcttagcaacaggaaaggaggggatggtgatgggtctcatgtctcaatgagcagaagcaaaagctaaaggtgacatacaacaatatatatacacataggcagtagtagactatgatcatataggtaattgtttattattttattgtgttgggctgatgggtgatggctgacctattcgtcggcaattattggcatagttcaaacagttcatggaactagagggttccattttgttccatgtatacggatgaagaaacaaggaatcatccctacagaaaaacaaatgaagaagggtactattattcttgagtatttgatcagtacataccggccaaaaaaaaaaaaaaaa

SEQ ID NO: 10824 - DNA, 2725 bp, Zea mays
ccggccggccttttaaatccaactagaatgtgctagagagtagggaaggccccatcattgtgaggtgccacaaatggtggaacggattcgtatccaggagacgtttgaggtcgtccttcagcgcttatcatatacatactgcgtgcccctcggccggcgggtaattcacaagacaagagaggatgggtttcttctctctatttctggtggcgtctatgccgatcatccaggtcctgctcataggtgtcattggagcttacctggcctctggtttcagcaacgttctgacgacgagtgctcgaagggatatgaacaaggttgtttttactgtgttcaccccatctttgatgttcgccagcctcgcgaagacggtcacccttgcagacgtcatttcttggtggtttatgccagttaatatagcgatcacgttcatgatcggtggcactctgggctggatagcttgcaacatcttgaagccaccgcagcacttcaggggcttgatcatggccttctgctcagcaggaaacctcggaaacctgctactgatcattgtcccggctgtatgcgacgaagacgggaacccgtttggggatgattcaagcacttgccgctcacgcagtctctcctactcgtccttgtccatggctctgggtggcctcttcatatggacgcacacgtacagcctgatgcagaagtccggcaagctgtaccacaagatgcagtccaaaagcatccagtgcccagccgacagcgacgaggagcatgagcaagccaaagaagatgggccagctggctgcgctgacgaggaggcacctcttccgacgtcagtcaagcctcgcgagcacgagcacgagcacgagcacggggaagaagaagaacaccaaatggaggcccctctcttgtcctgcgagagcgaggtcgctgacaaggggttctggacgaagctgaaagacgctatccaccagttcatcgaggagctgatggcaccgcccaccatatccgtggtatgtttaggtatctcgcttctcacttcgctgtggcacgtagttggaattggaaggaccaactctgatgttgatgccacatcttggatgagataattgggttcgttgttggcctggtcccatggctgaaatccctaatcgttggcgacggagctcctttcaaagttatactggattccctctagctgatgggcgacgacacgatcccttgcatcacccttatcctaggcggaaacctgactcaagggctttgaaagtcggggctaaagcgtgcggtgatcgtcgcgatcctgtgtgtccgcttcgtgctcctcccgctgatcggcatcgccgttgtccgcgccgcgtacgggctcggcttcctgtcccgtgacccgctgtaccgctacgtgttgatggtgcagttcgccgtgcctcccgcgatgaatatcggtcctttaaggtgacaccaatggagaattcctgatggctatgcaacaacaacttgtccatgaaattcgtgaagtatggacaacttcagttgagaatctactttatatgaaggaagaccttatcatccctcatggatgtgtgcattctcttgtaatctacgaagttctgttaaagttagtcgaaccattttctgattctatgttctctcatttgtttgacaacaacacatcttttatgaattaattattaaacaaaacgaggcgcaagactggattggtaattcatatattcttttgtggtgcgaatatattctggtaaagacatgttattttgttctaaagcacatgccataaaagaggttcccgaaaatgattatcatgttttcaaagaaatataaaattgcgtacagtaaggaacattttgaataggcagaggatatttttaagtgagacatacaattcggccagttgacttaaataagaattttcttcgtaccaccttcttatcaattttatctttttctatgatttttattacatataacataattagcaaaacattattatttatgattaccattagctatctctttctacaagttatggacatgtggagaaatttgtagtagtgaaacaactaaattaaaatagcccacaatagattatgaaatatttttctcataacaatataacacacattttgtatataagttatcgtggtattatatgttcccgttgcaacaatgcactgtcaatattgtatgagtctttaagtgtagtagcaaaagtcttggcacgtcattgttttagttattgtgttctgaacaacccattttatatatggagctcgtggcaatggcagcgccgcaacacgacgatggagcccgtagtgcgctcaggctcgcgcttctctgcaacaatgcactgttccccataagggctcccgtcactattgcgttcacgccgtccatcgctagaaccttgagcaattggaggctcgttaatttgtgttccgtcgcaacgcacgggcacatacctagttgaaatatatggctaccttattttataaaatttgatcaaaaattataggacacccttccaagtgccttaaatacactatattgtattgggttgtcctataatctagatttgtggttgttaaagcaaaatattttattggtgctctaaattctagaaattatacttgttttgaactttatagatatttttacagattacagtgttggagatgctctaaggtgagtaaaaatgtttggggttgcttgtagg

SEQ ID NO: 10825 - DNA, 2038 bp, Zea mays
  misc_feature (9)..(9): n is a, c, g, or t
  misc_feature (2003)..(2003): n is a, c, g, or t
  misc_feature (2019)..(2019): n is a, c, g, or t
cggccgggnaaaaaatatctccccccttctttgttgttgttgatatgtggcacccaaaattatacaacatccaagtggagagagaataatggtcatcatgttgattatgatcaacgaccccgggcctttaggggaaacaattagatatgcgagtgtccatgctcatttggggtgcactggtagtaggagggatgatttagagtcactggcatacacccttattttcctgataagaggaagattaccttggcaaggctaccagggagataccaagagtttccttgtttgcaagaagaaaatggctacttctccggagatgctttgttgttattgtccagctccattcaaacagtttcttgagattgtcacaaatatgaaatttgacgaagagccaaattatgccaagcttatctctctttttgatgggttgattgaagcacctgcttcgagacaaatcagaattgatggggctctcaaggttggacagaaacgtggaagattggttgcagatctagaagaagatgaacaacctaaaaagaaggttatattagggagcctagcggctcaatggatttcagtttataatgcttggtggcccatgaagcagaggtaccattacaatgtggctgactcgaggctaagcatgatgggctttacattagcagcgtggcttcctcggcaaacctttgggcactcatcatggacgcaggaactggtttctgttctcaggtttatgagctctcaccagttttcctccaaaaggactggataatggagcagtgggagaaaagctactacataacaacaattgctggatcatccaacgggagctcattggttgtcatgtccaaaggaactccttacacccagcaatcatacaaggttagtgagtcgtttccttacaagtggatcaataagaagtggaaagaagggttccatgtgacatccatggccaccgctgggaatcgctggggcgtagtcatgtcaaggaattcagggttctctactcaggttgtagagttggatttcctgtaccccagcgaaggcatccaccgacgctgggagagcggctacaggataacttccacggcggccaccaacgaccaagccgctttcatcctgagcatgccaaagcggaagccgatggacgagacccaggaaacgctccggacctccgccttccccagctcacacgtcaaggagaaatgggccaagaacctctacatcgcttcgatctgctacgggcggaccgtgtgctgatggcgcgcacgtgggaaatggaagtcgaagcgcctcgcatcaagagatgcgagatggggcgtcaagtcgaaaccagttctaatgataggatcagtgtatctctgaagatacggtatgggttaccctaccgtatttgtaaagaaataatgccagccgaacgacctttcctaacgcgtttgggcagaaattcgttgctgtcgccatattttgacaggagtttctccccgtgttgtcggtagaaatttgcgcgtgcactcttcccgttttggggcccatgcaatgtgtttcacccgatgtatcgctgggctgcctgtgtcgtgagcctcaatggcattttattttgagagacgtagataaattgaattggttgaatatttagagctcagccagtcaaggcccgattagcttctctttttgagatacaattcccgggctatgtcagtagcaacgtatctaatactccagtcgttccaaaatataattcgtttaaattaatctctactactctataagctcttattgtaggcatccacagttatcggttctgccccgcagcccgtcagcccccgcggtattttcggagctaagaatattgtgaaggaacttattaaaaaggcacatgataagcatttggaagctgagctaggtcgcgacatgatgcatggaattgttttaaaatagagtgaacctcagattcttatcaaagctcgtgatgttgctaggagcagtgctcgaaatagctngtctgaaaggataatntgaagtctatgggtcacta

SEQ ID NO: 10826 - DNA, 843 bp, Zea mays
  misc_feature (787)..(787): n is a, c, g, or t
ccggccgggagctcccccgccgttcgtgcctgcctgcctgcctgcctcggcctcctccctcgtcctcccctcctccgccgcctcaaacccggccccctcgcgcgcgtgcgcggcgctcgaggcgacgaatccagccacctcctccgcgcccatccccgccgccggtcgccgatattggaaggagctcggaaggctgggacgctgacccgaattttatggggagaggatgccagagctgcgaagcaatactcgtcaagcacgcttaaggtctaagaagcttgacgatctgcagccaggagagccgcttgcgaaaccggtgtcacctgctctgccgagcgcacggaagcgtgctcctacacgtgctgctaggggcagaaagggtgctgctgggagaggagtgcctcccgcaccaaagcctagaagaaagggggttgatattgtcgtcttagaagctgatcctgcttgtgaaaccccacttaaagctttcaagggactggaagttgctgctgctgcacccaagaaccttcctttgaagcaggtagccgaagttggtgttccgaaaatgaatggtgaaagtggggagaagattgttggggctgaagatgaatcgacagctacacctgtcccagaaagggttcaagtaggtaattctccagagtacataactgacaggaagttaggtaaaggtggttttggtcaggtgtatgttggtcgaagggtttctggtggtgctgctcgcactggtcctgatgcatatgaggttgcattgaaattcgagcatcgtaancagtaaaggatgcaattatggccccccccatatgagtggcaagtttataacactct

SEQ ID NO: 10827 - DNA, 2686 bp, Zea mays
  misc_feature (2678)..(2678): n is a, c, g, or t
gcacgagaccattacctagaacatcctaatccaaaaacaacaattcgtgcctgcctgcttgcctgcctcggcctcctccctcgtcctcccctcctccgccgcctcaaacccggcccccacgcgcgcgtgcgcggcgctcgaggcgacgaatccagccacctcctccgcgcccgtccccgccgccggtcgccgatgagctcggaaggctgggacgctgacccgaattttatggggagaggatgccagagctgcgaagcaatactcgtcaagcacgcttaaggtctaagaagcttgacgatctgcagccaggagagccgcttgcgaaaccggtgtcacctgctctgccgagcgcacggaagcgtgctcctacacgtgctgctaggggcagaaagggtgctgctgggagaggagtgcctcccgcaccaaagcctagaagaaagggggttgatattgtcgtcttagaagctgatcctgcttgtgaaaccccacttaaagctttcaagggactggaagttgctgctgctgcacccaagaaccttcctttgaagcaggtagccgaagttggtgttccgaaaatgaatggtgaaagtggggagaagattgttggggctgaagatgaatcgacagctacacctgtcccagaaagggttcaagtaggtaattctccagagtacataactgacaggaagttaggtaaaggtggttttggtcaggtgtatgttggtcgaagggtttctggtggtgctgctcgcactggtcctgatgcatatgaggttgcattgaaattcgagcatcgtaacagtaaaggatgcaattatggccccccatatgagtggcaagtttataacactctcaatggttgctatggcataccatcggtccactacaagggtcgtcagggcgaatactatatacttgtaatggatatgcttggtcccagcctttgggatgtgtggaattcgatggggcaggcgatgactccaaatatggctgcttgcattgctgtagagagcatatcaattcttgagaagctccattccaaagggtttgtgcatggtgatgtgaaaccagagaattttctgcttggtcagcctggatcgcctgaagataagaagctttaccttatagatcttggtttagcatccaagtggagagagaataatggtcatcatgttgattatgatcaacggcctgatatctttaggggaacaattagatatgcgagtgtccatgctcatttggggcgcactggtagtaggagggatgatttagagtcactggcatacacccttattttcctgataagaggaagattaccttggcaaggctaccagggagataccaagagtttccttgtttgcaagaagaaaatggctacttctccggagatgctttgttgttattgtccagctccattcaaacagtttcttgagattgtcacaaatatgaaatttgacgaagagccaaattatgccaagcttatctctctttttgatggtttgattgaagcgcctgcttcgagacaaatcagaattgatggggctctcaaggttggacagaaacgtggaagattggttgcagatctagaagaagatgaacaacctaaaaagaaggttagattagggagcccagcggctcaatggatttcagtttataatgctaggcggcccatgaagcagaggtaccattacaatgtggctgactcgaggctaagccaacatatagaaaagggcaacgatgatgggctttacattagcagcgtggcttcctcggcaaacctttgggcactcatcatggacgcaggaactggtttctgttctcaggtttatgagctctcaccagttttcctccacaaggactggataatggagcagtgggagaaaagctactacataacagcaattgctggatcatccaacgggagctcattggttgtcatgtccaaaggaactccttacacccaacaatcatacaaggttagcgagtcgtttccttacaagtggatcaataagaagtggaaagaagggttccatgtgacatccatggccaccgctgggaatcgctggggcgtagtcatgtcaaggaattcagggttctctactcaggttgtagagttggatttcctgtaccccagcgagggcatccaccggcgctgggagagcggctacaggataacttccacggcagccaccaacgaccaagccgctttcatcctgagcatgccgaaacggaagccgatggacgagacacaggaaacgctgcggacctccgccttccccagctcacacgtcaaggagaaatgggccaagaacctctacatcgcttcgatttgcttcgggcggaccgtgtgctgatcgcgcgcgcctgggaaatggaagtcgaagcgagggccaccgatccggtacggtggcgcctcgcatcaagagatgcgagatggggcgtcaagtcgaaaccagttctaatgataggatcagtgtatctctgaagatacggtatgggttaccctaccgtatttgtaaagtaatgatgccggccgaacgacctttcctaacgcgtttgggcagaaattcgttgctgtcgccatattttgacgggagtttctccccgtgttgtcggtagaaatttgcgcgtgcaaaatacaaagtttaaaaaaaaaaaaaaaaaactcgaggaggggnggcggtac

SEQ ID NO: 10828 - DNA, 1198 bp, Zea mays
tgtaaaaaggaaaacaatcgcgagcgccggccggggaccgagcagctccacaacaattcgtgcctgcctgccctgcctctcggccacctccctcgtcctccccctcctacgccgcccccgtcctcggcccccacgcgctcgcgcggcgcacgaggcgacgaacccgacctcctcctccgcgcccgtccctgccaccggtcgccgatattggaaggagctcggagggctggggcgctgacctgagttttatggagagaggatgccagagctgcgaagcagtactcgccaagcatgcctaaggtcgaagaagcttgaagatctgcagctaggagagccgcctgcgaaaccggtgtcacctgctccgccgagggcaggaaagcgtgctcctacacgtgctgctaggggcagaaagggtgccactgggaaaggagtgccccccgcacctaagactagaagaaagcggggtaatattgtcgacttggaagctgatccagcttgtgaagacccccctaaagctgtcaagggactggaagttgctgctgctgctgcacccaagaaccttcctttgaaggaggtagccgaggttggtgttctgaaaatgaatggtgtgagtgcagagaagattattggggctgaagatgaatcaacagcgacacctgtgccagagagggttcaagtaggtaattctccagagtacataactgacaggaagttaggtaaaggtggttttggtcaggtctatgttggtcgaagggtttctggtggagctgcccgcactggtcctgatgcatatgaggtcgcattgaaattagagcatcgaaacagtaaaggatgcaattatggccctccatatgagtggcaggtttataacactctcaatggttgctatggcataccatcggtccactacaagggtcgtcagggcgactactatatacttgtaatggatatgcttggtcccagcctttgggacgtgtggaattcaatggggcaggcgatgactccaaatatggctgcttgcattgctgtagagagcatatcgattcttgagaagctccattctaaagggtttgtgcatggtgatgtgaaaccagagaattttctgctcggtcagcctggatcgcctgacgataagaaactttatcttatcgatctcggtttagcatccaagtggaaagagaataatggtcatcatgtt

SEQ ID NO: 10829 - DNA, 606 bp, Zea mays
ctgggaatccctggggcgtagtcttgtcaaggaattcagggttctctccccaggttgtagagttggatttcctggaccccagcgaaggcatccccccacgctgggagagcggctacaggataacttccacggcggcccccaacgaccaaaccgctttcatcctgagcatgccaaaacggaagccgatgggcgagacccaggaaacgctccggacctccgcctttcccaggtcacacgtcaaggaaaaatgggccaaaaacctttacatcgcttcgatttgctacgggcggaccgtgtgcttatggcgcgcccgtgggaaatggaagtcgaagcccctcgcctcaaaaaatgcgagatggggggtcaagtcgaaacccgttttaatgataggatcagtgtatctcttaaaatacggtatgggtttcccccccgtatttgtaaaaaaataatgccaaccgaacgacctttcctaacgcgtttgggcaaaaattcgttgctgtccccatattttgacaggagttttttcccgtgttgtcggttgaaaaaaaaaaaaaaaaaaaaaaaaaaaaaaaaaaaaaaaaaaaaaaaaaaaaaactcgtgggggg

SEQ ID NO: 10830 - DNA, 1767 bp, Zea mays
tatacactctaatggttgcttggctacctcggtccactccagggtcgtcagggcgactactatatacttgtaatggatatgcttggtcccagcctttgggacgtgtggaattcaatggggcaggcgatgactccaaatatggctgcttgcattgctgtagagagcatatcgattcttgagaagctccattctaaagggtttgtgcatggtgatgtgaaaccagagaattttctgcttggtcagcctggatcgcctgacgataagaaactttatcttatcgatctcggtttagcatccaagtggaaagagaataatggtcatcatgttgattatgatcaacggcctgatatctttaggggaacaattagatatgcgagtgtccatgctcatttggggcgcactggtagtaggagggatgatttagagtcactggcatacacccttattttcctgattagaggaagattgccttggcaaggctaccagggagataccaagagtttccttgtttgcaagaagaaaatggctacttctccagagatgctttgttgtttctgtccagctccattcaaacagtttcttgagattgtcacaaatatgaaatttgatgaagagccaaattatgccaagcttatctctatttttgatggtttgattgaagcacctgcgtcgagaccagtcagaattgatggggccctcaaggttggacagaaacgtggaagattgcatgcaaatctagaagatgaacaacctaaaaagaaggttagattagggagcccagcggctcaatggatttcagtttataatgctaggcgacccatgaagcagaggtaccattacaatgtggctgactcaaggctaagtcaacatatagaaaagggtaatgatgacgggctttacgttagttgtgtggcttcctcggcaaacctttgggcactcatcatggacgctggaactggtttctgttctcaagtttacgagctctcaccagtttttctccacaaggactggataatggagcagtgggagaaaagttactacataacagcaattgctggatcaaccaatgggagttcattggttgtcatgtccaaaggaactccttacacacagcaatcatacaaggttagcgaatcgttcccttacaagtggatcaataaaaagtggaaagaagggttccatgtaacatctatggccactgctggaaatcgctggggcgtagttatgtcaaggaactcagggttttctactcaggttgtagagttggacttcctgtaccctagcgaaggcatccatcggcgatgggagagtggttacaggataacttccacagcggccaccaatgaccaagctgctttcatcttgagcatgccaaagcggaagccgatggacgagacgcaagaaaccctccggacctctgcctttcccagttcacatgtcaaggagaaatgggcgaagaatctctacatagcctcgatctgctacggacgaaccgtgtgctgatagtcgaagagaggccgcgctgactcagtacggtggcttgcgtcaagagattagagatgtgagatgaacattaaatcaaaaccagttctaatgatgataggatcagtagatctgaagatacggtatggtatcctaccgtagctgtaaagaaatattgtaccacccagtgccggccgcgagaccgttactgccatgaagtgaagctaatgcattttggagtctcttcccgggaaaagggaacacaataatgctcatgtgcaagtt

SEQ ID NO: 10831 - DNA, 1482 bp, Zea mays
agggagcccagcggctcaatggatttcagtttataatgctaggcgacccatgaagcagaggtatttacaatcatttaattagatgctctacaaggcatgatagtttggttacacttgctgcatttctctagtaatccgtagccctgtaaacatgatcattaagatgtgatgaactattgctgctaagctttgtcaacatctgttgtgtgtttcttaggtaccattacaatgtggctgactcaaggctaagtcaacatatagaaaagggtaatgatgacgggctttacgttagttgtgtggcttcctcggcaaacctttgggcactcatcatggacgctggaactggtttctgttctcaagtttacgagctctcaccagtttttctccacaaggtacagttatctgagtcaagcttgaacatgcctaataatttatttagccagaaagcctaactctgtttctaattataaacaggactggataatggagcagtgggagaaaagttactacataacagcaattgctggatcaaccaatgggagttcattggttgtcatgtccaaaggtctgaattttacttttcttattattgctcacacgtgcatattgaccctccattttgtcaccattttcccagtagcagtacaaaatcctaatgtttctcttgtatgtcctatgcaatttccattttaagccccgtttgcattgctcattaattatcatggtctgctatgatataatttggggtaatatattttcactactgcaggaactccttacacacagcaatcatacaaggttagcgaatcgttcccttacaagtggatcaataaaaagtggaaagaagggttccatgtaacatctatggccactgctggaaatcgctggggcgtagttatgtcaaggaactcagggttttctactcaggttgtagagttggacttcctgtaccctagcgaaggcatccatcggcgatgggagagtggttacaggataacttccacagcggccaccaatgaccaagctgctttcatcttgagcatgccgaagcgcaagccgatggacgagacgcaagaaaccctccggacctctgcctttcccagttcacatgtcaaggagaaatgggcgaagaatctctacatagcttcgatctgctacggacgaaccgtgtgctgatagtcgaagagaggggcggccccactgactgagtacggtggcttgcgtcaagagattagagatgtgagatgaacattaaatcaaaatcagctctaatgatgataggatcagtagatctgaagatacggtatggtatcctaccgtagctgtaaagaaatgttgtacccagtgccggccgcgagaccgttactgccatgaagtgaagctaatgcattttggagtctcttcccgggaaaatggaccccaacggaatgctccaaaaaaaaaaaaaaaaaaaaaaaactcgaggaggggccgcgggtaccc

SEQ ID NO: 10832 - DNA, 5884 bp, Zea mays
gcacgagaccattacctagaacatcctaatcgaaaagcttttcctctttctgcgtctgcctctgccactcgtccctcctggatcagtgagtcccggagtagaagatccggcctttttagctgcttgtagtggtagttggttgtttctggggagttgcaccaccgggaagcggggcaggagaggagggttggtgggattgcggtgatggactccggcaacagcgggagcctccagtcgtctagcggcggcggcgacgacgagtacgactctcgggccggcggcggtggagggggcgtcgactcctccgcgctcgccgcactgctccgaccatcgccgtcgccctcggccgccgcgttctcgctccacggctcctacttcggcctgcaagagctgacgtcgtcggcgccgccgcctccgcagcagcagcagcagccgggtacctggtcattaggggcgttcgctggcgcctcggggctgccctcctcctcgtccccgcgcgtcgcgcaaccccgactcgggcacgggcgggcggcagcaggctgctgacaccacgacagtggggcgggatgcccgcgccggcgcagccaccgagggggacgcggaagcgagcgcgcgcgtcgcggcgggcgcccacgacggtgctgacgaccgacacctccaacttccgcgccatggtgcaggagttcacgggcatcccgtccccgcccttcgccgcgggcgtcggggtcgggggccccgccgcgtcgctccgcacccgcttcgaccacatcttccccccgccgtcctcctccctgccgccgtacctcctgcgccccttcccgcagaagctccctgctgcgccctccagtttcccgcccttcacgacgacgacgacgacggcgacaccgtcgtcgtcctcgtccacgcccgtcggcgtcgccaatgccaatgccgcgacgggcacgtccgccaccgcagcagcaccctccaaccctgccgcgccggcagcggcagcggcagccggagcgggcgacaccttccatcatctgacgtcctcggcgcttctccggctacaggaccccagcggctgctacctctccttcccgaacctcctcgacccgcagccgccgtcgtcgcagtgcattttcggcgcggcgggcgggttcgggcaggcgtcgaggctgcacgacccggcgccgtcgccgtcggatttcctggccagcggaagcctcggcctcagtcacggcggactcttgggctccgagggcctacacttgcaccacccaaggaccgacgacgagctgtcgggtgtggtcgcggccggcgcttcgggcggcagctgcaagctgaactactcccacgccggcgcggccacctcgtcatcgggcgccgacaagccaccagacggcggcggcgccggtgctggcggaaccggaaggccgggacgaggcgagggcctggatccgtggatttgtacatcggagtagggatgggcaaggcatgctgcttcgtcctgtgtgagctgtgcgatacggcggggacgaacacgaaaccgagccaaatccgccatgcatgagcaatgacaaaacgaaggtctgattataccttttgttacttattgttaaatcatcacttctttgccgaggcagttgtcgtagattgccgccccttttgtacattaaattaaaaaaaaaccatcatcttgcttcggcttgatctcaaaaaaaaaaaaaaaagtcaatcgctcgcacgcacgcacacgcgattaagaggtgcaaatgaagcaataatgcctcgtactagttagatagagatagagggagagagtcgcaacctgcaggggctcccgcgctcgccggctccgtttttggtgcgtaacccccgggcggggcccacggtcccgaacatgagtgcaaacaaataatccccaccggcggcggcggcggcgatgggccggcagagattggcggcgagatttccggcgcgccaagtttctccactctcctctcctggctgcgagcgcgcgagttgagttgctccaccggtccccaaccgccgctcaccaaaccaaactgctgatgcatacagtacgtacttctccgtatgtgtgtgtgtacacgcaaacggcaactgatgctactactaccgcacgaaggctccatgggaaacggacggcgactgcgaggaagacgacgacgacggatcgtgattggtggggggagagtatgcatgtacgtgtacgttccccgggttgaccgtgtcatgagatcagacgcggcatggatttttttttaaaaaaagagaagatcgcggcaggcatgtgacgggggccgtcacgggtcttaatcaagcagcggtcctcgacgcgttgtgtgagaggggggagccagggaggggcgggcgatatgccggtgtcaatcttttgcagcaacgtgatgtggttgtctgggccgtcagctagccaggggggggtgcgtaggaggaggaacggatggatggaggacgggacgggacggagccaagggagggaggtgtgacctgttgcatgtgtccccctcttccctacacttgattgcactacgatggacagggtactttttcctcgttcgtccatacatacccatgggcgctgcgctgtcagctctccgttggatttttttttttttgcatattcaagactggatatggattgcattttgatctctctctgcactcgatagcttgcttgatcgagaggtttgttctgtttgcttggattggatatatattcttactgcgcgtacgtccaaggcttttttttatatcctactgtatatagctacagccttatttaataaaataaaaaactatactttgcgaaaggttatctaaacggttaacctcacgaaacccacaccacatttactagtagaactactactagcacataataaatctcgaatctagattcgtcttttttttccttccggggtgaaggtacaccaaacatgccctctaataattggtttctcaaggttcacgtccatgcctgcgtcaccagtacgacgtacacgctctacatactactcctcagtacgtacaggtagcggttacctttttttcctctagaaggaaaaaaaaaagaaaaccttgttcggttatttttattttatgtggattggatgagattaaaaaaaattatgaaagattttaacttgttttaaattgaaactcactcattcccacctaagccacctagattgagaacaaaacgaataagccctaaccgatgtctctggaatcacctggtttcacattgctctactagtggtaaagtttttagcgtaatagtagtagtagtacattctaggccaaagttttacggttaccagccatgagagcgacgccaattgttgtgcaactaggagaatgggtggactggaggaggagtaatctgtagccctcgagatgattaggcgctgcatggggttagatcagcggcagtgattgttgttgcctgaccgccaggtgtaaagcgcgcgcgcgcatctgatcgatgcgaaacaagcgacggcggcatgattagctcgcccgtcgatctgcctcgttccacccgtcgtcctggtggttcggcggctgctgctgctgcgtcggcgtcggcgtcgtccgcccgcagactagtacgtagtggtaacatgtgaaccccgcccgcccgctggaatgaatcatggtcgcccgcccatttgcaggggaataactctgttgtgctgcaatgatgcctattctcctctctgctacaatgcattgcgggttgtttgctgctctgtgtcctgtcttcttccctctttgctgctgctgctgctgctgcgctctggcgaggcgatgatgatgacgaagatgatctcccgcacaggaccctgatcctggacgagtgcccgcgtgaaatttcgagccaggccccaaaagttaaggcgcttttcagacgccgaacggaaagtctggccggcgacaccagtccactccacagcgcaccacaggccacgccactgctcctgctcttcagctcttgaccagagagggtcgagctgctggttcgccggacggacggcctgtcatagtttacatgcccaaattaatagtgtttggtttgaaaaatcaaaccatccaaattgaggtggtgcatcataaattcattcctcaaatttggtggaatgacttcattcttcatattagtactaactatagagggtgtttggtttaaggaatcactacatttaaattgaggtggtgcatcatggattcattcctcaaatttggtgggatgacctcattcctcatattagtactaactaactatgaagaatgaggtggtgatggatcaattcattccattccacaaaccaaacaaaaatagtgaggagtgagaagatgatggactagctcattcctcaaaccaaacaccctaataaggaataaagtggtgatgaatcaactcattctattccacaaaccaaacaaaaatagtgaggagtgataagatgatagattagctcattcctcaaaccaaacaccccataagtacccgttgagggcttgttgggttagttctagtttggtagctataaactgaatgagattgtaggactaaaattctctttttattgaaaatttaataagaacaatattttagcctctataatccacaccagttttttttctctctcaaactagctcttagacctagtttgtgtactctagtaatgactcagattgaagtgaatttagatgtattaagtgagtatttgacctattagagatttacacacactcttcgatccctccaaaacactccaatcccaaagtatccaaactggaccttaggtgtggattgacggagattggagaacattaaatccgctcctatacaaatttgtttagtaggggatttaatccccttccaagattatgagttttgtttggttttctacctaaaggcacaatctaccttagcttagtcgctcgaattgaagaactaagcttagaaagaaaaggtatgcatgatgtagtgtcttaggccgcaaaccaaacatcccatatagaatcgaacttacggattatatagggtctgattgtggttgggttgtggctatgaaaaaagctactatagctataagctattaaaaagataaaaatcgtttggtggaaactactaaaagccactaaaaattcttccatatatattttcacagtttcaccagaaagccactaaaagtagatctagaggtgctttcaattttacactgcgagaaagtcggtttttagaaaaagttgcttcctagatcaagcctttagtttgaattttggcttttaggagacaaaagtcaaaccaaacacccaggatgtgtctattactgagccgaagattcactcttctggttcaacaaaggtaaatgttctggttttctaaaagttgagtctattttcaagggtttggtgacaattttgtttttttaatgcagctggaggaagaggtagttgaatgtcacatccggatttaatggtaaatttggacgtgtcttaaatgtgtgttaggatcaagtctcacatatatgatgcctcatagtacagaaatcaatgtcacatttttattatataatagaagctctatacaaaatagctaaataaatacatcatatgacgataacgatcctccacacccatagttgacagggagaggcttcactacttgaaaaggatggttgcgaatatgtgaaataagttatccatcctgaattcaaatgctccattgataatatcaaagtctcgtgagccgatgtgatgtgcgggcgcacatacgccaggcgcgcgcgtgatgtgcgcaggggaacagagcgcgcagccaggacacaggaagggaaggaaagtg

SEQ ID NO: 10833 - DNA, 3347 bp, Zea mays
tatcgatgtaaaacgccactcaaagtctggcatctgtagcaaaggtgccaacatgtgcgcctgcttgagggtcttgaaggcgtcgtcggtccagcggaacgcctcctgcttgaggagagcggtgagaggcgcggccaccgtaccatatcccgcgatgaatttgcggtagtacccgatcaatccgaggaacccgcgtagagctcgaagtgattttggcgatggccatgcctccacagcctcaatcttggcggggtccatggccacgccgttcgacgagatgacgtgaccaaggtaggcgaccgtgtgagtgccgaagagacacttagaacacttgagcgccaacttgtgtgtccacagtaactggaacgcctgcttaacgtgttggagatggtcggcccatgaacgattgcggatgaggatgcgtcaaagaagaccagcacgaacttgcggatgtacgacttcaacacctcattcatgagagcctggaaggtagaaggtgtgttcatcaacccgaacagcatcaccaggaactcatagtgccctcgatgagtgcggaaggttgtcttggcgatgtcgtcggggtgcatttgcacttggtaatggagttgtcgaggctagttggttacgccatctcttgttggaacttcgatgcccccttcacaggagtattcttgtctattatgacaacatcagcgccgtctatttatccaccaatccagttcaacatatcgtacgaagcatgttgaaattgatctccacttttcgagaacgtgttgctattggtgacgttcacgcaggggcgaagctactgtgtagccagtgggtgcaagtgcaccccctaaaactccaaaaatcaattatactgttcaatttttcaccatataagcaccacctacatctcatccttatgaatgcacaagggaggtgcaccccctttatatttgctctagcttcgccactacgttcacgaaagggcttctaacatcagtgtttcttgagttcaagtccagtctcaacatttgcagtggctagatgtttcgactgggggtgttagattattactataatttgtaggctgctttccatctcccctcctgcatgagggctggtatggcaactctgtcactctgtcaggtatagcaactaggagcagtcctatattgcatctaggatctgctattttagtatagctatcaagagctacctctatggtaatcactaatcaggatcctaattaccaggctgccgcaccttccctggtgcgccaccctcctggcctatatattgtaaacctttctacatctaatgaatcaatctacttgtgatgtgcgggcgcacatacgccaggcgcgcgcgtgatgtgcgcaggggaacagagcgagcagccaagacacaggaagggaaggcaagtggctagaaggaaagttagccacctaattagttgtttcctgtgttagttatttccttattagtcatttccttgttagttatttccttgtgagttatttccttgtgagttgttaccttgttagttatttccttactagttgtttccttgttagttattatatagctgccccctctgtggctatataagcatgtacgagacatcatttgggataagcaataagtcagtcctaatctccctctcttctctacaaaccgacggctgaggggtataacctcgccggcgtgacggacagcggctacgagttacgtagccggggtccggccagtcggggatttggcgtccttgacaacctggtatcacggtctcgtcgatcctcacccacccgctccaaccacgcccagcagccgccaacgccaccaccttccccagcctccaccacagccatggccgagcccaccattgccgacgtcctcgctgagttgcgggcactccgcacggacggcaccgcccggcgccgccagcagggtaatcgtcatgtacctccgttgtttcacaggcgatcgtcctcggcagtggcttcgctggcttccgtgggccgaatacacctacaacacggctttccaatcgtcgctccgggagacgccgttccgcgtggtctatggccgcgacccgccctccatccgctcttatgagcctggtgagacgcgtgtggcagctgttgcactggagatggaggaccgcacggcttttctcgccgacgtccgctaccgcctcgaacaggcccaggcggtccaaaagcgtgtctatgatcagcaccatcgtccggtggagtaccaagttggggactgggcactactacgactccggcagcgcccggcagcatcactaccacggacctccaccggcaagctcaagccgcggttcgttggaccgtatcgcgtcctggagatcatcaacgccgtggctgtccggctcgagcttccgccaggggcccgcctccatgatgtgttccatgttggagtgctcaagaagttcgtcggcacaccaccggcaacacccccggcattacccccacacacaacggcgctgtggtgcccgtgccagcagtggtcacagccgggcgcctggctcgtgggattcgccagctattggtccagtggcaaggtgagccagttgcgtcagcaagctgggaggactacgacgactttcgcgctcgcttccctgatttccagctcgaggacgagctggtctacgacggcgggagagatgtgatgtgcgggcgcacatacgccaggcgcgcgcgtgatgtgcgcaggggaacagagcgcgcagccaggacacaggaagggaaggaaagtggctaaaaggaaagttagccacctaattagttgtttcctgtgttagttatttccttattagtcgtttccttgttagttatttccttgtgagttatttccttgtgagttgtttccttgttagttatttccttactagttgttttccttgttagttatttccttatagctgccccctctgtggctatataagcatgtacgagacatcatttgggataagcaataagtcggtcctaatctccctctcttctctacaaaccaacggctgaggggtataacctcgccggcgtgatggacaacggctacgagttacgtagccggggtccggccagtcggggatttggtgtccttgacacttgtggggtgaatgttgtaaagtgtatgctattgagttgtgggatggtgcctttgagcccttcgcttgtttgttcattcatttgcgattgcgctatgtaatttattgtgcctattgcgagcttgctgcaagtttaggcgtctatgtgtcgtggatgggcgtctatgtgtcgtgcaccactctgcgcttgctaggtggccgcacatctgttgtgcttagccagggg

SEQ ID NO: 10834 - DNA, 1301 bp, Zea mays
atggcttaatttaagggcacgagaatcttaattatacaatagtttttgtccataatattcgggttaattatataatagcctccgtttccgtaaaaaaatgccattctagctaccataactgccatcttttcggggggggggagaatttccttctagatttcgacgtcagtataaacttcaaacttcaaagcttggaggtacccatggacacggcctgctctacaagctcccgccgcaagatcttcccagcaggcgatttggggattgcagaaacaaaggccactcgacgaactttcttgtagggtgcgacctgtttagccacgaaatccatgacttgttgctcggtaaggtttgaccctggtttcctcactataaaagccattgggagttgcccggcgtcttcgtctggataaggaataactgctgcgtccatgatatcaggatgagaattcaggatatgctccagttcggcaggaggtacctgatatcccttgtactttatcaactctttcaaccgatcaacaatgtagagtaacccatcctcgttgaagtagcataggtcaccggttttcaaccagccttctgaatccactgttgctgcagtagcctcgtcgtcaccgacataacctgaaaaaatcattcaattgactcatgtagtagcgcccccaaacaagacaaacattgttccaagattcaagggaaatatctaaaatgccaaaatttctgggaacctattttgcctaaaaaaaggtgcaagttcatttatgaagtgtgaacaaataagttctcatggatatctgattgtggcagaatccttaagaaaaggactgctactagcaaaccttcaaatataaaacaaataagttgatttgttccagaccaactaacagtggccagctaatattttaaagagctgatacattgcgcatggtactctactactatggttttcagatataaaacaccatgaggtacacatggcaagctggtaagatacgatcgcaatgaacatcagcggcagagtggcattactattcgttaggaacagaataaacagccatgcattgtccgtgatagagatctgtagttataataactattaattaatcccaaggtgctgcactgaccacctttatttggttggtacaaatgtttaagcagcacgaccaaaagcctcattagaaacatgctggcaaaccatgctgcttgagaattaagaaaagatcgcctgatcaatgcacagcttccacagaacaactccatcactcacagacaatccaaccgtatgacagaaagtctta

SEQ ID NO: 10835 - DNA, 1230 bp, Zea mays
ggcagctccagctgagagccttgagacggagggggatctccggatagctatgggtgacgcgaagccttcggtgctaatcacgatgcccagccgcgaccgcgaccgggaccggctcgtgcctaccgctgccgttgccacccatgagtccccgtctgccctcactgtcggcgactccgacgacgacaagagcaagccctcctctgcttccgccgctgctgccgccgcgcagaccggccgtgaggcgttccataagtgtcatcctcttcccaattgcagttacattctatgtgacatggtggttctttcgctttgtggatgggtttttctccccaatatatgctcacctgggaatcaaaatatttgggcttggttttgtaacatcgatatctttcatttttgtggttggtttattcatgtcatcttggctgggagcatctatccttggcctcggagagtggtttataaaacgaatgccatttgttcgccatatttacgatgcatctaagcaaatcagtgctgccatttcacctgatcaaaacaagcatgcattcaaagaagtggtcatcattaggcacccaagaattggcgaatatgcatttggatttatcacttcggaagttcttcttcagggttattctagtgaagaacagatgtactgtgtttatgttccgaccaaccatctctatattggtgacatatttctggtcagctcaagtgacgtgattagaccgaacatgtctgttcgcgaaggcattgaaattgttgtctctgtgggcacatcgatgcctcaagtattgtcgattctggaaactgagccaaaccagttgaacaggatcagatccacccgaagctgagatgacttcacattttgtaatttcgtgttacaaagtccttgttgtacaagagtaggttctgacagattgtacagttctcctgggtagaaagcaaaatctgtttgtgaacacatctcacctgaacgcgattgcttgtatggccgtctcagcttcttcagaaatgtaacttagcagttgagtagagttgacctatgttaagagttgtcaagttttgaagtggaagaattttcttaaccatttggtttatgtgtccaggcagtcttgtgaggcctgtttgaatgggaggctttcatttttctgtacagtctggttccaacttgacctgaattcccaaaggatttttcccttacaaatggcaataataggacgcaccaag

SEQ ID NO: 10836 - DNA, 2744 bp, Zea mays
gtgttagttatttccttattagtcgtttccttgctagttatttccttgtgagttgttaccttgttagttattgccttacttactagttgtttccttgttagttatttccttatagctgcctgccccctctatggctatataagcatgtacgtgagatcatttggaataagcaataagtcagtcctaatctccctctcttctctacaaaccgacggctgaggggtataacctcgccggcgtgacggacagcggctacgagttacgtagccggggtccggccagtcggggatttggtgtccttgacaacctggtatcacggtctcgtcgatcctcgcccacccgctccaaccacgcccagcagccgccaacgccaccaccttccccagcctccaccacagccatggccgagcccaccattgccgacgtcctcgctgagttgcgggcactccgcacggacgtcaacacgctgcagtccgacatggcggccatgaaggacaagtccgcgtcggcctcggacaacgggggccacggtcggcgacccgaggggcagcgcgaccacgatccgtacatccagcaccgcaagtgggacttcccccgcttcgacggctccgtcgatccgatgctgttcatcaacaaatgtgagtcatacttccggcatcaccgcaccttgggggaggaacgtgttcgggatggcatcataccatctggacgacgtcgcgcagctgtggtacagccagcttgaagaagatgatggtgccccgtcatggggtcgattcaaagacttcctgaatgagaggttcggacctccactccgttccgcgccgctgttcgaactttcggaatgcccagggcccaccggatctgtggaggagtactctaatcgtttccagacgctcctgccccgtgccgggcggctggacgaagctcaacgagtgcaactcttcaccggaggcctcctcccgcctctcagtcatgcggtgcgcatccataatccgaccacgctcgccgctgcgatgagcctggcgcggcaagtggagctcatggagctcgagcgaccgctggtacgacagggagcgcgcggtctacttccgccaccgccgcctcgaaccgctccggccgcgccaccccagcagctggctcttccaaacctgccggcgggtaacgaccagggacgacgcgagggcaacacagcggcgcctctctacggcggagcaggcggaacgacgtcgccttggcctttgttttaactgtgacgaaaagtattctcgtggccataacaggttttgcaagcggattttcttcgtggacggggtggagattgatgacaccgaacccgtcaccgacgacggggacagggacgccccctgcttctcgctgcagccggtggctggggtgtccatgacggacaccacgcagctcgcggtcacactagagggccgcccagctcgtagccctcctcgactccggcagcacccacaatttcatctccgaagaagccgctcggcgaacgggtcttccgctccaacaacgtccccgcctaacggccatggtggccaatggtgagaagatcacctgcgccggcgtcatccgcaaagccccactaatcatcgctggtgctgcgttcccggcggagctgttcgtcatgcccttggccgggtacgacatcgtcctcggcaccaaatggctcggcgcgttgggacccattgtctgggacctggccaacaggcgcatgtccttccagcgagggggccgcaccatctcatgggcgggcctatccacgacgtcgggcccggcggtgtgcgccttgtccgctgaagaatcgctcttggatgctctcctcggagcgtttgctagggtcttcgccactccaacgggactgccccccaagcgcgcacatgatcaccgcatcctgctgaagcccgatgcacagccggtcgccgtgcgcccctatcggtacccagctgcccacaaagatgagttggagcggcagtgtgcagccatgatggaacaagggatcgtccgacgcagcgactccccgttttcgtcgccggtcctccttgtcaagaaggccgatggatcctggcgcttctgcgtcgactaccgggccctgaacgccatgacggtcaaggacgccttcccgatcccggtggtggacgagctattggatgagctcaacggcgccaaatttttctccaagctcgacctacggtcgggataccaccaggtccgcatgcgacccgaggacatccacaagacggcgttccgcacgcatgacggcctatatgtgttcctggtcatggcgttcggactctgcaacgcgccggccacattccaagccctcatgaacgacgtcctgaggccgttcctccgtcgcttcgtcctcgtattttgtcgcgatattttgatctacagcaggacttgggcagatcacctccggcacctgcgtgctgtcctggaagaactgcgccgtcaccagctcttcgtcaagcgcaccaaatgttccttcggggtctccgccgtcgcctacctcggccacgttatctctgcggcgggcgtcgccatggatcccgtcaaggtgcaagccatccatgattggccgacgccacgatccgcccgtgccgtccgtggcttcctcggcctcgcggggtactaccgcaagttcgtacataactatggcacggtggccgcgcccctgacggcgttgctcaagaaggacggtttcacttgggatgatgcagcggcca

SEQ ID NO: 10837 - DNA, 3707 bp, Zea mays
  misc_feature (3707)..(3707): n is a, c, g, or t
atttaggtgacaccctcgaggccggccgggagtgagctaccaagaagaagaaggaagcaggccatcttccgacccacttgtaggcgctgtaagcctgtaagcagtcacatctcagcccgcagacatggtgggcatgagaggcgcctacggtggtgcttgcaatgacgacagcaagagccggctgcacggaggcatggcggcggagccggagatcgcgtcgatggcagtgcacaaggtggcgccgccgccggcgcggagcacggcgagcaagatgaaggtgagggtgaaggagaccttcttccccgacgacccgttccgggcgttcaaggggcagccgccggggacgcagtggctcatggcggtcaggtacctcttccccatcctggactgggtgccgagctactccttgtcgctcttcaagtccgacctcgtcgccggcctcaccattgccagcctcgccattcctcagggcattagctacgcgaagctggcaagcttgcctcccataatcgggctgtattcgagcttcgtgccgccgatggtgtacgcggtgctggggagctcccgtgacctggcggtgggcccggtgtcgatctcgtcgctgatcatggggtccatgctgcggcaggccgtgagccccaccgcggagccgacgctgttcctgcagctggccttcacctccaccctgttcgcgggggctggtgcaggcctccctgggcatcctcaggctcggcttcgtcatcgacttcctgtccaaggcgacgctggtggggttcatggccggcgccgccatcatcgtggcgctgcagcagctcaaggcgctgctgggcatcgtccacttcaccaccgagatgggcatcgtcccagtcatggcctccgtcttccaccacaccagcgagtggtcgtggcagacgatcctcatgggcgtctgcttcctcgtcttcctgctgtcggcgaggcatgtgagcatcagatggccaaagcttttctgggtttcggcgtgcgcgcccctggcatcggtcaccatctcgacgctgcttgttttcctcttcaaagctcagaaccatggcatcagcatcattgggcagctcaagtgcggcctgaatcgcccctcgtgggacaagctcctgtttgacacggcgtatttaggcctcaccatgaagactggccttgtccccgccggcatctccctgacggaaggaatagccgttggtagaacatttgcctcactcaaggactaccagatagatggaaacaaggagatgatggccatagggttgatgaatgttgttgggtcctgcacatcatgctacgtaacaacaggtgcgttctcccgctctgctgtaaaccacaacgccggctgcaagactgccatgtccaacgtgatcatggcgctgactgtgatggtcacgctgctgttcctcatgccactgttcgtgtacacacccaacgttgtcctcggagcgatcatcatcgccgcggtgatcggcctgatcgatttccccgcggtgtaccacatctggaagatggacaagatggattttctggtgtgcgtttgcgcgttcgccggcgtcatcttcatctcggtccaagaaggccttgcgatagcggttggtatatctatatttagggtgttgatgcagatcacgaggccgaagatgatggttcaagggaacatcaaggggactgatatttacagagacctgcatcactacaaggaggcccaaagagtttctgggttcttgatcttggccattgaagcaccgataaacttcgccaactccaactacctgaatgaaaggattaaaagatggatagaggaagaatcttttgaacaggataaacatactgaactccatttcataatcttggatctgtcagctgttcctgcaattgacacaagtggcatagcgttcctcattgacataaagaaatcaatagagaaacgtggtctggagcttgtgcttgtcaatccaactggagaagtcatggagaaaatacaacgtgcaaacgaggctgaaaactattttaggccagattgcttgtatctgaccactggcgaagcaatcgcttcactttctgcacttgccaagatgacaaaaccctaaatggattgctgaattgtcattgtgttcatccctagcactgttaaaagttttcggtgcaggattttctgtaatggggagtgcatccaataggagtacatcacagctatgtttgtatctagtagaattcttcagatccatgtgatgcaaattcaatggaaaacaaatatgacagtacaatagtagatcttacagaaattttctactgcagcgataaatattaggtgtcataagagtatagagtatatttgaattcatctatttactacaaagttcttcttcgttctacattgacagttggtacaatttttggagcgaggtgcgctagtagatatatatcagaatacctgattggcatcccactttgcaatatggcaccttcacttcctctattaccgttgcatgactcaacttttggggcatttttgaagactagattgataaatcctcgagacgagattaacaagtcaccataaacgtctcgttgttaatgggccgtcgcctggaaggctcttgatgcctttctttgatgagcatctgtatgtcccaggcacattgatgcaggttccatgacatgggtaaatatctggcagctggcactcgtcaatatattgacatccatcagcaatatagggattgccctcgtatccgtgagaacagttgcaccgtcttcgatcgtagtttccaataatagtataggagaaactgtttgagcttaggcatctgaagtctgacgattggggtcctataggggacaacacaaacaagcctgcgtcgcgtattagatccaacgaccactctagcaccactggaacgctatccaccatcactaccttctcatgaaatctatttccaaaaaatagagcgctgaagttgctcgccatcgcggcctcaactctgctgaaccagtcctggtcaactatgaaaactgctctatggtagtagttacccgtttccccttctagatgtttaacctggataccgtaccaaggcaggtctgagccgagagatgcgatggacgtctggcagcagccaacgccggagcaggaggagacatcgggcgtattcacgcaggcggcggcgcaggcgctggcgtagctaagcacggtgccgtaggggatgagcttcgccagcacgttgcacccgaaggccacaaaggagttgcgcgcggtcgacaccatcaagggcccgtccggcgccggaacggaccatgagccgttgaactcggcggcatactctacccacgagatttttgtctggatgcgtaccgtgcagtccggcaaggagatgtcgagcacctcgacgccgtcccccagcagcagcttcgccgggtgctgcgcctcgtcgcaggtgaggttgaagccttcgtggaagcagccacggccgatcccgaacgggtacggcacttgtacgccgccgcagttctccgggcagccaggcagggctatcggccccgccgtcgctgacgcgacgaactgaagcgtgagggctccgatcacgccgatagtcgccagtcggcgggacgagacggcggtcgacatctctcagcttttgatttattaccgatttagcgatgtctgtttctcaaattttttcgattan

SEQ ID NO: 10838 - DNA, 742 bp, Zea mays
ccagagcacatctctgtctcgctaatcgccttcataaacccctgccgcagccccgctcggggcccagaccaaccaaacacacacaactgtagccgtcgtcgtcgttggcgtgcgtgttgctctgctttcggagcccgtgcgcgagcggaaccaaagtagcagaccatggagggcctgctgccgttcctgtaccgggccatcctccacctcgccagcggcggccagtcgcccaccggcaaccccttcttccgcaacgactcgccgccggagtcgccgctggcggcgcactactacgtccgcctcgccgccggcgccgacgtgccggccttcctctcctccgcggcgcgcggctactacgaccgcgggtgagagccctgccgaaccaggaacgacgctgggcgtgcgagcaggaagaatcctcgtgagctccttcagttgcgtgttcagagtgctggttctcctccctcttcttgtggcttcttggagattctcctccccctcctttgctccttggaataaaggcatggatggatgaggtccagccatccagggggccgcgtcgttttcttccattgtatataggccatatatgacgtgatcagtcgggtgctcgcctaattgcaggttctcagacacgggcgaatatgataccgatttgcaatatatcgccgaaaaaaaatgccaaggcctttgagaaaaaaaaaaaaaaaagaggcccctaaaaaaaaaaaaaaaagcggcc

SEQ ID NO: 10839 - DNA, 1428 bp, Zea mays
  misc_feature (153)..(153): n is a, c, g, or t
tgaccactagctacttgtctgcatctagttgtagacatcgtagcatgtcatgtcaagcaagttggatgatgctccaagttgacccgttcttctgagacgcgagaaagatggtctaccaaattctgtatcaaacctcagtttaattataggccncaagtttcgaggtcgaagtctcgaacgcaagcttgcttcacctaacagacaaaggaaccgggggggtggcatgaacgcataacaaacatcaccagaatttgtcctaacgtcaggtaacttgtctacaacgtgcgtcttttctgtggcccttcattcatttcttgaagcagaaggccattggtggtggtggtgattgccgattggtcttcctctactcccacctccaggccagactgtgaaacccggagcaggtgtagcaggcggcaggcaccacaaaaagaaatcgttgcccccaccaacttgcgctgttcccacacccaaataatattcccggctgctgcataaactactgcatcttgtattcctgtgcttcctggtgtcctggttgataaatactcccctccaggcgtcgacagaccacacaggcacattatccaactcctcttccagttgacgcggcatcctctccttgaccatttccctttcctcccagcctcctctagcagccgtatcactaatccagttgttccccactaccgcctctggtcgaattgattagtcaaagtccagaggccagagcacatctctgtctcgctaatcgccttcataaacccctgccgcagccgcgctcgccgcccagaccaaccaaacacacacaactgtagccgtcgtcgtcgttggcgtgcgtgttgctctgctttcggagcccgtgcgcgagcggaaccaaagtagcagaccatggagggcctgctgccgttcctgtaccgggccatcctccacctcgccagcggcggccagtcgcccaccggcaaccccttcttccgcaacgactcgccgccggagtcgccgctggcggcgcactactacgtccgcctcgccgccggcgccgacgtgccggccttcctctcctccgcggcgcgcggctactacgaccgcgggtgagagccctgccgaaccaggaacgacgctgggcgtgcgagcaggaagaatcctcgtgagctccttcagttgcgtgttcagagtgctggttctcctccctcttcttgtggcttcttggagattctcctccccctccttgctcaaaaaaaaaaaaaaaagcatggatggatgaggtccagccatccagggggccgcgtcgttttcttccattgtatataggccatatatgacgtgatcagtcgggtgctcgccaaattgtagttctcagacacgggcgaatatgataccgattaatttgcaatatatcgcccaaaaaatttttcccaggcaaaaaaa

SEQ ID NO: 10840 - DNA, 919 bp, Zea mays
ttgggaccctcgaggccggcccctgcgacacaggcacattatccaactcctcttccagttgacgcggcatcctctccttgaccatttccctttcctcccagcctcctctagcagccgtatcactaatccagttgttccccactaccgcctctggtcgaattgattagtcaaagtccagaggccagagcacatctctgtctcgctaatcgccttcataaacccctgccgcagccgcgctcgccgcccagaccaaccaaacacacacaactgtagccgtcgtcgtcgttggcgtgcgtgttgctctgctttcggagcccgtgcgcgagcggaaccaaagtaccagaccatggagggcctgctgccgttcctgtaccgggccatcctccacctcgccagcggcgggcagtcgcccatcggcaaccccttcttccgcgacgactcgccgccggagtcgccgctggcggcgcactactacgtccgcctcgccgccggcgccgacgtgccggccttcctctcctccgcggcgcgcggctactacgaccgcgggtgagagcccggccggaccaggaacgacgctgggcctgggcgtgcgagcaggaagaatcctcgtgtgctccttcagttgcgtgttcagagtgctgggtctcctcccctcttcttgtggcttcttggagattctcctccccctccccctcctttgctccttggaataaaggcatggatggatgaggtccagccatccagggggccgcgtcgttttcttccattgtatataggccatatatgacgtgatcagtcgggtgctcgccaaattgtagttctcagacacgggcgaatatgataccgattaatttgcaatatatcgcccaaaaaaatatttcctccaaggctttgagaaaaaaaaaaaaaaaaagcggcc

SEQ ID NO: 10841 - DNA, 931 bp, Zea mays
tcgaggccggccggacacaggcatcctatccaactcctcttccagttgacgcgggcatcctctccttgaccatttccctttcctcccagcctcctctagcagccgtatcactaatccagttgttccccactaccgcctctggtcgaattgattagtcaaagtccagaggccagagcacatctctgtctcgctaatcgccttcataaacccctggcgcagccgcgcccgccgtccagactccagaccaaccaaacacacagaactgtagccgtcgtcgtcgtcgttggcgtgcgtgttgctctgctttcggagcccgtgcgcgagcggaaccaaagtagcagaccatggagggcctgctgccgttcctgtaccgggccatcctccacctcgccagcggcgggcagtcgcccgtcggcaaccccttcttccgcaacgactcgccgccggagtcgccgctggcggcgcactactacgtccgcctcgccgccggcgccgacgtgccggccttcctctcctccgcggcgcgcggctactacgaccgcgggtgagagcccggccggaccaggaacgacgctgggcgtgcgagcaggaagaatcctcgtgagctccttcagttgcgtgttcagagtgctggttctcctccctcttcttgtggcttcttggagattctcctccccctcctttgctccttggaataaaggcatggatggatgaggtccagccatccaagggggcctttgtgaagtaggctgctccgcgtcgtcctcttccattgtgtataggccatatatgacgtgatcagtcgggtgctcgccaaattgtagttctcagacacgggcgaatatgataccgatttgcaatatatcgccgaaaaaaaatgccaaggctttggagaggttcttgtcccaaaaaaaaaaaaaaaaaagcggcc

SEQ ID NO: 10842 - DNA, 1445 bp, Zea mays
gccggccggttccgaatcgagtatagcagtcgatggcccatcgagtatagcagacgaagttgtagttgctctcctccgagaaccctcgccgccgccacccaccggagctccggtttgcagttcttcgctgaaggccatggatcacgacagattgaatttgccgagcacgtcggctatttcgctggaggtgatgggccaccagctacatatttcacaggatccaaactccaagcaccatgggaccacggtctgggatgcatcaatggtgtttgtcaagtttttggaaaagaatagcagaaaaggtcgcttttgtccgtccaaactaaaaggaaagagagtgattgaattgggagctggctgcggtctagctgggttcggaatggccttgttgggtggtgatgttacaacaactgaccaagccgaggtgctcccactgcttatgagaaatgttgaacggaacagatcttggatctcacaatcgaaccccgactcagattccgttggctcaattacagttgcagaattggactgggggaacaaagaacatatcaaggccgttgaacctccatttgattacattgtaggaactgacgttgtttattcggagcatctgttgcaacctctaatggagacgattactgcattatctggtcctaaaacaaaaatattgctagggtacgagatccgttcgacaactgtccatgagaagatgatggaaatgtggaaaagcaatttcattgtgaaaacggtctctagatcgaagatggatgtgaaatatcagcatcctagcatacatctctacatgatggacctgaaggcaccattgatccctgaggttgaggctgccgacaatgggaactacgaggaagaggttgaggttgctgcgaatcaagaggaagacgaagatcctggagtgaagagcgaatcttgttccggctcgtcaccagaggctaagagcggcagtctggatgattgggaaatcagaaggtgtggggctatggctgcaaggcttctgaaggatgtgaaactgtaaacatgaatcctagagatcgttttccccccttgtcagagaactctagagctcctttatgttgttgtccttgatagttgttgtactgcccatggcagtctatgttattgtatcttattgcatcagtggatattgataccattccaaaagaaaaaggaagtctctctatctctctctctgatagatgtcaggacaacacggctaatgagtcagataagaggggctcttgcttgcaccggcgcctggcggtagaaacaaggtaaatgatggggtgaaaaacaagggcagctgtggttggtttgtgtttatgacaggttgttcgttttgtattaaagccaattatttagactgctgcagctacaatttatatggacaaaatactgtaaaagaattatagccaaacgaacagttaagg

SEQ ID NO: 10843 - DNA, 1854 bp, Zea mays
gcccacggctggaggtgctcacagcgagcggagcggaggcgagggattcggccgcgcgcatggcgacgcctctctgaccgaagctgctccacccacccgcccggccgcgggggcccccgccggtcccccccacccccatccctcctcacggcacgggactcccctccccccctcctcttcctcccctcccgcccacggctggaggtgctcacagcgagcggagcggaggcgagggattcggccgcgcgcatggcgacgcctctctgaccgaagctgctccacccactcggccaggcgcgccgtcctctcctctcccctccccttatcctctcgttacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaggctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctccttttttgtctttgataaaagcctactgcgagtagccgattattgcggcacctagctgttatagtacacttaatgtctgcttggaaccaattatggcgcctagctgttgtagtacccttaatgtctgcttggacacttccgctgtgtaaatacgcgcccaataagagcggcgtatggatagatgttgtcactatggaccattacttgttgtatgcactgtatatctgtggactgttgtggtgttgtattagttcatgaaccatgaagctttgaagtaaaaatcccatgcatgttaagtttgttatgattccctaaaaaaaaaaaaaaaaaaaactcgagaaggggcgccggtacc

SEQ ID NO: 10844 - DNA, 1628 bp, Zea mays
cccgccgcgccccctcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcagtacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatatgcgcccaataagagcggcgtatggatatatgttgtcactatggaccattacttgttgtatgcactgtatatctatggactgttgtggtgttgtattagttcatgaaccatgaagctttgaagtaaaaatcccatgcatgttaagtttgtatgcgccccgtgtacc

SEQ ID NO: 10845 - DNA, 10017 bp, Zea mays
  misc_feature (851)..(851): n is a, c, g, or t
tacctcttcctattagtttaagcttttgggttgaattggttgttgcatgcaacttaatatgatacatgaaccaaatgttacgagttcgaaccctggttagcacaattaaaattaaataattgttgcttgctcctattctacatctgagactaatagaggctcggcgtgagggagagtattgtaatataagtgaattgctgatagcgcaattaaaataaaatattcgttgctcgcttctattccgcgtctgagacctaatagaggctcgacgtgagggggagtgttgtaatataagtgaattgctcacctctttttatcagctttagcttttgggttgaactaattagtacatgcaacttaataatctgtagataactttgaccacactgctatatgatatgaccatatatctagtatttggcttcaattctacaagttatttgatcttctgcatttgtaacgcttccaacgtttctgttttaattgttgtttatataccaaattatttcctttcatttccttagtacaaaatggcgatgatggtggatcctccgaatggaatcgggaaccaaggaaagcattactactcaatgtggcagaccttatttgagatagacaccaaatatgtaccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaangatgtgtacttggtatacgaactcatggatactgatttgcaccagataatcaaatcacctcagggcctttccaatgaccactgccagtattttctttttcaggtaaaacttggatcactcttccctgttctgaatgtactctttcatatctgtgttgttcaacaaatacaacctaaattctgtgtattgtaatgctctttagctattacttacctaaacaagtgttgttgcgaggtgtgcactaccacacgcttcctcgcctgcagcagaggagtattattagcattggcactaatctgaagttgaattttattgcattgatagtccactctgcgtgtcagtttagtcatgatatcaaaatcaatctaagcccagcatctgtctcttctgaaaatcttctttcataagccatttttgcaaaacgttgttataataatattactagttcactaagaatattatgaaaatcatgaaatccagataggatgagaaaattaatatgaaataattgcatccagaagagcataatctccagtgatattctggttgattttacaaattcttgcacttagttgatcgaccagttatcttctcttttgaagctaaagatttctctgcaaatatggacaacttcggatttaatgttgtggaactatttacttttatagttcttttgagctcaaaagaagaatcttaccttttgggttatattaaaaaaactcgacctgcaggacgtaagacaaccctgggtattatattaaaaagaatgttagagtgaacacactgaccagttcaatccaaaagcttaagctgatgagacaaggtagtcaatccacttatacacttcaacacccccacttgcgtgcatccagagagaggcgcaaacgtggaaataaatggctggaggcacaaataaagcctttgctacgattcgaactcgagatctctggctttgataccatgttagagtagacgcacaacccaaaagtttaagctaatgggagaaggtagccaatcgccccccccccctccgcccgaacccctgccctacccatacagaacgacaccaaaacacgaccactaccaggaccatgccttagatctgtgctttgccgtgggacaaacgaggggatttttttaaccacagcctgaaattcgctcctacggggagtctaacccaggacttgaggactgctactcagactacctaaacaactcagctagaggcccttttgcttttgggttatattttagtccatataatagttcagatctggtacgcatcctctcttttttgtatgcaagttgaaatcagcaagcagttgagcatgctgcacatgtgaatatctgtcaccatgtttctgttttcctctttggcaagttttcaattttttcaagtttgattttatctgcttacgttatcacatgcaaacaattcacagtcattctcccattggcttatcaaatatgcatacgcaattatacattattgcccacatgctttgtgcagcttaacaccttccctttagatgtttacatattttagcttatgttactgacttgctcgagccagatctcccactccaaatgatatgtcaagtaagacagcttgcaccttatttgatcagacttcctgttccaaataaaacaacagcttttattgaaaaatgaatcatctggtaaagctagcagttctttcagccagcttgcatatttacaaagagttcatccaatagttttttattattattaccgagggggagagcctccttggctgaaaggtaggaaatgctgggaacgataggaatcgagaaaccaggaccggccagctcgtaccaccgagcctttaccactgagctacagctcagttcctagttcatccaatacttaataagtagttctgcatagggcttaagaatctattcagtgattaataagtagttatgcatgaagctgaaaaaatagagattatcctctacatgaagtaaggaccaggttgatttttttgtatttcgagaacccttgtatttttgccatttcatcttgatatttttatgtacgttatcgctaataatctgacgtacttatttttcttcattgtagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaggctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatacgcgcccaataagagcggcgtatggatagatgttgtcactatggaccattacttgttgtatgcactgtatatctgtggactgttgtggtgttgtattagttcatgaaccatgaagctttgaagtaaaaatcccatgcatgttaagtttgtatgcaaaaaaaaaaaaaaaaaaaaaaaaactggaaacacaaaaagacacatcgtacatttgtaaaaaaaaaaacaagaaaaaactgtcatgaactgcagcgcgtttctgctgaatgcactgaaagcttatctgggccattagcccgttagccccctctgtatcatttccgaccagttgagcaactctgcatagcatcagcatacatatgcaggcgtcacagaaggggaggctgcggagaatcatccaattggcatctgaccaatttagcctgcgctgcccatgccgttggttggcattttgcctagatgtatgttggataactgagctgtgcaggtatgtgcctctgcgaaatcgtttcgctcttttttgtctgacgcactccaacttaaaaaaagaagaagaggataccatctcaatatctgatgtgctgaacctcggcttcagcgagccacctgttggtttatatttactgcatgtagttcgccttatgaaataaaatttctgatagaaaagttctccaggcgacgctgaagttacgatgagatctgtagtgttcttctcttttcgttctgatttgctgctgtattttggcagtgaccgcactgcagatacttttaccgctgaacagcagatgctgtcagctgattaaagaagaaaaatacttacgcgctacttactagcgcataacaatccgtgctaatttgtactcgtcgttttcttcttcgcaatggatgttacagagcaacgcgattgatattctggagcagtaaaagcacaacagaacccatcatctggagctgcttgctgtatgacggtatgttcttctaacaccgctttatttccttcctttacctctcacattgtaaacctgagacaaactatgtgaccaccatgccatgacaacccacgctaaagccatcctcacctatcctctccagagcaaaactccgatgaaacaaaaaaaaaactgggaaaatttctcactcacatctcttagtcttagctaacgaggaactagaggaacaaaaagttgctttgaaaaaaaaaactaaaagaaaagaaaaggctagcgaggaccactgcctgtgtctgtctagctagctctcttcctccagggcttgccgaagaagagacgggctcctaacaaacctcccctgcaagaaaccacagcaggaacagagaaacacagagcacgtcagcgcctcagaaccttcggcctttacgacgaactgcaatactgcgtcatcaggatgaacttttttttttctctccctttggtgttgagtgttttctggggccttacggacacatcttttacgctctttctaatcagttctagtggtgcttgccttcatccgaggccggcagtcggcgttcaccttgcgcacctggtaccggatcttcttggagaagagccgggtgcgcctcttctccttgtaccgcagcacgctggcctccctgacgccgccggcgccggcgccggcttcgttctccggaaacaggtccatgtctgagagcttggcctgtgatgacaagggtcaatgcaacgcagtgatcgtcagtaagagagagagttcccattcctcggtttcagagcttcagatggcgtgcaaattaagatattcaggaggaactttgcaaggctgttattacaccgtcgtcgtcaacgagaagtctctaatggaaaccacatgcttggtatgcccatactatataaagagctggctgtcttgtatgagtgacaggctccaaatacgcatgcatgtggccacagagcaaattgcagaacggccaaggccgccaagccaaccgagttggggctagcagcgtttgttgacgattgctctatcgtttggttggcccaagggccaccaaaaaaccgagcccaaaacgacccttttctagaggacaggacaggcagacctgttgttgtgcttggcaccagatctccaggctctactgtctgtggtccactgttgaatgattgagtttaactagccatatataaccaaatagaatggctggtttggattattcccttatctaacagaattacattgaactaatagagcagaaagtagttcatccaaatttgaaaaattgttcttgctgagacctaagagcaacgtcaagagactatctatattcttccttatgaatagagtttttttttaaatatcatccaacaacttatttaaatggctatccaaatatagtcttcttttgttccagatttctcacgataaagatagaaaatatgaatgactctctagagcgcaaacaatgtatagaaaagctgttgaagattggaaatataaacaacatatagaaaagatgttggagactaaaaagatatacaaagtgatttttatgtaaataactctccaaatgataatttagaaagtgaaatttataaagactatccgacatactctaagcgtctaaggttcactattttctatattttcttccccggtaaataaaaaactcaatattttatctcgataacttttttttctacgggttactgcagtaccgctgatgttctgaaaaagacgtgtactcgctgatacgtagcagtgcagtactgcacagtactttatgcgagggaccatccatttagataaacagtccctctggtttacttgttcgaaggaagcaattcacaattccagatttttttaccactgcgagccttgtcaccgcaaattatagattgcttcaaattttctatgcgtggtttttactatacatctaaaatttgtttagaaatccaaatttttaaacgaaagaacactggagatgcatgcagacggtacccaattgttacacttacccgcgcttcggcgaccgatgtcggcgactccggcgcgcttccctcggcaaacatggaccctctgtcggaccacgccttgagcacctcgtcggcgtccagcttcagccccagcccggtctttggcgccttcaccggcgcgctttcagcgtcgccgtcgccatcagcttcctcctccttgcatttcgcgctgggaagcagctcctcttttcccttcgcccccatcatgaccttctccaccttcaccaccttcttcttcttgcttttgttcttctccggagcggcggcgggctgtggctgtgacactgcggcgtttgacgccggcggtgtcggtggtgcaaccgttaggtcctttaccggcactgccggccacatccaccaggcgccatcgtcgtcccgccgcttcagtgcgcggttgaggttgggccgagcgccgtgccgggacccgaggccgagctcgaacctgccggcgaggccgaccaccatgaggctcctgaggtaggggtggatgccggagctggacaggatggagtcatcggacgtggtggcggcggtgctgttgctctcgacggtgaggctgcccatgatgccgtcgaggccctcggccgcggccgcggcctcctcgacgtcgaggatggactcggcgtcgaagccgtcgtcgtcgaagtcgatctcgccgagctcgttgacgtcgacggtgtcggggctcgccggcgacggcgccgggtcgcggaagtcccggaacgcgctgctcacgggggccggcgacgagcagttcttggcggcggacgggctctgcggctgcggcagcggcgacggcgcgggtatgtctcggagcaggaatgcggagtcggcgaggacggggagcggcgggaggaggtcggaggaggaggcgtcgagcgccgccgcgagcccggagagctgccgcgacgacggcgggcgcggcggcgccgtcttggggctcttcttgacggggaagacggaggggtggatggacgccagcagcgcggcggcctcgttgtacgcctggttcggccgcttccgcggcgcgcgcgcccgcttcagcgacacggacgtcgccgacgacgacgcgttggacgcctccgacagcgtcgacgacggcgacgagtgcaccgggcgcagcggcgacgagtgcgcgcccggcgacgccgccgccttcaccatgtccaggtccagccgcaggcccgtcggcatgcaggaagacgacattgcaccggctcaacggcaacagctgtaaccgttcaaacgatcgccttcgccttcgttttctcggaagggaaatggagcagctccagcctccagctacccttggattaattccacgaccatgaatccaagaacacgggggcaagaatggctgaacaacctaatcgatcaagccctttcctcctccccaaaaaagcctaacattcaagaaacccaaacactttggcagttgcctccacctggggcaccaacaacaccttgggagaagatgaggtgaaaaaaaaatactgtctttacagctgctgcacatgcactcctcttctgtggagagaagaggataagaagcggagtaaacagccaagagcactagagcaaaacaaaagaaaagggagaattccctgaactgaattgagaagctgtgttgggattggagacgaatggagatagcagaaatggtacttcttggtcctttggaggatgagagagaaaagatattgtatgggggggaattggagctggttggggcttgccggatgaggaggaagaaagggttcaagcgaaggcggtacagggtggggttttagagggcctgggcatggaggatggccacagccacaggatgagacaagccaccctctcactcaccatgtccctttctcttctgtctcctgctgccctgagggacccatgccattccaggccccccacagctagcgttttgggcagcccttcttctccgagtcatatatgtgctctttattcatccttgcacatgtgtcgttgggattgctttgcttggtcatctgagatttgcagacggacaaatgagaccaatttgccctacctcccaacattcaccatcctccccatttttgttttgttttgaggaagctcactggatgactgaagatgtttttatttgtatgtgtatgccagccaactactgcaagtctgtctcacaaagtaaggcacctggtagtagcaagaaccgtatgtgtgattcacacatttgtttaagcaaagatagatgccaatgtgtggagaaaaggagggaaaaaatgaattatacacactaagagatggtcgcagcgggtccgaattgtaagaaatactttgacgattgttgactatataggtgtaagaagcaataatgatcatgagaatgtcaatggactaaatagtccattagcaagggtttatatacgaaggagaccgacatgctacaagagagagactcctagctgtcatcgcctctttttctactctttttctacgcgatgctaacacaccagcgggtagcgtttacggatggataccatagatatgctactaatattgttgcagtgttgatcaacaatgaacatgagagcatgggtaaatgtgtcgctgctgctggtacacgaggaagtgccgactgcttccactatatcgttgtgctatcttcttctgccgcgctaaacatcggtggtaacgattcatgatcctctattcgtatgttatcttgactgaacgcggtagatacatgaatgtatagcgtaccgtttctccacaacaattcgttaggactcgccgacgggtcaaatttcactctcttccaaatgctttgatctcacggcattggtatttttaaagaacttaattggaattttgtttcttggttgtctccttgtaagcatgcacgctatggattaatgatattttttttctagagacggcagtgcccaatgaaacatggggataagcattacttaatggcaatctcttttggactaacacagcttgtcgctatgcctctcttgtgctgtatgaaaagcaaacctttgaagcttagtgtttccccccatgcatatgttttttccttgttggtgaattgtcaagtaccacacccttgtcctgatccatgtctgcgatgagcaggtgttaaatatatatatatacacacatacaactaatgtaattgggcat

SEQ ID NO: 10846 - DNA, 932 bp, Zea mays
cattgggtacctcgaggccggccgcgcccgcggcggccggccccggagcaccgagaataaccgcagtcccgctccttccctgccgctgccccgtctgtctccaactccgaatatgtcgtcctcgcccctccccaccacctccggcggggctcacatcttcccgtctccgcctcgaccgcgccaccgccggtgctgccaagtaatcgtcgccgccgccgcttcgccccgttcctacggcgtcggtcgccgcgccgtctccctagccggcgtcgccgcctggcttgccactatcgtaggccgggcagacgcggccagtccatttgacaagtacgtcaagaggaagaagctggagcctttggagacctacgttccggctgtcctgctgaccattgaccaattcgttgatctagagaaatccttagaatttgagaaaccaaggtatgacgagagcagatcattacttcgctctggaccggcatcatctttaagagtcaacattcgggcagtggcacaatatgcttctagtaatggtcaaggcaaggctgcatcagatgctgtggacgagtgcttacgagcactcgaagatctcgactcactactactacatgcatcacggaatgatccgtcagcatccgttgaaaccatgaggagcaagatcagtgttgcccttgcagcattagacaatctcttgcaaacggtgccatctgcagtactggataaaggaaaggcgattgctgatgcataccgaactccagtagatgattatgtagaggaaaatgctgccgagttggatcccaggctgaaacagttggaggatattctttaaggctgaattttgttaggttctatttctatatcatgtatacctgtttggattactaaattcctcgaactgtacatcccaatttataattcgtttgatttttttatcc

SEQ ID NO: 10847 - DNA, 5019 bp, Zea mays
  misc_feature (4517)..(4517): n is a, c, g, or t
gacactatagaagagctatgacgtcgcatgcacgcgtacgtaagctcggaattcggctcgagatatatttggtcgtctttcactctctatttttattgctgcagtaatacatgtcaatttccttgtattattgttactgcacactaactactaaacaactcgagtcaactgtctaaatatcattctttttatatgctatagttttggttatatgttcctactcagtattgttgaaatttatttcatttattgttacccttaaacatggcaagacatacaatagccatcacaccccttgttttaaaggcgtcacctaggcgacgcctaggcgtccaggcgcctgaaagatccaaggcgtccccgtcgcctaggtaagaataagcaagagggcatagggcatatcggaagggaaaggggccgcgctgtttcggggtggcagtgccgaatcgggagcggcggaggccaaatccagggcggcggaggctgaatcattggcggcagcgtccaaatcgtcgtcgtcggcggcgaatctgaagcggcgacgacgaatctgaggcggcggcggctcaatcgggggcagcagcaactgaatggtgggggagagaggcaacctagggttgccagaggaaggattatatgggttggctggtgggctgggcctcctaccccttccttctctttttttctttttctttttcttcctcctccatggggctgttttgctgattctcaggttgataaggcgtcgccttgctcgccttaggcgtcgcctaggcgtctaggcggtggtccggcgccttatctcgccttaccgccttaagaaccatgatgatcagaactgtatatgattaccatggtttgctactctcacaatatccattgcaaatcatagtgtatcagatgtgagaatagcatttgtacacaatattctctatgtgcatttacttgatcctaccatgatttacaactattataggatagtaccgctcagcaatccaaaaaaaaattgatcccagcgtgtcagacaagttctttacactattcgagaagggataagctcattttactatccccaactttgcctttttctttttctcatatatgttttgttgggttaagttcaaatttcactagttgacagatgaaacataaatacaagaaactaatccaaaagacactaaactaaaaaccacactaaaacactgtattctaattgttaaaagttatatattgctcagtggttcgtcatttcctttagattaattattaataataaaataaggcttaactcaggagattcccttccataaccgtacagccacaagcgcatgggtgtccagcggtagtatccgcccaagtgaatcagttatagcagccagcgtaccactcggagagagtgtaagccgttctcctttccttggggagtctttcaagcaggtgaggggtgatgctgcagtttatgtaacagtcaggaataaattttggtatatttttttaataatactgaatcttaactacatccattactttttgcaaaggattggggctttggccgtgactttttaggtggtgacggctcactccgccatagtattttggacaaagatgatattgtcgaaaatgttgcagctacacctcttgacaaaattgctccaacaattgacctgcttctatcttctgataacctacagaataacaagaagttagaagatgtgtaaaactaacaatatggcaacattatctgctaacttcccaatgccaacttctagagaaacaatagtatgaactgattgcaattcaaatttgaatggaaactatcaatatcatagctagttttctgttgcaaacttgcaacataattcaaagtgggaaacataatacacaaagtacatttgcacatgaataatacaggcactgttctgtcttggacacaccataaccatagaactcataatggatgtcagaaatgcaaaacccattgcaggtagtgaaactcacctatatgctgaaactacagcatcctctccaactgtgatggcacagtagtggcgctgacttgactgcccagcaatataaaagcagctgaattcaatataatcgtggcttcagaaaacttccactaaaggtagcttttaagagaatcaggatatgataaaaccaaatggcaaaggcataataataagtttatgcaacagttatatctaccaacaatagaagaatgatagtcagtaagtcacctgaagttctaacaagggaggtggcatcagaccaacaattgcagcatcagcgcatgaactgaacttgtttacattccaaatctgaaagggtattcgtccaaaagtttcctcatcctcagcatcttgctcttcaaacttatctttccacaggcgtgattttacatcttgaaatgcttttttaagaacgttctgtgagcaaccaagaattcagttcttatccttgaacatgcacagaaagcctgatcatcactggcgtctgagcacaaattctctgtttcttatatagagataatagagactagagagtgatggtttcacacaaacctgaaggtcagcaccatcaaagcgcgcgataacaccaggaaacactacagaaagttcatctgagcctgaatcttcccaagcgttctccttcctctcacgaaagttgagtttcagtatctttgcaggatatatactctgaaataacaattcaaggactgcactattaccatttaccatgaaggcatgaagtaacaaaaacaaatatgcatatttgctaacgcttagagatagacagcatagtccataaaagtagaaggcatctaagcagaacatcttctatttaaaacaaccaccttatactgaaactacattcggactgtactgctagaactcacacatttgaagattatatttggaacttacgtgatcctactaaaagtattttgtcatgtgaacaagtttttgagcttttctcgctcgagcatgatatagcaaaaccgggcaaaaaacagcctgatattcttaaaaattatgagaattatgacaaatagcaccaataatgagaaataattctcagaacgctgtatctacggagatccagatggataggatcttacgaacgacctgcttgtgcaatagatcgcctgcgagcgagtagaacagtagccacccagcgtccgtgccgatcaccacggacaccccctcctccccctctgcatcgtcctccccggcgaacgggacccactcaacggcggagattcggccctcgtcgggccccagcgcaggctccaccgtgaccccgccgcctccacctcccgccaccgcgacgatcacgagcacggagtgcgccgcgctggccactgcgagggatcgcgcgcggggcccgagcgaggggaggatggcggggtcgtccaaccacccctccctctcgccggcgcctgcggctgcgaggtccgacgaagcagaggcgaggagggccacctccgccaggtggtggccccgtggcgccatagagatggacggaggcgagccgagatcccgcccaagcttcagaaaattaagaaggttgtggagcggagatgcgcgcgattcgacgaggaaggcaagacgacatacgcgtgtgggtttttacacacacacccttggctgaatatcgggtttgcggttaaagccttatttggatgcgaagtctcgaagtattggaaacggatgtggaattggaaacgagtaaaatacgtttctggtcgtgtatcttaggggatgtttagttagtgattaaaattaattgagacatttaaaaaacctaactaatttttttataaattagttaatagttaggtagctatttgttagttagctaattttactaataatttttagccaacaaactattagttatagtgcattcaaacactctcttagactataaacttttaaagtattgtgttttaaaagttctatttattgttagggtctttcgtagatctaaatggattgtggtttaaccatacatcctagaaatagatcctatatgtcatgtggatctcgatgtttttttagaaaaccgttcaccctactgaaatttctcggcgacaacatcttcctgacctcctgagcatcaccttgagccgcctggacccggggccagccatgatggccccgtgtcctacaggttggagcactcgtcggcagcaacagggttcgggtcgttgctgtcactgcagtagctatgcaacttgcccaccaggcaccaggtgcaggcatggagcaggagctggagcagcgagcgtgggtgcgcaagcgaaaggatcggtgctgaagcttcttcaatcactttcgttgcttgctgcttggtcattagacctgcggtctcggctttgtaccaggggcggactcagcataaaacgggagtgagggtacaattgtgaggatgagtaccaaaataataaagcgagtacatccaagttaggttaaacaggagatctaatggtgaaaattgtactctactatttacgngataaagacgagcgcactccaaccaacgtaggtctgccctgcttcgtacaatcatatccacagtagcccgtggactcgccatggacgccctccagcaccgtaccacctccgtcgtcatgtcgtgtaccatccatcgtcctctcgtagcctaggtctcctgagttcctccccgccgcctgcagcaccacggcccttgaacttgtgtgcctcgacatcgtcgaggcagaggcacatgacgtggcgagcgactatctggtcgcccatggccaccgccgtctcctagtccaggtagctctgtcgtagcgggcgccctcggtgcggtgccatacatcgagagtctcctagtccaggtagctctgtcgtagcgggcgccctcggtgcggtgccatacatcgagaacgccgcaaaggccatcgccagtaaagatggcaacgagtaaattacccgcagataccagcttgtattgcttgcgctcgcaagccaaaattcgcgcccgcgcccg

SEQ ID NO: 10848 - DNA, 759 bp, Zea mays
gttccagaagatcaacataactttggttggtcaaccccggccgggcgggaagacacaccgacgcgtacgtagcacagtccattattgccgtctcccttttgcgtgagcaaagaaagagagcgagaagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggagaagaaggacaagaagaagaaggataagaagaagcacggcgagggccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgctattataatcaaaaagaaaaaagaaataacagtcagggatggtttgtttgccatgtgatcttgtacactcctacttaaattatggctgctgcacggtgctgctagcttgtactaataaagtgttgatctgcatgcttgcgtcttaatttgcgacacgcattcaggaacaagctggatcgaggagggccccgtcggcctgac

SEQ ID NO: 10849 - DNA, 2147 bp, Zea mays
gccactcccctcccgcattcatgtctgcttctggtttatccatccttttttttttttttttcaatcctgacccacgcacttttttttcttgattaacaaaactgtaaacactgaaacaagtaattctctacaacacttggcagtaacaatttaataacacaacaaaggaacaaatgattcatccgatgtgcctattcaaaactgacaattgcccagagtctccattgaacaggtaaacctccagcggggaatacgaaggtgagaacgacgacgtagagagcctcgctgagggttgtaagatcctgcttcctttggggcacgggatggttaggaggcgtgacccggtgcgcatcttccaaacctctattatgccttttcgcggggcatggattgctaaacacaaacaatagtcactcttcgtatactctatgtgcatcgaccctgacgaagccttgtctttgttcagaagcatttccacaaatagacatgaagcatcacgatagcccttccataaccgtacagccacaagcgcatgggtgtccagcagtagtatccgcccaagtgaatcagttatagcagccagcgtaccactcggagagagtgtaagccgttctcctttccttggggagtctttcaagcaggtgaggggtgatgtttttgcaaaggattggggctttggccgtgactttttaggtggtgacggctcactccgccatagtattttggacaaagatgatattgtcgaaaatgttgcagctacacctcttgacaaaattgctccaacaattgacctggttctatcttctgataacctatatgctgaaactacagcatcctctccaactgtgatggcacagtagtggcgctgacttgactgaagttctaacaagggaggtggcatcagaccaacaattgcagcatcagcgcatgaactgaacttgtttacattccaaatctgaaagggtattcgtccaaaagtttcctcatcctcagcatcttgctcttcaaacttatctttccacaggcgtgattttacatcttgaaatgcttttttaagaacgttctgaaggtcagcaccatcaaagcgcgcgataacaccaggaaacactacagaaagttcatctgagcctgaatcttcccaagcgttctccttcctctcacgaaagttgagtttcagtatctttgcaggatatatactctgaaataacaattcaaggactgcactattaccatttaccatgaaggcatgaagtaacaaaaacaaatatgcatatttgctaacgcttagagatagacagcatagtccataaaagtagaaggcatctaagcagaacatcttctatttaaaacaaccaccttatactgaaactacattcggactgtactgctagaactcacacatttgaagattatatttggaacttacgtgatcctactaaaagtattttgtcatgtgaacaagtttttgagcttttctcgctcgagcatgatatagcaaaaccgggcaaaaaacagcctgatattcttaaaaattatgagaattatgacaaatagcaccaataatgagaaataattctcagaacgctgtatctacggagatccagatggataggatcttacgaacgacctgcttgtgcaatagatcgcctgcgagcgagtagaacagtagccacccagcgtccgtgccgatcaccacggacaccccctcctccccctctgcatcgtcctccccggcgaacgggacccactcaacggcggagattcggccctcgtcgggccccagcgcaggctccaccgtgaccccgccgcctccacctcccgccaccgcgacgatcacgagcacggagtgcgccgcgctggccactgcgagggatcgcgcgcggggcccgagcgaggggaggatggcggggtcgtccaaccacccctccctctcgccggcgcctgcggctgcgaggtccgacgaagcagaggcgaggagggccacctccgccaggtggtggccccgtggcgccatagagatggacggaggcgagccgagatcccgcccaagcttcagaaaattaagaaggttgtggagcggagatgcgcgcgattcgacgaggaaggcaagacgacatacgcgtgtgggtttttacacacacaccctt

SEQ ID NO: 10850 - DNA, 795 bp, Zea mays
ggaggggcattagaccaccaattgcagcatcagcgcagaacgtgacttggtttacattccaaatctgaaagggtattcgtccaaaaggtgtccctcatcctcagcatcttgctcttcaaacttatctttcccacaggcgtgattttacatcttgaaatgcttttttaagaacgttctgaaggtcagcaccatcaaagcgcgcgataacaccaggaaacactacagaaagttcatctgagcctgaatcttcccaagcgttctccttcctctcacgaaagttgagtttcagtatctttgcaggatatatactctgcttgtgcaatagatcgcctgcgagcgagtagaacagtagccacccagcgtccgtgccgatcaccacggacaccccctcctccccctctgcatcgtcctccccggcgaacgggacccactcaacggcggagattcggccctcgtcgggccccagcgcaggctccaccgtgaccccgccgcctccacctcccgccaccgcgacgatcacgagcacggagtgcgccgcgctggccacggcgagggatcgcgcgcggggcccgagcgaggggaggatggcggggtcgtccaaccacccctccctctcgccggcgcctgcggctgcgaggtccgccgaagcagaggcgaggagggccacctccgccaggtggtggccccgtggcgccatagagatggacggaggcgagccgagatcccgcccaagcttcagaaaattaagaaggttgtggagcggagatcccggaaccggccgccaggtacccaatg

SEQ ID NO: 10851 - DNA, 2549 bp, Zea mays
gcacgagaccatttacctagaacatcctaatcgaaaagcaccgccggcgctataaaatgtgcaccggatcatccgatcttcatctcactgccaaactctcgtctgcagtctccacccacacacacgcgtaaccttctacaccaccttgcgcaaggatcagctctcagctccaattgacatggaaggagacacaggctgccgatctgagaaagaggtcgctgtggtcacaggaggcaacaggggaattgggctagagatatgcaggcaactggcttccagtggagtcaccgtagtgttgacagcaagggacgcggagaggggcgcgaggcagccagcacgcttgggctacccaacgtcgtcttccatcagctggatgtcggcgatccgtcgagcgctgcacgcttagctggttttatcgaggagaagtttggcaagctggatatattggtcaacaatgcagcaattactggaacgacaagtaacgtcgtcgatccagaagcttttcgtcaagagctcgcgggcttggatgtcatgcagatgatcgaagcaatcaacaagcacaacacagaaccgtacgagcaagcacagaagtgcttgcggacgaactaccacgggatcaaggctgtcacaaaagcgctgctccctcttctgcaatcctcgtcccatggacggattgttaacctgtcatcctcctatggattactcaggtttttcagcggagacgaactgaaagaggagctcagcagcatcgacggcctgtccaaacagaggctggacgagctgtcagagctgtttctcaaggacttcaaggatgggcagctggaggctcgagggtggccgaatgaaggagggttcatcgcgtacaaggcgtccaaggcgctcgcgaacgcctattcccggatccttgcgaaggagcacccgtcgctgtgcatcaactgtgtgcatcctggctacgtccagacggacatgaacttccggtctgggcatcttacggtcgaggagggcacgcggggagctctcatgctggccatggcgcccaagggaggcgtcactggcgcgtttttcgaccacaccgaggccgcgtccttcgtgtaatatgctcgcactcgtaccgttagctatcgcagtaataaaattccacacaaccaaaggaggatacgctattaggtcctgaaccaaatctgttctatcccctcccctaggaaagtatcctctcgctgagtagatggccgtccaatttcattttggttgcgatgagtatttcttttctttattattaaagccggtccaaaccgcctctttctagcccatccacgtcgtccaaaatctttgtgtccattcgatcgtgtatcattggcccaccttgatcgcgtgctctcccgtgcacttctcgttcatgtcgcttctggagacttccagttctagtgatgcttcctcgctccgtctctcttcctcctcactccctccgtccagcctcaatagcacatgaaaagaaatgcttcgagatgacgctgggttgtacatcgagctcagccccaacgcttctacttctctctgactgcttgtcgccaggatccccatcggcccatcccctcaaacacctttgcccggccaccgcgtcggccacggccaagtagaaggcggtgacgacgtcgccgcccagggacttcaatggcagctatatccctctcgagctcctgctcccctccgctcgcgtgtaagttctcaccaaacatctccttatccctctacccctccttccgatgtgaactgacaaggctcgtctcgctggctgcaacaccccgcccccacgaaccatacgccgccagccgcctccgcatcacccgacgtagttgtggtcgcttcgcttgccgctgctgcgacatcagccgcgatgccttccttcgaacccgccgcgccacgccgtccatcatcgtctccaatgttgttcacgtgcgctcccttggtggtgcccatcagatccggtccaggaaacacatgggacaccacgcagtacaacaggtcatcccgggagacggcggcagaagtgagacccgcgtcgcatgaagggttggggaagggagagccagggagatgaaggacaagaagaagaaggataagaagaagcacggcgagggccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgctattataatcaaaaagaaaaaagaaataacagtcagggatggtttgtttgccatgtgatcttgtacactcctacttaaattatggctgctgcacggtgctgctagcttgtactaataaagtgttgatctgcatgcttgcgtcttaatttgcgacacgcattcatgaagcgccccggatcgaggagatccgcgtctttttggctgtgccatgtgactcaaaaaaaaaaaaaaaagaaaaaaaaaaaagaaaa

SEQ ID NO: 10852 - DNA, 1016 bp, Zea mays
attgggacctcgagcccgccgcgagaatctggcgggcggccaccacgcaccacctcaccagatctttcttcctgttgcttcctcggctggtttccttttctcgccgcgtcgcctgcttcttcccccaaccaaagacacgaatcagccatggcgctcgcctccgccacgtcccgccccctcctcggtcgccccgccggcaccgcgcggccccacctcgccgtttcctcatcctcccccgcctcctcgatccgcttcccccgcggcgccgacggcggcgccagcagagcggccgtctctctccgcgcccccacgcctccagcggcggcaacagcaacatctggtagcattgctccagcaatttcattgactgaaaaggccttgaaacatctgaaccaaatgagagctgaacggaatgaagttttgtgcttgagaattggagtgaaacagggtggatgctcaggcatgtcttacaccatggaatttgaaaatcgagagaatgccagccctgatgattctgttgtagagtatgatggttttgcaatagtctgtgaccccaaaagccttcttttcatgtttggaatggagctggactacagcgacgccctcattggtggcggcttcttgttccagaatccaaacgcaacaaaaacctgtgggtgcggcaaatctttcgcgactggaaaggagaccgaggccgcggcaaccacttgcaacaactagagtagagaaatattgttagctaaacgtgatgtggcatgttgtatagcttgctcatgttgaagccctgtggctacaccacagatacataaagaggcatagttcaaaggaattacaccattaccaatggcctaattcagattttcttgtttggtgatcattccgaagtccttaaacttgtggtatggtctctcaaaatgcattgtattttcaggtatccaaacttgtcttgacgtgtcgtccaggcctacaagtactaaaattttatttttacatttttaaacttggcaagagcggcc

SEQ ID NO: 10853 - DNA, 1498 bp, Zea mays
  misc_feature (1416)..(1416): n is a, c, g, or t
agtaaccaccaccacgccagatctttcttcctgttgcttctcccgttccgtctctccctggtccccgcgtcgcctgcttctgcttcttgcacccccaccccaccacaaccgaaaccccactaataatccgccatggcgctcgcctccggcacgtgccgccccctcctgggtggccccgccagcaccgcgcggctccacctcgctgtctcctcgtcctccaccgcctgctcgatccgcttcccccgcggcgccggcggtggcagggcggccgtctccctccgcgcccccgcgcctccagcggcggcggcggcaacatctggtagcattgctccagcgatttcattgaccgaaaaggccttgaaacatctgaacaaaatgagggctgaacggaacgaagatttgtgcttgagaattggagtgaaacagggtggatgctcaggcatgtcttacaccatggagtttgaaaatcgagcagatgccagccctgatgattctgttgtagagtatgatggttttgccatagtctgtgaccccaaaagccttctcttcatgtttggaatggagctggactacagcaacgcactcattggtggaggcttctcttttcagaatccaaacgcaacaaaaacctgtgggtgcggcaaatctttcgcgactgggaaggaatccgaggctgcagcaaaagcttgcaacaactagagtagtgaaatattgatagcaaatcgtgatgtaacttgttatatagcttgctcctgatcaaatcacgtggctccaccacttatacttgtttcgtttcaaaatagttggctttgtttgtttttttcaggataactttgatcagatatatacaagaaaacattaatacttatggtatataattaatattaattgatagagctttgaatcgattttataaaaaaaatctacagataaaaaaatattaagtgttgtttggttgtatacttgaggtgttaaaaatgttcgctacttcacttgccacattgtcacgcctagggtaagacaggttttactgagctaggcgtgtgtttagtttgtgtgtttaatttgtagctatagttatgacaagatttttctccttttgtgtaggctccggtcctcgataatccataaagtgtggcaagatttccttaagcatgcctaatatgtggtgtagaaattgagtgtctaaccttaagcaagtgtggtagaaaatgtgtggcaattttggtactttaggcacacaactaaacatgccctgtgtttaaattctgcgccacagtttgctacgtttaagagaactttgccatacttttacatgttattgacaatgcctatggagctggagaaaattaaattttgtcataactgcggctataaactaaacacatgtctaacttgatcaaacctgactaactntagatgtgacaaactgtggcaatgaagtagcaaaccaaacaactctaatctttccttgggaccatagagttagcaggagcat

SEQ ID NO: 10854 - DNA, 2334 bp, Zea mays
ggtacccccgggtctcggccggggaatcccgtccgctcttcggtctacactgcccatctccccctgcagtcttggacgcagggaatacttgaaaccccggctcccgatggatcatggatctcctctctgctgcgtacggtgctacctctgacgatgaggatgccgcggaccgacccttctccatgccggttgccaccaggtccgcctccttctctccacctcccatgaagccgccgcggtgggaatctcacccatacctccctccaacccactgcttcccgcaaccacctctgcccgacgcagcgctgccactggcatctccatccagcggcagatacatttccaagagggagcgcgctctcctggcctcatcaggggcacatattgaatccggatcatccctgcctctgacgagagtggattttgaatctgcagttggctctatcacctatccaaatctacgagctgacattttgcattctttgcgatgccaaccgaaacctggaccaagcacaagtttccctttgaggctctcagtttgtttgaagggtcacactaaagcaatcaattgtgtagattggtcaccgactcatgggcatcttcttgcttctgctggaatggatcacacggttcatgtatggaatgtatgggacaaagggaataccactgctcgtgttttgaaacatcacactgctgctgtaaaggatgtaaggtggtcacttcataggccctttttactttctggagggcttgattgttccttacagctagttgatgttgttgagggaaaagtaatggaagtattcaaggaggatcaagctgtggaggttatcaagttcaatccaagcaaccccgatctcttcctatctggtgggtccaagggttcccttaaactctgggatattcgatgtggtctggtaacaaaagaatttcagagaagccttggaaccatccttgacattgacttcagtgctgatggaagacaatttatctcttcaactgacacaaccagaagcaatattagtgagaacactataattgtttgggatgtcctgcgacaagttcctttatctaaccaggtttataccgaagcattcacatgcccgtgtgtaaggtaccacccacgtgaagcatcatttgttgcacagtccaatgggaactacattgctattttttcagcaaggccacccttcaagctgaacaagtacacgcggtttgaaggacatggagtgtggggtttccctgtgaagtgcagcttttcccttggcgggagagaactcgcatctggttcatccgatgggtccatttacttctatgattacaggtcggcaaggcttttgaggaaaatagaagccttcaaagaggcgtgcactgatgtcgcgtaccacccagtaatgcctaatgtgatcgctgcttgtagctgggctggtgaaatatctgtctttgagtgacatgattataatgctgtgtggagaagcatcagcagttcagaaccgctagcatatatatgtgtgtgtgtgtgttctgtgactcaaacaccagttaatggtcatagcagattccaaaataaaaataatttgctgtatggagttcatcgtctgaatttcagtctcagcctcgcctatgaagagattatttgtggtttcaaacaaagccttgttctttctgttcaaagtagatgaaacatcatagcacattgattgtagtggcaacatggcccaagaagaagctaagtgagctaaagaggctgctgagcgcgtaaagcttataggtacttttactgaaatttagcttcggattaacaacttgttctttactacaactgaactttcaccgccgcctgagccgtatgatcctgaagccgatccggccatgaaggaagcattagaaacgataaggatcgccaacgaagctgttgacgaagctgtcaatagactcctaaatgaagctgccgagaagatattgaaagaggactgaattcttgtgtactaaaaaaatgtaatattcgtgtatgcgtcgaacatcgaacgtttgtatgtatattaatgtaatatatttctttgcgaagcataaaatctatgtatataccgttttgagccttcggcgaaaaaacaccttaccttcttttcatgtttcgtgaagaaaaattgccacctctattgattgaatacttcgtacttttgccatgactgttgtataatagcattgctgacgaaggttttcctattgtgtacaattaaatctgtcgaaagtgtattttgtgctttagcacattgttccataattcatcaaatattttgagaggagcatttcctccccctccacaactttgtt

SEQ ID NO: 10855 - DNA, 924 bp, Zea mays
cccacgcgtccgcccacgcggacagagacggccggccggccggagaaggaagccattcgctgcagctgcaagcaggatagtcaggagtagcgtgcaacggagatggaggaggactacgtgttcaagatcgtggtggtcggcgactcggcggtggggaagacgcagctgctggggcgcttcacccgcgacgagttcttcctggactccaagtcgaccatcggcatcgagttccagacacgcaccgtcgacatcgcgcgccaccgcgtcaaggcccagatctgggacaccgccggccaggagcgctaccgcgcggtcaccagcgcctactaccgcggcgcgctcggcgccatgctcgtctacgacgtcaccagccgccgcaccttcgaccacgccacgcgctgggtcgccgagctgcgcgcccacgccgacaagtccatcgtcgtcatgctcgtcggcaacaaggccgacctggcgcgcgacgcccgccgccgcgcggtggacgcggacgaggccgccgccttcgcggaggagcaggggctcttcttctcggaggcgtctgccctcagcggcgacaacgtcgagcgcgccttcctcacgctgctccgggagatccacgccatcgtgtccaggaagacgctggatgcggcggcagaaaccggcggcaccaccgacgtcctggctctcaagggcaccaagctgtcgcttgctgatgagatatccatcatggagacgagcgccttgagaacagcaagcggcggcagctgctcgtgcacgtgatggtggtgcatgcatatacgattatacatgcatatacagctcatggaattctaatccggaaatatatgttcaaacagtgtgctgtgctccgagagaaattttcataacggagataaaatatataaaaaaggatatgcagtgcatgta

SEQ ID NO: 10856 - DNA, 5152 bp, Zea mays
  misc_feature (173)..(173): n is a, c, g, or t
  misc_feature (5002)..(5002): n is a, c, g, or t
acatgagaatgatttaataacggagcgtaggtcaacttgttgggtcctttgcgatgatggaacttgtctgttcggcttaaatccttgatttgacatgcatggtgttcatattttttttgaatttattttagggcttgtcaacgtttttctttgagtagtaggcgacataaccntcgacaatgaaacatctgcatgcgatgactccgttcattttaagacctaataaagtttatacatgagtatttaatttgtgtgtgtaccatggttaaaaaaatggtttaatagagcttgactttctttttaaacaaagaaagccttgaagagtcgaagcacgattaattaagaatcgaccaaacgttgacaatcaccgcaagggtgcaaagagtaatcaaccctagctaggcgtttgacatgtatatgagccgggccaatcggatgatgcggcgtgcatatgtatccagcactgatggcgagctagctaggagccaggcagctagctagctagctgtgatgaatgaacaaggacctggaaagaggaacacgacgcttgctagtttgttggagacgatcagacacctctagggctcgcccgctatcaaggggacatgaatgaatgaatgaatgaacctgacaatccgattggggaacggccattgacttcgtgacagaacgtgaaccgccgccgcttcctctctcagattgatgggccgttgactgatcggaaggaagggagagacgattcgttgttccgcgccagacgtgtccggttgattgggcgggggggactgcagcgatcatgttctcagttacggcacgcacactgggcggcgcacaaccacgcagatgcattgcatcgtgtgcgtctctggagtacaggactcctccaactcatcacgggcagcagttgatatatatttgtcagtctttgtatttatgcattaaaaatgatagttttagacttttagtgggttgtacggcacagagtagtatagcagtagtactattatactccatatatgtacatagtactgtagctaaccgccagtcctggcttttggggcatcgaaacagtgtccatcttctcggggctccaaggagtggagttgagcgggcgagtcattttttatgcggactgtggctgtgccggtgccgccgacgccgatggcatcggccgcacgcgcgacgggaggcgagccgagccgagccaccgcccgctggggctgggatctcggacctggacctctctgcgcggcagcggcagtcatgcgcttccgcccgggcccgatcatgcgcgcccggtactgcatgtggtgatgtggatccacatggtccctgcacgtcgctacttgcctgcctgccccagccggcctggatgccgggcgcacaggaggaatcttcctccccccttgcggttgctgcggcctgcgtgaggtcgattggcctcgcgtttactgtacggagtacttctcagcaacagtccggacaaatggctgcgaaattactgtggcagtgaaaaatggagagagaaaaaaacacatatccgcagctaaaagtgggagcgtgttcgcgcgggatcccctgtcacgagacctctcgtggaaacagagtctgactcttctaggttcggcttgcacatgtgcctttactactggtcaggcttcggtctctttatgcaaatcacgtgccacaatttcggctacctctttcgagagcttgcacgagagggaagaaaagtgccgtcgttttgacggccgacggctgcgcggcgcaagattgcatggcgggcccccgtaggtagcactagcactagcactagcagcatggtttggtttggtgattgacaccgccacgcgacttggacccggtgttgtgtgctacactactcgtttcgttagcccgcgccggcgaccaggtcgtcacgcagctcgccacactggaccatcagacactgacccggaggccggacgccggagcaagctgcggcgaaagccctgtgtttcgttcccacctcaccttttttctttctttctttttattattttcaaataaaaaataaaaaaaaggttaaagaaaaaaaaagaatctttcgtgtcaacgctagatactgtatgttgaatctctttgataataaccagcaaaatctttacatgctaattaccaaatggtgaacaaaactgtcactctgtcagcctctgattcctcctcccccgccacagaaaatgagggaaataggaaagggggaaaagagtagattagagcacacatgcgggctctcgctgtagctatcaacaccgatcagagtgagcattcgcttgctcgatgtccgtgtcgccaagcaagcgcgacttctcgtctccgccagccttgtcgtcgctgtcctcggccacgaggccgccggtgagctgcctcgagcgcttggcctcgcacgcccagtccgtgcgcccgatgaccagcagcatgcgcaccatgcaggtggcctgcgccgccaggagccccaaccacaggcccttgaagtcgtagtggagccagaaggctaggacgagcgccaccggcgtccccacgaggtagaaggaccggaggttgatgctggctgcgtccttgggcctggcgctgccgcgcagcacgccgcagcccgtcgtctgcgggcagttgcccagctcgcacagcccaaggatgggcagcaccgacgcggtgagcgcgatgatcgccgggtcggccgtgaacatgctcgcccacacgttccgcaccaggaacgcgaacgccgaggccaggccgccgaaggcgaagcccagcatgagccccaccgcggcggcgcggctcgcctcctcgggccggttcgcgcccagctcgttgctgacgcgggtggacacgccgaagctcagggaggatgggaagatgtagatgagcgacgtggtctggatcaggatgcccatggacgccaccgtggcctgcgggttcagcagcaggccgcacagcaggatcatgatctcgtaccaccaccactcgaggcagacgctgacgcagctcggcagcgcgaggcttacgagctcgccccagccgcggaagctctcgcgggagagcaagaaaccgccggtgcgcttgtgcacgctcttgaagaggatgtaggcgacgaggaagaggagaaggttcaggttcgccagcacggaggcgaatgccacccctctgatgccgaggccgaggacggtgacgaggacgtagttgatggggaggtggatgacaatggccagcgcggcgcagaccgtgagcggcaggttgatggactgcgcccggaggtatatccgcacagggtggatgaaggcctggaggacgaggtccgggagcgaggccagaatgtaggtctcggcgaccgccgcgatgccggcgtcctggccgcagaggaggaggagaggccgcatgtgcatccacaggccaccgatggggacggccgccgcgatgagcagcagcaccgtcctctgcatggtgattccgaggagcgagaagttgcccgcgccgaatgcctggccgcatatgggctccatgcccatggcgaggccggagagcacggaataccccgtgatgttggcaaagccgatggccagcgacccgccagcgagggccagaccgccgagacggccgaggaagagcattgaaatcatggagcggaggtagagcaggaggcccgtcagaatcatcgggagcgcgaggccgagaatcgaccgcgcctctgcatgcgcgtcgctggacgacaccaacggcgtcatcgggaacgccgctcccagggagacggacaaggcctccttcaccgcggtggcaagccgcccgggcgacttgctcgtgagcacgggcacggccggcgcctcgtctccggccaccgggatgtggacctccccagtcttggcgagtaaggggtagacgatgacgcagggcgcgtccccgtgcggctgcgcgtcatcccggcatgccaccgtggcgtttcccgagcacgacgtcatggctgctggagaaacagagggataccctgctctctctctctctctctctatctctctctctctcctggttgcccgcccgcgcgtgcggtttcgccaggcaagggagtaaaaacctttgcggcgttggtaactcccaggcaatttacgagatcgtacgcagtttctgttggggggagatggggaagcgcttctcgggttgtctcccctttggaagctgggatgcttgcttggttggtggagtcgagagccgcgcggcgccccggccggggaagcccggcgatacctttttataggcgtcgaacggggcgagggggaagccttggccgcttaccccttctctcactagcttttctctgtccttgacagcgcttggattggttctgtgttttgtctttcaaccgagagccgcccagactttcatttcatttcttcgcgcactggattgtacaataatatgtacctgtaacggaatactaataattctgcataacatatgacatgagcatacatgttggctgtactggtagtaccttttatattcggcttcggttacaaacataatttttgtaacttcagtactttgcattaattaaaatattagtgtcacagctcttgggtaataagaatcaagttttttttttgatatttatgagtggttcttttttccttcaagagtaagttactttcgttgccattagttttttagtcagtgatgttgcgtttgactagacttttccattgaattaagaacggtatggggataagacttttaaaaaaaagctaggcacccaaagtatattgctaggatagttaatttcttcaacctgctcatgtaaacgaaattaattaagctagttttgcaacgggatattgttcagatcctttgtttattgcgttttggccggtcatcacaatattccaaatgaaagtacggctgttcaaacgcggctcatgtcctgcctatggttgacaaatggaggcctgaataaatatttgaaattgtgtgtttnttagcccttatgtttaaccctacgttcgctatgcttaaaaaattataaaacatgctatgggaacttatggcgtccagagcttagcttaccgtgtgattggttgttgcacggtagtaaccatgtccatacgtgagaagccaactctttttg

SEQ ID NO: 10857 - DNA, 1480 bp, Zea mays
cgacgtccatcatcgtcacctaattaaatcacaactagtgttcactcgcaggcggccggggatggtgagagatccgatcgatcgatcccagtgcagtgcaaccctcggcggcagaaaccccacaacgccagtggagttgctgctccgtgaagcaaaccaccgcgacgcgacgccacctgctaatcaacgtgccatcttccagctcgacgtctagctaagctagccccgcctccatggcagcatggcaccccaccattcctctcttcatcccctcgctctcgctcctcattatataaataataacccacactcttatacctcaattgcaatatatatgcatgcgcatcaagatcaagaataatccagcgccacacgggatcgacctagtacatagatacaacaagtcaacaacgtactaactagcccaccatggcgtcacgcctcgccgccgcccttctcctcgccgtcgtcgccctgctgacgtccgtggcgccgctggcgtgcggccaggcagcgtcggcgccgtccccagcccccgcgccgcccaagaccatcacggcgatcctgagcaaggccgggcagttcaccaagttcctccagctgctgcagtcgacgcgggaggcggagcagatcaccaaccagctcaagggcaagccgtccaacggcgggctcacggtgttcgcgccgcccgacagcgccttctccgcgctccccgccggcacgctcaactccctctccgaccagcagaagacgtcgctggtgcagttccacgtcgtgtccgcggcgctccccgccgcgcagctcgagaccgtcagcaacccgctgcggacgcaggctggcgacaccggcaggggcaagtacccgctcaacctcaccgcggacggctccagcgtcaacgtctccacgggggtcgtcaacgccacgctcgacgccacgccgctttacgccggggacaggctcgtcgtctaccaggtcagcaaggtgctgctgccgtgggcgctctacggcccgccggtccccgcgccggccccttccccggcggagagcaagaagaagaagaaggccacgccggatgctgtggcggatgcgccggcggctgagactgcggcggggacgacgacggcgtcggcggccgcgcgcgcgggagggaccccagctggcgtccgagctgcttcgtcctgcgtcgtggcgctcgccgccgtggcagctttgtggtgggctatctgaccacgtacagtacagtaaggatgcatgcgtgttttgccatcgtggagcttctttccggacagatttgtttctaattcatcaatcgaccagttcattattcttttcttcgttttataaaaaaagatgtattgtggatgtatttggtggcgttttgtaatgtttgtattgtatactttgaagaactgtacatcatattttgtggacgtatattgttatccaattgtattaatgtggacaaaaaaaaaaaaaaaat

SEQ ID NO: 10858 - DNA, 1008 bp, Zea mays
agtgctcacacacgcgccgaaacaccagttctctagagcagcgccgttcgtccattcgcccacgcacgccgcgtgatccgatcgcgtagggctccatcgatccgctacggccgctacaatggcaatgtcgtacaccaccctccactacttcgccgtctcctgcgccctcctcgtggcatcggtgtcgtcgctgccgccgccggcggtgttccaagtcggcgacgagcgcgggtggacggtgccggcgaacggcaccgagacgtacaaccactgggccaagaggaaccggttccaggtcggcgacgtcctggacttcaagtacggcgccaacgactcggtgctgctggtggcgcacgacgactacaagcagtgcagcacggagacgccgctgggccggttcaccggcggcgacaccaagttcgcgctggaccgctacggccccgtctacttcgtcagcggcgtcgcaggccactgcgaggcgggacagcggatgatcgtgcgggtcatcaggcccggcgcctccgcaccgcgcggcgcccctgtggcggcgccggcgacgccgccaaccccgggggcagcagtggcagatcaggcgcgcccagcccggccacctcgccggccggctccggctccggttccagtcccacttctccgagcccgagcccgagcccgagcccgctgccgcaggccagcggtgcgtctaggcgcgtgctcgtgtcgtccgttgcagttgggcttgtgctcttggttgcctgtgccatcaccctgtcgtccgtggtggcttgattaaacttagaagtctgttttctgcattcatgtacttagtgcgccgtcagtttaggaagtaatgttagcttgtcgagatctaggaggtatacgcgtgtcggttaggaatggttgggccactgggccgagtccgcatgctctttatgttaaagacttggtaatttcaaataaatggagttcttgccatgctctaaaaaaaaaaaaaaggctaattgggatttt

SEQ ID NO: 10859 - DNA, 965 bp, Zea mays
aagtgctcactcgcccacttcctctagatacatccacacaccattcactcggccacacgctttggtacgatcgcgtgggggcgctgcatctgcatgccgatggcggtcatcctccacttcgccgtctcctgcgccctccttgtagcatcggtgctgtcgcttccgccggcggtgtttaaggtcggcgacgagcggggatggacggtgccggccaatggcaccgagacgtacaaccactgggcaaagaggaaccgcttccaagtcggcgacgtcctgaatttcaagtatgccaacgacgactcggtgctgctggtggcccacgatgactacaagcagtgcggcacggcgatcccgctgagccggttcacgggcggcgacaccaagttcacgctggaccgctacggcccgctctacttcgtcagcggcgtcgcgggccactgcgaggccggccagcggatgatcgtgcgggtcagggccccctccgcgctgtacggcgcccccgcggcggcgccggcgccggcgatgccgccagccgtcggtggtagtggcagtggcgcgcccagcccgcgcccggcctcctcacccgccgtgccgtcgatcggcggctctggttccgcttcggcttctgcagccccgagcccaagcccgctgccgcaggtcagcggtggtggtgcgtctaggcgcgtgcttggcgtcgtgtcgtccgttgctgtggggcttgtggtcttggttgccagtgccatcaccctgtccgtgctggtggtttgaacgtacaattctgttttctggatccatactcgtagtgcatgccgtcggtttaggaagtaatgttagttttccgactacgtctcgatcggttagagttagtgtggccactggccacagtcgcatgcttagtttgatgagtgaaagacttgtgtcattcaataaatggatgattaatctaatcaaaaaaaaaaaaaaaa

SEQ ID NO: 10860 - DNA, 1129 bp, Zea mays
  misc_feature (9)..(9): n is a, c, g, or t
  misc_feature (1108)..(1114): n is a, c, g, or t
ctaatcganaagtcggaaactgtctttcccattcatgatctaggagccttcgccgtcgagagctgaggcgaagcaacatagaagacgaggggggagtgcgactcctcgtgacttgtgagggagagaagccatggcggagatggagccgagcatcgggaaccatatggcggaagaccaaccgactccggccgcctccactgccgaggaggccgctatggatgcagataccagcggcgagcggcgtagcgctgccgcgttggtgggcctgctccgcgggttcctcgccgtgcaacagcgccgggccgaggcctactccacgctacgaagggggttttctgagtatatggcttatggaggtgaattggcctatcaacaactgtgtggcaatattacagcggagttcaatgattgctcaaaacaagtccttgaaataatttccctgctctcaatgccagaatttagtcgcagcgatcttgccgatttactgaagggtgttcaagcacatgagaaagagaagttgcatttgacagcgaagattcaggtgctgaagaaagccggcaggccttcagagcgcctggtgaaccacgcggactgcaggtcgcgcagcatggcccagcacgtgtgcgtgcacgtcaaggagatcacggaggccgccggcaccgaggacgccgaggcggatgcggagtatgacgcggccctcaaggaggccatacagggcgtgcaggttgccgtgagcagcataaacgaacacatggaggaggtgcgctacgagattgacggactcgaggcagagacgatcggtagcaagtggagcgaagtcgaggaagcgttccctggtaccctgtctataaaatagatagatgagatgagatgttgagcgtggaagactgaagaagaatcacgaacagagagattcgatgtgaatttttgggtactgttcagttcagggtacccgtgttattatacgtcctccaatccaaaatttagttctttctggtcttttttccctccacgtttgaatgataatgaatacagagctacatataaattatattaatagtttaattaatgaatgtatatttagtctaaaataaaatatatggtgggnnnnnnnaaaaaaaggccccta

SEQ ID NO: 10861 - DNA, 947 bp, Zea mays
attcatgatctaggcacgagaccattacctagaacatcctaatcgaaaaagaagacgaggggggagtgcgactcctcgtgacttgtgagggagagaagccatggcggagatggagccgagcatcgggaaccatatggccgaagaccaaccgactccggccgcctccactgtcgaggaggccgctatggatgcagataccagcggcgagcggcgtagcgctgccgcgttggtgggcctgctccgcgggttcctcgccgtgcaacagcgccgggccgaggcctactccacgctacgaaggggtttttctgagtatatggcttatggaggtgaattggcctatcaacaactgtgtggcaatattacagcggagttcaatgattgctcaaaacaaaatttagtcgcagcgatcttgccgatttactgaagggtgttcaagcacatgagaaagagaagttgcatttgacagctaatattcaggtgctgaagaaagccggcaggccttcagagcgcctggtgaaccacgcagactgcaggtcgcgcagcatggcccagcacgtgtgcgtgcacgtcaaggagatcacggaggccgccggcaccgaggacgccgaggcggatgcggagtatgacgcggccctcaaggaggccatacagggcgtgcaggttgccgtgagcagcataaacgaacacatggaggaggtgcgctacgagattgacggactcgaggcagagacgatcggtagcaagtggagcgaagtcgaggaagcgttccctggtaccctgtctataaaatagatagatgagaagagatgagatgttgagcgtggaagactgaagaagaatcacgaacagagagattcgatgtgaatttttgggtactgttcagttcagggtactcgtgttattatacgttctccaatccaaaatttagtacaaaaaaaaaaaaaaaa

SEQ ID NO: 10862 - DNA, 3426 bp, Zea mays
cgggcacagaaacataccatgtgtttggttgcctgtatttgctggtgcttgcatcgcaggatgcaataagctggtgtttgattgttatcaaccaggctctacgcatgcgaggtgtgtgtttggttacctgcgtacagatgtggagtcagactcgcacgatacttaaagcatcttgagccaggctctgcagacgcgagcaaactgttcgcatctctggagccaggctcccgccgacctggcttatgcagtcgggctaccgggagaagccaaccaaacatgtggatagtgtcgattctggtcgccgttagaaggtgttgtcaagtaaggggtgtttaaatacactagagctaatagttagtagttaaaattagttggagacatctaaacaccctaactaatagttcaactatttttaataaattagttaatagttagttagctaattcaactagtaattttttagccaactaactattagttctagtgcatttaaacaccctctaagactatctctaatactttaccagtggagatccctatattctgctggacacaggacatgttctaatagctgaccgacaagttgagtgagaatgtttgaatagaaaataaaatggttcgatgtaatattggtaactaggtaatatttttaaaatttagatatagaaatatgaaaaatatagcatataaagagattctagattaaactagcgatatatttttaggaatttattttgctttcggaccttttatttttactgagattctagatttttgatagaaataagcggtgtttgaatgcactagagctaatagttagttgactaaaaagttattagtggaattagatagctaacaaatagccagctatctattaactaatttactaaaatagctaatacttaaactattagctacgttgtttggatttcttcaactaattttagtcattaactattagatctagtacattcaaatactttaaaagagtgtttgaatgcactagagctagctaaaaattggtattagaattagctagctaacaaatagctagttaactagtagataatttattaaaaatagttagtagctaaaatattagctagagtgcttagatgtttctagccaattttagtcactaactattaactatacaacattcaaacactaaaaaccaacaaataatttttttgtttgcctttaattcgtagcacactggattgcattctggaacagctgtcggaaactgtctttcccattcatgatctaggagccgtcgccgtcgagagctgaggcgaagcaacatagaagacgaggggggagtgcgactcctcgtgacttgtgagggagagaagccatggcggagatggagccgagcatcgggaaccatatggcggaagaccaaccgactccggccgcctccactgccgaggaggccgctatggatgcagataccagcggcgagcggcgtagcgctgccgcgttggtgggcctgctccgcgggttcctcgccgtgcaacagcgccgggccgaggcctactccacgctacgaagggggttttctgagtatatggcttatggaggtgaattggcctatcaacaactgtgtggcaatattacagcggagttcaatgattgctcaaaacaagtccttgaaataatttccctgctctcaatgccagaatttagtcgcagcgatcttgccgatttactgaagggtgttcaagcacatgagaaagagaagttgcatttgacagcgaagattcaggtgctgtaccgccgtcgttttccggtgcggcccagccgtcccagttctgaactatgaaccctaatggtcatacaaaagatttctggtgacgtgttaaagactctgtagtgctgtaggccagattgtgctggactctagttctgatatgattctgtagcattttattttattagccttgaacgcggtagtcgatacagtataggcctgtttcaaaggttcatcggaaacagttctgttcctgccaaaattggggaatttccagcaaaaacattagatatccatcctgtgagcagcccatccccgtcatgatgtctctgtctgctctcctgtcatctcatctagttatttttggtgcttcagtttattggttttttgcatcctgaagtgatgtgtttctatgttatgttcgtagttttaggttgtgttgctggtgtgcagtgtggatttgagttatacttgttgggtggttagagtaattattttcgtcttacaccataactttggattgtgattggaacatagctttgaactgtggatccttgcaccatatattaggctgtgtttggttcagcttctggaaagtgtttctaatgagaagctgaagctcaaccaaatgtttagaacctgaaactgcttttccagaagcagttcctttcgtgtaacttaattttcaccgcttcttggacccttattttggctttcgactttcccaaataggtggaaatagtgagacttttaatattttatagctgtttcgagggaaatgaagagacggtgtaagttttatagttgtttcaaccaaaaaacaaaaaacttacaatcttttgccaacacatagctcacaacaactttttttatagctcacaaacagacctttagaatctgtaatgttttagttaagcttccttttcccttaaaattccctatagcggattgataaaactgaattccatgttataggggagggcttctatagcaattgagaaaatccatcccctttacgttcatgagacccacatgtcattgcaactctcttcttttatcttcctgttctctctttcctctccctcccatctctttcagtgcttgcccaaggtgacaatgtggcgacccaagtgctcgtctgcctagcgcggtctgggcccgcgtgcccagtgtggcagtggtgtggcggtgtggccaacccacacacttgactgcccgaagtggtgtcggcggcatggggcctgcgtgcttcgtgcttggtgcactggtgttgcggtggtgctccagtcctatcctatggacccacaaggccacaatcttagtgacatgaggaggaagaaaggagattttgagaggttgagaaaaaaattaggaaaggggatgtgttggagcttgttttttttgcttcaatccttttcattgctggttacagggagaggggattgttttggtaaagattctcttaggatttaggaagtttctagcattgaaccctccaaagttgttcattgtgtataatagtaggcctaaaattcttcggacataaaaatagatgttttgtgcaattttaaatgagaacttcgcctacgtaggaaggtcagatgccatgttagcttggaataaattttgagatggaagggacagatgacaagaaaggttcaattgttttcagt

SEQ ID NO: 10863 - DNA, 1135 bp, Zea mays
gcgattgggaccctcgaggccggccgggaagaaaacagctgtcggaagctgtctttcccatgatctaggagccgtcgccgtcgagagctgaggcgaagcaacatagaagacgaggggggagtgcgactcctcgtgacttgtgagggagagaagccatggcggagatggagccgagcatcgggaaccatatggccgaagaccaaccgactccggccgcctccactgtcgaggaggccgctatggatgcagataccagcggcgagcggcgtagcgctgccgcgttggtgggcctgctccgcgggttcctcgccgtgcaacagcgccgggccgaggcctactccacgctacgaaggggtttttctgagtatatggcttatggaggtgaattggcctatcaacaactgtgtggcaatattacagcggagttcaatgattgctcaaaacaagtccttgaaataatttccctgctctcaatgccagaatttagtcgcagcgatcttgccgatttactgaagggtgttcaagcacatgagaaagagaagttgcatttgacagctaagattcaggtgctgaagaaagccggcaggccttcagagcgcctggtgaaccacgcagactgcaggtcgcgcagcatggcccagcacgtgtgcgtgcacgtcaaggagatcacggaggccgccggcaccgaggacgccgaggcggatgcggagtatgacgcggccctcaaggaggccatacagggcgtgcaggttgccgtgagcagcataaacgaacacatggaggaggtgcgctacgagattgacggactcgaggcagagacgatcggtagcaagtggagcgaagtcgaggaagcgttccctggtaccctgtctataaaatagatagatgagatgagatgagatgagatgttgagcgtggaagactgaagaagaatcacgaacagagagattcgatgtgaatttttgggtactgttcagttcagggtacccgtgttattatacgtcctccaatccaaaatttagttctttctggtcttttttccctccacgtttgaatgataatgaatacagagctacatataaattagattaatagtttaattaatgaatgtaaaaaaaaaaaaaaaaaatggacg

SEQ ID NO: 10864 - DNA, 1090 bp, Zea mays
gctaagatgccgccttcatttgaagctcccaaagcccaacacctctcctagcctccttccgtcccgccgccactcccgtcatgggcgattccgcggcgggcgcgccggagccgagcaggttcggcaggatctgcgtcttctgcggcagcaaccccggcaatcgcgccgtctacggggacgcagcgctcgacctcggcaaagagctggtggcgaaggggatcgatttggtctacggcggcgggagcgtcgggctcatgggcctgatcgcgcagacggtccttggtggcggctgcagtgtcctcggagtgattccgagagcactcatgccgcttgagatatctggtgctagcgttggagaagttaaggttgtctccgacatgcacgagaggaaagctgagatggcacggcaagctgatgccttcatagctcttcctggagggtacggaacaatggaagaactgttagagatgataacgtggtcacagctcggaattcatgacaaaccagtcggtttgctgaacgttgatggctactacgacccgctgctcatgctgtttgatagaggggcaacggaaggctttatcaagctagattgcagagatataattgtttcagcgccaactgcccatgagttactgaagaagatggagcactacactcggtcgcaccaggaggtcgccccacggacgagctgggagatgtcagagctgggctatggaaaagcgtcggagtcatagcgtacccttagtgcttaccaagatgaaatcgtccctggagtacgtttttcgtctagcatctagttgttactcgactgcaggcatcggcattcaagcatcatctttagatctactcttttagctgtcactcatgttaattgttattgttacttcatctggtgaacaagagtataagaatttgtatatgttcttccacgtcaacggtgctggcaaaagcatattacaaacagtacttttgttcaccgtggttacaaataatacagtttgtacgatgaagggattaaaaaaaagggcggccgccgactagtgagctcgtcgacccgggaattaattccggaccggtacctgcaggc

SEQ ID NO: 10865 - DNA, 1440 bp, Zea mays
tgcccccaccagagcagaggccgccacgcgctctcgtcccttctcaacccctccttctcctccgctccccccgcgcggcgcggaagagagaccaaaggggacggcagccaggaaggaagaggaggcttcgagatttttgcggaacccccacgccacccccctctgcacaccaccacaaccttctcctcatagcctgcctctcgcgtagggtttgcgcgcgccaccgtctccactccaatcccagcaccacccgtcctaccgccgccgcattcggagctctgcatctgcctgcagcccgattcgccaatcgccaccgagcctcgagaagcctcgccgtaccggtttggggatttctggtttccctttctcactgttactgttgctgggatctgaggagtgtttgtattggtgctaattgtttctgccgatttgggcgtgattatccaggctgagtggtattggtgatgtcggctgattagatttgggggtgtattggtagaggggattcgttttttttaggagggggacgtctggacgtctaccttctctgctattggattgggctccgtgatcgagactgctccgtgaagtttttggtcctagggattgtgtttttttgatcggcccggaccaggaatagagggttcttctcttgagaagatctagggccgcgtgttctatcgtcgtctgtagataaaatcaaaagaaaaaagaaaaaaagaaaatagagagggagaaaaaaaagagagagcgagagatatagagaggtagtggaagggaggttggaggttatggcgctgaattactcgtcacgctcgctcctggtgaccgatgaatgtgccaacatgatgcttggttgtgggtgctggtcggatgaggcctctcctgtatcatcctccggggtgaattcactgtggtggaatgagcctgagatggagatgaaggaggcggatcctgtggatctcttacccacggacccctttgggatgaacctggaaactacgttcacagctgcgatcgccagttgcatcggggacctcacgttcatgtctggtgctgggcattttggaagcggtgatgacgatgatttctctgatgacctgagttattacttgaaccaggcttttatgctcactccggagccatggagtggtgcctatactggtggttttgaggattcttttgtgtgtggaggcctctcaggtgctggaggcatggaacagttttcacggttgcctcctagtatgtcctactctattggggtcatggaggacccatatagctcttgtcacccagctttgtcatgctgtgataatatggttgaggaggacccatctagcctttgtaacccagctttggcatgctgggatatgggtgatggtgctcctgtccaggaaggaaatgatgcacatgaagcgaaggtgtttgttctgagctatc

SEQ ID NO: 10866 - DNA, 1900 bp, Zea mays
acaccatacaaccgacgactgcatttaatgatcattctcggttcatttgctatttttctcgtacaattatgctgtatatatataacaaaaaaatgttctcagtttacctgcctactaagaggaccttcctcagcaggtcatcgataaaaaaccaccgctcacgctcacattcaacaatgctgcattacagttgtcattgcatttcatctgctatactttttttgtatattaagtaaagcaaacaaatggccttattggacctattggtgcagtacccttccacaatatgaagagaacattgaggtggaatggaagcaaatttatacggctgcccctttcacttgtcggccaggaaatgttcagctattatctggtggcctagaagaccagcaattgatacatagagccacacttagtgaagtctataaatacgagtattacttctgttttgatattcaagcacaattgttgtcagacttgtttccgtcgccctcaggtcaacagtgctctgaaaaggtaatcccagcatctacaggaccatggagatcttcaaactttatttgatatcaatacagctgctggtccctaaagatccatcctaccaaggaagtctgataacctgatactttttgcaattactgtacttccatcatcagcatcaagatgccgcagtattacctcttccaagcggccatctctgtaggcatgcttatagaaacaacttgttccgaaggggcatgagccagtcccaaagtcgaagtacttgcaatcaatagacttgagcttggatttgtagctttcagtgatctcctctttctcttcctttgagaagtaccaaagaacacttggaatgacatagtatgaaagtttccgacatattggacaagccctcaatgctgagttcacatccataccagatgcaggagaattgctacgccaatttctaatgcattcaatacagaaaggatgatcacattcggataagagtccaaacttcctttcagcagcagtaggctttgaaagcacacgatccaaacatacactacattctatttcttggctgcgtttcagagctacaaggcgtttgtgatttttctcacataacttgatatgctcctccctctcatcaggacgataaggatgcaagcacagttttccacaggttgcacacagatctccatgcatttgagggcacccttccccataaggacaattaccagcagcagcaaaagaacaaatagggagatccacaggtttcaatgatgtctggtttatcaaattttgattagaagaccagtcaattccatcatctgaaacaatatcatgctgaaaatcatttctccatgcaggcttactggcagaatgtgccaacacatccacagatatctgatgtctttggttgcttgaatctgtttggtgcaccatatgaggtggatgattgtaacttgaaagttgaagagaagtagatgcacgtcttgattttgattaggatgttctaggtaatggtactcgtgcggttccgagaaactttgacatggccatatctgcaacggctaccatacgagcatgcacctttttggtagaatgtgcaaacattatttgcttgatcactccagtcgtgggagaattcacagtactctcctttcaagcaagctccatgcatgaagaacttgcaaagaactttcttagtcgacatggccgaggcaaaccgatcggacaagccagcccgcgtcgcgcagctactagaggcgactaacagcgccgtcacctagcttcgcccctgatttgaatccttcccagcacgtcgccacggcctagggattgcttgaaactggtgtgccttcctcaggttcctttctctcctcggcccttgcgcgtcgccttttgaggctttccgatt

SEQ ID NO: 10867 - DNA, 615 bp, Zea mays
aatttcataaacatgtcttcagactagaagccccctgcctcctgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaagaagagaaaaaggaggaggccaaggaagagagcgatgatgacatgggcttcagcttgttcgactaagcagttcaattccagctctcctgtggaatctgctatgctaaagattacctatcttatgtgcttttaggtcgaattttgcggatttaatatgtttgagacctaagtatctgtgcaatgagtactgcaaaccaccttgggatggtctttttagaatgaaaatggttttggtgcttggttg

SEQ ID NO: 10868 - DNA, 2469 bp, Zea mays
taactatctcatttaaattaggtctatctacgtgatatatagaaatcgtaggtatgtaagcgagagtttagaataataagaaaatatagtactaaaggggtgtttgaacgcactaaactaatagttagttggctaaaaattcttagtaaaattagctagctaacaatttactaatgtaccaaaaatagcttatagctgaactattagttaaggtatttggatgtcgcaactaattttagcctataactattatctataatgcattcaaatacctcaaaattaaaagaaccctcgtcccacaatcaaggcctaatcctggaattatctatatgacccgcgaagtgcgcggcccacacgctggtacccacaaaattagggaacaacggcacacctgagcggacgaagcgtggcagtcgtgggggccctgattggagtgcctccttgcccatctgtcgtcccttgctgggactcctctgctgccagccaacttgcttacaccttaagtagtacctgaaggagagagttgaggcagcccagcggttgttgagaaaccagcaatccagcatggcacggcaaatattgttgagtatgtgtaattaagcaactatagaaaattacatagaagatgtttacgacaagagaatacatgtcttcgggtgtaagcaaccatcatacagggaaatggttgtggaggccggtctgaaggaaagccagcgcggtacttacccaacaacacaagggacgcaaggacatgtccgtttcctccgccctcccctgttctgctccccttgcttagcttaccaccccaaaagctggctttttgtgcggagtcggttcgagctgaattcggcaggcgggccgccgacggacaggtagaagaaagaaagcgaagcaagcagtgcatctgctgcagcctgcaggcaggcgccgcggcaaggcatcttcggaaacttctggcggccgtcacccgcaaagcgagacacggttcctggattatattgctggcgacacacacaaacagtatcaggccgcctcactgcctgcaagaaagcagctcaggtcagtgagctggtgcctggattatattgctggcgacagcatgatgccgctggaggctaggcgtatatatatacacacacgcagccttcttctagtagctacggagtaccattcatcatcagagctagcaagctcaaagaaaactgagctcgtgtgtggtgagcagcgagtgagtgagggactggtgaccatttcaagaacagcgccgcagcagggagctaattcgttcgttcatcgtcgcatcatcagtttgtgatccttcgcccccgtagcttcctgcaacttcgagctcactaaacaaccatgggaggaggcacgctggagtacctgtcggatctgctaggcggcggcggcggccggcgccggtacaagaagaggaagcagttccagacggtggagctcaaggtgcgcatggactgcgacggctgcgagatgaaagtcaggaacgcgctctccagcatgaaaggtatgcatatcttcttcatcagattctactccgaagaaatacaacctgctggctgctgctaattgttttgttgcatcgccttgtttgcgtccatcatctgatcatcatcgtcatcaggggtgcactccgtggagatcaaccgcaagcagtacaaggtgacggtgcaggggtacgtggagccgcacaaggtggtgaagcgggtgcaggccacggggaagaaggccgagatctggccctacgtgccctacagcctcgtcgcgcacccttacgccgcgccggcctacgacaagaaggcgccgccgggctacgtgcgcagggtcgacgccgtcatgcccgtctcctccacctacggcgggcccgcggcggcggccgggccgccgcaggaggagcggctcgccaccatgttcagcgacgacaaccccaacgcgtgctccgtcatgtaaattagaattactttttcttttcccctacacaccaccgtgggtgcatggcgcagctctcttcgaccacagaaaatgtaaaccgtacgtggatgcatgtcaaaaccatagatgatcgcctcggttggatgtctatgtccatcacatgtgcttgtacgtacgtagctgtatgttgttgtatgctttgtatattattgtttgatggaaccaaaagaaagcatgcatgcgtggtagagagatttttcccaaaattaattaaagttagtcttcttcctcgctccacatgtgctgccgaatcttagcctacctttaaattctgttataaatttcatctgtagagttgtgtgttgcatgtatatattctattaatgaacctatgatgatgtgtctgtacttgacagtgcagttggattgctctgtttcatttattttaatctaacatgcttttgcagcatcactacagtaaaacgatacaagtccgacggctccattatgtccgacggc

SEQ ID NO: 10869 - DNA, 2454 bp, Zea mays
gctatctggttctggaaccatccagggacgggcggcggacgtatcacgtggtcatcataaaccggccggcggccccccccgtccggcattgttcccgccgtcttccccaattcgccgccaggccagggtaaaaaaaaaaagaggaagaaaacctcctgcaattcccattccatcgatccagctccggtccaagccaaagctttcttcgccccaaaccttgttcaactccaatgtcggacttcttcttcgggagcccgttccgccgccgcttccacgcgcgccccttccacgccgtcgactggtcctccgccgcggcggcggccatggactgggtggagaccccgtcctcccacgtgctccgcgtcaacgtgccgggactcggcaaggacgacgtcaaggtccaggtcgacgagggcaaagtgctcaccatcaggggcgccccgcccgcggccaaggagaaggggaaggaggacgaggaggaggggacggtgtggcacgtggcggagcgcggcaagccggagttcgcgcgggccgtggcgctgccggagaacgtgcgcgtggacgggatcagggccggcttggagaacggggttctcaccgtcgttgtgcccaaggaagtcgccccggcccggccccagcccaggtccatcgccgtctccagcaagctcccatgcgtcgcgggcccggggtgcccgtcccggcggtgcagtgttaaaccatgccgcaaatggcgggtacgtctgaattctggtcgtgtgtgtgtccgtgtcacctagaaaacgcgcaccccgtgtaaattgcgatacaatttcatgcaagtaatccgagtgagtgaaaatggctgctagccaaaaacggtcgattctgaatatgcagtttgcaataaactaaattaaaaggaaaaggcatgtttgaatatgtgaaagattcaccttttcaaagtctactctccatgaacgtcctgattgctctggtctcctttgcttcctggatatcgaacccagctctaagagttggctagactcttaagctaaaagccttagagttaacttgattcggctcgtttacaagttcgagctagagcagaaaaaacaatatatattaatttctagttaattttaaactaatttaatattggaaaatagtaattatactcatagtttcatagatcacattaatataacaccaaattaatacagctcatcaatcactaattcacacacttgttcattcgtttaactcacagttatattcgaatagaccaatttaacacatagacacattttatcaatcattagtttaacttatagatcatagaccacacatatatacaatatgttcatcaattgttatgtaaataatatgcatatagttttgtttttctgatatatgatagcttgtttagctcgcaagctgtctcgttaacgaaccgagctaatatattaacttagtttgttaatttttcttaaataaaccaatctaaatttgaatcgagctgatcacgaaccgagcgagtgacagtcacgtggtctagtcctaccaatagttcacatgcttgtggcagcaggtgttggattatgatgtaacttctctagtttcaatttggttatccatttgctcgtattcacttgacattctacacccatccggtttcgattgtagtggctatacctttactagcggtggtctactgcttcctgaagcaactagcagaaaatgatgatgctagttctagacttctagtgacactgatagtctatggaatctctggtttatcacttgaggaattttctatggctcactatcatcatcagactaaataggtatatgtccatgcgttatcacgagagttaaaaattaatataaaacatatatagaacaacaaacatcattatgatatgctaaatcattgtgtaagtagtttatatgaaaatcgtcaatcacccttgaccaaccaacatttatagacttattagcgctacaaaagcacaacacacaagtatttgatacggttcagccggtacattcgcaaagggagcaaaacagattttccctgagaccaagagaccttacagcatctgcgattctgcatgacagtaacaggccccaccatgattgatgaagtcaagtgatatgaaaaagatttaaaagttcaagagtttctcttatagcaaaattgtacaatgatagttcacctgctcttttgaaaaggtaacttcagtgatatcaatttctagttaattttaaattaatttaacaatagaaaatattaattatactcataatttcatagataacatcaatgtaacaccaaattaacacagatcaccactcaccaattcacaattcacacatatattcatcagtttaactcacaaattatatttatataaaccaatttaacacatagacacagttcatcaatcattagtttaacttatagaccatagacta

SEQ ID NO: 10870 - DNA, 1133 bp, Zea mays
  misc_feature (44)..(44): n is a, c, g, or t
gtactctctctgttttgttttaatgtcgctgaatagtgtaatancaaataaaaagaaatgaagagagtaattattttatagaaggagctatatcgtatcggggactcagggaaacaagggtttattcatataataatcatatctcagatatgcaactgcattccacaggcttctcaaaccatccatctacgtcattctccatgtctcgctatctggttctggaaccatccagtgacggccggcggacgtatcacgtggtcatcataaaccggccggcggccccctccatccgacattgttcccgccgtcttccccaattcgccgccaggccagggtaaaaaaaaaaaagaggaagaaaacctcctgcaattcccattccatcgatccagctccggtccaagccaaagctttcttcgccccaaaccttgttcaactccaatgtcggacttcttcttcgggagcccgttccgccgcctcttccacgcgcgccccttccatgccgtcgactggtcctccgccgcggcggcggccatggactgggtggagaccccgtcctcccacgtgctgcgcgtcaacgtgccgggactcggcaaggacgacgtcaaggtccaggtcgacgagggcaaagtgctcaccatcaggggcgccccgcccgcggccaaggagaaggggaaggaggacgaggaggaggggacggtgtggcacgtggcggagcgcggcaagccggagttcgcgcgggccgtggcgctgccggagaacgtgcgcgtggacgggatcagggccggcttggagaacggggttctcaccgtcgttgtgcccaaggaagtcgccccggcccggcccaagcccaggtccatcgccgtctccagcaagctctgatgagtctgaggcgatgagtggcagagtgtacggtgcagtgttaaaccatgccgcaaatggcgggtacgtctgaattctggtcgtgtgtgtgtccgtgtcacctagaaaacgcgcacctcgtgtaaattgtgatacaatttcatgcaagtaatccgagtgagtgaaaatggctgctagccaaaaacggtcgattctgaatatgcagtttgcaataaactaaattaaaaggaaaaggcatgtttgaatatgtgaaa

SEQ ID NO: 10871 - DNA, 638 bp, Zea mays
gtatcgactcctatgggcgattgggtacctcgaggccggccgggcctatcttcctgcttcggacagttgagagagagagagagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtcttgggaccctgtgttaatccttgctatatggatctgacagtgctcatgtaattcaagaatcctggactatcttttatgtgcttatttgagtttgcaagtgcgtttccgtaaaaaaaaaaaaaaaaaagcggcccgcaaaaaaaaaaaaaaaaaaaactcgagcccgg

SEQ ID NO: 10872 - DNA, 658 bp, Zea mays
  misc_feature (609)..(609): n is a, c, g, or t
  misc_feature (611)..(612): n is a, c, g, or t
  misc_feature (617)..(620): n is a, c, g, or t
  misc_feature (626)..(627): n is a, c, g, or t
  misc_feature (639)..(642): n is a, c, g, or t
  misc_feature (645)..(647): n is a, c, g, or t
  misc_feature (650)..(655): n is a, c, g, or t
  misc_feature (657)..(657): n is a, c, g, or t
gggtacctcgaggccggccgggccggggcctatcttcctgcttcggacagttgagagagagagagagagagaggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgaccaccaccactagatcgccggcaggatccgtgactcggtcaagaagctggagccaactttaccaagcacttgtgctgttgatgtttttacagttttgagctcataaggtcagccatgaccatattgtaatctgtgaccgggtagacttgcccactggtccgtccaactattgtctttggaccctgtgttaatccttgctatatggatctgacagtgctcatgtaattcaagaatcctggactatcttttatgtgcttatttgagtttgctaagtgcgaatttcaacgtggcccctagggccaaaaaaaaaaaaaaaanannaaaannnnaaaaannaaaaaaaaaaannnnaannnaannnnnnana

SEQ ID NO: 10873 - DNA, 650 bp, Zea mays
actccatagggcgattgggaccctcgcccccggcgggggcctatcttcctgcttcggacagttgtgagagagaggggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtcttgggaccctgtgttaatccttgctatatggatctgacagtgctcatgtaattcaagaatcctggactatcttttatgtgcttatttgagtttgcaagtgcgtttccgttaaaaaaaaaaaaaaaaaaaggcccgacggccaaaaaaaaacccgcggcccgagactagttctctcctcgtgc

SEQ ID NO: 10874 - DNA, 2909 bp, Zea mays
ccaaagtaatgcgtttgcaattataggatcgcgtgaacagtaaaggaatattgtactatttataggcacaggacacagcctgtaaggaattacaatcataccccttataaaagtttacaacaatgactcagactctcatgggctaaaaggtcattctatctttaaatcgattcgatccttcatcttcggatacgctataacaccgaagcttcatgagtgatagcttcgacatcacgtataagcagtttttgccgaagctgttttttgttgcaggaccctcgacgatgaagcatggtcccaacagatgctaagataggaggataaaaggacaaggtgttttcagtatcaaatgcagaccatacttgcagtcgtgcttgcgttggtggctttagtgtttgatcatattagcaatctgccttgaatagaagaatctaatgttgtgcaaacaacaaaccttgccgactaacagcctagtcttgctgtatgcctgaagttcgacattcccttccttaacagcagactactgttcccttattggttttgctgtatgtcttcagtcagcagagcacgagggtgaggacggacttgccagggctgcggctcgagcctgacagcagcggtgctaggtcacggcctgcagtcccctccgcgagtgcgcctaactgcctaagcacaacatcctagcgctgcttgactggtgcgacgtgccgacgtctctgggagccgtggctctgttgtctgattgagcttttagttgggcgtcgcctgcacattgtgtagctaggctgtgttgtctgatgaagctatctatcccgggaaggcaaaacgggggtgaatgaataaaaaaaaagggtcaacctaggcatcctgctttggctcctcaccggctaatcttctccgttgctggtgctcagcgaccttgtagtccacgacctcacggaacaggccaggggttagctcgcagtccttgctcccgtagacagccgcctggacgctggccatcatcttggctatctctcgtccggagaagccctgggtcttggccgccgcctcgcggatcaggtcgtcggtgacgcccttcaccacgatcttctggggctggcggcggaagaaacggagccagctcttctcgcgcttgtcgccggctctgatgacgtacttgtccaggtatagcttcaggagcttgaaccgctcgtcttccccgggcagggggaattccaggacctcgtcgatacggtcggcgacggccgagtcgagatcgccaggcctgttggtggcaagcgcaaggacgatgtccttggactggtcgcctgtgcggaagaggagagcgttcagggcactcctttgagcttcgctcatgtaagttttgtttcgttcgcacaagaaagcatctgcttcatctatgaagagaagcaaacccctgttagatttcttcgcccagtcaaacaactgatgaatcttggtgactgcttgtgatcccaatggtgcaacatctccaccagtcattagtgcataatctaatccagaattgcgagcaagttctcgtgctgccatggttttccctgtgccaggaggcccatagaaaagcatgttcctgaaaggagcttgatgaagttttgtattggctgtggcattagcaagctgcttcactctcttctggagagaaggatttagaataacatcaccaaacccatttctgtccttccctaggttgcttccattcttcagtttgctagtcagggtacttgtagcacgtgagaggaaaccagaccagggatatttcccacgtgatgactcccttatcagtgatggctgacccagaatacgatcaacatagccccagactactcttgcaccctcccttgttgtgtatatccctgcagcaagtgctgttacccctccaactgctaccactagcttattttggtcggttaatatcgttcgcaaaccacctccgatatgctcaaaggttgtatttatcacttggatccacttctccctgtcagcatttatctcctccaaaagcaatcgcctcttcacatcttcagtttgccttgttactagtattctcccctccgcctctgccatggctttctttgaaagggtcgcctgctctagatcagccctttgcctctctgtctgtctccgttgttcctggatttgctcctcagtcgcccgcctgatctgctctagcctaatcccagattcctcttgcatcttcacgagctcttggtttcttaacctttgcgcctcatgttcagcctgcagtcgcttcctctttagctcatcctcatactgagccgtctgcgacttaaatttcgctcgttgttgatcaagtttttttctctcttcaaaatccactcgtttttgctcaagctcgatatcggccactgccttctgcaactcgagtttcttcgcagctacttcctgctggtgcgtctcctcctgcttcttcataagctcgaacagctttttggggtccgacgactgtttgagcttgtcaatcgcctccaccccacgctccagcggcgcggggtcgaagcccgcggcactcgtgcgagggtggtgagtagaaaccttcggagcctcctccggggcttcctcgcgctggccgcctgacggcggtgggggctgctgatgcggcggcgcggcgggggcgggggccggggcggaggagtagaatccggggaagcggaaggtggagccgcctccgtcagcgtgggcccgctcggaggagagcacgaaggctgcccccgcggagacggctgcggccgctgccttagcggcggcggccatggctgtgacttgtgagtcgtgtgggtttgggcgggtagggtttaaagttggctgcacgtccgtaccgaactctcgatcttttgattaggatgttctaggtaatggtctcgtgc

SEQ ID NO: 10875 - DNA, 4015 bp, Zea mays
ggccgggagcctttacagagagcgatttatatgtcatccactttattctaatgctagttagtactaattaataatctgcggaccctcgaggccggccgggagagagatctaataaaaccattcggtgcgccggacaggtcaatcactgctactcctacatcgatcagtgctgtgtagacaagaaaagcgggcagcttcgttcaaccccgagaaagcttggagccagagcagggggggcgaagagacgatggtcgggatcttctccaggttctccgccggcgcccaccgccgctccaagagcgtggccgaggctgtcgagacgctggcccccaacataagtacaggagaatctgacccagcggcagctgttcctgcggagagcccccatggcatcgaggttggtgttgagttcaagccagtggagcgccccgtggaacctatcaatcttgatgagccagtgaaatgcccgcttcctgagccgtctatactgcacgacgggaggatatggaaggagaaaatgtcttcagtcagcacgagggtgagaacagacttgccggtcgtgaaggaagggtcgcagctggagcctgacggtagcagcgctaggtcacgatctgcagttccaaggcgcgccatactgccctccgtaagcgcgcccgagcacaacatcctagcgctgcttgacgagtgcgacgtctccgggagccgtggctctgctgaatgagctcgagttgggcgtcgccagcacattgtaactaaactgcgtttgccacgagctgatctgagcacagcaaaccttacagtatgtctgaaaagaattggaactacgcaacagatcttttgtctggattgtatctataaatacgagtgaaagcgttttggggaaattgtctcgcacttgtcggaggcagttatggttactgaaactgaaacacttggttttgtgttgtaacttttgcactgttgagtgcgagcatgcagctctgaatgtgacgccaagttgtcaagtgcaaaatgaactgggaaatttgttacgggtaggcagtggttgctacttatctatcaaatctcaattcgcttgcccgtagatttgccgctaccgccgacagccgcagctgcggtgccgtcggcctcaccgggatcgtgggccatgccatgcatgacatgcctggcgactggagcaggagacggtggcgacaggttaggtccgggcggttgtgacagatgataatgccggatcgccaacagtgggacgactcgagttgaggcacagcggacgaacatttttactgtgagagaatgtcacttgtaggtatcgacggcgcaggacattgtcgcgcaccagcgaagatgggtgaatggaactgctcaattcattcacgggcagagcggtactatagactctagattttaattttacactataaactttataaagatcaaattagattaggatcggactctatttatatttgtttttttaactaaaattatttaaaggttctaacttattgtgacgagcatcagtaggtacgacacatctacaagagctgcaaaacaatgccaacaccattatagccactggctctctgtcgtttattgtcagtaaatcagaccattttttgttgtgcttctgttagaagatagaagactgaccaaacagtataatgcatcaaaacggggccagcttgctgggtgtgtgtgtgacctgtcgccaaagtttccatcacatgccacatgcaaccctcatctcttataccaaaaaagttaccatcgcctaccaccttaagaccaacctggtaaggcaaatggaacaaaagaataacacggggcatgcaaaacgcctgcccgatgaagcaatctatcccgggggggaaacacagtacatcccacggcaaaatgggggtgaatcaaaaaaattggtaaactaggcatcctgctttggctcctcaccggctaatcttctccgctgcttgtgctcagcgaccttgtagtccacaacctcacggaacaggcctggggtgagctcgcagtccttgctcccatagacagcggcctggacgcttgccatcatcttcgctatctctcttccagagaagccctgggtcctggatgccgcctcccggatcaggtcatcagtgatgcctttcacctcaatcttctggggctggcgacggaagaactggagccagctcttctcatgtttgtcaccagctttgattatgtacttgtccagatatagcttcaggagcttgaatcgctcatcttccccaggcaggggaaattccaggacctcatcaatacggtcagcaacagcagagtcaagatcaccgggtctgttggtggcaagtgcaaggacaatgtccttggattggtcacctgtgcggaagaggagagcattcagggcactcctttgagcttcactcatgtaagttttgttccgtctgcagggtacaaaaaaacaatctgagatgtcacaacactacaatttgcaagctaagggagacaaaacacaactgaaatataattggatctttgcacactcaaaatagaacaatggcagaaaataattgatgcaatacacttctactacagaatactaaatttctattgcaaattgtagtgttcttaataatgtacttaataatttcactgcttaactgcccctctctatacatttcaagtcaccgaacagttggtgattagttatagttatagagccgcacatttctattgcaaaatcatttgtgctagatgaattgacttaatagcatcataagtcaacacggtagatttgaactctcttggtaatcacgaaaatacggctatgctagcaacagaaaatttctggactccatgctatgatgctgaaaattcaaatggtgtcatggaagtccaaacaagaaaagtgtctgaagattttgtttgcacttactcgcacaagaaagcatctgcttcatctatgaagagaagcaaacccctgttagatttcttcgcccagtcaaacaactgatgaatcttggtgactgcttgtgatcccaatggtgcaacatctccaccagtcattagtgcataatctaatccctgtaagtggcgacaacattagtgggacagtagcatttcaaacatttttattgatgctgacataggtatggtctataaaacatacagaattgccgagcaagttctcgtgctgccatggttttccctgtgccaggaggcccatagaaaagcatgttcctgaaaggagcttgatgaagttttgtattgcccgtggcattagcaagctgcttcactctcttctggagagaaggatttagaataacatcaccaaacccatttctgtccttccctagggttgcttccattcttcagtttgctagtcagggtacttgtagcacgtgagaggaaaccagaccagggatatttcccacgtgatgactcccttatcagtgatggctgacccaggatacgatcaacatagccccagactactcttgcaccctccctgggaaaaatacgtgaacggtgaatctatgtaaggacatcaagcaaaaaagttaagtttttagtgcatgaataaagtgtggaaaaaactacctccaaaaaaatcaacagaaagcttatgttcatttgtgcagattcctcatgcatcatttgaaataaatgcattggtcttgaaataaaatgtggtagatataggaatcatccaaagcaaacaaaggggcaaatttagaagaaatagagcaactactcatactgtgactactcctagaattcaaacccataaattgcataagatgtgactctagcaccccaaatggtttcttattcatcattgagtttaaaagctgagaggtggatacacagcagcagtttaattcagcaactttgagctccaatgcagattaagaaacagtggagttgcagtgagtctgtgagtgaaccacaactaaaaccggaaattgaaacaaagtccaccatgaactttaccttgttgtgtatatccctgcaggtc

SEQ ID NO: 10876 - DNA, 3914 bp, Zea mays
tttgatcctggattctaatgtaaatttgtgcaatattttcatggatttgttccatacctaatgagctatggataaaatcaatgtcttacatagttttaaaaaatcctaaacccttgggttatattcgatgatgagtttaaccaaataaaaaaaattaagtagacttagattatttgggacatgaattgtgacatgaatttaattccaattcatgctaatccagaactgaattggtgtaaacgaacaaagtcttatgagactttcttgtggtacagaattagttaatcgatgcttgaagtgtcatttccgttgtagcaaaggtatatcacacggtgcaaacctgttgcctaattggtcttagttaattgactgatggattctacgataggaggataaaaggacaaggtgttttcagtatcaaatgcagaccatacttgcaatctttcttgcgttgcaggctaagtgtttgatcatattagcaatctgccttgaatagaagaatctaatgttgtgcaaacaacaaaccttgccgactaacagcctagtcttgctgtatgcctgaagttcgacattcccttccttaacagcagactactgttcccttattggttttgctgtatgtcttcagtcagcagagcacgagggtgaggacggacttgccagggctgcggctcgagcctgacagcagcggtgctaggtcacggcctgcagtcccctccgcgagtgcgcctaactgcctaagcacaacatcctagcgctgcttgactggtgcgacgtgccgacgtctctgggagccgtggctctgttgtctgattgagcttttagttgggcgtcgcctgcacattgtgtagctaggctgtgttgtctgatgaagctatctatcccgggaaggcaaaacgggggtgaatgaataaaaaaaaagggtcaacctaggcatcctgctttggctcctcaccggctaatcttctccgttgctggtgctcagcgaccttgtagtccacgacctcacggaacaggccaggggttagctcgcagtccttgctcccgtagacagccgcctggacgctggccatcatcttggctatctctcgtccggagaagccctgggtcttggccgccgcctcgcggatcaggtcgtcggtgacgcccttcaccacgatcttctggggctggcggcggaagaaacggagccagctcttctcgcgcttgtcgccggctctgatgacgtacttgtccaggtatagcttcaggagcttgaaccgctcgtcttccccgggcagggggaattccaggacctcgtcgatacggtcggcgacggccgagtcgagatcgccaggcctgttggtggcaagcgcaaggacgatgtccttggactggtcgcctgtgcggaagaggagagcgttcagggcactcctttgagcttcgctcatgtaagttttgtttcgtctgtagggtaccccaaaaaaaaaacaaaaacggtctgagatgtcaacgctacagtttgcaagttatgggtgagaaactgagcactactcgcacgaaaaaaaaaaaaaaaagattttgtttgcacttactcgcacaagaaagcatctgcttcatctatgaagaggagcaaacccctgttagatttcttcgcccagtcaaacaactgatggatcttggtgactgcttgtgatcctaatggtgcaacatctccaccagtcattagtgcataatctaatccctgcaaatggtgggcaccatttattggggcagccgtatttcagacggttttattaatgctgacatagatatggtctatgaatgaaacatacagaattgcgagctagttctcgtgctgccatggttttccctgtgccaggaggcccatagaaaagcatgttcctgaaaggagcttgatgaagtttcgtattggctgtggcattagcaagctgcttcactctcttctggagagaaggatttagaataacatcaccaaacccattcccgtccttccctaggttgcttccactcttcaatttgctagtcagggtacttgtagcacgtgatagggaaccagaccagggatatttcccccgtgatgactcccttatcagtgatggctgacctagaatacgatcaacatagccccagactactcttgcaccctccctggggaaaaaatatgtgaatctacgtaagggcatcaagcagaaaacaaaatcagcaaaaaggtcagatttacgtgaatgaatgagaaatgaaaaaaaaaaggcactccaaaacaatcaacacaaaggttatgttcgtttgtgcagattcctcttgcatcatttgaaatatactcactgaccttaaaacaaaatgtggtagatataagaatcgtcaaaagggaaaaaaagacaaatttaaaagaaatatggcaacacaaaggttatgttcatttgtgcaaattcctcttgcatcatgtgactactagtatatcgcataagatgtaactctggcaccacaattggtttcatattcatcattgagttcaaattttgagaggtggatacacagcagcagtttaattcagtaacttatgagctccaatgcagaagaaacaccagaattatggtgagtgaaccacacaactaaaacaagaaattgaaacatagataacatgaactttaccttgtggtgtatatccctgcagccaggcctgttacacctcccactgctaccactagcttattttgatcagttagtatcgttcgcaaaccacctggggaaaaaggtaaagaaggaatgacgcaaaggtgtcacaaagttttatatgtcaccactgatgtttcataatataataagcacataaagacccctaacatccctaggttgaatacaacataggagtaaacggtctgagtaaagtgacatttgctggtacccgtagtatccaaataccagttttaattgcaaataataactttaggttttatcaaatacccaagctatttgacacaaactattagaaatagtttaaaaggactgcataaaaaggtctaacaaaaaactattcacatagtatggcatacctccgatatgctcaaaggttgtatttatcacttggatccacttctccctgtcagcatttatctcctccaaaagcaatcgcctcttcacatcttcagtttgctttgttactagtattctcccctccgcctctgccatggctttctttgaaagggtcgcctgctctagatcagccctttgcctctctgtctgcctccgttgttcctggatttgctcctcagtcgcccgcctgatctgctctagcctaatcccagattcctcttgcatcttcacgagctcttggtttcttaacctttgcgcctcatgttcggcctgcagtcgcttcctctttagctcatcctcatactgagctgtctcgcgacttaaatttcgctcgttgttgatcaagtttttttctctcttcaaaatccactcgtttttgctcctgtgaaatggctcgtgttacaaaataaatttgagcacaatgtaattcatgacttgacatagcaaaagccccgtccaacgacttgctatttaaaatgaagtacttaatatcacaccgtttactatgagaacgaaacaattacaatttatacaaatgtaataagagtataaaacccctccagtaaaaaaaaactatattccatgcttgctgcaaaactatttcattttcaccaaatatctttacaactacatatgtcagacgtatgaaaatgataaaagaaagaaacttgtcttagaaaaactatgtgatggagactatctgttatggatcagaatctggtgggttgataggatttaatacgagtggaaggtttggggtctagggccaggaccccgacgcttggggaggccgggcatagggctttgcccacggccag

SEQ ID NO: 10877 - DNA, 2416 bp, Zea mays
ttttttttttttttttgtaatgccaaaaccattatagccactggctcactgtcgattattgtcagtaaatcagaccattttatgacgagcatcagtaagaagatagaagactgaccaaacagtataatgcatcaaaacggggacagcttgatgggtgtgtgtgtgacctgtcgccaaagtttccatcacaagccacatgcaaccctcatctcttataccaaaaagttaccatcgcctaccaccgaagaccaacctggtaaggcaaatggaacaaaagaataacacggggcatgcaaaacgcctgcccgatgaagcaatctatcccggggggaaaacacggtacatcccacggcaagacgggggtgaatcaaaaaaattggtaaactaggcatcctgctttggctcctcaccggctaatcttctccgctgcttgtgctcagcgaccttgtagtccacaacctcacggaacagccctggggtgagctcgcagtccttgctcccatagacagcggcctggacacttgccatcatcttcgctatctctcttccagagaagccctgggtcctggatgccgcctcctggatcaggtcgtcagtgatgcctttcacctcgatcttctggggctggcgacggaagaaccggagccagctcttctcatgtttgtcaccagctttgattatgtacttgtccagatatagcttcaggagcttgaatcgctcatcttccccaggcaggggaaattccaggacctcatcaatacggtcagcaacagcagagtcaagatcaccgggtctgttggtggcaagtgcaaggacaatgtccttggattggtcacctgtgcggaagaggagagcattcagggcactcctttgagcttcactcatgtaagttttgttccgttcgcacaagaaagcatctgcttcatctatgaagagaagcaaacccctgttagatttcttcgcccagtcaaacaactgatgaatcttggtgactgcttgtgatcccaatggtgcaacatctccaccagtcattagtgcataatctaatccagaattgcgagcaagttctcgtgctgccatggttttccctgtgccaggaggcccatagaaaagcatgttcctgaaaggagcttgatgaagttttgtattggccgtggcattagcaagctgcttcactctcttctggagagaaggatttagaataacatcaccaaacccatttctgtccttccctaggttgcttccattcttcagtttgctagtcagggtacttgtagcacgtgagaggaaaccagaccagggatatttcccacgtgatgactcccttatcagtgatggctgacccaggatacgatcaacatagccccagactactcttgcaccctcccttgttgtgtatatccctgcagcaagtgctgttacccctccaactgctaccactagcttattttggtcggttaatatcgttcgcaaaccacctcctatatgctcaaatgttgtatttatcacttggatccacttctctctgtcagcatttatctcctccaaaatcaatcgtctcttcacatcttcagtttgccttgttactagtattctcccctccgcctctgccatggctttctttgaaatggtcgcctgctctagatcagccctatgtctctctgtctgtctccgttgttcctggatttgctcctcagtcgcccgcctgatctgctctagcctaatcccagattcctcttgcatcttcacaagctcctggttccttaacctctgcgcctcatgttcagcctgcagtcgcttcctttttagctcatcctcgtattgagccatctgcgacttaattttagctcgttgttgatcaagttttttcctttcttcaaaatccacccgtttttgctcaagctcgatctcggccagtgccttctgcaactcgagtttcttcgcagctatttcctgctggtgagtctcctcctgcttcttcataaactcgaacagctttttggggtccgacgcctgcttgagcttgttaatcgcctccaccccacgctccagcggcgcgggatcgaagcccgccgcactagtgcgagggtgctgagtcgaaaccttcggcgcctcctccggggcattggactcctgaggcggcggcgcggcgggggcaggggccggggccggggccggggagggggcggaggagtagaagccggggaagcggaaggtggagccgcccccgtcggcgtgggcccgctcggaggagagcacaaaggcggcccccgcggagacggccgcggccgctgccttagcggcggcggcggcggccatggtcgtgagtcgtgtgggtttgggcgggtagggtttaaggctggctggctggccgtcctctcgatcaaaaccgcggtaggagatgcgagtgtttgtt

SEQ ID NO: 10878 - DNA, 1208 bp, Zea mays
cattgggtacctcgagtctctggtctggtcgctgcgcctcccgcttggccgcgagcccgcgaccatggcggcgccacccgtccccgtcctctgcagcgcttccccatgtcgcatcaccacccacctcgcccctcctgcctttcggaccgttgccgcggcgcggccgcaggccttgcccttcgtcttgtgcgtcgagcagcgcgtggggccctcggcgcgcgcgcgcgcgccgttcgcggccaagcgcggcggcggcggcgaggtatccgcggaagctccagacggcacgcgcgcgctgctccaggcggcgctctggggcgccgaggctgcctatatactctggctcttccttctgccttacgccccgggcgacccggtctgggcaatctcgcaggctaccatcagcgacctcatcggcctatcactcaacttcttcttcgtcctgccgctgctcaactcagttggcgttcacctgctcgaatcgcctctacttcaccctatggcagaaggattgttcaacttggtgctcgcttggacgctgctttttgcgccactcctcttcacggattgtaggagggaccgctacaagggatcgctcgacgtcctgtggggctttcagatgttcctcacaaacactttcttgataccttacatggcgatccgactgaacggtccggacgcggaccggtctccgccacgaagatcacagctgggttcagtcatggtcaacggcgcgccggctgtgggcgcggtcggcggcctcgtctgcgttctctcgatcgtttgggcgttctctggccgcggagattctggtttcggaggcattgcggaacggtggcagtatctgcagagctacctattctcggagcggcttgcttatgcgtttctctgggatatgtttctgtactccgtattccagccgtggctgatcggggacaatcttgggaacgtgaaggcggatgctgctgggcttgtgagtgtggtgcggttcgtccccgttgtgggtttagttgcctaccttctttgcttagaggaagaggattagctgttaactgtgttttttatatattttttttgtcgatcgtttggatcgttgatcagcgtgcagttgagtggattctgtgcttggtggcagtgagtttgcaactgaaaacacaaatcttgccgccgaacgaaaaaaaaaaaaaaaaccgggatggacatacagt

SEQ ID NO: 10879 - DNA, 3440 bp, Zea mays
  misc_feature (196)..(196): n is a, c, g, or t
  misc_feature (311)..(311): n is a, c, g, or t
  misc_feature (424)..(424): n is a, c, g, or t
  misc_feature (1942)..(1942): n is a, c, g, or t
ccctctaattaactcttgatatacgctactttaatgctacttaatatgcttgtaatctcagtttacaactggtgtaagcgcttgaattatcgtctcaatttagtcgatagctgctgaaatacagtaagttgggtcgtgcacttatgtatttatgtgctccataatgactgctcttaatttatatatgatcactttnaatgtatatatgatcgcgacacaatatctaattagacatgctcataaaaagtttttatatcgtggctcgtcacgcgcgcatgggcgcgtataatacactagtatccatgagcatnatgctccatcctccactccgtggcgtaaaggtggggcaaggtacagaactctagatggagatcttgttggggccgcctcccagtcaggtcggttcctgagttttacgggaccnggaataagattataaatggaggccccgatactataagaactatttttactattatatatatcaactaattaaaataattcaatgtatcatataaaaacttgagtgataaaaaatagaaataagattattatctcaaatatattgtaaggaacaccttaaaaatgacttctaacatttttagatgcaaaatcatcaatgatggcttcaatattaatagcatctaaaagtttcttctcaacacatgaagttgatagcctatttaacattttttgagacattatagaccttaaataattcttttataattttagctttgagaaggtttttcagttgatgtcacagcctctcgtattgtaaataatatccgataagcaataaatatattgtgatagcaatctatttgtctcacaaactaaaaaactccgtaacaaacattaatctatctggtagtgacatttgcaatattcttaactctaatatcagatgatttacattcgcttgtgtgttggttgtggtctgcaaagatggtcgctagtttgaggtcaaagattgaggattattcctatatgtactgagtaggcgggctagtttgaggttaaagattgaggatttctatatgcactgagtaggtaaggccatgaggagtgggggccagagcggtcgaccctcgtcggtcttgtttgggagtccaaataacggaggggattggagaatctaaaattcttgaataaggaggggattttagcccctctaatccccttcggttttgtggcttccaaactagcccttaggcacggccctgccaaagcgcggcttgcgagcacaaccagagtgggtagcgcacgcacttgtccacccactcgccgaggtcagagtagtagcagaggtcgatcatgtcactattgatgagtgacaggagctcaatgaactagtagcagccgccaccaccgctgggaaaggtgaggacaccggaaagcgcttcgagttcgaaaggcttctccgtggccgagtaagagggggagcgcggagcttgtggcggcgtcaaggacacgcgcgagtagatagggaggcacaacacaacgtgagagcgcgacgatcaccaacgacacctcgacaccggtgccctcgggcttatagaagatgcctatatttagaccctgtttgcatccggttttgaagaagctggtttataaaaattgatgtggttctaaacataccagtttatgactcggtttatagaaattagattctcagttttttaaaaaatcgagaagcagacctcttttagctgaaagataaaaactggtttcttaaaactgagttgctttcaaacaggagcttagataacgataagttgttgacgatattgacggttatttttttaaaacgtctatttatatagaccatccgttctaaaataaactttgttctaaaataaaatctattttactttattttactttttagttgattcatataataattaacatatttattttatatatagtatctaaatcnatcatcatctatctgaacataaacataaaaatcaagacttaaaagactaatattttagaaccaagaaagtagattataaagaatatagagagccacttgatggcttgtccggttattcaaatcccatatagattggatggtattggaaaaaaattatgaaagattttaacttgtttggaatttaaatcaacttaatctcatccaatccatatcctagattggaagcaaaataaatccatatccacatgaattgagaacaaaacgaaaacagaagttgctctaaagatgcgacctctagatgaggacaaatagttaaaattcccgtttgcaaaaataggaaattcgtattgtatttggggctctataatttttatacgatttcaattatcagaagaaagtgtgttagcactccagcagctatgccggtgatttattgtacgcttcagccttcaactccgtcttcccatggacgccaatgagttgcaacttgagtttcttaacctcaaacactgaatcacaaatgtacaacgctcgaagccactaatcactcggcaatgctatttagctttctttttttttttttgtcaacaaaatgaaatggtggtggtgtttttcctttattttttgcgataatatacatagtttttaaacgagtaaaacctgagtgtacaaactagtaaaaccaaattggcaaaaggcgtcacctctgctatgtagacatgtagtcgccatcgccagttcgccaccggcaatcacttcagagggcggagccgcagaaggggcagaaccggaactgcggatcgacagcgcggctgcacgcgccgcaccttgcctcccggagcagcagcgagggtcccgactccgcgccgagggagcccggtgcgaggaggccgcactcgcgacagaggtacgcggggtccttccccggccaccgccagacggggacgaagaagagcttgaggaccttctccgtctccaccaggtccgcggcgccgccgcaccggaggcaccgccccgccgcttccttgagcacccgcccggccccctgctctacgccgcctacgaagaagaagaacatcttgccggatcttacttcctgtcgtcaatttcgtcactcgagatcgatctcaggtcgattagccggttagggtcgaggtggtatcatggtaagtggggttttgtaaggcttgatctgtgggcggattggctctcgggacagaggtgaaaggggatgaactttctcgagagcacggaattgagatcacgaattcccttgagcgccacacgcgtcacggcaccggtgcgatccgttttttttttttttgcaatttgcccatttttgtctttttctataaatatgccatctctagttttaatttaaaaataaaccttctgttcggcgctattgttattggtgccaatttaacacgtttagggctgatttggtgctaagggatcccaaggggatccatgggggaggaatccccttgttattcaa

SEQ ID NO: 10880 - DNA, 850 bp, Zea mays
ttggtccctccagccggccgggcggaaacttgcagccggccggccggatcacccactacctctattccggtgcgccatcgctctcgtcctcgctgatcgatccaagagactgggaccttcaaagagcaataggactcatggaggttggagacgcaagaaacggttctgcagcagcggcactgacaaagggaagtgcggatgatgccgcccgcaaaccgctccctccttgctgcgtcaaggccaaggcgcgtgtgcctgaaaccgaggccaactgccatgatactgtggtttcagggtggttcacggaacccagatcgcgttttggtaaaacaagcaaagtgcagtacttcaataacccgatgtggcctggagaggctcattcattgaaagtggagaagatcttgtttcaagggaaatcgccttaccaagaaattttagtttttgagtcttcaacctatggaaatgttcttgtgcttgatggtatagttcagttgactgacaaggatgaatgcgcataccaggaaatggttactcaccttccactgtgctcaattcctgcaccgaagaatgttttggttgttggaggtggtgatggtggtgtactgcgcgaaatagccagacatgattcagtggaaactattgatatatgtgagattgatcaactagttattgatgtttgcaaagaattctttccaaacttatccattggattcaaagatcctcgtgtccgacttcatgttggtgatgctgttgatttcctgaggaattctcccgaaggaaaatatgatgctattattgtagattcatcagatccaattgggccagcacaggcactcgtggagaaaccgtt

SEQ ID NO: 10881 - DNA, 1636 bp, Zea mays
aaaaaaaatcgccggccgggatcacccactaccctattccggtgcgccatcgctctcgtcctcgctgatcgatccaagagactgggaccttcaaagagcaataggactcatggaggttggagacgcaagaaacggttctgcagcagcggcactgacaaagggaagtgcggatgatgccgcccgcaaaccgctccctccttgctgcgtcaaggccaaggcgcgtgtgcctgaaaccgaggccaactgccatgatactgtggtttcagggtggttcacggaacccagatcgcgttttggtaaaacaagcaaagtgcagtacttcaataacccgatgtggcctggagaggctcattcattgaaagtggagaagatcttgtttcaagggaaatcgccttaccaagaaattttagtttttgagtcttcaacctatggaaatgttcttgtgcttgatggtatagttcagttgactgacaaggatgaatgcgcataccagtgaaatggctgctactttgctaccgaacaaattgaattgaaggatgttctccccaccttacgtcttctaatgagtagtaactttatgggcagctagccttatgatataagcctactgactgatgcaggttttggttgttggaggtggtgatgggtggtgtactgcgcgaaatagccagacatgattcagtggaaactattgatatatgtttgcaaagaattctttccaaacttatccattggattcaaagatcctcgtgtccgacttcatgttggtgatgctgttgatttcctgaggaattctcccgaaggaaaatatgatgctattattgtagattcatcagatccaattgggccagcacaggcactcgtggagaaactgtttattcagacaattgctagagctttgaagcctggtggtgttctttgtaatcttgctgagagcatgtggctgcacacacatctaatccaggatatgcttgctatctgtcgacagacattcaaaggtgctgtgcactatgcctggacaagtgttccaacatatcccagtggtgtcattggatttttgctatgtgcaaaagaaggtcgtgcagtgaacttcttaactcctgtgaatccaattgagaaaatagaaggaacagcaaaagctggaagggaactcagattttacaattccgagatccatagggctgcttttgttctgccaacatttgtaagaagagaactggaagcatataccactcctagtagctctgctgaaaacgagaaaccgaaagaatcggtgtcagaaccgcagaagataaagatattgtcaaacaacgccattcttacagcttcctagccctgagccgtactcaatcttgctcggtatagttgtattctcacagaataaatcagtcactggcttttgctgacaccgcacgagcagctttagtatagtgagttgaatgatgatcgattgaataagagggtggatattgaactgatgtaatgcctctgccgaaacaatatgtccccctatcttgttaggcgtgttgtgtgttgtgcacgatttcagctgtagcttgtaaattgtacgacccgttgatgtaatgtataccctgcgtttgtgctgagaaaaaaaaaaaaaaaaaaaaaaccgtta

SEQ ID NO: 10882 - DNA, 1668 bp, Zea mays
tcagctacgtaggccccccccccgctgctgcctgctcttctttttctgctgagtacaagaaacagtctttgctcgcgtcgtgggttcttcccctgttcgattcaccgcgaggtctgcgacggaggtttgcgtgcctccgattgctgcatccgttgctgatcgaggagactgggaccttcaaagagcaataggactcatggaggttggagacgcaagaaacggttctgcagcagcggcactgacaaagggaagtgcggatgatgccgcccgcaaaccgctccctccttgctgcgtcaaggccaaggcgcgtgtgcctgaaaccgaggccaactgccatgatactgtggtttcagggtggttcacggaacccagatcgcgttttggtaaaacaagcaaagtgcagtacttcaataacccgatgtggcctggagaggctcattcattgaaagtggagaagatcttgtttcaagggaaatcgccttaccaagaaattttagtttttgagtcttcaacctatggaaatgttcttgtgcttgatggtatagttcagttgactgacaaggatgaatgcgcataccaggaaatggttactcaccttccactgtgctcaattcctgcaccgaagaatgttttggttgttggaggtggtgatggtggtgtactgcgcgaaatagccagacatgattcagtggaaactattgatatatgtgagattgatcaactagttattgatgtttgcaaagaattctttccaaacttatccattggattcaaagatcctcgtgtccgacttcatgttggtgatgctgttgatttcctgaggaattctcccgaaggaaaatatgatgctattattgtagattcatcagatccaattgggccagcacaggcactcgtggagaaaccgtttattcagacaattgctagagctttgaagcctggtggtgttctttgtaatcttgctgagagcatgtggctgcacacacatctaatccaggatatgcttgctatctgtcgacagacattcaaaggtgctgtgcactatgcctggacaagtgttccaacatatcccagtggtgtcattggatttttgctatgtgcaaaagaaggtcgtgcagtgaacttcttgactcctgcgaatccaattgagaaaatagaaggagcagcaaaagctggaagggaactcagattttacaattccgagatccatagggctgcttttgttctgccaacatttgtaagaagagaactggaagcatataccactcctagtacctctgctgaaaacgagaaaccgaaagaatcggtgtcagaaccgcagaagataaagatattgtcaaacaacgccattcttacagcttcctagccctgagccgtactcaatcttgctcggtatagttgtattctcacagaataaatcagtcactggcttttgctgacgcaacacgagcagctttagtatagtgaatgatgatcgattgaataagagggtggatattgaactgatgtaatgcctctgccgaaacaatatgtctccctatcttgttaggcgtgttgtgtgttgtgcacgatttcagctgtagcttgtaaattgtacgacccgttgatgtaatgtataccctgcgtttgtgctgagaaaaaaaaaaaaaaaaaaaaaaaacctcgtgc

SEQ ID NO: 10883 - DNA, 2304 bp, Zea mays
  misc_feature (2104)..(2104): n is a, c, g, or t
ctgcagcagcatctccaccaccacgaatggtggcaaaaataattacatataaaataaaagatgataaaatgaagaacggctagcaggtatggcacggtgaaaagattcctgctgccacctatttaagggcctccccacacgctcatcagtcatcacccactacctctattccggtgcgccatcgctctcgtcctcgctgatcgatccaaggtaagcgagacgaggatctggaagctcccgaagtctcggctgcgtggcaaagcgaccacgcccacgttcttttgcttgtttctcatcctcgtgcccaacttttcgggtggggggacgccgttctgatttccgttttgcgtcgctccctgggtttgctaatcgcggtcgcagctgcggctcgccacttcgccattcccccgtgatccttgtcaccaaatcagccaaaactgtttgattaccgtcgggtgtgtcggtggagctgcggcaataaaaaaaaagggaggacctattcgcgtcctatatctgcaaagggaattgctggaaaagtttcgctgctgcctgctcttctttttctgctgcgtacaagaaacagtctttgctcgcgtcgtgggttcttcccctgttcgattcaccgcgaggtctgcgacggaggtttgcgtgcctccgattgctgcatccgttgctgatcgagggtacttgttgttgttgtagccctgcctttcttatctgattcttgttgggtgctttccaatttccgacgtatagttgctgattgcacggtttccttttccccttcttttttttcttgcaattacttcattatataaaatattctgttctcgtccacgtgccttttttttttcagtttggtggtgctcctcctactttattctattctattcgtctggtgtaggtgtagcaacctgtcacgcgtagacatgctgctttctctgtgcctatccagatggctatgaatccttcatttcgattccgagcgaagcagcactgataatgacgttcagtctgcatacgattcgcttgcttttgcttcggcacgaagcagccctgataactgacgcccctgcttgttttctgtgtctgaaattctgctgttgcctgactttgttgttgagccagagactgggaccttcaaagagcaataggactcatggaggttggagacgcaagaaacggttctgcagcagcggcactgacaaagggaagtgcggatgatgccgcccgcaaaccgctccctccttgctgcgtcaaggccaaggcgcgggtgcctgaaaccgaggccaactgccatgatactgtggtttcagggtggttcacggaacccagatcgcgttttggtacgttcaggatccagactggtagctaatgggctatgtgaccatcatttgtttgtgtccggcaacaatcaatacatacgggaaatatatgttctttcagcagttctgatatatatatatatatatagtatcaaattgatgtatgtgcaggtaaaacaagcaaagtgcagtacttcaataacccgatgtggcctggtatttctcttgtttctgaaaaacaataatagaaatttgccatgttttttttcttccaacatcttcaggttcacattgtatgatgatataaaacttggtcacacttacctagctaattttgtcaatttgataacttcaaaagatttgatatgcaaaactgactagtgaagactttcaatattggtgtacttgtgtatgtcaaaactattttccccctaaaaggctttaatggtcctacatattcaggaatcaggagtttgatcaacatcttttattatttacaggagaggcccattcattgaaagtggagaagatcttgtttcaagggaaatcgccttaccaagaaattttagtttttgaggttatttttttatctgcgaaatctgcacgtgaaaacccgaactcgtcaatcattgtactaagtagcactttcatttctgttcgcagtcttcaacctatggaaatgttcttgtgcttgatggtatagttcagttgactgacaaggatgaatgcgcataccaggaaatggttactcaccttccactgtgctcaattcctgcacngaagaatgtatgtttcttgaccttttcttttctgataacagtgaaatggctgctactttgctaccgaacaaattgaattgaaggatgttctccccaccttacgtcttctaatgagtagtaactttatgggcagttagccttatgatataagcctactgactgatgcaggttttggttgttggaggtggtgatggtggtgt

SEQ ID NO: 10884 - DNA, 1452 bp, Zea mays
  misc_feature (1)..(1): n is a, c, g, or t
  misc_feature (1432)..(1432): n is a, c, g, or t
  misc_feature (1437)..(1437): n is a, c, g, or t
  misc_feature (1439)..(1439): n is a, c, g, or t
  misc_feature (1448)..(1448): n is a, c, g, or t
  misc_feature (1450)..(1450): n is a, c, g, or t
ncttttttttttttttttgaaagtaagaatgcttgattatgaagtgatatcaaatttacatatgcatgcttccttaatagctgaagtagattatagaagaaaattgttaaccggcaggcgggtcggcactgattcgaagaacatgagcagcgtttccgtcccttgggtttcctctgtatatggtcatggtcgcctcgtccaggtcaaccaaaacagtgcacagagtgtacaacttcggtcctgtcatgtagatcgggtacttctcgtcagctgtgtctcccagcagcgagagcgccgcctctttggagtccacatccactgctgacgaacactgcgcagctctcctctccctgctcatcgagttctcgtccggcacctgcttcacttggagatgccggtacatgttggcgtggaagaagggcacggcgccggcctcgtggacggcgaaccggttcccagaggcggtctcgacgttgacgatcctccgccctctgacgtccgtcaggttgtagctgtggccgactgagacggccggtgaacagaccctgtgcattgcgtcctcgaggttcttcgcttctagcaggtcccgggacacgaagttccgggcaatggcgcccgcgacgatctcgtcgttcgccgggggaaccgagttcagcgtgaaggccactccgttggtgttgaacccgaaggcgcagctcgggagctcgccggcgcaggtgtaggcggtgaaggacgcgccgtccggcagcgtggcccgcacgaggtacgtgtggccgagcagcgcgacgtccccgtcctcgttgtgcgcggcgatcgccgtggactcgctgacgatgaggacgtcggagcagtcgccgtcggcctcctccttctccttctcctccatctccttagggatgaacggcaggacctccttcctgaagttgaccaggatgacatggaggagcgggacgccgctgccgtcggcggtgcccaccagctcgtcccagtaccgcgggtacctcttcctgttggcggactggagcgcggcgaggagcggctgcgcctgcgccgtcgacgcgaacggcagcagctgctcccggagcacgaggtcctgccgcatcctgctctggatgacctcggcgaaccgacggcccacggcgaggcccagcgcgtacccgtccgcgcagcggccggcgtcgaaggcgtctagctcgccggcgccgcccatgtgtcgaatggctttgcgcgcctagcttgtgccgtgccttatctccaagcgcactggtcaaatgggccaggatggcatgtgttctgatttttagcccatcgaggcaccgatcgcaatatccatgttggtgttctgtagcctcgaaacgtatccggcccactagggatgggagtggaccggatcaaccctcactgtgtcatagagatttttcgattaggatgntctangnaatggtctngngc

SEQ ID NO: 10885 - DNA, 1136 bp, Zea mays
gttttagttgggatctgtacgctggcatcagtttttacattctgatggagtagcttaaagttagtgtttcccggtgatgtagtagtctctatttatgctatgaatcgtggtcctcggaactctatggaattttttgtaagaatatcacagatgttgtgccacagagcacagaaaattttatcatcatggacatctccgcaaacgatctcaattgtagccatatgaatgatctattgagttatatactatatactggattatgacctaacaccagaggaacttgcagtgacatggtatgcaattctaaatgtcagccaagttgaatatttcccagtggagaacatccaaacagaattcctgtgtcagcagtaggggttggacgaaagctagttactcagcccagacactttatttgtcttagtgaactaagaatgttcatgacattaccattttcgatatcaatcatgagcttattttgattccatctatgtgacctatctatttgtacatgagcatgcatctggtacaaatctgcgtaattagaagaacccagttcatcacagatacttttacacaggttagtttttatactgcagagtgcagatgtatgcatgtgcagagttctgaatggttttagccaattagggtacaaatttcataattaattttgagcgtcgcatttactcatagttccaaacggttctgacctttgattgctttgctttatgataaggtgttggagatcaggaacattcccccccactgctgcgatggatcccatgtgaagcacaacaaagcaaccggtgataatgtgggccccctgctcgttaagaagtagatgcagtttctttcgacttttgccctagcgtcatgttgagcgctgagctgaacactatctgtctgtcatgatatatgtttttttagccaagataaactatcacgacgcaacgatccttcattcagaataaagtaagctgctcatgtcaacaagtctcagtttcatgattgtaggaagcgttagtgacaggtgatacatgtagtgggatgtatgaaaatcggaaaaaatattttgttttctgtgatgaacaatcaagtcatgagcttatgatctctgctaatgtccttcagttatacta

SEQ ID NO: 10886 - DNA, 794 bp, Zea mays
  misc_feature (761)..(761): n is a, c, g, or t
attgggtacctcgaggccggccggggccacacaccctccaaatcctctccacgcgcctacccccgacgtaccgagcgtccgagccacgactcttccctcgctcgctcgttcgtctcctcccaccaaggcaccaaaccaatctagccaccaaggcaccaaccaagagccatggcatccccgttctgcgccgctgccgccgcttgccgccttgccgtccccgccccgtcccctcccgccgcacgggcgcctaggccccgacgcggcctggtggcggtgcgcgcggaggcgggcggtgggataaacccggccatccggaaggaggaggacaaggtggtcgacaccgtcctcaccggcgagctcgccaagccgctcaccgcgtactgtcggtgttggagatcaggaacattcccactgtgcgatggatcccatgtgaagcacaacaaagcaaccggtgataatgtgggccccctgctcgttaagaagtagatgcagtttcgttcgacttttgccctagcatcatgttgagcgctgagctgaacactatctgtctgtcatgatatatgtttttttagccaagataaactatcacgacgcaacgatccttcattcagaataaagtaagctgctcatgtcaacaagtctcagtttcatgattgtaggaagcgttagtgacaggtgatacatgtagtgggatgtatgaaaatcggaaaaaatatgttgttttcttggggggacaaacaaagcaagaacctatggactanaaaaaaaaaaaaaagcggccctcgagctccagc

SEQ ID NO: 10887 - DNA, 4459 bp, Zea mays
tcgaggccgacccggcacgaggcagcagctggaggcagagatgccaaccgcaatgtcctgtcatctttgctcatgaccaaatcggtcaaggtcgcccatggatggagatcacaggaggcaagccgccgccgcggtcaccgtcacgcaagtcagcccggcgcggcgcctgatcgcctggctgaggcttctcttccgggcgttcgttcatagatacggcaaggtcgcgagctggaacgcggcggggcgccctgtcttcgtcgtcctcgcggtcttcttcctccagaggagcctgcgccgccggtacctgtcatggaaggagtcgtcgcgtcttccgctgatggccgccgccgccgtcaccgtgcagacgaccgtcagggcgatggcggcgcagcgcgagctctctgtccggaagcagaccagagctgccacacgcatccaggcgcaatggcgtgcgcacagggcggtgtggagctacctgacgacgaagagagccgccgtcatctgccaacgtgcttggaggcaaagcgttgcacgcaaggagctcaggaagctcagactgtgtgtgcaggagaatctggagagggaaatgctggaggaggtgtgcaggctgcgtgagatggtggacgtgctccagcaggctgtcaatgacgccgagacgagggccgtcaacgagagggaggcggcgaaggatgccatggcgcagttggaagcagcctcggcgatcgaagagaccgtggtgatggttgaggacactgagaaggtcaagtcgctggagggccgaagttgaccgcctcaagggtttgctgggagctgaaatgagtgaaacttttgccgccaagaaggcgctttctgaagccgagctgaggaacgagaagctggccaggctgcttggagttgaggaagttaagaacaaacggcttcaagacaccctgaaaaggtagtgttatccgggggtcaaaatcagataagttcacgatggaaattctagcgttttgaaatggttgttctgtttcataggatggaggagaaggcttctagtctggacgaggaaaacagaatgctgcgacaggctgtggcgtcaaaccctgctattgtcaggtcgccatcgggcgaaaaccatgaagcacctggaattcaggtacgcccagttcattttagttaatgatggatcacagtttcagttatctaaaaagaaacaactgatcatagttgtgtgcattcacgttgtcaggcagctcctgataatgagaaatcaaggaatggtacagtgaagcctatagcagtggatcgggaggctaatgtccatgtatgtacgatcctataaccatcgtcttagtcaaaaagcttcttctgcgggccgctgacatgacatgataatgcattttctaactgtctaggagaagggcgctgaacagcccagctcaaatggtcaagaagctgggaagcaacagcaagtatggcatcggctccgaacttttcagctctaccaccatttcgcgcgcggttcatgccacgcgatctgagcgtctttttaaacatctcgaaacgttcaggagcttctgatcaagtgcctatccgaagacctgggtttctcggtcggcaggcctatcgctgcatacctcatctacaggtgtctggtgcattggagatcgtttgaagaagagaggaccgtggtctttgaccggattatccagaagattactgctgcccttgaggtatctagccgagcagtggcaagtaatacttatgagacaacggattttatgtcagcaagaaatgagaatttgattttttttttcctttttttgccgccgctgccaggcgcgagacaacaacgatgcactagcatactggctgtccaattcatgcgcgctcctggttcttcttcaaaggacactgaaaatcaacggggtagctgccttggctcgtcagaggcgaagaacgtcgtcacctctcaaggtgccacaggtaaaccaattctgaaacctgagaattctgaaacctgagagctctgaaacctgatctcgcagcaggaaaaccaagatccagctcccgacggacagttgatctgtggactagcccaagtctaccaggttgaggccaagtacccagctatcgcgttcaagcagcagctcaccgcactgctggagaaggtctatgggatgatccggcacaacctgaagaaggaactgtcgccgcttctgggcctctgcattcaggtacgtagtagtgtctgccaggatgcggttctcaaacaagtgtatttgccaaaaataaaaaaataaaaaaaagtcatgacccaacaagggtttcaatcttctcctgcaggcgccacgcacattcgtcgtcagtcccagaggatcgtgttcccaaggaacagatctggcgcaacaagcctccatggcgcattggcagagcatcatcaagatcttgacaaattctctcgatgttctgaaatcaaattacgtgcgtcgtcagaatctcagcacctgcagaaacatatacgcctctcttttttttctctctatctctctctctctctctttattagaacgcgcctgattccatcagggctggtcgcgttgcaggtgcctccgttcctgatctgcaagatgttcacgcaagtcttctcgtttatcaatgtgcagctttttaacaggtactgtacctgctttatgaacatcacatactacagaagcagcgttatgaactcatgtagccttcgattgtagccttctgctgcggcgtgagtgctgctcgttcagtaacggagagtacgtgaaggctgggctggatgagctagagcattggtgcttttggctgactgaagaggtgatggcatcctcagactgcttcaacagagcttcagttgataaaagaagctgcttaacttcaattcctttctcctcctcctcctcggctcctcctccttcttcttcttctttgcgaaagtcgctgaccctgtaactgtgaacagtacgcaggatctgcatgggacgagctgaagcatatcaggcaggcagttaccctcttgatacttgacgacaagcatagccggagtctcgcggagatcacagacgacttctgcccagtgagttttctgagccttgccagctactgcacgcttttgttgaagtttcgtttcgacaccgccgccattcttgtcaagttagtgaccgcgtcgtctatatatggtgccgacgtaggtgctgagcatgcagcaactgtaccggatcagcacgatgtactgcgacgacaagtttgggaccctgggcattccatcagaagtgagtgatagatcccaagtcccaacaacacattcctgcctgccaaggacttccaggattcgttcggtttcgaggactgaactctctctgcatctctctctctcgataaaccgcaggtcgtctccagcatgcggaccaagatgatcgagggctcgtcgagcagcccgtcggcgcacgacgacatcaactcgttcctgctagacgatgacttcaggttctacgtaccgactcctcttctttttctttgacctgcctgatgatatatacattggtcctcatcaagattgacttaatttgtgactgcagcataccgttctccgtggatgacttcacgaagctgatagtgcacgtcgacgtagcggacatggatttgccaccgctcattcaggagagcagcggcggcggctccaaaatgggacattgaggagtgacaatatgcacgccttttttgtgtgtgttgcggtgatgtgcatagtgcgtgacatattgctctgagaccagggttttgtttttttcttcgtcgactggtcttccatttttctcccatatgactactacctgagtgagtagtgcctgtttgggtttgcgcgtgtgtatgattgtacagaactgagctgtggcatataaggtaaggaaagaaagcctgtgtgattcaattttttttatcaaaagagtgagtgatgcttgcaagtcaagctttcctttgccaagtgtgatctcagattctaactgctgtgacacctgtacttttgttgtttgtttgttttttttttttttttgaaagaagcctggcgctgatggcctccatttaactgttgagcatctgtcactcgctcaatagttaatggtctagagaaacattgtcgaccatctgtgtcactagaattgatgacttgttgtctatccttattgcctctgtttcaaccttgccagtgcgatttggatctggtcatggccggcgccatgcacagtaatgtggtcaataacaaatatgctaaactacatacatataacatataccatgttcatctaagataacatgtgaacagagtattatagatcgttatctctaaagtctaaacatatagtgcagcggaagaagaccataacgatatagtagaagttgtcgtacgtctgcacgtaccaccaacaacgatatgtttacccgtgct

SEQ ID NO: 10888 - DNA, 1249 bp, Zea mays
cggcacgagaaagcccaagcgattggttgctgttgcttcctgctttcgcttcgccttcacccgttcgccgtgcggccgagctctctagttccgccgctcgctagtcgccttcctcccaaatggcgaccgccatgcggggcagcagcctcctgcggttcggtttccgccatccttcctgcctcctgttccagtcccctcggtgtcctgccccgagcctgggtctgaacctggccgttggccgcaccgggcttatacgcctccgatgctcggcggccggggccggcgacgccggtggaaagaaggtgtcggctcggctggctctgacgcagcaggtgctgcggaacgccgaggagcgcgccgcgtcggcgggttcggaccctgcccccaagatcaccctggatcatgttactgttaattttgcaagaagtggtggtcctggtggtcagaatgttaacaaagttaacacaaaggttgacatgcgattcaatgttaaggaagctcactggcttggggagagaatcaaggaacggatattacaagcggagaagaataggataaataaagatggagagcttgttatatcttctacaaaaactagaacacagaagggcaatattgaagatgcattgcagaaaatacaggcaatcattgatgctgcatcatatgttcctccacccccaacagaagaccaaaaaaaaaaaaaaaaaaaaattgctgcagttgctgaaaggaagagacttcagaataagaaggtgctttcacagaagaaggaatttagacggaacagaactagctgggattgatgcaaggtatcttgcacagacccgtctttctgttttgtgccattccgcggtgggcattggcaatagtttagagggcttgttctcggggtagcaaaagcattcggctgatccttacagcagtggtgtacagagaccgacgaaaaacaagggtcagacttgctgaaggcatcttggtgaagaagatatagctaagtttcgtaggcatctccagtttttgtttcgtctattagtagggatggattcggatcggatactcatggaaacagatccgaacgtcactatttaccatattttaatccgaatacgaatactatcggatacgaatacaaaacggatagttcgaattcggatttacattcgaatacttacttgatttggaacatagcatcataacaagtattaatttgttttatcgatggatttatagttgaaaaaaaaaaaaaaaa

SEQ ID NO: 10889 - DNA, 1931 bp, Zea mays
gcaagtctgaactttcctcgtgccgttttttttttttttttttactcctctttggattgcatcaaggatcacaccacattcgtcttaataatctagtagtaatcatcatatcctatatgtttagggatagaaaacttattaaaccacatcgctaattaaccatgttcatattctggacatctcctgctgctggtggaggttgccctggtattttgggtccctgcggacgatgcgcttccagtaccagtgcctgtcaaagagcatccatatctcctcgatgggcacctgcttggtctccggcagcaggaggatgacgaagatggacatgacgacgatgagcgcggcgaagagcacgaagacgccccaccggaggtggcacagcgcggcgaggaagcactgcgctacggaagccgtccagaagaggttgacgcacaccaccacgctctgccccgccgaccgcatctccagcgggaacagctcgctcggcaccagccatccgaggggcccccaggaccatccgtaggccaccacgaagaggcagatggccaccaccagcaccgtgctcacgcccttgctcagctcctcgccttttccgaacttgagggcaaggatcacagccaccacgaccatggatgagaccatctgaatgcccgcctcgatgaagaggaagcggcggccaaggcggtcgacggtaaccatggagatgagcgcgccgacgacgagcatggagccggtgatgatggaggagtagagcgccgcggaggagccgaatccaaggctctggaagatgacgggcgagtagaagaggatggagttcatgcccgacagctgctggaacgccgggatgccgagcgcgccgatgatgagctgcgggcggttgcgcacggcgagcaggttccggaacgtgcccgtgacggcgcgcgcggcctggctggcctccttgaggtcctcgaactcggcgtccaccttgtgcgtgccgcgcaccttctccagcacgcggcgggcctcctccaggtgcccgcgctcgacgaggctgttgggcgtctcgggaaggaagagcgcgccgacgaagatggcggtggccgggcccatggcgaggcccagcgagaggcgccacccccaggggtgcaggcggtcggtgaagtagttgatgacgtcggcgacgaggatgccgaggcaggtggtgagctggaagagctggttcacggcgccgcggatgcggtagggcgcgatctccgagaggtagagcggcacggcctggttgccgaagccgatgccgacgccgaggagcacgcggccgacgatgagcatggcgatgttcatggcggccgcgttgatggcgccgccgaggaagaagctggcggcgcccaccatgatgctggcgcgccggccgtggcgcttggtcacgtaggaggcgccgaaggtggagacgaggcccgcgaagtagagcgacgaggtgaagagcgtcagcacctggttgtcgtacttgcagtagtccgtctcgtggaggtgcgcctgcttccgccggtacacgtccgggaagaacttcaccaggaagtcgtccatggaagtcacgccgctggagactccgaggtcatagccgaagagggatccgccgaaggagccgacgatgcaagcgaggatgaagtagccggtgatcttgccctcgtagagctcggccctcccggcggctgccccgccgccgccaaacccgccggccatctcgctgtcctcccctctcctacgtcgtgctcgcttctcttcagacgaccgggttcaccttacgtactccgcccctcttccgtgaaaggctgaaacaaacaaagaatgaaatttttcgattaggatgttctaggtaatggtctcgtgcggaatgaaataggcagggcaggggaagggaggggaggagaaggaacccggccggcctcgag

SEQ ID NO: 10890 - DNA, 3442 bp, Zea mays
  misc_feature (1980)..(1980): n is a, c, g, or t
tctgcgacgccaagatgagcgaggtggtgtcctcgctcggctgggcgcgcgcgcggccgtggcctgagccgctgctgcaggccttcttcctcgccgccaagggcgtgtggggcgtccgcctcctggcgcgctccgtccacccgccgctccccgttgtgcgcgccgagcgaggcgcgcgcttcgacccgcggttcatggaggacgccgcggccagccgggcggggacgctggaaccggccagcgtgaagatgatgatggcgccagggttccacgtctacctggccggcgcgggcgtggtgaaatgcagggtcgtctgcttctacaccagcagtaacgcccgcacagacggccacagagatggcgggagcagcgccaacggcagcgtggggttggggagtagctgtagtgacattaatgggagtgctacagatgtggttgatagctgtagagcagtgaagtagggtaaaatgttgcccttgcacaggtagaaagaacacggggattttacttgttcgctaaaaaaacatgatgatctgcgtttaggcatttactgcttctgcttgtgtgaatatgggtgaattattaatcacgaacagtttctgttaattttttattatgtaaagtttgagtaccacttaacagtttctttgtttggccgaagctgcaaagtgcggcatgagaatcatgacatgaccaaccttggaagctcgaaactttcacatcgcagatcccaatggaatagattgattggaccctccaactatcttaaccgtcagacacgtgtcttcggccttttggctgtccaattttctttagccacgctagtctatttcttctcttcttaataaccggttttaccgaaaaacttggcatataagaaattgttgtgtgcataacttatacagaggtagcagtagtattgttttttataaaaatataataaatcctatgagttctgcagctaatttagtgggattttcttgccatgagctaatgatttgtgtttttagggaaatggtctacagaggtggtaaatcaacaccagagagtttggaccaactagcagaagtcctccagatgggctatatctcaagtcagcccacccagcaaaaaacaaactaaactacaggaaaagcccaagcgattggttgctgttgcttcctgctttcgcttcgccttcacccgttcgccgtgcggccgagctctctagttccgccgctcgctagtcgccttcctcccaaatggcgaccgccatgcggggcagcagcctcctgcggttcggtttccgccatccttcctgcctcctgttccagtcccctcggtgtcctgccccgagcctgggtctgaacctggccgttggccgcaccgggcttatacgcctccgatgctcggcggccggggccggcgacgccggtggacaagaaggtgtcggctcggctggctctgacgcagcaggtgctgcggaacgccgaggagcgcgccgcgtcggcgggttcggaccctgcccccaagatcaccctgggtaattaactacagctggcctgaatcctcgttctgccttccaatcggtcccaaaacccttattgatttctgaatggcaatgtcgcactctagcatcaaaccggtatagtttgcagcttatgtaccacagttgactgtcaagaaacgttaatacttatgatcacaaggggcactgtatgtgcaaactgttgtagggcttgcactgagtctgctcaagcctgtagaaatcctatttgcataccaattgatgtgcgtatgtggtaatttcgtttgaccggaatggctggcaccaaggagttgtatgtgcggtttaaatgtatcttctactaattcgttaattccttggtaacttcatttcacgtttagagcaaactgtggacatgattgatatggtcttttgtcagcgtgccattctttgattagaaactgttggtgctgtagagtgcaaattaacgaccncatataaaagcagataggttacatattacctcatgaagtcatgaaactggctgtttgcaatgacgtttatcatattatgttcagaagcgttgatctgtccatgcagcttgtagctgcttctgtcctggacgctgtactctgtaaactgtgtttgcatgggttataatgctaggctagttgcttaaattaagttggttagtcctctgttttctcccttctgttcctggttatcagactgcttgtctttccgttattacaataatggaaatggagaattccaaaaaaatatagtccaagtgagaacatggagagcgtgaggatggttgaggtgattattaattttggctcataaatcgatgtctcaaccaatatagacatgacatctcctgcaatgttctgggttagttacaattgagaatgcattttcttgtcacacattgttgaagatgttatccgtgcaagtgcaaggtgcaacacaagatgattgagtgatctttctgtgaacctgagtagatttggtatgcctatcaactgcaatgtttatagatgatctagaagacaaaaatatccatgtaaatagaacttatggttggtttcgctttcgataaattttgggtgcaacgatatattttccagtgttatgaaatgatttttgaaacttgattaccatgtttatttagtgcttgatttgctaaagtttattctaattccatttactgcagatcatgttactgttaattttgcaagaagtggtggtcctggtggtcagaatgttaacaaaggtttcattgttttcccacattctcctttttgtcattccatatagaccatctgcgtcagtttctcatcattgcattggtatttatttacatttgtattttctcttcctgctgtttctgcattcagaatttagtgagtgccacgatttttcagtactcaatcactcaatagcatgtatttttctctctcttttcatgcttattcattagataattgttttttaaagaatattcattagataattgctgttgggccatactacaacatgcttgcactcttttggctattaaatctattatagaacctgatgaatatgtcaaaacaagggctgatcaccctcttgtggacggtttctcctgttgagaagagtttctgttcataacctagtttgggtaggcaaagctcattgatatattgcttcttggttgttatctcccttgcaaacatggccttcctatagtgtatagtatttaggccccagcctgttaacagatcacatccaacttatattcttaagcataagattcataatactagtaaactttctaatattaatgcatgcaagatttctcctaacgaactcagaaatctctgaataataatcagtgaattacttaaataagtcacggcttaatttttgcctctttgctctaaagccccactaccatcttacagttaacac

SEQ ID NO: 10891 - DNA, 993 bp, Zea mays
cattgggtccctcgaggccggccgggccgggacacgatacatgcagctagctcaagggaaaggcaagagactccttgctagccatggccttctactatgcaatagcattgcttggcatgcttgctgtcttctcctcgggggggaatgcactcgatgacaatatgctgaaaaccacggtatacatacaacagcttccctatcaaaaccagagaggtgtagcagaaggtacggcagtaattagctggtacataaaggatgggccaggtgcttctgcgaatacaatcgggcatgcggagggcctggtaatcttgacagatatagccaggtcttcgtggctaatcactacggacttggtgttcgacggtggaagcctcgcagggtcctcacttcaagtgatggggcagcatgagtcttcaggccagtggagcattatgggcggcactggacaatttaccatggcacgaggtgttatagagtacaaaacaatccaagaggacagtagcagcaggacctttgaagtatgcatatatgcatactacactcccatgaacggatggaaagccggtctggctttaggtgacactggcagtaaaccttgaggactacgatcgagatttagacgaccatccatgtgtgcgcgcgccaatgcaaggagtgacgtacggcagccagatctacaatctttttttatgcttcatccaataataaatgaaccccactcccttatattatgaattagaaaaacacaatcatttgttgtattattccagacaacgaatttatttgcagtttattcagttattttctgtctcatgcatgttccccttgtctcaacagtggtcatcaataagacgtgtcttcggtggaaatatattaattgtaggaacaaaaaagaaaaaatgccccagtttgttagatttcagcactgtaacgaccaaggtttccagcgaccacatatatagctgtcatatatggcaaaacacagggcttgtg

SEQ ID NO: 10892 - DNA, 1807 bp, Zea mays
acagaatcctgactgcaactctgaacagcgaaccacccatggccctcgccaccactgccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgctggtcccgtggatcgtccgcggggaggacggcaagccccgcctcagcacctccccgccgccggacgtaatccaggccatcgcgctcgcggaggcggaggccaagaaggccgccaacaaggaaaccctcaagggccagaatggccagttgccgccgccgccgcggctgcttccaatgccagcgtcaagggcaaggaaaggaagcccgccccgaccgtgccgcccaagttctccaaggcagccaggaggttttacaatgagaatatcaaggagcgggagccgcaacggctcgccaaggtccttgccgccgcaggagtggcatcaagaaggaccagtgaggagctcatcttccaagggaaggtgactgtcaatggttcagtctgtacttctcctcagaccaaagttgacatctcaaaggattctatctacgttaacgggaaccgcatttccaagaagttgcctccaaagctgtattttgctgttaacaagccaaaggggtacatttgctcatgtggtgaagagtcaaaatctgttgtctccttatttaatgattatttgaagggctggaacaagattcaaccagggttgccaaaaccacgcttgtttactgtgggtcgtcttgatgttgccacggctggtctgataatagtcacaaatgatggtgagtttgctcaaaagcttgcacatccttcttcaaatgtaacaaaagaatatgtggtgactattgatggtgccgtgcacaaaaaacatctcatagctatcagtgaaggcacaaaaattgatggggtcatgtgcattcctgatttagtagaaccattggctgcccaatcagatacaagaaagacccgcctaaggatagtggttcatgaaggacggaatcatgaagttcgtgaacttgtacagaatgcagggctacaggtttatgcattgaaacgtgttcggataggcaggttcaggcttccagcagatctgggaattgggaagtttgttgagctcaaacaggctgatatcaaggcactagatggcaacaactagagatgacatctgatgtggctaataagcgcatcttgtccaaagatggtagtaatcctcaaagtcacaatacatgagctgctactcaactcagaaagcttgtgaatgttctggatgtccattggtggtggtggctgatgatcaagtgtggcaaacatgttttgccttgaagaacttgtgaactactccatacttcgcctgcgctgcgaatctccacatcatatcaaacggcagaaccaagtccgcgatgcagcagtcgtttggtgaggatggaacattgtcaaatagcgatcttctgttggcatatacattttactctctattctaaattataatttttttagatgcattgtttttactaaattaaaatatcttatagtttagaatgcatcttgtccaacaggtagtcaataatggcagacgagttatatttggccaaattacattgtactccgtgtaccgagaactgtttttttaagaatcctttattgaccaaaaaaaaaaaaaaaaaaattgtggcactgttatttctatagtcatgagaatcccttc

SEQ ID NO: 10893 - DNA, 2850 bp, Zea mays
  misc_feature (134)..(134): n is a, c, g, or t
tttcatataaactcccgtgcaaaccaactaacatatgtcaaaagaaaataaaaagatatacttcattgtctactataccattgtataaaatttcaagtttaaaatttcttcttctttgtatctcttaacatatnatgaattttaacttgaaattttatacagtgctatagtaggcaaagaagtacatatataattttctttagaattttttgtgacatttgttagttggtttgtacgaaatttgcacaataatttggtttgcatatgatacgttggcgtttagattatgtacttctttaaagaaagaaaaaagagaaggaatttagaagttgttattactcctataaaataaaagaatttagtactgggactggactgagcggcccactacaagctttgggctcgttcgggcctcgccggaagttcccaaccgagtggaaccgggcttcttctccgcaacctacgtgccagttttgtactgccgaaggaattttcgtctgggtgcgtttgcgtcggctcccaggccccagcttctccgtggcgatatgccgatatccgataaaccccgcacaatcctgactgcaactctgaacagcgaagcacccatggccctcgccaccacagccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgctggtcccgtggatcgtccgcggggaggacggcaagccccgcctcagcacctccccgccgccggacgtaatccaggccatcgcgctcgcggaggcggaggccaagaaggccgccaagaaggaaaccctcaagggccagaatggcgcagttgccgccgccgccgcggctgcttccaatgccagcgtcaagggcaaggaaaggaagcccgccccgaccgtgccgcccaagttctccaaggcagccaggaggttttacaatgagaatatcaaggagcgggagccgcaacggctcgccaaggtccttgccgccgcaggagtggcatcaagaaggaccagtgaggacctcaggcattcaatcaagtagtaatagctggaggagtattctagatgagtttttttccatgcgttaacgttcctcatcttagatcagaataggtattgatttagtaatatgtcagcttttgttagtttgtggagcactggactgtggagatagcaatgcttgtatgataccatggtgatatctggggttctactaggacttagccattttttaccaaatggcatactcgctccatcccaaattatatatataaataacttgacctgcaggaataagacagacctagacattgtattaagatggagaccttatcacgcaggtcgagaaaacctctcaaacccctgccccacccatacatagaggcgccatagcccatatgagaatgaccgcaacaagggccggttcttagacctgtgctttgtcgtggggcagacgaagagattttttaaccctaatctgaaatttgctctcatgacatgataagtgctactcagaccatctagctaactcagctagtggccatttgactctaaaggagactccaaataataagtcattccaacttttttgtagagtgaaaagcatctaaagtttgatcaaatttattaaaaataatatcatttatgacaccagctaagtatcattagattctttattaattatatttttatagtatatctttttgatgttataaatctctataactctctctctctatatatttgctcaaacatgagatgttttctaagaaagttggaatgactgataatttggaacggagagagtacattagaaaatccagattgttctcctttagagtcagatagctctcccaaaattggtggcttctattacatacttgtcttgtttgctcctgatatctttagcagtttgggttgctatttccacttgtcatttgtgatattgtggagtttggattttctttagttcctttcgagtaactctagaaacataacactccactcttcaaaacttttggttttgctcaccgttgtctgttaagatgcttactaaatgactctttccagtggcatcaagaaggaccagtgaggagctcatcttccaagggaaggtgactgtcaatggttcagtctgtacttctcctcaggtattaattctcagagtttttgtcttctatgaatgaggagatactagttttgctaccataatgttttgctttcatagtaatgttcactgttaatcttaccacaatcgcttggtccaagaacacttgaactgttttatgtgacttgattttttacgcgcattatgctatgaacaaaatttctttttctgcggttaaatcaaaggataaaataactcattttgtgcagaccaaagttgacatctcaaaggattctatctacgttaacgggaaccgcatttccaagaagttgcctccaaagctgtattttgctgttaacaagccaaaggggttggtctcttctttttcatatttgatttgtgtgctgcatctgtagccaaggcctgggctccatgtgttccagccctgtctcttggtctacaagtccatggaaggccacttaactatatgtagaaacatcatggtcataagggattttaggcatatttgaacaggctcggcctgggtctcaggtcatttctggcatcatccctgtgcattaaccatgattatcttgtattcccagtgaattattttgaatcagagaaaaag

SEQ ID NO: 10894 - DNA, 1870 bp, Zea mays
gctttggatacttcccgatggaacccctgctgcttaataccctactcgcatgatgtatttcactcttttctccatgcagcccatctactatagctcgccattgtcattcatcaacgtcattcgcaaacaatattgtgattcatgatgagagccattggtttcacagtaaaacaactgctaaggtcaaggtcatgttgcttattcttttaagagcatgtgccattcctttgtagtaatgaaaaacatgtcttgtgcatttgtcttaattctttcaccatgtttgggaaagagttggtttgttcaacattttttccctgaaagatcacagaaatatgaccgagaacattagcatgcagacaatttcaatcttgcaaaagggacttctgagcatattgagttcataatggttgtcactgcccaatattaaaaattactgctgcttaatggtagaattttgtgtatatcatttcaagtatagaagtactctactactcttagcgacttgcggaagtactgctttttagatactaattgtcagttgtccgtacattgctacagtttctatatatcacatgggtagactttgttttaataaaacacaaaaatatgtgttctattggttaggtgggtgtaaatgtggagctaacaaccaaggttcaaactcccacttgtgcataattttactttatttttgaattaagcgggaaggggaacggtgacgtgggacgactgttgaaactgctgtttagagatagagattgaaaaacaggaccaaggttcaatggttgtttagaacattgtagatcatcttagttccaagtttgtaatgctattttcatgcttggtgatgatttagaatcgatgttactaacacaatttcatttgagaactttatcctcagtatgatgcggatctctgagatctgaatacatgcagaatcacataaggaaggcaaggaggggagcctgcacaaaataaaagcccacacggatgaaactcgcggaacaagtgctgacataaatgagaacacaccagttgacaaagtcaaaggtccgaatgtgtttgagcgtgccaaggaagagattgaagctattgtggaagctatccatccgaagaatggatctgacagtaagtgaagactgaaacccctggggctgttttgccttaactggctgcaaaagccttaacgtgaggccatgtgctaccagatagataaatgctgtcaaagacgttcacccaatagtctttttatacgcgctctggagctgtaaaagctaagagcggacttgtttttatgctacactgttttccgttgtatcattgtggtttgtttgtccagaggtgtgtagaaatactcaacatggaattgtgatgcttaaattgttgagcttgacaggacattatattgtgccaccaactcgccatggtctggaagttgtaataagagtgatcatgaaacagggcataaatctattgctagtacttttttagtggaaacccattactaggttgtcgttgtctagtggatcgatgcttatagtttgagggaaccttacactggtgactggtttgaaccattattgcaagattgttactggaaataactgtaaaaatgcatttagaatgtaaaacagtcgtttgagggccgagaccttgcaaaagataactgttggagacttgttatcaaatgatatgaattaagaacaagtcaacacaaaatgttaaaggttaaggcgcttcgtatttcgaagcattattttccttaagacataatgattttcagacgaaggttatgaaggacatatcttcatgagtgtagtatacattaatgaaagaagaagcatgtaaaacataaaaaacaacatgaatg

SEQ ID NO: 10895 - DNA, 959 bp, Zea mays
gccggccgggtcgacgaggaatatacccattgtttcatccgtttcctttgcccgaacgtgcgctgtctctcgatcctgcatctctgcacctgctcgcctccccagggaggcagggacaatcgacttcggcgggcgccggctagccccaccggcgacgacaggcacagtggaccacggaggagaaagtactctgctttgaatgggaagtgccatgaacaaagacaaagttcatgacaaggagactcacggaacaagtagtgatataactgagaaaacacctgtggaaacggtgaagggtcccaatctgcttgagcgagcaaaggaagagatcgaggcccttgccggagctgttcatactaagatggagcaccattccagtccccacgcgaagaaggatgaatcacataaggaagacaaggaggggagcctgcacaaaataaaagcccacacggatgaaactcacggaacaagtgctgacataaatgagaacacaccagttgacaaagtcaaaggtccgaatgtgtttgagcgtgccaaggaagagattgaagctattgtggaagctatccatccgaagaatggatctgacagtaagtgaagactgaaacccctggggctgttttgccttaactggctgcaaaagccttaacgtgaggccatgtgctaccagatagataaatgatgtcaaagacgttcacccaatagtctttttatacgcgctctggagctgtaaaagctaagagcggacttgtttttatgctacactgttttccgttgtatcattgtggtttgtttgtccagaggtgtgtagaaatactcaacatggaattgtgatgcttaaattgttgagcttgagtgcttgacagggcattatattgtgccaccaactcgccatggtctggaagttgtaataagagtggtcatgaaacagggcaaaaaaaaaaaaaaaatactttttt

SEQ ID NO: 10896 - DNA, 841 bp, Zea mays
ttcgctcatatcctaaccaggctcactaatccttaccaatcctttcacccaaatcatacataagatagatgttcaatatgtctagggacccattggtcgtcggcaatgttgtgggagatattgtggatcccttcatcacaactgcgtcactgagagtgttctacaacaataaggagatgacaaatggttctgagcttaagccatctcaagtgatgaatgagccaagggtccacgtcggtgggcgtgacatgaggactctttacacacttgtcatggtggacccagatgcaccaagccccagtaaccctacaaaaagagagaaccttcactggttggtgacagacattccagagacaactgatgccagtttcgggaacgaaatagttccgtacgagagcccacgtccaatcgccggaatccatcgcttcgcattcgtcctgttcaggcagtcagtgaggcagaccacctatgcgccggggtggagatcaaacttcaacactagagacttcgcagccatctacggccttggctcccctgtcgctgcagtgtacttcaactgccagagagagaacggatgtggtggaagaaggtacataaggtgatatatcaaccaagctatgtgtgcttctctctctctcaagggagagaagcataacaacaaattggagtgaaaaaaatatatatcatgtgtgtggtgaacattgcaagtacgatgttcacaatcataagagccattattggatcacatattattctaatgtaatgtggctgggcgttctattggaaaaatagccacggtttgagatttatatataaatttgtgttgacgaaaattctgata

SEQ ID NO: 10897 - DNA, 946 bp, Zea mays
ggcctccacagtttgggcaaaatccacgtgtctccattcctccggtcatgtttatccatccaagaaatccaaactggacactcgcatgcatcccatcatctgcaattctatgtacacgtacaagagagagaaagagagagagagcctttttccctggatggtgatgatgatccatggaccaggctcccaaaactagtcctgatccagcgctccaacctcccggctctgctctgttcttcttctagttaaccgccgctccagttttttttattattattactacgatgctagtactatactgttactactagtgccgctaggctagctctacacggtacggtggcaagtcggcggcgggtctataggtggccgttgtcgccggggcggtcgccggccacggagacggcggagaggcggctggggcggggccgggcggcgccggcgccggcgccgacgcggcggcggtgctgcgccgcggcgggggacgggcgggcggttgccgcgagcgcgcggcgcgcgcactggccgccctcgacggcgccgatccgcaccagcgcgctgcccatccgcctgcccgccgcgcacagacggctggtggtggtcaggggcggcggcggggaggtcggcttgccgtgcccgtgcggcggcggcggcttcgtcgcgcgctccttgtgcaggctgcagcggaacgagcccgggtggctggtcggcgagcacatgcaggtccgtcggccccgcgacgacgacgagacgctgacgctgacggactgcccggcgccggagagcgagacgcgcgtgggcgaggcgtagcggtagtgcgcggccgagaggacggggccgctcggcctcctggtggtggtcgcagcagtcgccatgagaggtggcgggttgggttgtgtggggtggagctcccaattgggctgctgctttcgcttctgcaaacttt

SEQ ID NO: 10898 - DNA, 887 bp, Zea mays
ccggccggccggataaacctagcacactactttcttttcttcacctcatcaggattcaggaccacccgccggcagcagatacgcccaacaaaaaccaaccacccaccaagccagcaagcacctctccaagcagacagacgggaagggagggcaaccgagagcgatcggcgatgggctccttcctctcgagcttagtcacgccccctccggccgccgacgaccccaactgcgccgtggtggccgcccactccaaggccacctacgacgagcagtgggcggcccacaagagcagcagcaagctgatggtgatcgacttctcggcctcctggtgcgggccctgccgcttcatcgagccggccttcaaggagctggcctcccgcttctccgacgccatcttcgtcaaggtcgacgtcgacgagctcgcggaggtcgcaaggacatggaaggtagaggcgatgccaacgttcgtacttgtaaaggatgggaaggaggtaagccgtgtggttggggccaagaaggacgagcttgagaggaagatccggatgttcacgtcatcttcctcatcgtaaactcctgtggttcgcctgggacggagttgctgaagtgaaatggttcccttctctgaatgctgaaaaaaagaaaaaaaaaactatgtgaaaatgatggtagacgtgtctgggtcagtaataagagtttctaaaatctgaatgagatttgaatcgctccccgttgatgaatttctcatggtctgtgtattccaccatgattcataaggtcattctcagtgatgagttttaatacactgtttctaatgctgccacatcaaatttaaactaaccagggaactgtatagacagagtttcacccctataaagtctatctttttt

SEQ ID NO: 10899 - DNA, 834 bp, Zea mays
tctatttatctacaggaagccccaataaaactagcacgctactttcttttcttcacctcatcaggattcaggaccacccgccggcagcagatacgcccaacaaaaaccaaccaccctccaagccagcaagcacctctccaagcagacagacgggaagggagggcaaccgagagcgatcggcgatgggctccttcctctcgagcttagtcacgccccctccggccgccgacgaccccaactgcgccgtggtggccgcccactccaaggccacctacgacgagcagtgggcggcccacaagagcagcagcaagctgatggtgatcgacttctcggcctcctggtgcgggccctgccgcttcatcgagccggccttcaaggagctggcctcccgcttctccgacgccatcttcgtcaaggtcgacgtcgacgagctcgcggaggtcgcaaggacatggaaggtagaggcgatgccaacgttcgtacttgtcaaggatgggaaggaggtaagccgtgtggttggggccaagaaggacgagcttgagaggaagatccggatgttcacgtcatcttcctcatcgtaaactcctgtggttcgcctgggacggagttgctgaagtgaaatggttcccttctcttcaatgctgaaaaaaggggaaaaaaactatgtgaaaatgatggtagacgtgtctgggtcagtaataagagtttctaaaatctgaatgagatttgaatcgctctccgttgatgaatttctcatggtctgtgtattccaccatgattcataaggtcatttttaatgcactgtttccgaaaaaggcccctagggccgcggcc

SEQ ID NO: 10900 - DNA, 1613 bp, Zea mays
tggactagctcattcctcgaaccaaacaccctattaatcaccagatcagccctcagagtaaccaaagtacacctagcccatacaagcgacgggccgagatgggaggattatttttagagtaaacaagttgagttcagctttaaagctacttgcgcccacaaaactaccagaacgcccctgaccgaccccgctcctctatatatacgcgcagctcgtctcacttctcgcttgccagcccagccctcaagcaacacgacgcattgcactagctagaccttgggctcgcaaacctcacacacccttccgcttaacctgcagcccttcggtcatcatcagcactcagcagtagcataggcaccaaggtagcgacccccgacacaatgcagtacggcgcggcggcggcggagcaggcgtggtcgtacatgccggtggtggcaccgtcgtcggccgtggagacggcggcggagcgcgtggagcggctggcgtcggagagcgcggtggtggtgttcagcgtgagcacctgctgcatgtgccacgccgtgaagcgcctcttctgcggcatgggcgtgcacccgacggtgcacgagctggaccacgacccgcggggccgcgagctggagcgcgccctcgcctgcctcctcggcgcctccggagcctcggcggcgggcgcgccggtcgtgcccgtcgtgttcatcggcggcaggctggtcggcgccatggaccgcgtcatggccgcgcacatcaacggcaccctcgtgccgctgctcaaggacgccggcgcgctctggctgtgatctcatcgccggccgctagctactagccattgccgccgttgcagctgttcgatcggggggctagctgatagtaaggcaggttacttattaattaatacacccaaagtagtgagttattaatcatagagtgcgtgcgcttgtgtgtttgtgtgtgtgttagtgggtgtgagagagagaggtcggtgattctttttactgatgctgcctccgtcttgtgtgtgggagctagctagttagatcgtgcttgcatgcccacgcgcgtatgtacgagtgtgtgtgcactgctactgctactgctagctaggtttggtcggtgctagaagagatcgatcggtttagtgttcttctcttccatgcatcttattaatcagtttggcttggggttccggcccctcgtctttgtgttttcatatcagagccatgcgtgcgtgcatctgggcaaacgagttgtgtgacagttgccaagaacggaatccgaatttactccatccgttctaaattatataattcgtttgacttttttatcacaagtttgaacgactcgtcttattaaaaaactaataattattattaagatttactatgatactgtttcgcgaataatatactaagtataactgtgaaatttttattttttttacaaatttttaaataagatgagcggatcaaacttgtctaagggtttagggatggagtattaaattgccactcgacatgcatctctttcaattactcgttacgtttatatatatatatatatatatatatatatacaaagcgaaaaggggaaaaatgcatatatcaatatatttacaacct

SEQ ID NO: 10901 - DNA, 1911 bp, Zea mays
cctcgaggccggccggggcagggcacccggtcggtcctgcgctctcgagtcgagactccaccttccattcatttcatctgctccatctctctctttgttcgccggcgtataataagcttcccctttctgcaactgatctgatccgggctgccgtgagctctgctcgccctgatggagttcaagagggatgtatggagcctgctcctcgtgctgctcctcgggcagctcgtcgccttctccatggccgcctcaagctttgcctcctccctcattgctaatcttggagtcgatgccccactgacacagtctttcttagcctacctgttgctgaccttagtctatgtaccaatcgtcctgcgtcgacggcagaagctgcaaatagcttggtactggtacctagctctggccttctttgatgtacaggggaattatcttgttgtgaaggcgtaccagtactcatacattaccagtgtgactttgttggattgctggactgttgtatgggtcgtcatgctcacctggtacgcactgggcacaagatactcactctggcagttcgtgggggcagggacatgtgtggcagggctcgcccttgtgctgctttcagatgcaaaatctcaagatgagcaagatccgaaaaaaataccacttctgggggatgcccttgttattgctgggacagttggttttgcgtttagcaatgttggggaggaatactgtgtcaagaaaaaggatagagttgaagttgttgcaatgcttggtctctttgggttgctgatcagcacagtgcagatacttgtatttgaaaggaagggcctagaagcagttacatggtctccaacaatgataagtctgtttgcaggatttgcagtggcaattttcgtattctacacagttgctcctttcgttcttaagatgagtggagctacattgttcaacctttcactgctaacatctgacatgtgggcagtcgccattcgagttttattctatcagcaagagataaacaggttgtactacctagcattcacagttgtggccattggattaatcatctattcgttgaatgatagatcttcagatgatgaaacagctggaagtacagaagcaccagcccaatatcagcaacttccaattgaagacaattcaacaagaattggttctagttcaggtagccaagaaaggacacataaggaagaagttcatatctgttagtgggataatgtattaatgtacgaagacacttcattgtcaatgcatggatttttaccaaatcaaatatggcatagagatatgcagagtaaaatgctggttgcttcatgtataggaaaatgtttaattggctcaagaagctaagcaagatgaggaagagaatcagaattaattttctttacaagtcagtccagcagattattcacaagagcagaaccattgctgaaggctcccgcatcagtgagatctaaggaagggataatacatcgggttaaaatgatctttgactagggattgtgaacaatcacagctggtctgcaaagcataatagcaacagtatgaacatgtaaagggagttactagtcactaaagctctttcaagaattgcctatgaaggaaaaaagatatttttagatagcatatggatagcttacatgctttactggaatgcagagtgctaaagcgccacaatattttcttgttaggagaattatgatttaatgatattttctatattactcattgtaaaattctatgagaagtatcatgccccgtgaattggaagctaaaaggggtaagtgaaaaataagaatttggttgaactcgtgttagtgtatctggttaggccttagtgttagtgtatctggttaggtctatgtaccaggcccatgtaagactatattgctaccctctagggtt

SEQ ID NO: 10902 - DNA, 5778 bp, Zea mays
tgtcctcttgctatctttggacggcgagcgactgtgctacacaatttgtctcaacttcccatcaaccaagaatatggcagaatatgagggcctcattgccaaactccgcgctgctgtggagctcggcgtaaggcaactcctagccaagggcgactcgaagctggttgtcaaacaagtccatggcgtgtgtgggtgccagagtccccaacccactacataattgttggaagttaagaagttggagctgctcttcaacatgttgaaggtgcaacatgtcccaacgcggaccaactctccaacattgcctcctcgtaggcaccgacaccttcgagggtctttcaaaaaagcctctcacaactatatgtcctgattgccgctccgacaaagggggtctggctggtgcgaaagcgtcggtcactccggtggccactccctcctcggacacaccaccctttgcgctaagtgtcgtaggggccatttctggcatagaggctggtccatacgttgaagggctctaaactcgggatgcttttggtgaagggggcgtccctccatcgatgacacccactgaagcgcatcctgcccaaggacagtcatgggcacgatggctctgaacctcgctagagtgttttcggtgtaggaacatgttcctccgtcgataagctcaggggtacttctggctcaggggtctgccccctagtcgacgtactagtcgatgaactaggccccgaccaaccctagttttttttgaaactaccctttatacaagtgcacgaagctagataagcactaaagatgagaaccggaataaaaggaacacctaactcctctatttttaaattattggtccttcattttgtatgatgaatatatggtcctaaattttcataatttgattgcataatttcttctttcagatagagtgaagttatgttaaattggaagcaacagaactagtcatttatttcgtcaacgaagtaggacataaaaagatatttcagaaatgggactaattgttactcttataacacgtttggatcgtgtggatttaaactaatatctagaagtaccttttattttattattaaattacttttctagaccaatgtttaaaaataaatgcacatctactattttgaggagtcaaatatttcaagttgttttttcatacaaaatagtatcaacagttatatatccaaacaattttactacaaaagaatatatgataaatatcagcatgtttatatatagttggttaaatttaagattggttgatcagagatgcgaacttattttagaacagggtactgggtgcgtagctacagttcttccggtatattccgttctgctgtgaagttattgcggccgctttcagtcccaatcatttccatccaccaaagaagtttccccaacacaagtatcctgaagcttaaatttaggttgagggactggtagagaggggtactgccttattcctaacactggtaagagtgcgtagcaggtgtactcgaaaacatgagtgcgccactatataggatgctggagaaatcctatcgtaaaaaaaaaaaacagatttcgatgctttcagtagtactataatttagaaacatttatttaagatagtttggtaacactatttttaagagatttttatttttttaaggaaattagttcattttcatttgagaaaatagaaaactttttaaaaaaatggagttgtcaaactaacccatagttggtaaactctccaaaaatagtgtctaatgaaaaatatttgagaaccgaaacattactctccaaaattacgttggaccacaatgagacaaggaaagacttttgggcgctcatataaagtgtctccgaatttggttattcgcacagtaagacaggagagttatggtggaccacagtatttgctatacgtgcttgttcccagcataccagtatgtctgatattcaggccctctcctttctacagcctgccctgaatttcgttcagcaatctccgtttgaaaaaaaaaactgattaggacatgtacaaacaaacctgacacatcagttcgtttttaagtataagaggtggctaagatattgtatgatataattctaagacgctgattataaatacagataacagatataatgtgtgtaaaatcctaaagagatgagttctttacgaagacgagttctttacgaagagccgttaaccccttataaaccctttaaaagactctatattaaatgagacccttatcaccaccgaataaacttccgtgaagcacgagatcacgacggcaggacaagctatttgctcagccgatgacaagatccccaggtgggccaggtcgcacgtcgcttggcacatggtgcccctaactacccgcgacggttagtttattgcacgccgtccaccagccggtcctgcgctctcgagtcgagactccaccttccattcatttcatctgctccatctccctctctgttcgccggcgtataataagcttcccctttctgcaactgatctgatccgggctgccgtgagctctgctcgccctgatggagttcaagagggatgtatggagcctgctcctcgtgctgctcctcgggcagctcgtcgccttctccatggccgcctcaagcttcgcctcctccctcattgctaatcttggtattcaatctttcacctctcattgagctgaccagaatacacagacttgttggtgtccatggtaatttacttgatgattcttatctggatagtggtaaattttgttacttaccatgaacatcgtgcaggagtcgatgccccactgacacagtctttcttagcctacctgttgctgaccttagtctatgtaccaatcgtcctgcgtcgacggcagaagctgcaagtaagagtagctgcatcagctaacccaggaaactgttgcgattcatagctcactgtcttgagttgtcttgcagatagcttggtactggtacctagctctggccttctttgatgtacaggggaactatcttggtgagtagtacagacacgcactacacagtcacaagtcaatgaagttttgttaggtctctcttgctgctactgagtagtacagacacgcactacacagtcacaagtcaatgaagttttgttaggtctctcttgctgctgctgatcgacatctaatgtcccagttgtgaaggcgtaccagtactcatacattaccagtgtgactttgttggattgctggactgttgtatgggtcgtcatgctcacctggtacgcactgggcacaagatactcactctggcagttcgtgggggcagggacctgtgtggcagggctcgcccttgtgctgctttcagatgcaaaatctcaagatgagcaaggtaagctactccaggcatcctacagttcaattagaaagtcaacaacattttgagaactcggaaatcgtagtgctaggactgtccataccatctcccttaaaagaaacggtagcagaacaatcaagaataccaatactagcggtgcataagattgcaatgcaatagctgtagatgtaaacaaggctttatgaacgatatggtcgaaatatacctttagtttctgtagttacataattgtttacttcacatgtaaatcttatttttttctgcagatccgaaaaaaataccacttctgggggatgcccttgttattgctgggacagttggttttgcatttagcaatgttggggaggttagtcatgcaacacatgcatctgctgctatcagcaacggtttctcacagtggcaataaccatttcattttcctcatatgtgtaggaatactgtgtcaagaaaaaggatagagttgaagttgttgcaatgcttggtctctttgggttgctgatcagcacagcgcagatgtatcctcaaaaattcattattagttatataacctgtatagcaaactggcatgatctattggtaatcacatacattgctctatttcgcaaggttaaactcttgccacagttttcctggaacaaaaaagtagtaactgtgtaacccatattaatcttaaaaattagttaaataaactggcatgatctgtcgaatgacatctatatattgtctcccttttgtcaagttaaactaacagcacaattctttggaacaaaagttgtaactataaatatgacccaggttcttgtaatcttttaacttgatgaaccttagacttgtatttgaaaggaagggcctagaagcagttacatggtctccaacaatggtaagaaaagtacattctaccgtgaaactccccataaacctcactgattttattatctggaaactcattcctgcttttgtctttttcatttgttccagataagtctgtttgcaggatttgcagtggcaattttcgtattctacacagttgctcctttcgttcttaaggttaagatctccaacatgtcaggcatgacatgagcttcacaaggaggaggcaacactagaaacttaggccctgtcaaatggttatggtttattaaaaataaacacagaataatggtgatctgtttaaataatagtggttgactaaatattatcagactttttattgtaatttcaatcagttgaataatagtttagctttttttatttttgtgctcttttgcagatgagtggagctacattgttcaacctttcactgctaacatctgacatgtgggcagtcgccattcgagttttattctatcagcaagaggtgattttttctaaacccagaatacttgttccaaatggtaacatattacccaatatgctcacatatttcatatgcaatctacagataaacaggttgtactacctagcattcgcagttgtggccattggattaatcatctattcgttgaagtaagtctgtatataccatcctagataatttgcagatatgtgactcaatggttgcagaaacctaacggaatttgtttcttgtgatatatgaagtgatagatcttcagatgatgaaacagctggaagtacagaagcaccggcccgctcgcggcaacttccaattgaagacagttcaacaagaattggttctagttcaggtagccaagaaaggacacataaggaagaagttcatatctgttagtgggataatgtattaatgtacgaagacacttcattgtcaatgcatggatttttaccaaatcaaatatggcatagagatatgcagagtaaaatgctggttgcttcatgtataggaaaatgtttaattggctcaagaagctaagcaagatgaggaagagaatcagaattaattttctttacaagtcagtccagcagattattcacaagagcagaaccattgctgaaggctcccgcatcagtgagatctaaggaagggataatacatcgggttaaaatgatctttgactagggattgtgaacaatcacagctggtctgcaaagcataatagcaacagtatgaacatgtaaagggagttactagtcactaaagctctttcaagaattgcctatgaaggaaaaaagatatttttagatagcatatggatagcttacatgctttactggaatgcagagtgctaaagcgccacaatattttcttgttaggagaattatgatttaatgatattttctatattactcattgtaaaattctatgagaagtatcatgccccgtgaattggaagctaaaaggagtaagaaaaaaataaggggggggggggactcaaaaaaaaaaaaaaaatttggttgaactcaaaaaaaaaaaaaaaa

SEQ ID NO: 10903 - DNA, 1267 bp, Zea mays
cggttcacatgcgtttgttcgcttccgcctcatcgccccgtctcctctctccctctgtctcaaatctgacctgcattgcgagctgcggctgtcccccgcgattattccaagctccccgagcccatggccgcaatggcgatggctccagctgccgtgtcgttcctggcgctggcgctgctgatgctcagtgacgcggaggccaagttcctgcccaacaacatcaccgtcgttggctccgtctactgcgacgcctgctccaacaataccttctccaagcacagcttcttcctgaaaggggccagggtgctgatcaagtgcagcttcaaggtgaactcgacgtcgtccgaagagctgtccctggaagcggagcgcaccaccgaccagcacggcgtgtacaagctggacgtgccccccgtggacggcttcgagtgccgcgagggccacgagctccggtcggcgtgccgcgccacgctcgtccggagctcctccgccgcctgcaacgtcccgggcctcggggcctccacgcagcacatcgagctccgctcccgcgccaccagcgcctgcttcctcaacctcaacgcgctcaacttccgccccgccaaacgggacggcgcgctctgccacgcccaagggggcgacgcgttcggctcctcgcttttcttctggcccttcctgccgctcttctggccgccgttcagggtcccgggcggcggcgccggcgggacggtgtcgttcccgtggccgttcccggtgccggcctggctggtgccgttcctgcggccaccgttcttgccattcccgctctacgagccggcgccgtcaccaccgccgccgttctaccgtttcccgcctccccgagaagcggtctctcggccttgaaatcccatgagccaagaagcttgtcaagatacgctattttagcctttcttggcattagattgtgtgttagtgatgagaaactgatcagaggtcgtgtgatatttggcccggccccatgataggttgacctccgtgcgcatgtaaccgatgctagtactgatgctgccatgtagttcattgtgctcgtgaactgatgaacacgtgtggtctgatatttagtagtggcaacctggcaatggttacttgttacatctcctatttgaaggttcagccaagaaagcccatgggcggccctcccgtgcagtaagattaaattcctaatgaatcggtccatcgtatggggtgtttggtttgaagaatcaattcattctagatgaaatggtgcatc

SEQ ID NO: 10904 - DNA, 4040 bp, Zea mays
cttgctgcctgcagctcaatcgaaccacaacagctcgttctgaataaatcagcacggttttttttacatttaggtttgacctgttttttttcaaggcggattgctcagagtccaatggtaagccgtagaaaaaacatctctataccgttttggcccaagctctgctgatgccagcccccacattatctgcacctgccacgtctgaagtccatcggtcatgtgtgtgcagtgcccattttacggccgttcctaaattcgtacatttctgttttttttcttcacatgttttttttataaaattaaactggtgagattaaaaaattcatgtattgatttatataataattttgcattccaaatagtatacctaatgagttatttaaaaaatgagttatttaaaagataaaaaaaaatatggtgagttgcaaggcttgaacccccaacctcatggtttaaaaccttgtgctgcaccaactaggctagatggctttgtgctatttttatacaacaaaactattaataacacaaccgagctcggcgccaagatctgtggcgctgagctcggtgccacgtcaacgacacggcgtccgggttatgccaacgtagcacgtacctcggcgccatagccaatggcgccgagctgtgttaccttggcgccataggctatggcgccgagtaaagggtccaaaagtgacattaaaattttttaaggtctaaacgtgaatttttttcagagaaacggacaaaatacaaaaagttcgggcgcatgcatgggtggggtgacggtggcgctcgcaactcagtaactcacacgtgcccgctcggactcaaggggctggggcacgggcatgggcatgggcgcatggcatgcctgcaagcagagtgtagcagacggcgtcagcacgccaccttggccgcttggcggccacacggtgccgacctgacaggggcgcgcgctctcgagtcccagtcccaggctactgccgtggcgggccttacggccgccacgtcggccgaggccacccatccatgcaagcggcgcatgggaacgtggcattccggcgcgacggcacgaccgcgctcccgcgccatgcgtcacggtcacgtgcacgcagagccccgctcgccttctataggtagcgccgcgcgggtggcgtcgcttctggtctgtggcggatcggatcgacacccagccagcgcgtggagactggagagtagaacaccccaaagaggccaggactgagactgaccatgggagaagcgtgcagggacgcggcggctgcgggccagcagctgcggcaggacgaagcgggcggaggaggagggcgtcacgcggagaaggagctcgtcggtgacccgacccacgactcggtcgtctcggcgaactgtacgaggacgtgccggcgacgccgatgatggcgctcaaccacatctcccgcctgtgcgtatccgtcgacgcctccgtccggttctacgtcaaggcgctcggcttcgtgctcatccagcgcccgccggcgctcgacttctccggcgcatggtatctaaggaccatatatatacttggcttggccggctgacttgttcgaacggaccattagttcacacatgcacgagccatgaggtgacaatcatctcctgctgctcctggttacaggctcttcaactacggcgtgggtatccacctcgtgcagcgcgacgacgcgcggcgggcccccgacgtgaggccggaggaggcggagctggaccccatggacaaccacgtgtcgttccagtgcgaggacatgggcgccatggagcggcggctgcgggagatgcgcgtgcggtacatgaagcggaccatcaacgaggaggaagggtcgcccatcgaccagctcttcttcagggacccggacggcttcatgatcgagatctgcaactgcgagaacctggagctcgtccccgccggcgccttcggccgcctcaggctgccccgcgaccgccacaacccgcccgtgcgcatggtcgccggcagcgacgagtagagggggagggggctttcgcgtccgcgtgaccctctgccctccaaggccagcagcccagcaccacagggggagaaatagtttgtggctcatataatcgccgagggctcttaattatgctggattctgggtcgtgtttcctgccgagtttcagttttgaattcgaatttgttctagttttgccctgcttcggttaccaggagattcttagcaagatgaaccgtggaataactgtgaaactaaaccgtggaagatgaattctcaatcaggtctaaataggcaaccgacagcctagcctggacactgcttggttctagcgggctatagtagggcaggctaaaatatctaaactgaacctgactacaaccattacacgccttctactgctacagctatctggatgaaggaatacgataataggagataatagaacagggtatggaattatgttgtatcattcatatccttttatggtatacgccttcgctcttttatacttgtctactgttacaataggccgctagctagtccatacgtcacaggagagcggatagcgcgttacaatagtccgctagctagcccatacgctcgcaggatagcgcgcactgggcttacgcagacgccggcccacaaccacatcctcctttacttctttgccttttgaacacaagcctatttagcgccattttcagcgtcatgacactgaatactgacaaaccgatcaaaccatcggtgctgccaataacaagtagaaattgatattctcgtgggcgaaacttgcaaggtagtcatacatactatgggctcttttttagctcagtaatcatacttagatgttctatggacagtctctctatttttttctattttagttttccgtatctaaaacctctatttttttctattctagttttccgtatctaaaactaagagcaaacttttggaactaagagcaaaccccaaaaggatgctaatttttttctattttagtcttattgtacttttccgtatctaaaactaaaagcaaacttaaaactaagagcaaactccaaaaggatgctaaaaagttaccactaaaagagcaaactccaaaggatgctaaaatgttatcactaaaaagtgattattggtggcgggctaaaagtatttagggaagaattatgaaagaattattgtgtatactccaagtttccttaaacaaaaactgaaacacgaaaagttgggctaattttttaaaaaactgaaaaacaggttcatcctccctcctggttgagtgaacaggatcgaagtcctttttatttggtaccgatcaaagtttttatttggtaccgatcaaagtttgtcagataactgagctaacaacttagctactttcttagtatttataattgcaacaatgtgatgccgagataacataatataactagtgatagctagtgtcagaatataactagagatagctagtgaggacgctgagaccagatctaggatgtgaaatgcagtggtgttgtgtgtttccaggagagtgatcttgttaaggccgtcaaagagctataacggccggccctgagggggtgccgaatgtgcggccgcatcgggctcaaaaaaacagaagccccctctggccactggacgttagcactttttcccgctaagcatatctacctagacataaatacgcaagagcgatgcgctatcgattagtttcgtttagattgttaaactaatgtctcgattacttatctaatatccactagacagaatattatttactatatacatgatggttgcatcgacggagagaagatttttaaaattgaaatattttttgaactatttaaggtcaacgatgacttaagagaggttaaatggtttaacgattatatgtatctaaaagaagttgttggataagattgatcttaatgtataaacgttaagagaggttaaatggtttaacgattatatgtatctaaaagaagttgttggataaaattgatcttaatgtataaacgatgatttgta

SEQ ID NO: 10905 - DNA, 1069 bp, Zea mays
aattcggcacgtggcgggatcggatcggatcggatcgacacccagccagcgcgtggtgagtagaacacccccaagaggccaggactgagactgaccatgggagaagcgtgcagggacgcggcggctgcgggccagcagctgcggcaggacgaagagggcggaggaggagggcgtcacgcggagaaggagctcgtcggtgacccaataacccacgactcggtcgtctcggcgaagctgtacgaggacgtgccggcgacgccgatgatggcgctcaaccacatctcccgcctgtgcgaatccgtcgacgcctccgtccggttctacgtcaaggcgctcggcttcgtgctcatccagcgcccgccggcgctcgacttctccggcgcatggctcttcaactacggcgtgggtatccacctcgtgcagcgcgacgacgcgcggcgggcccccgacgtgaggccggaggaggcggagctggaccccatggacaaccacgtgtcgttccagtgcgaggacatgggcgccatggagcggcggctgcgggagatgcgcgtgcggtacatgaagcggaccatcaacgaggaggaagggtcgcccatcgaccagctcttcttcagggacccggacggcttcatgatcgagatctgcaactgcgagaacctggagctcgtccccgccggcgccttcggccgcctcagactgccccgcgaccgccacaacccgcccgtgcgcatggtcgccggcagcgacgagtagagggggagggggctttcgcgtccacgtgaccctccgccctacaaggccagcaccacaggccgggggaaatagtttgtggctcatataatcgccgcgggcgcttatgctggattctgggccgagttccagttttgaattcgaatttgtgctagttttggtttgcttcggttatcaggagattcttagcaagatgaaccgtggaataactatggaactaaaccgtggaagatgaattctcaaacaggtctaaggggttgtttggtttaaggggttgtttggtttcatgggaataaactttagtctctcccttttagtc

SEQ ID NO: 10906 - DNA, 2193 bp, Zea mays
cacgcgtccagtgagaacgcatgcctttctcggagcgagtagcatggcgcgcgctggttggctccactatgcggcgttttttcaatttgtttttttactcctctttctgcgggaaggcggcgagatgtcgggtggacggtggatcggcaaacgaagggcctgtcggtgtggacggtggagatgcactaagccttctttgagcaggtcacatcttttgcaagttcatggtgcccagtacgtagtggacagcagagaagctccgggcggggccaatgcaaaaccgatctggcggcgtcgatgtcgtgaaaaccgtcatgcccaactcgtgaaaattttaaaccccagcatcaccaggccgctagctccgtctctcaacgataagattacccacaccaacccgcgctcgccctaatgagctgttgatttgccggagggaagcagttgcgcgcgcgctctactatactgtcgccgccgccataaacaaagagggaaccagcgtctcttccctaatctaaccatctcctgcgtgattgacactaaccatgccgtggctagttaaatgacggggacggggtcacgccttcgttgcgtgcctccacctccccccctcggcgcccccaacgacatgttgttaccgtggctgtggcagccggccggtctccttctccatccatatgtactggcagcatcgtatcacctttttttctgcagcggtgatctcatctaggcgtcggtcagagctctctcgagctcgccagcggtggttggtcgtcgtcgtcgtcgtcgtcgatggggaggccgccgtgctgcgacaaggcgaacgtgaagaaggggccgtggacgccggaggaggacgccaagctgctggcctacacctccacccatggcaccggcaactggaccaacgtgccccagagagcagggctcaagaggtgcggcaagagctgcaggctgaggtacaccaactacctgcgtcccaacctgaagcacgagaacttcacccaggaggaggaagacctcatcgtcaccctccacgccatgctcggaagcaggtggtctctgatcgcgaaccagctgccgggaaggacggacaacgacgtgaagaactactggaacacgaagctgagcaagaagctgcggcagcgcgggatcgaccccctcacccaccgccccatcgccgacctcatgcacagcatcggcgcgctggccatccgcccgccgcagccggcgacctcccctaacggctccgccgcctaccttcctgcgccggcgctcccgctcgtccacgacgtcgcgtaccacgccgccggaatgctgccgccgacgccggcgccgccccggcaggtcgtcatcgcgcgcgtggaagcggacgcgcccgcgtcgccgacggagcacgggcacgagctcaagtggagcgacttcctcgccgacgacgccgccgccgcggcggcggccgcggccgaggcgcagcagcagctggccgttgttgggcagtaccaccacgaggccaacgccgggagcagcagcgctgcggccggcggtaacgacggttgtggcattgccgtcggcggcgacgacggcgcagcggcgttcatcgacgccatcctggactgcgacaaggagacgggggtggaccagctcatcgccgagctgctggccgacccggcctactacgcgggctcctcctcctcctcctcctcctcgtccgggatgggctgggccggcatgggcctgctgaacgctgattaattaactcaagactgctttagtgtttgctatacgtacttaccatcaattagtatgatggtcaaaccttccaaccggatccattcatatgcttgcacaactctgggagtctgggtgttttcggattacaaattgtacggataattgacgccatttgtgcgtgtgtgtctcattcattttccgaaaaaaaaaaaaaaaagtgttgtgtggttcaagctgccgctggtataacttggcacgtctcacggcacctgaaaaaaaatcacgggcaggcttgcgtcgttgcatcggtcgccaccacacaccggccggcccctatcacccgtttcctcacgacggaacgggacgatgccgcagcagtcagcgtaacaaaaagaaagcaaagggtgaaaggggaagggggagaataatctcggtttttagcacgcaaacacacggtacgagcag

SEQ ID NO: 10907 - DNA, 806 bp, Zea mays
  misc_feature (557)..(557): n is a, c, g, or t
cctcgaggccggccgcgcccggtggccgctccccccactagcgattacacagaattccctcccaatcggcggcggcacgatgcgcctccgcagccgggcaatctttcccctcgtccgcaccaccacgtcggccgcgtcttcgtcgccggcggtgctgagcatcggccacgcgctgcgcgagcgccggctgttcacgggggacgacgtggcggcgtacgcggcggtcagcggtgaccgcaacccggtgcacctcgacgacgccgtcgcccgggagctgagcgggttccagcgaggccgcgtggtgcacggcatgctcgtggcgtccctcttcccttccatcatcgctgccagcttccctggcgctgtgtacgcgagccagacgctcaagtttgcggcgccggtgtacgtcggagatgaggtggttgctcgagtccaggcactcaacatcaggatgatggcggcggcgacgaacagctgcacggcaagacgatatgtcgtcaagttcgcaaccaaatgcttcatggacgaagaggagggctctgttgcgattgaaggcngaagcaatggctgtcctgcccacactggagctcagctctcagtcgactagaaactaggagtggcctcaaaccgggtgactagtcacaagttgctgttgcttaatcatacccgacctggtaatccctctcttctggaacactgtgtagaatgcgtgtaaactaaacttagtgtagccttcacattataagcgaggagtgaaataaagctgttgtttatgacagaaaaaaaaaaaaaaaagcggcctcgag

SEQ ID NO: 10908 - DNA, 1294 bp, Zea mays
gccggccgtttcgaaatccaaactgtctcttcacgtccttccgggtcctatcgctcctctccgtcgccggtggagctcatggcatcctccatggccgccgccgcctccgcctccgcctccgcctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggagatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccctgttgaaagggtggttggaagagccggcttgatcctgtaacagggaaaatatatcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtggatgctgtctttgctaagatcgacgagctgctgggttctatcctggagaagaaaaatgaaatggtgtccagcacatgagcaaggggaatatatctgaagcacaggacgacacgtacaagtaatgtaagccagtctcacgtaatggaaatttctccatgtggatgtggtcaaagcataggattttttttctccaattgttaactgtacgcgaatggaagcgacagatcattcgtaggttgtgagggcttcaaagatcatctgctgctgtacatgttttgttgctgtcttgtgaacatacatgtcttgttgtttctcaactggaggaatgctgttaacctgctgtatcatttccttgaatggcttatgtgagagggaggaggacctgagcagcagctcttgcaatctttgtctaaattccttcggatggtgaagcccatttcgtctgttctccgaaaagtatattgattgcattttccgaagaattgatcctctgtactgggccccttttctccttaaacatagctcatcaagagtattagttatgc

SEQ ID NO: 10909 - DNA, 2264 bp, Zea mays
cattgggtacctcgaggccggccggggtccaaaactgtctcttccacgtccttccgggtcctatcgctcctctccgtcgccggtggagctcatggcatcctccatggccgccgccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgctggagatttgttgcgggcggaaatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtggatgctgtctttgctaagatcgacgagctgctgggttctatcctggagaagaaaaatgaaatggtgtccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaagcataggaatttttttcctccaattgttaactgtacgcgaatggaagcgacagatcattcgtaggttgtgagggcttcagagatcatctgctgctgtacatgttttgttgctgtcttgtgaacatacatgtcttgttgtttctcaactggaggaatgctgttaacctgctgtatcatttccttgaatggcttatgtgagagggaggaggacctgagcagcagctcttgcaatctttgtctaaattccttcggatggtgaaggccatttcgcctgttctccgaaaagtatattggctgcattttccgaagaaaaaaaaaaaaaaaagcgactatttttctccttaaacattctcatcaagagtattagttatgcaagatctaagagtcggtaagatctcacatacatataaaacatactagatacaaaccataatccgattatggttccttttttttctaggctagagtttgtatggtttacaacactttctcttgaacgattatcacgatatgcacatgtctcattaaaaactccatccaaaaattctgtgacaaaaaacggtgctcaaagaaaagtgcacaccacattcgctaattgtattgtaaatgttgtctcactaaatatcttgtgtgagaatctttcgagtaaaaagtaaagtcacagagggaaaaagagtgcaaactttaaccttttattcttcatgaacagatattgattttataatgtatatatgaactgcaatatttttatgatctatgcaagcatggacagagcttacatacccgcgttagagtcgctatcgagtgtgtggattttgaactaggaggggatactcgaggctcacgggccccccgctcttcaggtgaacctcgtcgcgacaatgtgcgagtaggggcatcctcccacatggcggagccggttcctctgacgtactacagtggacagttgggccactgtgcatggaccctgtcacatgtggggcccatgcgtcagtggctcctcccccgtgataatctcgtttcccatctttttttactccttcatgatgatggggatgaactacccactatcatgattcttgaatacaattaaaagctaaatgttcaacctcagttaacttgataaacctcacactgcag

SEQ ID NO: 10910 - DNA, 1279 bp, Zea mays
cattgggtacctcgaggccggccggggtccaaactgtctcttccacgtccttccgggtcctatcgctcctctccgtcgccggtggagctcatggcatcctccatggccgccgccgccaccgccaccgccctcccgctgccgtccgggacgacgcagaggccgtctgcccagggccgcctcctcttcaccgccgcgcccgcccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggagatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgttaaagtgcaaggagatgccacagtggatgctgtctttgctaagatcgacgagctgctgggttctatcctggagaagaaaaatgaaatggtgtccagcacatgagcaaggaacttctccaggggaatatatctgaagcacaggacgacacgtacaagtaatgtaagccagtctcacgtaatggaaatttctccatgtggatgtggtcaaagcataggattttttttctccaattgttaactgtacgcgaatggaagcgacagatcattcgtaggttgtgagggcttcaaagatcatctgctgctgtacatgttttgttgctgtcttgtgaacatacatgtcttgttgtttctcaactggaggaatgctgttaacctgctgtatcatttccttgaatggcttatgtgagagggaggaggacctgagcagcagctcttgc

SEQ ID NO: 10911 - DNA, 1343 bp, Zea mays
cattgcattgggtacctccgggccggccgggatccacaagaggagaagaaacaatcaaccagcaacactcttctcttataacatagtacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttagtcagactgcatttccatgactgctttgtcaagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgcccttgcggctcgtgattccaccgccctggttggtggaccatactgggacgtgccacttggccggagagactcgctcggtgcaagcatccagggctccaacaatgacatcccagcccccaacaacacactccccactatcatcaccaagttcaagcgccagggcctcaatgttgttgatgttgtcgccctctcaggtggtcacaccattggtatgtctcggtgcactagtttccggcagaggctatacaaccagacaggcaatggcatggctgacagcacactggatgtatcctacgccgcaaagctgaggcagggatgcccccgctctggtggtgacaacaacctcttccccttggacttcatcacccctgccaagtttgacaatttttactacaagaacctcctggccggcaagggccttctaagctctgatgagattctgttaaccaagagcgctgagacagcggccctcgtgaaggcatatgctgctgatgtcaatctcttcttccagcactttgcacagtctatggtgaatatgggaaacatctcgccactgacagggtcacaaggtgagatcaggaagaactgcaggaggctcaacaatgaccactgagggcactgaagtcgcttgatgtgctgaattgtttgtgatgttggtggcgtattttgtttaaataagtaagcatggctgtgattttatcatatgatcgatctttggggttttatttaacacattgtaaaatgtgtatctattaataactcaatgtataagatgtgttcattcttcggttgccaaaaaaaaaaaaaaaaaaacagacaaaaaataaccggacggagccccttgcggcc

SEQ ID NO: 10912 - DNA, 2151 bp, Zea mays
  misc_feature (1361)..(1361): n is a, c, g, or t
  misc_feature (1496)..(1496): n is a, c, g, or t
cattgggacctcgagccggccggatgtgtcgcctctcggtggtcacaccattggtatgtctcggtgcacctagtttccggcagaggctatacaaccagacaggcaatggcatggctgacagcacactggatgtatcctacgccgcaaagctgaggcagggatgcccccgctctggtggtgacaacaacctcttccccttggacttcatcacccctgccaagtttgacaatttttactacaagaacctcctggccggcaagggccttctaagctctgatgagattctgttaaccaagagcgctgagacagcggccctcgtgaaggcatatgctgctgatgtcaatctcttcttccagcactttgcacagtctatggtgaatatgggcaacatctcgccactgacagggtcacaaggtgagatcaggaagaactgcaggaggctcaacaatgaccactgagggcactgaagtcgcttgatgtgctgaattgttcgtgatgttggtggcgtattttgtttaaataagtaagcatggctgtgattttatcatatgatcgatctttggggttttatttaacacattgtaaaatgtgtatctattaataactcaatgtataagatgtgttcattcttcggttgccatagatctgcttatttgacctgtgatgttttgactcccaaaaccaaaatcacaactcaataaactcatggaatatgtccacctgtttcttgaagagttcatctaccattccagttggcatttatcagtgttgcagcggcgctgtgctttgtaacataacaattgttcaggcattatatccaaatctagaggcctaccaaaatgagataacaagccaactaatctgctgggaaataggtaacaagtctctaacaagatcttaagcttattctgagatgatgtcgagaccgatgccttttgttacgtcgtgccgtgcctcttgttgccatgctggtaagttgctgcctcttgatgagggcaagctgcttatcaaggcgggatgaagtgttatggacgcaggcatgggtgctgctagcttggcatccagggttccaggataacccatctacctgcattagtttgtttagtttcttaactgctaagttggcagatcaggttagttagacaagattgctagtttcctgcttggtttgttagttcatcatgtacgagggccaggctatgtaatgccaggggtaccgtgttgttattgattgaattaagcaggagttaacaaaaaaatccttcttcttgctcacccgtgggcaaaggcccctggccagcgatctcgctcccccttaaccctagctctcataccatattggaatcaaatatgggcaacanttactccccagattccaaattttggtctctttagacttctcaaattttctccaaatgtaggtcattctatgtatacttacccttctcttccttgttccaaattaataaatgctaccagtctcacaaatgaatgtnatctactttcttaactcatgtgcacaaatctagaaccaacacatcaaagtgttagagtggatgcactaactagttcaacccaaaagcttaagctattgggagaaggtagacaatccacttatacactcccactcacatgtagccggagagaaagacacaaatgtggaaataaaggggtggaggtacaaataaagcatatgtcaggatttgaactcgagacatctggctttgatatcagacgcactaaccagttcaacccaaatacttaagcaattgggagaaggtaggcaatccacttatacactttaacacagaggaagtggattccaaaggaaaaacttcaatcatcataagggaggaccaaaaatacattcatgcgacctccgtagtcaggttgtcgtgcctgatagaaatctatagggttcccatgcaagcattcaaactaatgtcttaacaatgttaatatcactggatgatatttcatatgcaatgctagaaggtacctggttgtgtcagcctcatatatgtcggtattgtttcagattcttgaacactgatatgagggaaatcataggacagcttctgctttcatgtatttaaagaaaacgcatctgaaatgagagataaataaagttcaaggagagataaatacaag

SEQ ID NO: 10913 - DNA, 449 bp, Zea mays
accacgcgtccgccggacgcgtggcgagaagaagaagaaacaagccataccatagcacacaccaaaggttactcagtcacatggcaacatccagcacgggctgtctcgtcttgctctgccttgcgtctcccctcctcctccttcccagtgcggtggtccttggccacccatggggtgtcggcggcggcggcttgtccccacagttctacgaccactcgtgtcccatggcggagaagattgtgcagtccgttgtggcgcaggctgtggccaaggagaccaggatggcggcgtccttggtcaggctgcatttccatgactgctttgtcaagggctgcgacgcttcggtgctgctggacaacagcagcagcatcgttagtgagaaagggtccaacccgaacaggaactccatcagggggttcgaggtggtagaccagatcaaggctgctctc

SEQ ID NO: 10914 - DNA, 6480 bp, Zea mays
  misc_feature (4196)..(4196): n is a, c, g, or t
  misc_feature (4219)..(4219): n is a, c, g, or t
tctaccattccagttggcatttatcagtgttgcagcggcgctgtgctttgtaacataacaattgttcaggcattatatccaaatctagaggcctaccaaaatgagataacaagccaactaatctgctgggaaataggtaacaagtctctaacaagatcttaagcttattctgagatgatgtcgagaccgatgccttttgttacgtcgtgccgtgcctcttgttgccatgctggtaagttgctgcctcttgatgagggctcgctgcttatcaaggcgggatgaagtgttatggacgcaggcatgggtgctgctagcttggcatccagggttccaggataacccatctacctggttgtgtcagcctcatatatgtcggtattgtttcagattcttgaacactgatatgagggaaatcataggacagcttctgctttcatgtatttaaagaaaaggcatttgcaaaacccgctggtctattggctctcttttactcatgtcctacagttcaaccatttacaccagaggcctggtagatgtctagaagacaaaggatatcagctgagggttataaagtggttgaatctaacaagatgcatcctcaacctccaggcctttcagaacctgagttaatatgtttgcaatcttgatactgcagcaggaaaggtttccctaaaaagttgagcagtacccaattttacccccaattctgaaccattgcttcaactgccttggtggcctttaagaagctcccctttcgagcaaagtgaagcaattcccagcataatatgactcaaaatcatcattgaaagactttccaagcaaatttcggtagtcaatatcagggccacccctcgattttggataaactatcatctccatctatcatggattgaacttttccatcagaactcctacaaagactattgcttgaaatatcataagcgactggacttgcttgtcctgaattggacatggaaccataagcatcctcagtttttctgtaccttttttatatgcgcaagcgcattatagctgatagaatttgaagaggataaaagcatgagtcccccttcatttaggattgttacaatctcatcaatcctcccctgatcacatccagaagataggagatcaacaagggactctgcctgaatcttatctccaacactgtttattaactccgtgacttctttgcactgaaacatctccctcaagatgcccctggattcttccatccttccttttgcatagagtcctttgataaggctcatgaaaccaacaaaatcaggatctatattcctatggcggtattcattaaagaatcttaatgcagcttcagtctcacctttcagacaaagtccattgataattgcaccaagtgtaaaacaatctggaagtataaagagttcctccatatgagacataagctcaagggcctttccagttaatccaaagttacaatgaccacttatcagcaagttgtaaacacgggtagtgggtttgatacctttggtggacattttttggaataactgatctgcatcatctaataaaccttctctacacaaagcacctataagaatagtataggtgattattgttggaagcatcttgctgttttctaagtagtcaaagagcctgaaagcttcagtaaggcatccttgatgacacaaaccactgagaactgagttatgaatgacaatgttaggttgaaatccctcttttttcatgccttcacaaaggtctagcgctttttcaagatacccacccttacaaaggccatccaccactatggaatacatagttagatctactgaaaacccactttgttcagctaccttcaaaaagttacatgcgtccagaacttcaccttgcttctttagagcaaagacagctcctctcagaacactgacaggaacactacctttgtccatgtaattagaaaaccaaatagttttgctaatatctttttcgctgagataacaggacagcatatttatcattgtcagatcaagcaggccatggattttaatgaaatcacatagcaatggttgtatgacctcttcatttccatttcggtgtaaactcttgagcagcttgcagcatgttttactacttacagcaatggcttgtattctgagtaacttgtaagcatccattgctgcttgacaacaatttctcttgcttaagaatgcagaagcataattgcaaacagatgaaaataagtcaatatctagttcaccaaccttacaaatgaaatccagcacactatgttcaccgtgtcctttgaagtgtgcatgaatcaacttcctgcagttaaagaaattaggccttatttttttctgaacaagatcataaaatatttggtcggccatgttaacttttcctccattacacagtgctctaatcaggcactcatgaacaactgcactggagaatcctgcatcttttttgtattcatcaaacaattccagtgccttgtcaacttgctcagctttacacaatttgtctatgattgtatggtaggtgatagtattaggccttaagccaatctcaggcattttatgaaacaagctccaggcatcattcactttgttaatcataaacaatgctttgataagaacattgcatgtgacaacatccatagaaataccactaccttcgagcctatccttcattgccataacaccagttatgtcacctctgttaatgtaaccatgtaacagtgtgctatatgtgaaattatcagcagcaacaccttcagaaatttcaacagccttttcacagtgaccagctttacacaaaccgtttattatcgcgttgtatgttatgatgctagcctttattcccttattctccatctctgtgagtaaagagaaagccctgtctaaatcgtccattttgcacaaactgtcaatcaaaatcgaatatacatactcgtccaccaccatgcctgtttgttccagtttcctcacgatagagaaagcatcttcccacctgtctctcttacagaagccaccaaccagtgatgtataagtaatcaaattcggcttagcatccactcgcaccatctcatccaagaaacccgttacggtctcctcactaccttctctgcagagtccatcaataacagtagtatagttaattacatcagctgtgatccccttccctagcatggatcgatgctcccgaagaccttccatcaagaacccacgactcatgtatccatgaaccatgctgccgtaaaacacagcatcagcattcatgcctttacactccatctcccgcataagctctgccatctcaccagttctcccctccaacccaagagcatggacgactgatgtcaatgtcacaaggcctggatcaaatccactgaactgacgcttcaccttgtcgtagaaatgcagccctgctccggcctttccggttctggagaacccagaaacgatcgagctgcaaatgcgatcgtctacctgacaccccctattggtcattatgtcgaacaccctgagcgcgcaatccacctccccgtgggcgcacagcaacaccaccatcccgcaatacgtggacggcgacagcaccatgccgtggtcttcaatggcagcggagagtagctccacagcgtggcgcgggtccccgcctctggcacaggcccggcggagcagtgcatcccagaggtggcgagtggaggtgctggaggcaagcgcgaggcgctgtgcggcgtcacgcggccgcgcggagtcgagcagggcggaggcggcaaggaggtgcgtgcgcggagtaggggcgatgccgttggcaagcgcctgggaggcgagcgcggcgaggaggcggtgcctgcggcggcggaggagcactgtcaggaggcggtcgacgtggcgagcggtgaccgcgcagccgagtttgatgagtgaggggaacggcggtggagggggagagggctcgccgttgccgccggggaggggcatggccgctggcctggcgggcagggagttggagtgaattaatttctgtaggagaccggagttttagcgccggtgagatgtaaagcgatttcattacagcagcaaccgattacgttgcattgcgtttatttgacatataatcgaatatggtcatagggactttatagaaaatagagtgttattcaatatacctttcatcaaattgtaataatatactacaaattatcngataacttacttcttttctattngtagctttgttactggtcaaatcccacgacattaaggtgccctttgattcatatatttataacgtaataggtaactgataacgttaaataatgtttattttagttcaatcgtaatcagataacacactaaaaattgataccaatatattcaaacttattatcgccagtaatcaagtgtaaaccattaccatttgcattacatttcaaacagcacctaaatttttagtccctcctttttaagttcctttgcaacaccagtaagtcaagtatatacaacacctgtatgtcaagtatttacaatacataagtatctcgagagttctcatggaagctctttgcaagttccactaggtggctaattggctatacaagaagctctctgttgtcctttccacataccgcacagctctactagcatgtagtaaggaatacagtaccgaaacaaacaataagataggcttcaggtacgaagtcacttttcgcatgccacaaaactctaccagcatgtaaggattacagtaccaaaactatatataaggcagactttgcgtatgaagtcaagagctctcctggaacgactgtgagcgcgacatcgccgccgggttcgcctgcaagacctgagcagcgtccgacctctggcccttgctctcgaccttggactggaaaggcttgatgaaagtgccagggtctccgggcttgatgccgagggtggcccatatcgaactcttggcggcgtcatcagggtcatcgatccggagcgtcttgggaacccacagcgacttctctcttttctcctctctcagcggattggtgtccctggaatgcttgcccagagtaggagacccgttgcccgagcagctgctgctgttgcttgatggcgacggcgacagcggcggcggcggcggcggcgacacgcagacgttggttctggtccatggtacgttccaagccgtggctggccatccggaaaaacagccccagagcccgggtggcacgagagggtatggaaacgctggactaggaggaggtcttgagcctggcatcatgggagggttcatccatacagctgagccaggcctgcagctctctggagcaggagcaggttcgggcatgcttttacctggcaccatcacaggcacgttgctccatcctacactccaagggtacatgaaaggggttccaaggtaatactgaggcactggggcaaccccgttacaatgaactggtgccccgttcttgccgacgacgggggccatggtttcaggcacaccgttgtatggtggtgtgccggatccagggttattattatcttccctgttttcacctcttgctgttggtcctccagggctgttcccgttctgctcatcaatgttcagcgccgacaccattgactcgcaaaatggtacctcaggcccaaattttaggaccgttccatttctactggctggctgtgtcggggcaggtggagatgatgcaagaccttcagggagcactggctttgatatgtccactctaggccccagcatacagtcaggggccatcagtagttgacggtagtgcaatgacgcgttcttactcttgcgccgcccggcgccaacaggtacgttcctcatggtgccccctgcagtccagtaccgctggcagttcttgcagaagtgccttggttgattaacgttgtagttgttgtaatagcagaactttgtatccatgctgttgcaccgagggcaaggtaggatcttatctggcttcttattaagtgccctgtcctggcctgattcctcatttgatgtcttctcgttctgcccctttgcatctgatgctgctttatcttcggcactgtccatcggtccctcgtctcctttcttgtgctccgactccgagggaggtaaattggctggttctatatatccatgcgttggtgatgcgacggcttccatttgttcatctttttcctcttgttgtgcgtcaattttcatttcgtcgtcatgttccttttgtggcgcatcaacctccatttcattacccttctcctgttgtggcgtgtcaaccttggtttctttacccttctcttgtggcatgacaaccatttcattagcatttttctcttccttctcattgtgttgatcctacaagattatagcaagaagctattatatatccgagattttcaatagtgcagtgtagcagcaggccaaataaaaaaggctaccagcagatataaacagccataatagcaactacgatttgtagcatttttttta

SEQ ID NO: 10915 - DNA, 1057 bp, Zea mays
  misc_feature (1028)..(1028): n is a, c, g, or t
gggtacctcgaggcccggccgggattctcaccgccacaagcaatccccaccggttctcgcctccggggctctcttgcgctcacactcccaccgccgcatatccgagtagagcgccacgaactccacgagctctccgcccagcgagactgtccgatgccccctccttcacccgcctcgcaagtgcgcacttgcgatgctggcgccgcgtagtcgcccacgcgcgggacggtgagtgagatggcgcgctacttccgcagcagcaacctcgcctctaggatcttcgaccgtcagctcatctccccgctccctggcgctaccgttaacacgattagacagttttatgaaaatttggtcccaagctatactatatatgacatagattgcccagattattcgtttcgcaagttcactgatgatgggaaatatcttgtggcttttagccgaaaccatcaagatttgattgtataccgtccaatctggttcacatattcatgcaatgaagaatgtgaaactcatgagcttccgccaaaggcaaagaagtttgacagcttctttaagcagctttattcaattcctcttgcatctagcaatgagtatatttgcaaggactttttcctgtacatggaatgccatcgatttggtttatttgcaacatctactgcacaaagtaacgaatcaactgccactgagggtgcaatacatggggtgccattgattgagaaaataactttccatcttgtgaggctagaagatggtgtgatcctggatgaaaaggctttctgcaatgattttatcaatctggcacatagtattggtgcttacatgtatgaggacctgctttgtattgtttctttgcgataccaaacaatacatatcctacagatacgagattcaggcaaccttgttgaggtacgcaacattggtgcattctgtcgggaagatgatgagctatttcttcactcacatattcagactggttatgggggttcttttcttcctggcataaaacaacggtttgtgtcatatantttttgcaagacgtggaatgaggattcag

SEQ ID NO: 10916 - DNA, 925 bp, Zea mays
  misc_feature (16)..(16): n is a, c, g, or t
gcacgagaccattacntagaacatcctaatcaaaagaccaaccagccaaaacacgcccgcgcgcctgtttgttcggccggaggacgccatggccatggaggagggatcaggagcggtggagaaagggccggccgtgggcacggtggctgacgcctccgccagcgtcatcggcgaaggcgccgtgaaggaggaggccgggggcagacggcagccgtcggccggctacgcggccgtcgtgattggcggcaccttcgaccgcctacaccagggccaccatctcttcctgaaggcggcagcggagctggcgagggagaggatcgtggtcggcgtctgcgacggcccgatgctcgccaagaaacagtacgccgacctgatacaaccgatcgagaagcggatgcagaacgccaaggattatattaagtccataaagcccgaccttgatgttcatgtggagcccatcgtcgaccctttcggcccatccatcgttgacccaggccttgaggccatcattgtcagcaaggagacgttgccgggagggcacgctgtcaacaggaagagagcagagagagggctcactcagctgcagatcgaggtgatagagctggtgccagaggagtcgacgggggacaagataagttccacggcattcagaaagatggaagccgagagggcgctgcagcaacagaataaacaagaagatacagcagtaggcactccggttggggtgcaaaacatagcggttcagtcacatggagcatagtacatgaaccgaagttctgttgcctgtacctttttttaaaaaagtacatgaaactttgaggtctctacttccatcacatacaaagggacaatgcttctttgcccaaacatggactgatcatcaatacagaaaagttccagtttcttactaaaaaaaaaaaaaaaa

SEQ ID NO: 10917 - DNA, 1588 bp, Zea mays
ataaccttgtcctctgtatccgtgctggtgctctgctgggtctcggtctcgtcaccgccacgccggtctgccgtcgtctcgtctgctgcactccactgtccactccactctcccaccgcactttcctctctcctcccctgttttcgctcccctcgagacccccaaagcaccgaaagggggaggagcggagggagagagagagaaagcggcggggttcaagaacgccgcggccatccggagccaggattctcccgatacccccctcgttcccagctcttcagtggcgccgatttggagttccagagacggcgatgggctccggatctctgctcaaggtcttcgccaacaacttcgacgtccttgcagggcctttggtggcattggcttatcctttgtatgcttccattaaggcaatagagaccaaatctcctgtggatgatcaacaatggctcacatattgggtcctgtactcactaataacattgtttgaactcacatttgcatcaattattcagtggcttcctttctggccttcaatgaaattgatctttatttgctggcttgtcttgccatacttcaatggcgcagcctatgtgtaccagaattatgtgagacctgccttcataaagaaccagatggtcaacatttggtatgtccctcagaaaaaaggccttcttgggaaatctgatgacttcctcacagcacttgataagttcattgaagaaaatgggactgacgcgctgaagaaattggcgaacaaggctggcaagccatttaaacagtctgggaaatcatctaaggatcagaaagagacaaaatcatcaaaggattccaaagaaccgaagccatcaaaagatgcaaagcaaccaaagccatcaaaagatacaaaggagccaaagccaccaaaggattcaaagtcacccaaggactccaaagaacagaagaaggcggcgctgaaagatccgaagaaagcaccgaaggattctaaaggactgaagaaagcgctgaaggatccgaaagaacaggaatcattggaagactcaaaggaacatacagcgaagaaggccggcaagcgtgtgacgttcgccgaggtggagcctgagaaggagctcaaggcctcgaacagtgactggcacccatcctctgatttccacgcggcgtaccctgagcagaacccatgggctagcggcttcatgatctttgaggatgaaaacagctactggaaccgaggacccctagactgctgagatcaaatgtatcgaggtggacactttttggtccgctagcagtgcaaggtcccaccagttcatcttcagccgaggagatgggtctcactcgcattatggcgacttgcgcctggtgtctgactctcggtcctgtaacatatttgtccgacgaatacctgtaggttgtagtgtagaattatcaattatgcagtgtggatggtgaaccggtgatattgtgtttcaggcggtgaaccttgttagttaggagaattgagatagtagcagtgtggtgctaaaccttatctggtttctggttgtgttgcttgctgtgccccctggtgcgtttccaataaaaaaaaaaa

SEQ ID NO: 10918 - DNA, 1477 bp, Zea mays
ctgctgcactccactgtccactccactctcccaccgcactttcctctctcctcccctgttttcgctcccctcgagacccccaaagcaccgaaagggggaggagcggagggagagagagagagagcggcggggttcaagaacgccgcggccatccggagccaggattctcccgatacccccctcgttcccagctcttcagtggcgccgatttggagttccagagacggcgatgggctccggatctctgctcaaggtcttcgccaacaacttcgacgtccttgcagggcctttggtggcattggcttatcctttgtaagttgctcatcacttgtatttattgctacaaactcaactttaacgagccaaacacaaatgtaactgttactacaacttataggcttcctttctggccttcaatgaaattgatctttatttgctggcttgtcttgccatacttcaatggtgcagcctatgtgtaccagaattatgtgagacctgccttcataaagaaccagatggtcaacatttggtatgtccctcagaaaaaaggccttcttgggaaatctgatgacttcctcacagcacttgataagttcattgaagaaaatgggactgacgcgctgaagaaattggcgaacaaggcaggcaagccatttaaacagtctgggaagtcatctaaggatcagaaagagacaaaatcatcaaaggattccaaagaaccgaagccatcaaaagatgcaaagcaaccaaagccatcaaaagatacaaaggagccaaagccaccaaaggattcaaagtcacccaaggactccaaagaacagaagaaggcaacgctgaaagatccaaagaaagcaccaaaggattctaaaggactgaagaaagcgctgaaggatccgaaagaacaggaatcattggaagacccaaaggaacatacagcgaagaaggccggcaagcgtgtgacgttcgccgaggtggagcctgagaaggagctcaaggcctcgaacagtgactggcacccatcctctgatttccacgcggcgtaccctgagcagaacccatgggctagcggcttcatgatctttgaggatgaaaacagctactggaaccgaggacccctagactgctgagatcaaatgtatcgaggtggacactttttggtccgctagcagtgcaaggtcccaccagttcatcttcagccgaggagatgggtctcactcgcattatggcgacttgcgactggtgtctgactctcggtcctgtaacatatttgtccgacgaatacctgtaggttgtagtgtagaattatgcagtgtggatggtgaaccggtgatgttctgtttcaggcggtgaaccttgttagttaggagaattgagatagtagcagtgtggtgctaaaccttatctggtttctggttgtgttgcttgctctgctccctggtgcgtttccaataaaaaaaaaaaaaaaaaacggcacgag

SEQ ID NO: 10919 - DNA, 776 bp, Zea mays
  misc_feature (11)..(11): n is a, c, g, or t
gtaccctccgngggctcgggcccggccccgccaccggcattctgctctgcactccattgctagctgcaacgcactgcaagaaagagctagctagctgctcaccgtcgttacgaagatgatcaagctgaggtaccctaagaagctgttcaggaggagctcctccaagggcagcagcactaccagcagcagcagcagcagcgacggcgatgccgccggcagcgcccgcggcggggagatcgagtgggaggtccggccgggcggcatgctggtgcagaagagggacgacggcagggggcacgtggacgtcatcaccgtgagggtcgccaccggcttctcctggcacgacgtctccgtcgtggctacctgcacttttgtgtgggcgtgcaaaaaaacgattgcaggtgagctgaaggcggtgctgtggaagatgacagggctggagcctcgggagcagaggctcctgttcagggggcaaggagagggaggacggcgaccacctccacatgatcggggtgagggacatggacaaggtgctgctcctggaggaccctgccctcaaggacatgaagctccgggccgggctcacggcggcgtatcgtcagactttcatcagggtctagtagtaggcttaggcttgccacccccgccccctaattaactgtgatgcatgatagagagagagtaaaacgaaccagtatcttggtttcggctgctctgacttctgggtcggtgaacgactgcctgccctgttgaagagaagccactgcttgttgttg

SEQ ID NO: 10920 - DNA, 1283 bp, Zea mays
atgcatcccctgaagagcacggcgctgcccggagcaggatgcgtgtaaggtgtaactaccgcctactgcagctcaggttgtcgctcatagtcttctcttctgccgtccatccggcctgcgcgctcgctctcctgctctcctgcgccaactgggcgaccgccgacgacgccaacgccgacgacctacgccaggtgctgggatttttgtcggttccttcggcagctttcgtcgcgtccttcgccggcgacgagcactcaccaggtccgctcctgaagaagactgggatattttgcatacacagaggatcatctgtgtagaggacattcagttttctccagttctccagttcctggatagcaatggcaaatgagtttcctgatgaagttcttaagtctgttttcccattgctggatggtaaagatctagtattctgcatgcttgtatgccgtcaatggcatgaaatcgcaaaggatgattacttctggaaatgcatttgctcacggaagtggccgtccatttgcaaacagcccccttctggcgcaaactacaaaaagctttacttaaccttctctaagccacgggagatgcagaacctccctgtgccaaggcttacattcgaggatattgttttctatattgatatgtggctcgaaggatcgctcatcttttctcaagcagtttcaggccgcactctccgagcaggcctacagggcgctccccctcctggcattccagatatacttgcagcacatttgagttcccaagactgcatcttgatgctggaagtggagcccaagttggccagttcccatggggccagccatcactgtatctgtccttgccaaccgcaaggattcgaacaagatggcttgcatcataaacaagtcaacgttcgattacatcgacagtaatgcagcgcgggctctggcttatgagtatctcaggttttcgcccagacaccctttcacatccgacatccgggcatggatgtcgttacttttcctgtgcaaaggggcgaacaccattgaggtgtttggtatcgagctagatttctgtgacgccgcgaagtcagagaaagaaatcttgtggctcctagacatgcttgattggaaatagaagttccttatcccctttggggtttgacacatgtaaagcctgttcatggttagtcgttcctttcctgttggaccatgtacgctactactgaactacataatctcctgagaaaatgtaataaatgtcacctgctactccattttgctaacaaggcgaggttattttgt

SEQ ID NO: 10921 - DNA, 1593 bp, Zea mays
aggcccctgcgcgtcttcattctttctccctgccctcccctgctgaaggaagccgcctttttggagtttggacgcgggaggacagcctccgcactttccgtccgtcgcgaggaattcctgcccgggcgggcgtagagcagggcgaagcattcgttggggacgaacgtttagggccggggatcggggaacacgaggctgcgcgttggcgcaagcaagcaaattttgggtcctagcttgaaggactgccatctttttttttggttggtgagctacacatcaaatgttaatcccccgtttccgtactcttatattgtgcttattattattatcttctgtaatactatagcatttattctgtctgtacataggtgggatcaaattatctgttaaggttccttcgtttatgatcttttacatctataatttgcaactcatctctttgtttgatttgatttgattgccctgcctgttgatggtgaaactagcgtctgtttgatagaacgcatttttgccggccagctccactcgagaatttgaaggaattttaccaacgtggggagctgaatatttttttctgctcctctcattttccactctccacccgcgcctgactgcagctggctgcgatccccctatctaccgcctgattcatctttgtctccgtcggtgccgccctctccgccagcctgaccccagggatggctggaaaaggaagctatgtacctccacaatatattcccttatacagcctagataccgaagaggatcgtgtccctgccgtggaagagaaccatgctacgcgccctaaactaaaccaggatccaacacaatggtcatctggcatctgtgcctgttttgatgacccccagagctgttgtattggtgcgacttgcccctgtttcctttttggaaagaatgcacaattcttgggatctggaactcttgctggatcatgcactacacattgcatgttgtggggccttctcacaagtctatgctgtgtatttactggaggtctagtattagcagttccaggatctgccgttgcttgttatgcttgcggatatcgcagtgcactaagaacaaagtacaatcttccggaagcaccctgtggcgatttgacgacacacttattctgtcacttgtgtgctatatgccaggagtacagggagatccgtgagagaacaggcagtggctcctcaccagctcctaatgtgactccacctccagttcagacgatggatgagctttgatctttaactgatatgaatgtatgttatctgacaaactttggtgtgtggcctggtggctagtgctgcctttgcctgttggcattttgacatatttttgttcttgggctctcacaacgctgctatgttgtttgtagagttgtaaacacgggttttgaactagtgaaccactgacagttcacggaagttgtaaacacagttgtaccatggaactgtagtagaattattaagtgtatttttttttggctatttatattggtgagaggatgggaagggaaaagaaaagaaatgcacttatcatgcagaatgtttcattgtgtttagttcaaaaaaaaaaaaaaaa

SEQ ID NO: 10922 - DNA, 1672 bp, Zea mays
cattgggtacctcgaggccggccctcaccgaaaaaaaaaccatcaccgccttcccggcgctcgccgctgccacccgtcgccgcgcgcctttccgccacccgccgccgctgttggcgcccaaacatcgcatctgctgttgctttatcccttttattccacagccgctctaagtggtgggtgtccctctatattcgccgcttataggaatcgagggttcgatcggctgtggtgcgtggtgactgtgaacgaggaggagcgcaaagatggctgatttccggacctccacccaacgggagaggtggatcttccagtcgcacgatttgatggagaggtgggcggcggcaaaccagcgggccgctcagacccttgcgcagtatgggacgacccggcttaatgtggacctgcttgatggctcggtatcctacccagagtccatgccggatcatgttgagggtagctcggttgtaaagcctctttcttacgaagaggagcaattgacaagggtattttacgagcagaagattcaggaagtatgcgctgcattcaagttccctcacaaaatccaggctacagcaataatatatttcaagagattctatctacaatggtctgtaatggagcatcaaccaaagcatattatgttaacatgtgtatatgcttcttgcaaagtggaagaaaaccatgtttctgctgaggaacttggtaaaggaattcagcaggaccaccagatcattctaaataatgagatgattcttcttaaaactttagattttgatctcattgtttatgctccatatcgatcgattgaaggatttattgatgacctagaggatttctgcagggcaggtaatggtccattccagcgtttgaaggagttgcgccaggctgctatatcccatgttgacaaaatgatgttgactgatgcacctcttctctatacccctgggcagttggcactggcggctcttcacaagtctaatgatcttctcagggtcgtcgattttgaaagatacttggaaattatcttctcaaggcaacattctgattgtccaatcgaacagtttgttcagtcgatcaacgaaatcaattacttagtcgaccagcttaatatacctactgtcaaagacatgagacacgtggaccgcaagctgaaacattgctgggatccaagctcacatgacgagcataacaagaagaaagaaaagaagtcaaagcacaaatcgaaaagaacatctaccgatgcccaactataggaagcatatggtccagcagtggctttgtgtaagagtacaacgggcctccaaatgatcgaaactgaactcaggcatctaagcacagcagctctaagacagctttctacaccagctgaggcatacctgaggtcaagcaattttgtgacgatgtgggctatggaacttcattgctccaatgggagagttgcagcaaagatacaaactaagagatgtaacattggatgcctatctccaaagtacggagaacttcaaattttatatggccgactttgtgtcagccacaattacttgagttccttttgttacggatgtagcattgtttattaagtttaaacgccgaatccaagatgatccacctgctgttgtgaatcgttttttaactgatcagtgattttgaagaaaaaaaaaaaaaaacggcc

SEQ ID NO: 10923 - DNA, 1607 bp, Zea mays
  misc_feature (27)..(28): n is a, c, g, or t
cattgggtacctcgaggccggccgggnnaaaaattcaaaaaaaaaaaaacctcgagaacaacccgaagcacatagcattacacatacgcactttctctctctactgtctgtctgtttctcccaatcctccacagtctctctctagagtagacccaggaaagaggcgatggatatggccattgacacgccatcgccggcgccgcccacgccgccggcgccatcggcagcggccgggcggcagacgcgtgcggcagaggcggtgcgtctggagcaccaactggtgcgcgtgcctctcgagtccctccgcgccaccgtccgctcgaaccaccgcctcgccgagaaggagatcgccgccgtcctctcctccgcctccgcggcccccgcagagagcagtgccgccgccgtcgaccacctcacctccctcgtctctcgcctccacggcctcaagcgcaagatggaggagggcgcacgagcggaggaactgcaggtgcagcggtgccgggcgcgtctggaccggctggcgactgccagcaccggcgacgatgccgagtgggaggacatgcggttgaagaggatcctggtcgattacatgcttcggatgtcctactacaattccgccaccaagctcgctgagacttctggtattcaggacctcgttgatattgatgtctttctcgatgcgaaaagagtaattgattctcttcagaataatgaagtttctcctgctttagcttggtgtgcagaaaacaagtctcggctaaagaaatcgaagagtaagcttgagtttttactgaggcttcaagagtttgtggagtttgtcaaggttaagaatttcattcaggctatagcatatgctcgaaaacaccttgctccctggggctctgtacacatgaaagaattgcagcgtgtcacagcaacattggtttttagaagcaatactaattgtactccatacaagatattgtttgagcaagaccgctgggactatcttgttgacattttcaagcaagatttttgcaagttatatggcatgacactagagccgctgctgaacatatatctgcaagcaggcctgacagctctcaagaccccgttctgctctgagggtagctgtcccaaagaagaccccttgtctctggagggcttcaggaaactagccgagcctctgcccttctctaaacagcaccactcgaagcttgtttgttacatcaccaaggagctcatggacactgagaacccgcctcaggttctgccgaacggctatgtctacagtgagaaggcgcttcaagagatgtccaagaaaaatgacggcaagattacatgccccaggacaggagatgtttatgacgtttcagagtgtgtcagggctttcatctcctaatcatgaaatactctgatttggtgtggctttgggaatctgagtgaatgtacatagagtggtcagcgcattgtgcgccatgtcgagttgattgaactaacctgcaatgttgaactggctggatgttggattgtgcgcatcgttgcaaccgtgaaactgacgtttttcatgctccaaaaaaaaaaaaaaaaaagcggccaaaaaactcgagggggggcccggtacccaa

SEQ ID NO: 10924 - DNA, 842 bp, Zea mays
gaggaagttgcaacgctggggcctcgactatcaaaaagcttaaactgaccatgtgtccacatccacatcttaactaactcgtgccatcattgtttggtacagtgtttgcctcactaaaatacaattgatacacagatgattttgttgtcttcacatttagctgccgtacaaacatgtacacggaacaccacacgcccagattcactcggcactcaccgacatataatccttgttgccaccagtagatatcttgtacacgtaaaatatcagtacgagtgcactgatagaagcgacaattccagcaggcattatcttttgtgttttgacgtatcttattcccataacaacagtcaatagcacagcacaaacgatctgaaggacggtggcaaagatggcggcagcgccacctccggcgtgcgcgaaggcccaggcgctgagcgcaccagcgagaaggagcgcagcaccgaatccgcccccggcgaccagagacgcggcgctgccgcgcttcatgtagccggctacgccgccggctacgagcagcaggccgtaggggatcgtgacgtagaagtcctccatgtcgatgcctaggcgcacttcctttcccctggtgctctcggttgggcgcctcgccttcttccggtactgaaggacggcggaggggacttgccggtggcggtgggctcgtcactcgttgcagacttgcagcgaggagaaccggtagcgaaggtaactttgggctggctccgtatcctgggccttcgccatctgctcacttgatgggtctagccattggaagtcgcgatcatgtgtcgactgcgctgttctaggtaatggtctcgtgc

SEQ ID NO: 10925 - DNA, 986 bp, Zea mays
  misc_feature (850)..(850): n is a, c, g, or t
acgagcacgatgacaggtgggtcccgctgcctcgcggccacggtgcaccgttggattcgttccatggtctacatgccagggagaaagtgcacggggactctagagtaaatcccggtgctaccggcggcggcggcgacgaatcgagcaggcgcggcggccatggcggcggcggttgagagcgtggtggtggtccataacgtggcgaagcggcacaacgtggggacgctggcgcggagcgcgacggcgttcggcgtcgcggaggtggtcgtcgtcggccgccgcgatgtcagcgcctttggcagccatggcgccacctcgcaccttcgcttccgtcacttcgtctctctcgcgctcgcccgcgcctacctcaaggatgagagaggatgtgacatttgcggcgtggaaatcaccgacgacgcgcagccggtgaccgcccacccgttccgtcggagcactgcgttcctcttcggcaatgagggtactggactttcacaaaaagagtgcgagatctgtgacttctttgtctacatccctcagtatggtggtggaactgcatctctcaacgttactgttgcagcttcaattgttctccaccactttggggtctgggctggctttactgaacgaggccgagagggcaacaaattcgtggtcgctgaaagaccacaggggcactcgaggggactttactgtacagactcggttgaagcagtggttgaagagcggaaaatgcgaaaagaaaatgcctgcgatgtactcgaggaaaatgggtgcagccatcctcaggaatcaaacggtctagacttgatgtttgcagactagagtatgaccacatggtatcccatctctngatgtaatctactccctgcccctctctgatgttaaatctactccctgcatccgcattgatggcacgaagttgcaatacagaacatgacagggcttatgagagagaaatttatcctgacacacatgtatggttcacg

SEQ ID NO: 10926 - DNA, 760 bp, Zea mays
ctcgaggccggccgggggcacggggactctagagtaaatcccggtgctaccggcggcggcggcgacgaatcgagcaggcgcggcggccatggcggcggcggttgagagcgtggtggtggtccataacgtggcgaagcggcacaacgtggggacgctggcgcggagcgcgacggcgttcggcgtcgcggaggtggtcgtcgtcggccgccgcgatgtcagcgcctttggcagccatggcgccacctcgcaccttcgcttccgtcacttcgtctctctcgcgctcgcccgcgcctacctcaaggatgagagaggatgtgacatttgcggcgtggaaatcaccgacgacgcgcagccggtgaccgcccacccgttccgtcggagcactgcgttcctcttcggcaatgagggtactggactttcacaaaaagagtgcgagatctgtgacttctttgtctacatccctcagtatggtggtggaactgcatctctcaacgttactgttgcagcttcaattgttctccaccactttgggggtaaaaatccactctactccagtcaccacagcactctttttctgtaatatattgaagtgttaaatgttggaatgtgcaaagtagcaaaagtcaaatcatgttcttgcttttgaacctaactgttttatggagttttagggtgccaaatttccatgttcttactctaaatagtcatgttctccctgccagacatggttaaggaattatttgcaaaaaaaaaaaaaaaa

SEQ ID NO: 10927 - DNA, 869 bp, Zea mays
cccccgtctggatggcccaggaacggcgcaccgtggagtccctctctgatttttggcgagcagaacatacctgagacgacaggtagaagacgactgactgcctcgagcagcagagatcagggaggccgagggcgggatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttcttcctcgtcggcgtcgacagcgatgagaatgagttagctatccttgaattcatacatcttctggtggaaactatggatcgccacttcggcaatgtgtgcgagctcgatatcatgttccatctggagaaagtgcacttcatgttggaagagatggtgatgaatggttgcattgtggagacaagtaaacagaacatcttggcaccaatacaacttatggagaaaacttcctaaaatagtgatatccatttgtgtagttttacatccacttcttagcacatttgcctgtctgcccctttccataaaatttccctctgtatgtgagagtgcaaaacaatctctgtaaccatggagtattgaattgacctgattgtgtgctttcagatattcctgtgatcctcttttcatgtatgcattcgatttgctcacatatgtataaaaggtgtattatcttaagaaaagctgatttatctaaaatgtaatttatcgacatatttatatgtattttgttgcagataaattaaaaaaaaagatc

SEQ ID NO: 10928 - DNA, 975 bp, Zea mays
  misc_feature (938)..(938): n is a, c, g, or t
  misc_feature (949)..(949): n is a, c, g, or t
ccggccgggatctcgaggccggccggagaaaaaaaaacgtgctgtcttcccgtctcttcccaatgcggcgtctcgctctcctcttcctcctgcctctcctcctcgccaccggcgtcaccacggcgtcagcggagcccgcgacccctcccgcctctcctcctcctcctcctcctcctcctcctcctcctcctcctcctccaccgcctccgccgaccctcgccgagctcctcccgaagtacggcctgcccccgggcatcttcccctcgaccgtcaccgccttctcgctcgccagcaacggcagcctcaccgtcgacctcgcggggccctgctacgtacacttcgagtacctcacctacttcgagccccacatcacgggggtgctccgctacggctccctctccgacctccagggcatccaggtccgccgcttcctcatctggttcaacgtcatccgcatcaaggtcgacctgcccccgcctccgcgctacgtctacctcgacatcgggtggatcacgcgcaagctccccgccgcggacttccagtcgctccacgcctgcgaggactccaggaggtgccgcctcacctccgcgctcgccgtcgccgccaaatggttccaggacttctttgcccaattttaggggatggggaaggcctacgatttgacaacagcagtggatgagttccctgccttcgagtcttcgacggccgaaaaggatttgtgtgaaccttgaacgagctggaacactgccattgttactctctcttcacgcgatgtagctaatcaagctgttatctcatttgtacatctgtcgacgtttcatcttgtgggttgtgcataaacatgttgaaatttgagaacatgtagcaaacatgatgaagttgcgtgtttcatcatttggtcggaagcttaaagcagtacctcggccgcgacgatcttnttcagcagtanataaagatggggaaaaggaagtttgc

SEQ ID NO: 10929 - DNA, 4097 bp, Zea mays
  misc_feature (400)..(400): n is a, c, g, or t
  misc_feature (1023)..(1023): n is a, c, g, or t
  misc_feature (2000)..(2000): n is a, c, g, or t
ttctatctattataaaaagcatcattccatttttctttggtaattattgcgactacaaaagtgaattatccaaaactatatttctttcacacatatttcccccatatttaacttatctaaaatttaataccacatatacatgcaaatagaaaatagaaattaattgtagtaaccatttatactgaacacttccatccctttctcttctgcttccataaacgaagacattaaaattctttgtttcccaactatatagcttcaaacatggacctctgcgcatcaaagaaaagtcggacaccagatcttccaagaactgaagattttctcagagtatcagcatctttttaggttgtagaatgccttctatataattatatataactgctcaactcttctgaanacatttcatgtaaatataacaaggtagctttaaatattgcaacaaacatattaccttctgccagtgctcacttaacctattttattttatataaatctgttgtgctctaaactgtcttttgctccgtatcatcttaaaaaaaactccttcacttttttagtctggcaatattgcataccatttaccacgcgcgcaaagcgcacacccgttactagttattaaaaaaactctattgatgtgatatatatagaaatcgtagctacaagcatctctagaagtgtctcatactctcatctcatgttcgaggtggcagagtgatttacccgggtcccgggtctcttgctgaataagtgttgtccaaacgtttttaattttaactaaatatatagaatatattatatttatagcatataattaaaagtattagtttgatggtttaatctgtttctataataaatttatttaaatatataatttttgttaatctttttcatgaatttagttaatttttttttaaaaaataatcgatatgtatagttgtatattatactctttccgttttaaaatagtagtcgttttattacttggttttaatgtctatatttaaatagatgatgataaanttatacatatatagaaaacacatacctcaaatatgctatgaagcaattaattatttaaaatagattttaatttgggaaagagtgagtactatactatagctatgcttatttttgggatgcttgttttggaacggatacagtaggttaatagagtgtgaccgcaaaagtaataatgatcagaaggaaacgcgtgtgaagctgaatctaggccgggagagcaggagatgccgccgtcgtgttgcgatcacacgcctgcctgatttcctctcacgtaacttacacccagaagcatacagaacgcgtacaccacaaactcctataatccagcaatgatgcatgcatgcatgtatcttcatcaaaggatgcacgtgtccccgagcaatatgatggcgcattaatgaacacaaatcattcgtgtctgaaacagcaagcggtccattattggagttcacgctgttatcgtcgggcctgctatttcttgtcgtatacattcaaactgtctagagagctccgatgcatttttcgtatgtatttttttattagttagagctccgatgcatactctaggttgtgataattaatatcaaaactgtctagagagcgtaactttttctattactcctaccattttaagttgtactcactttgtcctaaaatacaattcgttttcgtttagatatgtgaaatttaggtacagataagctaatattattttatacataatatatttatatattaccgtagtcatatatgagatatttatacactacatttttattatagatgagtaagtttaaagggtatgtcatgaattacggagtagagtcatggactactgatacatgaatcaatttccacctactcgttcaataaatttgacataggcttatatctaaatattgcaaagtggtgaaatatcaaatttcaaaccaaataacctactatattaataaaatttcaattccttaaaaataaanagatccaaacggctcgtgggtccatacaatacttaatgcatgtgttttatgtatatgtctagatttattattatttatttgaatatagacataaaaatcaagagctaaaacgattaatattttagaacgggattttagacgacgtatagtgcttactgtataaagcgccgacgataaaagttatttacattggaaagggcaaaaaacctacaatttgataccgaggaagtgggttttactcgtagaaaaagatatttatccgctaatttgaaaagagacgtttgatacgtactctcttaaccgtattattaatatgattattaacatttcaaatctgtccgaatgccagaatcaaaaatattaatccataattcctacggaaaagggagggaaatcctggcagacccatctgctgaagacctgaacactactacctccgtcactccaaagggcccggggcacccgagggcccggtttcaacaaaccatcggccaattccgaagaagaagaagcaacaggaatcgtagcagccaaggcaaccgtgagcatgggctccctgggtcctagcgtggtgaccctgcaggaacagcagcagcagcccaagccccgcaaaccggcggcggcgggcggcggctgccacgagctggagcagcagagcagcaactgcggcgggtcgtcgttccggatgccgctgcactacccgcggtacaagaaggcggactacgaggccatgccggagtggcgcgtcgactgcctgctccgcgagtacggcctccccgtcgccggggaccttcgcgggaagcgggagttcgccatgggcgccttcctctggcccggtcagtactgatgaactgtacgtttgatggagtcccagatcgaagcagcatatgcataaggagtcgagattctccccgccggattcaccattttacctacactagacataggatccagtgattcggtatgcatcagctcgttctcgatcgttccatgaaactactataattgtcgtcgctctcctcctcacctcgcgtgcatcgttgtggaatcagtaattcatcagcatctgtacaataccatgtggctgggcagagtatgtattgtcagtacgagttagttatttcatcaaaaatggaataaacataaatattccagcttctatgtctgggattcatatatgtcgccccaaaaatagccgccctaggtgatgaacaaccgagactataaacatcaatctctagttctctttccgcgcccaaggtgtcaatcttaagtcccaattacatgatcaactgagcctctagtatcgatatatagctcaaatcggtactaaagggggtatagcgacatccacatggacttgttctcgagaatcttcaagtacctattggagctaacaactagcactaaagtatgctgattttttagttttatatatttacaaattaatattaatattaacaaacatggagaacaaactagactaaccattcagttataaaaatgtacatggtacaagatagtggacgctaacttaatattgtagtatgtattgtatataatattgcttgtgcacaaacttgaccaatcttttctggacgttgacacgatagtccttatgtttttttggttaacaaccaccggatagataaagcttatattgtaaatcccttccttacgagttacgacatctctggatctctatccttgatccttcacaatatatagtaggtgtaagggcacactatgtagtattgaatatatattattgaatcgtgtacaagagagacagtaaatgcttatagaacccagtagcggaggagagagatgtctagtgcatttcgctagtatatctcaaatatatatactagaaatctaaccacaccacatcaaggccattatgaaagtcagaatcttttaggtcctatcagtggctaacttcatgtaccaatcataaaatctacgcatttgtgttggtaagtgtttcaccgactctagcctcactagaggctttccatgctagcaagtccatgttctttcttgtgatgacacatttttctttggatgtttttatgtgctttactaagcatgtgttca

SEQ ID NO: 10930 - DNA, 1506 bp, Zea mays
ttttttttttttttttctttgggaaaagggaagtttgcaattagtcggggcaacgattggaggtgatctttcccctagaccgagtacaagccttgtttttaatataatataattgtgaaattaatatactaattttgaatttcagtgctatcacgttatttaccgttcacagagacacgaatttgttttaacactagtgttgcccgaagcacgacattacctaaatccctgggtagagaatttagcaacattaccaatgagtagaactccgagcaaagcatagaacctatgtagagttaggtggccgagggtccctgaacaccgaggaggaaccaccagatgcggccggggaaggtgatgtggctacatagttacttcctggcaacgatgctgaataaagagcaggaggttgtcctgggtgtatatttgtggcgaagcgtgatggacttgccgtagagaatgttgccggactccttggagtgtggccctgtagagaaccaaacggtgacctcgcaaaagaggctgttgaaggagagatactgtggaagtgatgcaaggggcgtccaggagtgccctggttggaaccagcatctgaatcgccagcaacatcaccaaaattgacatcaacagtcagttgctgtcggggccaacctagaaacagaacttccatctgttgcgttttctgatggctggggcatggcagcgcgcaatgaagcctgcatgttgcgccttcggatttcttcttcagcatttaagacctgcttcagcatctgcacaaggccatgcttctttttatttagggcgtccagcttttcattaagttttctgttcttgtcatcaattccatcaggataactcgcctcctcctccggctttgggtcaacaccttcactttcaccctgaccttcttccgcatcgccatcaacgactacctcccccgcatcttccatgtccgcgtcctccaccgccccctcctcttcttcctcctgctgttccggatcctccgcctccgcctccacgttcccctgctcctcctgatgttgctggtcctggtcctggtcgtgctgcaactgctcctgctcctcttctcccccgtcgcccgctcctccctcctcgtccggtgcctcccgctcggggtccgcggcgccacggccgccatccatgcccgaggaggacggggaggcctgccccagcggcgtcccggcgaggcgcgcgacagcacggaagcggttgcgcaggaggcggcggaaccgcttcacgtcgagggtcggccggggcgcctcccatcggcgcggggcagaggcgccgctgtcggggccgccaatgtggaggttgccgcggtacatcgagatcgccaccatcctccagtccagggtccctgcccgctccgaccgccgcggcgacgtagggtttggtgggtttctgctccgatgcggtgggcgtgtgtggcgtgtgggtagagatggcaatttttcgattaggatgttctaggtaatggtctcgtgc

SEQ ID NO: 10931 - DNA, 961 bp, Zea mays
gccggccgggctccgggagaaaaaaaaacgtgatgtcttcccgtctcttccaatgcggcgtctcgctctcctcttcctgcctctcctcctcgccaccggcgtcaccacggcgtcggcggagcccgcgacccctcccgcctctcctcctcctcctcctcctcctccaccgcctccgccgatcctcgccgagctcctcccgaagtacggcctgcccccgggcatcttcccctcgaccgtcaccgccttctcgctcgccagcaacggcagcctcaccgtcgacctcgcggggccctgctacgtacacttcgagtacctcacctacttcgagccccacatcacgggggtgctccgctacggctccctctccgacctccagggcatccaggtccgccgcttcctcatctggttcaacgtcatccgcatcaaggtcgacctgcccccgcctccgcgctacgtctacctcgacatcgggtggatcacgcgcaagctccccgccgcggacttccagtcgctccacgcctgcgaggactccaggaggtgccgcctcacctccgcgctcgccgtcgccgccaaatggttccaggacttctttgcccaattttaggggatggggaaggcctacgatttgacaacagcagtggatgagttccctgccttcgagtcttcgacggccgaaaaggatttgtgtgaaccttgaacgagctggaacactgccattgttactctctcttcacgcgatgtagctaatcaagctgttatctcatttgtacatctgtcgacgtttcatcttgtgggttgtgcataaacatgttgaaatttgagacatgtagcaaacatgatgaagttgcgtgtttcatcattaggtcggaaccttaaagcagtaccgcagaaaaataaacaatctttttcagcagtaaataaagatggaaaagggaagtttcagtcaaaaaaaaaaaaaaaa

SEQ ID NO: 10932 - DNA, 760 bp, Zea mays
actcctttgcattggagtagcagcaaagcagagcagctcggccagccagccagtgggtctgttcccgaggcacacacacgcacacacaggtgctgaagcacacggcagttgccttgcctgttcgattgctgcttccttcctcctccctcgagtcttcttctcagcccagagagacagacaccaaggaaaagctggtaggtgccgcttgctctgcctccgatccaacccaacccaaggcggcagcagcagcggcggcgggtacgttcttctcggccatgcatggaatggaacgagggccgcccaccgccggcgccgcctagatctctgcatccggtggccgccattggcggttcttggctccgattcggtgctgcctggtgacgagaaaaagccaaggaaaaaaaaagaaggaagggacggcgattcaggactcactcttgccctgtcgtcgacatgaagtacatgaagcttggatccaagccggacgcctttcagacggaggggaacagtatcaggtctgttgcaactgagctggcagtggatattgttgtcactgtaggggatgtcaagttctaccttcacaagttccctcttctgtccaagagctcccgcctacaaacgctggtggcctcgacaagcgaggagggcagcgacgaggtggacatctccgacatcccgggcggcccggcggcgttcgaggtctgtgccaagttctgctacgggcatgggtggtgacgctcaacgcctacaacgtgctggc

SEQ ID NO: 10933 - DNA, 1288 bp, Zea mays
acggacggacacgggcagcaattcagtcccgcgtcccccggacgcgctcttcccatcgttgaagcccagagagaagggtggcatggctataaacaggcagcgctgtcctcgccccccgccctccccgcccccggtcgtcgtcgtccctcccgaaacaaaagaagctattttgacaccacacacacacacacagaggagagaagataagagaacgaggggcagggcagccagcgccgctagctgaagcaaggcagggcaagagaatccgtacgtcgaggtgcaggtcgtaggtaggatggacgcggaccagcagggcgtggttgcggcggcggtgaagccggcgctggccaaggggacgccgtcggcgtcgttccggctccgcaacgggagcctgaacgcggtgcgcctccgccgcgtgttcgacctgttcgaccgcaacggggacggcgagatcaccgtggacgagctggcgcaggcgctggatgcgctgggcctggacgccgaccgcgccgggctgtccgccaccgtcggcgcctacgtgcccgacggcgccgcgggcctccgcttcgaggacttcgacaagctccaccgcgcgctcggggacgccttcttcggcgcactgggaggccaggacgacgccaccgccgcggcggacggcgccggcgccggcgccgaggaggacgagcaggagatgcgggaggcgttcaaggtcttcgacgtcgatggcgacggcttcatctccgccgctgagctgcaggaggtgctcaagaagctcggcctccccgaggccagcagcatggccaacgtccgggagatgatctgcaacgtcgaccgcgacagcgacggccgcgtcgacttcaacgagttcaagtgcatgatgcaggggatcaccgtctggggcgcctgactgacctcatcgtcgtaccgcgtacgttctgacttctgagtgtgtggcaactggcatgatggtccccgcatttcgtcgagacagtcctgcgtctgcgtctctaattgaattctttagtatcgtccttcacatcactggtctagtggtgatgagaatgccctgtcctgtgtgtgtgtgtcacataaccatggtatgtaatgtcatactggaaattaggtatatgatgatgacagctgataagaaaatgtatcaaactgggctattgtaatcattgtcaaccaatgtcttgggtcgggttagttatccacgatgtgattgaactaacattatgtttggcaaagctgttttagcgattatatagtaaaagtaaatttatttggc

SEQ ID NO: 10934 - DNA, 2168 bp, Zea mays
gagtaaatactcgaacttggcgagctatgtcatttaaacactggacttagaaaactaggtaaatgggttcttgaactttgtcgacccatataaaaatcgtctaaaatcgaatttgctcaaacctgattgtgacctgacatgcgatccagaattttcactagcaagcgtgtagtcgctatagtcatgagtaggaatggtaatgaatcacgatccaaaatatttctcttcataataagttaagacccttaattagttttattttaaaaataaatagaaatatagactaatcatattttgattcgatccttaaattttatattgtaaacatctagatcacattacccccatagtcatgactctcgagtctccatcgatttagtagatatatggagttatggacaccttttcccgagcgtccacctctcccatcccatgtggtgtggcctgtctctggtcctgacgcagcttcttgttccactcgtttcctcgccggctcaagcacgggtggaaatgcgacgaaattgccttttgcatatatacatccccctatgtcttctgcatgcgagcaatgatgtcgtgtgtgtctatccatgcacggaaatttcagaacaaaagtttcagttgggctgggctggtactgcggcaaacataaagccagagagagccggggtgcatcaccgcgtcccccggacgcgctcctccaatcatcgccacagggaaaaagaaggtggcatggcatggctataaacagaaatcagcccgccgtgtcgtgcctactctctccttcccccaaaataaaagaagcgattttgaacggctccgctagctaaagcagggcaaggcggccggaaggcaggaaatccgtacgcacgccgaggtcgaggtcgaggtctcagcagggaggatggaaacggagcagcagggcgtggttgcgggggtgaagccgacgctggccaaggggacgccgtcggcgtcgttccggctccgcaacgggagcctaaacgcggtgcgcctccgccgcgtgttcgacctgttcgaccgcaacggggacggcgagatcacggtggacgagctggcgcaggcgctggacgcgctgggcctcgacgcggaccgcggcgggctggccgccaccgttggcacctacgtgcccgacggcgccgcgggcctccgctttgaggacttcgaccggctgcaccgcgcgctcggggacgccttcttcggagcgctggcgggccaggacgacgcggccgcggacggcgccggcgccggggaggacgacgacgagcaggagatgcgggaggcgttcagggtcttcgacgtcgacggcgacggcttcatctctgccgccgagctgcaggaggtgctcaagaagctcggcctccccgaggccagcagcatggccaacgtccgggagatgatctgcaacgtcgaccgcgacagcgacggccgcgtcgacttcgccgagttcaagtgcatgatgcaggggatcaccgtctggggcgcctgatcgatctcatcgtcgtgggatcggacgagtgtgtgtgtgtcaagcaaattgaacccacaaagctccgcaggacccgtatttccttcctcgagacagcgatgcgaccttcattcttgtcttgtcttgtggtggcaccggtgtgtctctacttgtgtgtgctcttcttttaaattcattaattaatcttgtcgtctttcgctggtcaagcagaggcgatgagaatggttcatgcatgcccggtgcatgttggtggatttgcaagattgcaacccttgcattaacccgatcgcgcctgatctgcttgctatgggccttctgtttttttgtgactggatggccctctgctttgtggaccaaaaagtggttcaggaatagcaatcagttgggctacattttttatgggcatatccatatccgttcccaggtgactatttgacatgtgtgccatttctcaatttccaaacctcattcaaccaatcaattacttcggtacactatcggctaatgtgaaatgctgctgcaatggtatgtattatcgttgctacagtgctagtttattgtattactgctataatattgtgtattatcattccacgaatattgtttgtattattgtctcgtaacttgatactggtgaaatattgaattatggctggccgct

SEQ ID NO: 10935 - DNA, 2660 bp, Zea mays
tctataataataataataataataataataataataataaaacaaaacagtgaagctagtttttgtgccaacgtttgtaattcgcaccatcaattatatttggaatttatcgttaatgcaaagccagctctaccgaatgcgtaaggttttttgactgttagatatttaaggattttatggtatattttaattacaaaattatttagataaatcaggaacatatatattgccaatgaagcagtgcaatcatattaggtgtacgtgtttatgtttattatcattataggctggcgtttggtttccccgagataatacgacctgcagcgggtggggtatccgaggaaatacgctgcgagctcctgattgtgagattctgccagtagaaaatgcgctgttcatttttacttcttcgcgaagaaggaagaaggaacagctcatctatcagtgttctcagtattagattcccattatcccctgtaaatcaaacacggccataatcatgaacaatataaaaatgagaagtttaaggatgtgtacatgatgtgtcgctgttggttggggtgggggggttatgactcacatgtcgcgttcatatatgtccagctgataaatggattaggatccctcataaaataaatataaatactaaccacctttatagactgtacccttaggggtcgagtttaaaacgaaaaatgggcgcgcggttgagatcagtcaagtccgacatccgtgctatttccctatcgcgttgctaccttgtacatccgatttgttgtgagctgtactactgtgcgtgtatgtgtactgtacatgtaggatggtctagttgcttcgtgacgtcgctttctgcttcgcatattcacatgccccacgtgcccacgtgggaagcctcaggcggccgcgtaaatgttagataaactatgcgtcgcggtcggttctctagtcggcaaggcatgatccacaccgcttatccgtcgccggcggtgacggtggtcggcggcaaggtcggcaccgcctcggttcctcacgagtcacgacctcctatgagaaattcatggtttagttaacagttggaccaccgtgttatttttcttcttgttttttttttacgtttacgcgagggattaaaaacccaccaacgacccaaaagagaaggggcgaaaaaataatctagaacagaaaaacaaagcgcgacaaaacaacaaaatgtcgtgggtaattaggagtgtttgattgctataaaactaatatttagctgctcaaattagtatagtacttttagtaaattagttattcattatctagctattggttagctagctaattttattagtaaattttagttagataactattagttctagtagaatcaaacaccttttaaaaaagttataacaaaacggaaataacgggagaaaagaaatggaagaaattaggataggaagtgtagacggatgagagctagcacggatatacacagtttggatcggattatttagagattacttgcatgtactagagctattatgacgtaaacgctatattaacataaaaaatatccctatataggatttgagttgcaccgatcataaagcatgcgcaccgatcataaagcatgcaaggagtacaaaccctgtagagtgtagaccgaccggataccctggtggcaaagatggctaggacgacaaaaaaaaaagcagtgacgtgtacggcatacaacaccatgagaatacgcaagtggacgagtcgcaaaggaattaacggcagaatatataccatgaatatagatatcagcgatgcatttttccgtccacgtttttgaagcaaaacctgccatagcccataggccagtcttttttctgtgggccgtgtgcgcagtggctttatcccggccgtcacgctcacgccgctgtcgactccgccgtgcgcaacactataaaaaagaacagctcccgccgcggccgcgagaagacttcacaagaatctactcgtcgagtcaccaaagataaggctctatcggactcggagtctcggacagcacagcaaagcaagagccgctactcaagtatagtctgacaccggccgaccctgccccaacccaagccatggcggacaacaacaaccggcggaaccacgggcagaccttgctcgccggcgcgggcctgggcctgctcgccgtgaactcgggcctcgccatctaccgcgcgaggggcgacacggccgccgtcctcttcgtcgcggggtcctgcgccaccctgctcctcctcttcgcctgcctccgcgcctacgagcgggcggcgcccgggtcgccggcccgggaccgggcgcggcgcgccgtgtggccgctcgccacgctgctcacgctctcgttcgcctggaaggtggcggcggccatgccttccgccgccgcggccgccctcgtatggggcctggccgtggccaccaccgccggcggcttcgtggccctgtacgtgcagcaggcatgaacacgtgggcgcgggacggactaggcaagcagctgcagacttgcagctcgttcagggatctagatctgggcgccgcgcgcctgtgtagaaatgtacagtgtatttggctagcttttcgattttgtgcatatgtatgtagctgactggctgataccaaaaaaaaaaaaaaaa

SEQ ID NO: 10936 - DNA, 2900 bp, Zea mays
ccggccgggggggcaacaagccacaaatccgaaaccctcgcatcggcctgtacctagccgccgtcgccacagagccctcatctcgtccgtcctcggcggcctccgcggagcagccgtcgctggagcctggagaccaaagatccggccagatctgatgtcaggagggactggctcatccgggcgcgcggccccgcggtacgccccggatgacccgacgctgcccaagccgtggcgcggcctcgtcgacggcaccaccggctacctctactactggaacccggagacgaacgtcacgcagtacgagcggcctgtgccccccgagagccagctcctcccgcctccgcctccgttgccacccccgcctccacggagccgcgaccgccgcgacaggtccagatcccgatcccgcaccccaccccggcgcgaccacagggaccgcgaccgtgaccgtgacaggcgccacgacgagcacgcgtcctccaagacggcgtcttcccaccaccatccggctccggtagccgtcgccgacgatccttccaccgaggcataccgccgccgccatgagatcaccgtcacgggggataatgtgccgactccaataacttcatttgaggctggtggcttcccgtcagaaattctgaaggagatacaacgtgctggattcgcaagcccaacacctatccaagcccagtcatggccaattgctatgcaaaatcaagatgtagtagctattgcaaagactggatcaggcaaaactcttgggtatctacttcctgggtttatgcatatcaagcgcctgcagaacagcactaggaatggcccaacagtgctagttttggccccaacaagggaacttgcaacacagattctggatgaagctgtgaaatttggaagatcttcaagaatttcttgcacgtgcttatatggtggtgctcctaaaggtcctcagttgagagatttagatagaggggttgatgttgttgttgcaacacctggaaggttaaatgacatcttggagatgcgaaaggtaagtcttaagcaagtgtcatatcttgttctggatgaggctgatcgcatgctggacatgggctttgagccacaaatacggaagatagtgaaagagatacctcaccgtcggcaaacccttatgtacaccgctacatggcccaaggaagtccgaaggattgcagatgatcttcttgttcatcctgtacaggtgacaattggaagtgttgattcacttgttgctaatagttctattactcagcatgtagagatcataacaccctcagaaaaacaacggcgcctggagcagatattacgatcccaggattcaggttcaaagatattaatattttgtaccaccaagaggatgtgtgaccaacttgcaaggacactcaccaggcagtttggagcttcggccattcatggtgacaagtcccaaagtgaaagggagaaggttctgaatcagtttcgatctgggcggtctcccattttagtggcaactgatgttgctgcgcgaggtttggacatcaaagatatcagggtagtgatcaactatgacttccccactggtgttgaagactacgttcacaggattggcaggacaggaagggctggtgccactggtgttgcatatacatttttttgtgatcaggattcaaaatatgctgctgacctaatcaaaattctggaaggggcaaaccaacgagtgccccgtgatttagaggatatggcttctcgtggcggtggacgaggtaggaagaggaaccattgggcatcccgccctgacaggggtggttcacgttctgaactggattcaaggtacagcagcagagatggactagcatcttctgggaaatcagagagtggtcgcggcagtcgtggaagggatgataatggtagccgtggcaggtacgaccctggtgaaaccgatgggcgatctcgtaggtctactagaggccgcagtagaagccgtagcaaaagtgacagtagaagccgtagcccaagtcccaagaagtcacgtcgtcatgaaggtagacgtagcaggactaagagcaggagcaggagcaggagccgtagaaatcatggcgctagccacagcaagagtcgcagccctgtcgctagccgtaggtatgaaaagactgcttcaggatctgctcggcctaactcggggcatgcagagcacaaaagccctccaagatctcactctagggatgaccatgtgaaccactctgaccacaaggatgaccacaaggatgaccacatggaagatgggaagatggaaagggttgatcttgatcgctcgcccagcccacacgatgacaagtctgctccatatagtcctgtgtacaatggcaaagccagtggctcaatgagccccaacggtcagccagaggcaggtgccaaatttgttgaaccttctgggaaacctgagcctgcatctccagtgcgctgcagcaaaggcagagatgatgatgaggaaggtatcatagacgaggatggagagattggtgaggatgatccgcgtgcaaatgcagctgtgcagaatggtaataactgacggagagtggcctgcatcttctgtgacaaccaagacttatctgttatgcaaaatgcagtcattcccatctgcaagtcctgaatacggaaatgcatttgtgtgccattaaatatctcgtagaacatgtgatactgatgcctctgccatcgatgaaccaaaactgttgatgcatgtcatgtcatgttgttaaacttaatgacattgttgtgttctggtgttttacagccagttctgtaagtgatttatgataaaatatattgtcaggtctggaagtggtagtttatgataactagcaaagttatgttgctacggtttctatttataaagtatagaatat

SEQ ID NO: 10937 - DNA, 1746 bp, Zea mays
gtcctcagttgagagatttagatagaggggttgatgttgttgttgcaacacctggaaggttaaatgacatcttggagatgcgaaaggtgacaattggaagtgttgattcacttgttgctaatagttctattactcagcatatagagatcataacaccctcagaaaaacaacggcgcctggagcagatattacgatcccaggattcaggttcaaagatattaatattttgtaccaccaagaggatgtgtgaccaacttgcaaggacactcaccaggcagtttggagcttcggccattcatggtgacaagtcccaaagtgaaagggagaaggttctgaatcagtttcgatctgggcggtctcccattttagtggcaactgatgttgctgcgcgaggtttggacatcaaagatatcagggtagtgatcaactatgacttccccactggtgttgaagactacgttcacaggattggcaggacaggaagggctggtgccactggtgttgcatatacatttttttgtgatcaggattcaaaatatgctgctgacctaatcaaaattctggaaggggcaaaccaacgagtgccccgtgatttagaggatatggcttctcgtggcggtggacgaggtaggaagaggaaccattgggcatcccgccctgacaggggtggttcacgttctgaactggattcaaggtacagcagcagagatggactagcatcttctgggaaatcagagagtggtcgtggcagtcgtggaagggatgataatggtagccgtggcaggtacgaccctggtgaaaccgatgggcgatctcgtaggtctactagaggccgcagtagaagccgtagcaaaagtgacagtagaagccgtagcccaagtcccaagaagtcacgtcgtcatgaaggtagacgtagcaggactaagagcaggagcaggagcaggagccgtagaaatcatggtgctagccacagcaagagtcccagccctgtcgctagccgcaggtatgaaaagactgcttcaggatctgctcggcctaactcggggcatgcagagcacaaaagccctccaagatctcactctagggatgaccatgtgaaccactctgaccacaaggatgaccacatggaagatgggaagatggaaagggttgatcttgatcgctcgcccagcccacacgatgacaagtctgctccatatagtcctgtgtacaatggcaaagccagtggctcaatgagccccaacggtcagccagaggcaggtgccaaatttgttgaaccttctgggaaacctgagcctgcatctccagtgcgctgcagcaaaggcagagatgatgatgaggaaggtatcatagacgaggatggagagattggtgaggatgatccgcgtgcaaatgcagctgtgcagaatggtaataactgacggagagtggcctgcatcttctgtgacaaccaagacttatctgttatgcaaaatgcagtcattcccatctgcaagtcctgaatacggaaatgcatttgtgtgccattaaatatctcgtagaacatgtgatactgatgcctctgccatcgatgaaccaaaactgttgatgcatgtcatgtcatgttgttaaacttaatgacattgttgtgttctggtgttttacagccagttctgtaagtgatttttgataaaataaaaaaaaaaaaaaaaaaaaaaaaaaaaaaaaaaaaaaaaaaaaaaaaaaaaaaaaaaaaactcgaggggg

SEQ ID NO: 10938 - DNA, 1227 bp, Zea mays
gcacgagaccattacctagaacatcctaatcgaaaattttgtgatcaggattcaaaatatgctgctgacctaatcaaaattctggaaggggcaaaccaacgagtgccccgtgatttagaggatatggcttctctcgcggtggacgaggtaggaagaggaaccattgggcatcccgccctgacaggggtggttcacgttctgaactggattcaaggtacagcagcagagatggactagcatcttctgggaaatcagagagtggtcgcggcagtcgtggaagggatgataatggtagccgtggcaggtacgaccctggtgaaaccgatgggcgatctcgtaggtcagctagaggtcgcagtagaagccgtagcaaaagtgacagtagaagccgtagcccaagtcccaagaagtcacgtcgtcatgaaggtagacgtagcaggactaggagcaggagcaggagccgtagaaatcatggtgctagccacagcaagagtcgcagccctgtcgctagccgtaggtatgaaaagactgcttcaggatctgctcggcctaactcggggcatgcagagcacaaaagccctccaagatctcactctagggatgaccatgtgaaccactctgaccacaaggatgaccacatggaagatgggaagatggaaagggttgatcttgatcgctcgcccagcccacacgatgacaagtctgctccatatagtcctgtgtacaatggcaaagccagtggctcaatgagccccaacggtcagccagaggcaggtgccaaatttgttgaaccttctgggaaacctgagcctgcatctccagtgcgccgcagcaaaggcagagatgatgatgaggaaggtatcatagacgaggatggagagattggtgaggatgatccgcgtgcaaatgcagctgtgcagaatggtaataactgacggagagtggcctgcatcttctgtgataaccaagacttatctgttatgcaaaatgcagtcattcccatctgcaagtcctgaatacggaaatgcatttgtgtgccattaaatatctcgtagaacatgtgatactgatgcctctgccatcgatgaaccaaaactgttgatgcatgtcatgtcatgttgttaaacttaatgacattgttgtgttctggtgttttacagccagttctgtaagtgatttatgataaaatatattgtcaggtctggaagtggtagtttaaaagcggcc

SEQ ID NO: 10939 - DNA, 1161 bp, Zea mays
agtgtttcattttttagaagaatcagattggaggttatgatttcaaattagtaataagatcagcatatctgaagttcgttttttttagaagaatctaattcaaggttatgatactcagtccatatgctgaccctgattgattttttgtgatgctaacaggtatgactctggtgaaactcgtccgcgatctcgtaggtctgctagaggtcgcagtagaagtcgtagcccaagccccaagaggtcacaccatcatgaagctaggcgtagccgcagcaggagcaggagccgaagctgtagaaactttcgtgctagccgcagcaagagtcacagccctgttgctagcagtaggcatgaaaaggctgctgttatttcaggatctactcaacctaacttggggtatgcagagcacaaaagccctccaagatctcactctggggatgaccatgtgaaccaccctgaccaaaaggatgaccacatgggagatgggaagatggaaagggttgatcttgatcgctcgcccagcccacaatatgacaagtctgctccatatagtcctgcgtacaatggcaaagccagtgactcgatgagccctaatgttcagccaaaggcagatgccaaatatgtcaaaccttctgggaaacctgagcctgcatctccattgcgccacagcaaaggcagagatgatgatgaaggtatcatagacgacgatggagagattgctgagggtgagatgatgatgaaggtatcatagacgaggatggagagattgctgagcgtgatttgcgtgcaagtgcagctgtgtagagaatggtaataactgacggagaatggcctgcatcttctgtgacaacaagactgttatgcaaactgcagtcgttcccatctgcaagagtccagaatgtagaaatgcatttgtgccattaaatgtctcgtaggacctatgataatacatctgccatatatgaacaaaaactgttgatgtatgtcctgttgtttgttaaacttcaatgacttgtgttctggtgtcttactgctagttctgttaagtgatttatgataaaacatattgtcaggtctggaagtgataaatttatgataattgtcaggtctggaagtagtttattatattggcagccccctggttggagatccccaccttgc

SEQ ID NO: 10940 - DNA, 1562 bp, Zea mays
acgagaccccggccaagccaagatccaaagcacgcacgcattcccagcgtccggcacacggaggggtcgcgtttctctagtctcgttctccactctcagtgactcaggcgacccgcggccgaccatgcgggcagcagcggcgtccctggtgctggtaccccgcctcgccctcttcgtcctgctgctgtccggctccggcgtgccgactgccctgtcgaagtcgacgctggagtcctgcgcctcctccagcgcctgcccggcgctgctctcctacacgctgtacgcggacctgaagcttgcggagctggccgcgctgttcgcggccgacccgctggccatcctggccgccaacgccatggacttcgcggtcccggacccgggcgaccgcatcctcccggcggggctcgcgctgcgcgtgccggtgccgtgcgcctgctccgacggcatccgcaaggccacctccgcgcggtacgtggcgcgggcgggggacacgctggcgtccgtggccggcagcgtctacggcgggctcaccacggccgactggatccgcgactccaacggcatggccgaggaggaggacgccgccctcgacgccgggaccacgctgttcgtgccgctgcactgcgcctgcttcggcggcgccgacagcggcgcccccgccgtgttcctgacgtacccggtggccgagggcgacaccgtgccggccatcgcgcggaggttccgcaccacgggcaacgacctgatgagcgtcaacgacctggccaccgccgacgtcgccgccggggacatcatcgtcgtgccgctgcccgcgtgcgcctcgtcgttccccgcgttcgcgtcggacgccggcctggcggtggccaacgggacgtacgcggtcaccgccaaccgctgcgtgcagtgcagctgcggccctggaaacctggacctgttctgcgtgccggcgccgctggccgactccacgtgctccagcatgcagtgcagcaacagcagcatgatgctcggcaacttcaccctcctcatgaccagcgccggctgcagcgtcacctcctgcagctacggcgggtacgccaacgggaccatcctcgccacgttaaccacgtcgctgaaaccccagtgcccaggcccgcaccagttccctccgctgatgccgccgccgacgtcgtcgttcttcgagacctacctcggcccgtcgccgacgccgatggcgtccgaaggcggcatgggtccgcagatggctggcatggcgccgacaagcagcccgccggtgagttcagggccgccgacggcaggttcacacgtcggcagtgacgctcttgcacaggtcgcttatctctgcctcgtcgccagcctgctgtggtagactggtagatgggctgcctgcgagatcggaaaggggattcttttgtacgggagcagtcagttatttttctgcgcggcgtgtaattttttttgtcatccttcgttctatctgtcgtccatcatgtattatcgcgaactcatgcaaatacggagtactgtattcgtctacgaaggaaggtgacaatggccggggattgtgt

SEQ ID NO: 10941 - DNA, 1322 bp, Zea mays
gcatgttgattggaagagctcttgccattgacggcattggaaggggtcgactctattagtcatgaaatgacctacagaatacagattgcatcacagaaacttttttttttttttttcaagtaagacactgagcaacttgaatgcaggtaaaccgtacctggggcaggagatccccctcaccagtaataaagttttaacattcaaaggactatgtatttacagcgtttgagactggatcaaccagcaatgatagatcaggtaaatatatggcggaggaggcctcctgagtaagagaacgacttctccgtctcctccaggcagtggtccttctcctcccgagaccagctcgaagcgacttggttaagcttgttgcggacgttctgcagcagctaggagagattgccctcccacttgtagaactccagctctttgttgttcagaatcttctcggaaacctttttgccaatcattcggcctccagcagtatgagcaaagtacacgttatagaaatggcagataaaggcctgggggtcctcctcagacagctcttccagtagagaagcgtatgtggtgccaggagccgatggttctggaattgtgtggccctgttgcctgaaccattccagatcatttttcagcgcctctgatctctccagcccagtattccgaaactctgcataccacgggacggcggcgcgctcgacaatggcttcgagcgtctggaagacgagcttgctgtcgacgaggaatcggaggtacccctcgacggagggctcccacttggcgacggggggcgcctggggctccttctccccctcccgggcctggtccttggtgtggagcttcatcgcgaccgcccgcatctcctccacgaacggcttgctcccttcttccccgctcgccgcgggcgccatctccgtcgccgccgccgcggcgaccagcctcctctgcgccgtggccgccgcgacagacaccaccccggtcacgggccgggctgagacggagacggacaggctgctccaccttccggaggagactctagcgggcgcgagcagcgagagggcgttggccgcggagagagctgccggtgcgggcgccatggccgcggtggcttgtattgagcgctgaatcgctgatgctagggtaccgtgctggggaagcgaaggcgccgctgaagaacgacggcgacggaggaggaggactgtggcgggccgcggtggagtgcagtgttggtgtggccgtgtggcggatgcccgagcgggtgggagagcgaggagcagaggaggcgggggagggaaagggaatagaataaccgggggaac

SEQ ID NO: 10942 - DNA, 3590 bp, Zea mays
tgtttaggccgtcgagcgttggccgcgcgtcgtatacgaagtccgagcccgacccgcaacccgaaacccgtctcgcctcgccaaggcaaggcttcctttcctctcccttcccgtccaagatggaagcagagtacccccaccagcaggcggccccctcttactccacgaccgccaccgtcttctggccgtacgcgactcgccgcagaaagagagccgaggacggcagcgacctctcgctggcgtcggatatggatctcgacgccgacgcgcagcgcgccgcagataagctgaaagcagtgtcagaggaacttggacatgagatccgggttttttcaagtgagaactttgctctacaaccgagcaagctgcctagtgcagatcatgaggaaggtgacgacttttatgagcttcagcctgctgattactacaacttgatttcaaacaggatgggagagctatctaaaatgctaaagactcgcaagatgcgggaagcagaacttgctgctcagcgagcaaagcgaacaaaggcagtaatgagggtgcgattccctgatggctacatacttgaggctgactttcttccatcagagaggattcatagtctagtggacctgctcatgaaagtacttgctagaccagatctgccattctatctctatacagtacctccaaagaagcgaatactggacacatcacaggacttctatacatctggttttgttcctggagctaatgttcatttttcttatgatctgcccgaaggttttgttgttaaatgcagatgatctaaaagcaggacccttcctccgtgaaggaattctaagtttggatggattgtcacttctgctgaaacctgctagtcaacctgatgattctagaatgaactcttctactcatcaatctggtgcatctcaatctgaccctgtaccaacaacaaataagaagcctggcagaccaaagtggctgaaaaggtaaaatccagaataatcttcttgccattgtggtacaatagttaaaaggagaaaaacttgtcaagtttctggggataattccaattccttatcaatcttcttaagcaatgatacacagctctcatgcgtatttgagaagaataattccttatcgtcttttggtaagttagcatatgcccttgctatccactgtttcagaacattgttagaacttgcaaggagcttttaaattgcagtttcattttagtgcgtgcatctcatactatcttgattgttgaaccaaccccacccaccatagggttatgtctcgtgataattctgtttgcttgaactccatttcccatctagctattttgtttcggaacatcttttgcctttgcaagaccacgacaaaataactggtacccacttgttgcaggtgataccactccaggcgtcaggtgtgtgctttcaacacagaatcagtctgtaaacactattcatggttgaacaagtttaaagtttggacagactacactgctgcagtacaaggattggaccctctgcccactgaagctgttgggggcattataattggggccccacctttttgtaggtgggagacaagtagcatgtaaacttgaatgtgttgctgactcaaacagaacagtgctctgctctggctaagcacctggccatcttacacatcgtgtaagccccatagtaacttgaatgtgttacacatcgtgtgcctgtgtttgctatccagtcttttacacagcatttcaggaaacagaaagtgcttgaaagtgtaccaagtgtggccgtgtggggtttcagttcgcccatgatattgtggcaagtcgctttcttgtgattgatggtgatggtgccctcaccagcgactaatttgtcgccaaatggcatgtgttttcttcttatgatggtgacttgctgtccagctataccctgtgtggttgtgatttgtggtttatattcaacgtccaggacctgatgttctgaggttgacggggggtatctggaggctgggttgctgatctttttctctttatttttcttgtatataggtcactagtagttgtgtggttggaacttgaggtttgggggaggctgcctatatgtggctgtccctgtcgctagatatctgtgtttatcttgcaatcctgtatggtcacacacatttggcgctttgggcggtgcatgtgtaggaactaaactagtgcgtccgcaaacgtcctgatcagatcaaatggcaccatgtaaaggaccgaggtgagatggaatcataagcgaacgagtggagtgcatagcatcaggcaccaccaagtaacagaaatataatctattgtctcttcgtctaaactgtaagtcgtcactcaatatttgtgtgatccgaatactttggggtcacagctttcagatgcaattgccatctttcacacgcaaaagacaaaacaacacatatcagacgtggtctaccaaacacataatttacacattaagctacatctggacttaaatcagatgcactcaagtatcaaacaacctataagaaaaatatagttgggtccatttaaatttggattttggtgtttgatgatcaacaatatcatttgaatcaatgacatttaacaatatataagatataatttaagtagatgaaaggtgaactatttagacaaagtgacgatccaaatgaccaacacctcaaataaggtattggtaaccatgttgaaaacctgcaagacatgttggaagtttaaggatctgtttgatatgctatctaacttgctacaactacactttgccttactttttatgccaaagtccagttcttcaatggttgactaaccttagacaagttgtatcgcggttagccgcgaaccaaacagaccctaagagaccaataaataaaagtcagacacaaagacaaacaaaatttaagttgagttgaagttatgcctaaaatacaaaagcgtgacacgttgaaaataggatagcatatggttcgacgctccatggatgattgtccgacgatcatgtctgatgcactcttctttagctagttacggttggtttctagggcatagtccaacgcttccctcgagacggttcaacgctcttcaaacccttctcttgcttcgcttctttgtgatctttgtatccgacttggtcccacctcgtgtcttggactcttgaatgttattgtagatctttaatgagtctcttaatatcttgctcaagatgctgatattcttaatcattatttgcctttgtgttaagttcatgttgtattcttcgaactagatctataaacactaacaaataatgttagtttaaatggatatgttaaccatcaaacacataaactcaattattaaatgagccttggtctattttctcatatagggtagaagagaggggggtaagaatgatgagcgtgactcctaatatgcattagtcctacatttcttctactcacccgtagggatgtcaatgaaaaattattcgttcatttatcctcatccccgtgaggtaaaaaattatttcttcatttatctacgaacactaacggaagagttttttcttccatctctgctcccaaaaagggaatttctc

SEQ ID NO: 10943 - DNA, 1375 bp, Zea mays
cacagtcagcggcatcgctcagcgtttacccaacaccagcaatgcagggaggttgattcaacacttggcaacttgtttgcaggtaaaacgtatctgggggagggagatccccctcaccagtaataaagttttaacagtcaaaggttatgtatgtacagcgtttgaaactggatcagccaacagtgttaaatcaggtgaatatgtggcggaggaggcctcctgagtaggcgaacgacttctccgtctcctccaggcagtgatccttctcctcccgagaccagcttgaagcgacttggttaagcttgttgcggacgttctgcagcagctgggagagattgccctcccacttgtagaactccagctctttcttgtccagaatcttctcagaaacctttttgccaatcattcggcctccagcagtatgagcaaagtagacgttatagaaatggcagataaatgcctgggggtccttctcagacagttcttccagtagagtagcgtatgtggtgccagggggcgatggttctggaattgtgtggccctgttgcctgaaccattccagatcctttttgagtgcctctgatctctccagcccagtgttccggaactctgcataccaagggacggcggagcgctcgacgatggcctcgagcgtctggaagacgagcttgctgtcgacgaggaatcggaggtagccctcgacggagggctcccacttggcgacggggggcgcctgaggctccttctccccctcgcgggcctggtccttggtgtgcagcttcatcgcgaccgcccgcatctcctccacgaagggcttgctcccatcctccccgctcgccgcgggcgccatctccgtggccgctgccgcggcgaccagcctcctctgcgccgtgaccgctgccgcggacgcgacagacaccacccgggacacggaccgcgcagcggcggagacagacaggctcctgttccacctcccggaggtgactctagcaggcgcgggcagggagagggcgttgggcgcggagagcgatgccggtgcgggcgccatggctagaccgcggtgccttatagcgtgcgctggcgctaggggtaccgtgctggggaagcgacggcaccgatgacggacgacagcgacgcggaggcggggactgtggcggtggagtgcggttttggtgtggcggcacagagggggggtgcgtgtgggagcccgtcagcgcgagcgaggagaataggaggcggggtgggaatgagaaccgggggaacggattggaacggcctcgccggctggggaagacgatggcgccgaatgttggtagtagtagtagactagttgcaaagctttaccggtgttgctttggtattagtcactggctgt

SEQ ID NO: 10944 - DNA, 2313 bp, Zea mays
  misc_feature (2288)..(2288): n is a, c, g, or t
ttttttttttttttttttttctttttttttttttttttttttgtaaagtgtagtagtttgaaataggagtgagatcgtgagtgtggtgacataatcttactccgcgacagccgacgaccagtgtcggcggtgctttcatccaacgaacatctgacagatacagaaaactctacgtgtaacatactacacgacaccgcaccaaaagcattacagtcgcaagcggagggctgccatcggcaacaagagaaatcgccctcggatgctacagtaaacccactacttcacgccaacacaacacgtatgacgtatctggtccgcacagacgagcggactcttcatatctttgctgggacagctatcgggatgatatcgaatatggcgctgctgccgtcgaccaccattcccttgaccacctccacgccagcgcgatcagccgcggacgccgttgccctcttagctccggcaacgtggtgcgaccggcggtcgaccagcagggccctcccgatcttggacgggctcgacagctgcgccggcgagaagctcggcgtggcgtacgccgtcgcgtacggcgtgcccgaggcaggcaccgccgtggcctgcttgctgccgttgctcttgcacgcaaccttcgcgtccgctccggcggacgggatgctgtcagctggttgcttgctcagctcgtcgacgttgagcaggtcgtcgatccgcgcgatgatgttggaggccaggctctccaggaccctcgagtagctctcgaggatcgatttgcccacgtccttgttgtactggatcttgctcatgtccaagctcgtctgagtgagcccggggaaccgctgcttgagggacatgagcagcgcctccgcgcgctcggcgagcaggtccctcttctccgtgtccatgaccatgtccttcacgatgccccaggacgatctggcgccgccgccccccttccggcgccacacgtagatggaggcctcgacgcggttggcgatctccagcgcctggtattccgacgacaggtcgaggcagtcgaggaggcagtcctgggagaactggtccgaggtgatgtaccggtagatgacgtcgcccagcgccgcgcgcccgttctttggcagcgagtcgaggtaggagaccggcacggccatctcggccagtgcgttgctgttgatggccatggcggccttgaggatctggctggcgcagtcgcgacggtgctccagctgcctccgcgtggcctcgcggagaccgccgtggggcacgtgcggcaccggcagccaccacttgtcgtcgcggcggtggaacgttctccggtaggacgcggagctgtcgcagtccggcgcacagatgccctggtccacgtaccagaactcgacgtccctgaaaccttccaggatttcgaggagcatgttgtctagcttccgaagcgccggcaggttgatgtacagatcagaccgcggcctgcttgtcatgatctcaagccttgtaccatccgggaatgtctgccacgtgggcaccagctccacgatgtggtcgctgacgcagagcaggcagtccaactcgcgccgccacatggccttcttctccggcggcagcggctccagcctccagagctggccgaacaccgtcgcgcagaggttggtgacggcgttggagatggcgagcgcggtgcagacgcccttgccgctcccggacatgtcctcgccgagcagcagcttggagaaccgctccttcatcatctccatctctgatgctcctccgtgcctgtcggccgcggcgacgacgccgcgcggcttctggtccttgccgccgccgccgcccgcggcgtcggccgacacagacacgcaggtcttgatgatggccaccttgtgccactcgtcgggcggggccggggagtacgtgcaggagaagctggaggcggcgtcggagctggcgctggagctgctcccgcggcgcccctcctcgtcggctgagtccgccgtcagcgcctcgctagccgccctcccctccccgcccgcgcccgcgcccgccgtgccacctctcgccatcgccggtcgagcgagtgacgaatgcgtggctgccttagctgcctctatgactatgaggacgcgtcggtcgttgtttcccgggagcacgagcgcggaggcccaggccccggctaggctagatacgccggcgagcgactacggttgtggcgtgcggcgagagggacaggcaggctggatcctcgtggggtggaagtggaatggtggatgcgatgaaagagagcttgtgacgagtttttcgattangatgttctaggtaatggtctcgtgc

SEQ ID NO: 10945 - DNA, 1392 bp, Zea mays
ctcgaggaagatggagtacccccaccagcaggcgggcccttcctccacgaccatcaccctcatctgtccgtacgcgactcgccgcaggaagagggccgcgggcgacgacctctcgtcggcggtggacatggatgtcgacgccgacgcgcagcgcgccacggacaagctgaaagcagtgtcagaggcacttgggcatgagatccgggttttttcaagtgagaactttgcttcacaaaccagcaagttgcctagtgcagatcatgaggaagatgacgacttttatgagcttcagcctgctgattactacaacttgatttcaaacaggatgggaggtagaaaatattgtttcggactttagttatttagtgtcaacttagtttaatatattgaccaacctgaattattttgcattctgatttacttacggtagcactgttgaaaatggcaaatttgtgcagagcactttaaaatgctgaagactcgcaagatgcgggaagcagaacttgctgctcagcgagcaaagagaacaaaaacagtaatgagggtgcgtttcccggatggctacatccttgaggctgactttattccatcagagaggatacatagtctagtggacctgctcttgaaagtacttgctagaccagatctgccattctaatctttatacagtacctccaaaggagcgaatactggacacatcacagggcctctatacagctggttttgtccctggggctaatgttcatttttcttatgatctccctgaagattcgttgttaaatgcagatgatctaaaagcaggaccctttctccgcgaagaaattctaagtttggatggattgtcacttctgctgaaacctgctagtcaacctgatgattctagaatgaactcttcttctcttcaatctgatgcatctcaatctgttcctgtaccaacaacaacaaataagaagcctggcagaccaaagtggctgaaaaggtgataccactccaggtgtcaagtgtatgccatcaacacagaatcactctgttaggcttctaaacactattaatggccgaacaagctcaaatctgaacagggtacactgctgtagtacaagaattggatcctctgcttacagaagctgcaggggcattagaaatagaatcccacctttttttctaggtgggagccaagtagcatgtaaatttgaatgtgtcgcgactcatcaagtcatcagaacagtgctcccctgtggctaagcactttgtcatcttacatttcgtgtaaaccccataggaagttagaaacggcggagataatagtccagtgttgttaacgcttcacggtgcaatgccatgcctgtcttcactattcagtcttgacaacaatacattccagttctggaggac

SEQ ID NO: 10946 - DNA, 1394 bp, Zea mays
cattgggtacctcgaggccgcccgggagagtacccccaccagcaggcggccccctcttactccacgaccaccaccgtcttctggccgcacgcgactcgccgcagaaagagagccgaggacggcagcgacctctcgctggcgtcggatatggatctcgacgccgacgcgcagcgcgccgcagacaagctgaaagcagtgtcagaggaacttggacatgagatccgggttttttcaagtgagaactttgctctacaacccagcaagctgcctagtgcagatcatgaggaaggtgacgacttttatgagcttcagcctgctgattactacaacttgatttcaaacaggatgggagagctatccaaaatgctaaagactcgcaagatgcgggaagcagaacttgctgctcagcgagcaaagcgaacaaaggcagtaatgagggtgcgattccctgatggctacatacttgaggctgactttcttccatcagagaggattcatagtctagtggacctgctcatgaaagtacttgctagaccagatctgccattctatctctatacagtacctccaaagaagcgaatactggacacatcacaggacttctatacatctggttttgttcctggagctaatgttcattttgcttatgatctgcccgaaggtttgttgttaaatgcagatgatctaaaagcaggacccttcctccgtgaaggaattctaagtttggatggattgtcacttctgctgaaacctgctagtcaacctgatgattctagaatgaactcttctactcatcaatctggtgcatctcaatctgaccctgtaccaacaacaaataagaagcctggcagaccaaagtggctgaaaaggtgataccactccaggcgtcaggtgtgtgctttcaacacagaatcagtctgtaaacactattcatggctgagcaagttcaaagtttggacagcctacactgctgtagtacaaggattggaccctctgcccactgaagctgttgggggcattataattggggccccacctttttgtaggtgggagacaagtagcatgtaaacttgaatgtgttgctgactcaaacagaacagtgctctgctctggctaagcacctggccatcttacacatcgtgtaagccccatagtaacttgaatgtgttactcatcgtgtgcctgtctttgctatccagtctttacacagcatttcaggaaacagaaaccgccctcagcggccaccaagtgtggccgtgtggggtttcagttcgcccatgatattgtggcaagtcgctttcttgtgattgatggtgatggtgccctcaccagcgactaatttgtcgccaaatggcatgtgtttttttctaaaaaaaaaaaaaccccccccccac

SEQ ID NO: 10947 - DNA, 3825 bp, Zea mays
  misc_feature (3236)..(3236): n is a, c, g, or t
tgcacatagaggagatagatataaatgttattccgcagcagattgtgtaaaataggggatttgcactgtagattacactgtttgcagagtgaagtttgaaataggggataagataggggatgtgataggatagctgctggagacaaactaacgatacaggaaaccataaaccaggaataaaggatagatcagactatttttcttttgagcatgttgatccatacattgaccaaattagatgacccagaaagagcaacaagttcagcaataaataacaatgccacaaaataagtgatttttatgtacagtttacacatacaaataccatactggaattcaaatgcaacagagctcattgtaacaatataaatccattaggtttgtcctaactcctaaatcaatcttctttaacttcagccatcaatttccaaattttatagattgacaacacaagatttatattataacactcattttgagaaatatttccatgatatatgaatcttgaatagtcaatctatatataatttaagatactaatggtcaaagttaaacaagtttgacttggaacaaacctagatggacttgtttgtgccatagtcataagaaatggagacgatgccacgttccgtgacccaaagtcgttgtcccaaatcgtgtatcgggatcaccatgggtcatcatcccgaatgctagggagtcgctctaatagtgtagatgggaacaacgaccgatgctcattcgtgatggaggaggatcatgcaagttggggtagggcagcgcaaattggggtaaggcgggcgcagatgatagcagggggacgtgtatggtggtgaggatggggatcctatcatggccagcaagaggtggcgctctggcttcctgcatcggcgctcctgcaggtggccgtgggccgagttgggtgacagccgcttctgcgtcgtgagctctatggcttctatgtgcggttaggactgaagtatagtgtttcattactataatgggttggtattgtgctgtaggttgtgttaagctggtattaggttgggaccttggcataacacatagggtccttggaattttggaacacggccgagggcccatggaatcgactcgggatcatcgacctattagacatgggttcacataccaaactcacgactcacatctcatagagatatacccccgtgtaccatattttttcaagtgtcgacccacgacccgtgaccacgttccttgacccaatcaacctggtaacattgtgactatggtttgtgcttggagggaataatttccaagtgaagctctctacacttatcaaacatttgctgatctaccacaaagcaacacaatctttagaaaagggagaaagcaacacttcattatagttgagttgaagcatggctaacttcttccttgcaagaatgcgcaaccatccatgtccatgtgcttaaaagtcattctctacctatgatgtgtatggttggacctaacttttatccgtcgctcaaattcacagctgaacagaagcgaaaccacccaaaatagtccagctccatcccttagtgaagctacgcagccactgctacccaattgcaccttcagttttataaaagaagttgtaacgaaatttaatttcaccgtgattattgtttacttgtaatgcatagaaaatggatttattacgaatcgataggctattgcaatctttttatattaaaaatgaaaaaaaaagtagagaagccgtattttttgtggccccgaaccaatcaaatttcatcgattcaatagaggcgcacgaagcagaacgggcgccatccaccaatcgaaacaaacagtgaagcgaaagcaagagccgcatcctttccaccgaccaagacaaacagggaagggaaagtaaagcggaacactcacaccacgggacagcggagcgctcgacgatggcctcgagcgtctggaagacgagcttgctgtcgacgaggaatcggaggtagccctcgacggagggctcccacttggcgacggggggcgcctgaggctccttctccccctcgcgggcctggtccttggtgtgcagcttcatcgcgaccgcccgcatctcctccacgaagggcttgctcccatcctccccgctcgccgcgggcgccatctccgtggccgctgccgcggcgaccaacctcctctgcgccgtgaccgctgccgcggacgcgacagacaccacccgggtcacggaccgcgcagcggcggagacagacaggctcctgttccacctcccggaggtgactctagcgggcgcgggcagggagagggcgttgggcgcggagagcgatgccggtgcgggcgccatggctaggccgcggtgccttatagcgtgcgctggcgctaggggtaccgtgctggggaagcgacggcaccgatgacggacgacagcgacgcgggggcggggactgtggcggtggagtgcggtgttggtgttggtgtggcggcacagcggggggtgccgggtgcctgtgggagcgcgtcaccccgagcgaggagaataggaggcggggatgggaatgagaaccgggggaatggattggaacggcctcgccggctggagaagacgatggcggaatgttggtagtagtagtagactagtagcaaagctttaccggtgttgctttggtataagtcactggctgtgggcctcatggccatggggagccaatgggtcttcacgacttcacgtgaccgcgacctgggccacagtctcggccatatcctcttgtttctttttttcgttctctttttagaaagccatatccatatcctcctgtttttagacatgtacaacccacccacataaagtatttgtatcttaaaaagtatcaagagaataaaacaaataaaaaattataaggtaaaacaaaataaaacataactatagtacgattctttaaatctagatatggttttacctatcaacagttcaacacataaatgagatgtatcttgagggtttctattgaataagatacacgactcagatacattaagttgtatgaaaaaaaaattagatgtatctagtgtttaaagaaccgcaacataatatcttggttgaaatgtctttaggttgtctttaatgaatcgtgtaaaatagggaacgtgacaccgagtgtttgaaactgtttgaagagtgaagtttaaaataatatatgagataggaaatgggatagagaatctgctgaagacgntcttagcacacatttggacccacgttttttcagtggcgcctcacaaaaccatacaatcccacaaaatagctcgcggttaagctcgattctcgctatcattgtagactgtgaaccatcgtcgcggctagagatggcaatggggttccgatcctcgattctctgcgaggaattcctctatcaggggacggggatgtgagtaagttccacggagatcgaaatgggaaaaactttgtccccgtcgttgggttcgcgtacggatggatccggatatttattcggatgtcatttttttagtcttctttcttcgattgtgaacaactaacatatagaatttgctatgtaaatttatattcttgtttttagcattgagactattaatcttcacaaaaaataaacattaaattcattctatatctttttaaataattcatataaaattcggatgtctatccgaatacggattcggatgttttttcacttttttgttgtagcgagaaaataatgtacataaaaatttatacaaaaatttatttaaatacttcataatatttttaataacattgccgaaaattaactttaaattttataa

SEQ ID NO: 10948 - DNA, 1458 bp, Zea mays
atctcaggtctcagctcagcccgcatcgaatctggagtccaagcccgacccgcagcccgtctcgcctcgcgaaggcttcctttcctccccccttccgtccccccccccaaagatggagtacccccaccagcaggcgggcccttcctccacgaccatcaccctcatctgtccgtacgcgactcgccgcaggaagagggccgcgggcgacgacctctcgtcggcggtggacatggatgtcgacgccgacgcgcagcgcgccacggacaagctgaaagcagtgtcagaggcacttgggcatgagatccgggttttttcaagtgagaactttgcttcacaaaccagcaagttgcctagtgcagatcatgaggaagatgacgacttttatgagcttcagcctgctgattactacaacttgatttcaaacaggatgggagagcactttaaaatgctgaagactcgcaagatgcgggaagcagaacttgctgctcagcgagcaaagagaacaaaaacagtaatgagggtgcgtttcccggatggctacatccttgaggctgactttattccatcagagaggatacatagtctagtggacctgctcttgaaagtacttgctagaccagatctgccattctatctttatacagtacctccaaagaagcgaatactggacacatcacaggacttctatacagctggttttgtccctggggctaatgttcatttttcttatgatctccctgaagtttcgttgttaaatgcagatgatctaaaagcaggaccctttctccgcgaagaaattctaagtttggatggattgtcacttctgctgaaacctgctagtcaacctgatgattctagaatgaactcttcttctcttcaatctgatgcatctcaatctgttcctgtaccaacaacaacaaataagaagcctggcagaccaaagtggctgaaaaggtgataccactccaggtgtcaagtgtgtgccatcaacacagaatcactctgttaggcttctaaacactattaatggccgaacaagctcaaatctgaacaggctacactgctgtagtacaagaattggatcctctgcttacagaagctgcaggggcattagaaatagaatcccaccttttttttctaggtgggagccaagtagcatgtaaatttgaatgtgtcgcgactcatcaagtcatcagaacagtgctccgctgtggctaagcactttgtcatcttacatttcgtgtgaaccccataggaagctagaaacggcggagataatagtccagtgctgttaacgcttcacggtgcaatgccatgcctgtcttcactattcagtcttgacaacaatatatttcagaaaactgaaagtgcccgaggtagctggaatataccaagtgtgggggtttcagttctggaggatacggggctgtttgtttcggcttcagccaacacccaact

SEQ ID NO: 10949 - DNA, 2295 bp, Zea mays
ctttcacatcatactactttttgtatggtacggatttctggtatctatctatttttttcaaatatgaacgtggaattagaataagtaagactacatccaacagtttaactatgtttttatacctatattcaactccacactacaaacaatgtggtctacaatgtaaaataatgttttaggttactatataagtgaattactggacggtctaaaatgataaaattagtatacacatgttaaaaatggatattactacagacatacatattacgtgttttagcggatgcaaggtcacataatttggatttgtagatatctattttgaccctagaagtagaacgggtggcgcgaattgtttgcgttcatagacatcactattcgctagaccgtgtcacctcgcgcgtgccacgtttctcgcgacggtgaaagactgaccatcacgcgacgaaaaaaagatgttatcctttttcttctgctgcggaacgaaactgccacccaacaaatttattctgcgatccgcagcaagaaacagacccacacccatccatccaaactgaatggcaattgctggttccgggttccccgttcccatcaacatcaacagagcgcccctttctcgccggtgcgccgttggtgggtggtgtgggtgcctcgtcgtcgtcgcactttgcggttccgtcacttaggctcggacgaccaggacagggcgaggccgactggccacgtaccgccattacaccaagcaatcatgccccttgcgcgccgcgctcgccacgtcacatcgtgtccgacgcgacgaaggggtcgtagtggaggcccaccgccgagagcagcggcgggccacgcagcgccgtgatccagaccctcaccgtcgtgcccgcgacggggcagggcagccggtgcagccgcttgtgccccaccgtcgtgccgttggccacgggcgcgccgtccacgtacaccgcgtgccgctccacgcgctgtcccagcgccacgtgctcctggatccgcaccacgttgaacgcccgcgcccgcgcgcccggccgccgccgcagctcgatccagtacccgttccggcgcccgtcctcggccgtcggcgcccagtacgtgtcgtcgcggccgtccatcacgttgcgcgccgcgaaccgggcgccgcgctcgctgctggccctggcctcgctgcccgcggcgaggtccgtgccgaagacggtggccacggcggccccgaactcgcgcagccgcgcgatgtcggcgtcctcgaccaggcccgtggagttgggcggcgcgttgagcaggagcacgcagttccggcctacggagttgtagtagatctccagcagctggctcagcggcttggccgtctcgttcttgtgccagaaccagcccggccggatcgacacgtcgcactccggcggcacccagtcgcgcccccgtgggtcgcccgcgttcaggtacttctcgatgccggcttctccgatggtgatcatggatcggttgacggtggaccagcaggtggttccggcgtagcccttctcgtcgccgacccagcggacgtcgggcccgtcgtcggagaagatgttgatggagcgctgcagctgcttcaccgtctggaaccactcctggaagtggtacgtcatattggtcgcgttcttgcccttggcgccgtcgaaccaaatctccgacacgctcccgtacccggtgaggagctcgtggagctgggcctcgtagtactcgttgtacgcgacctcctcgccgtacctctggtcgtgccggtcccatggcgagaggtacagcccggcatcaaggccgcgcgcgcgggcagcgcccacgaactccctcaccacgtcgccgcggcccccgcgccaggggctggcgcgcacggagtgggccgtgtagtcggacggccagaggcagaacccgtcgtggtgcttggcgacgaggatgacgagcgaggcccccgccgcccgcgccgcgtccatccactgggtggcgttgagccccgcggggcggaacagggacgggtcctccgaccccgtgccccactcggagtccgtgaaggtgttcatgccgaagtggaagaacatgatcacctcgcggcgctgccatctcagctgcggcgccgacgggatcggcagcaccggcagcggcggtggagtcgcgcgccacgcctctgtcgcggagacgaggacggctacggccagcgccgcggcggccaggcacagcagcgggcttgccatcgtgctgctgttattgtcacttctctttttgattaggatgttctaggtaatggtctcgtgc

SEQ ID NO: 10950 - DNA, 1205 bp, Zea mays
gtgcggcgctcgaggcggccgtgcgaaaccggctccgaaaggaccaacgtctccgatctcacttctggggggacctcggggcccgtggcccccggccgggcctcccacccacaaagagataggaggatagcgtctatccccaatcctcccgccgcggcgacgccttcccctccctccttcctccgtcccatgctccgccgctgacacgttggcccgacttaaccttacgatggccgccgcctccgccatcaccgccgtctccggcgttgtgcttccccaaaccttcctatcccaccggtcgccgccgccgcaggtcctagccgtggcctcctcattccaccggctctccttgtgcgcttcccatcgccgaatcactcacataatcccccgcgctgatgcaagtgccgaagctggagaaccggagcctgtcactacttcagctgaatccgaagaggaggtggccgaggggtctgtcgctgtggcggaggcggaggaaccgacgccgccgagcaagccgaaggttaagttcggcgaaataattgggattctgaataagcagttcattgaggaggctgagaaggtgaagactgtaccggatctgaggcctggcgatatcattgagcttaggatgcaacggcccaacaaaaggagattgtcgctctttaagggcataatcatcgcaaagcacaaagctggtgttcacaccacaatccgtgtcagaaggatcattgctggtgtaggagttgagattaccttcccagtgtactcacccaggatcaaggaaatcacggttatcaggcacaagaaagtgaggagagcaaagttgtactacctgaaagacaagcttccccgcttttcacattcaagtgaaatcagatatgctgacagaacaacttttccaccaccatctcgatttctcttaaacctttttttcacttccctatcgatatcatcatatttcactgtaatctctgggtatcagatatgtaatatctacagctttatagcatacttggcttagcgcaatgttttgtttgttgtcagtgtacaaaattcatactagcaccttgttattatgaatttgcaaatacaaggttatgtactcttgtgcgtcgagtttgtgatgaatgattgttaggtcattcttaattggagtttcatactcattaaaaaaaaaaaaaaaaaaaaaaaaaaaaaaaaaaaaa

SEQ ID NO: 10951 - DNA, 902 bp, Zea mays
cattgggtacctcgaggccggccgggatccccagtcctcccgccgcggcgacgccttcccctcactccttcctccgtcccatgctccgccgctgacacgttcgcccgacttaacgttacgatggccgccgccgcctccgccatcaccgccgtctccggcgttgtgcttccccaaaccttcctatcccaccggtcgccgccgccgcaggtcctagccgtggcctcctcattccgccggctctccttgtgcgcttcccctcaccggatcactcacataatcccccgcgctgatgcaagtgccgaagctggagaaccggagcctgccactgcttcagctgaatccgaagaggaggtggccgaggggtctgtcgctgtggcggaagcggaggaaccgacgccgccgagcaagccgaaggttaagttcggcgaaataattgggattctgaataagcagttcattgaggaggctgagaaggtgaagactgtaccggatctgaggcctggcgatatcattgagcttaggatgcaacggcccaacaaaaggagattgtcgctctttaagggcataatcatcgcaaagcacaaagctggtgttcacactacaatccgtgtcagaaggatcattgctggtgtaggagttgagattaccttcccagtgtactcacccaggatcaaggaaatcacggttatcaggcacaagaaagtgaggagagcaaagttgtactacctgaaagacaagcttccccgcttttcaacattcaagtgaaatcagatatgctgacagaacgactttttccaccaccatctcgatttctcttgaacctttttttcacttccctatcgatatcatcatatttcactgtaatctctggggatcagatatgtatatctacagctttatat

SEQ ID NO: 10952 - DNA, 1088 bp, Zea mays
tcacccttgggtacagcggtgggggcccgcgtgcagcgtcacagcctcccacccacaaagacattgggtacctcggggccggccgggaatcctcccgccgcggcgacgccttcccctccctccttcctccgtcccatgctccgccgctgacacgttggcccgacttaaccttacgatggccgccgcctccgccatcaccgccgtctccggcgttgtgcttccccaaaccttcctatcccaccggtcgccgccgccgcaggtcctagccgtggcctcctcattccaccggctctccttgtgcgcttcccatcgccgaatcactcacataatcccccgcgctgatgcaagtgccgaagctggagaaccggagcctgtcactacttcagctgaatccgaagaggaggtggccgaggggtctgtcgctgtggcggaggcggaggaaccgacgccgccgagcaagccgaaggttaagttcggcgaaataattgggattctgaataagcagttcattgaggaggctgagaaggtgaagactgtaccggatctgaggcctggcgatatcattgagcttaggatgcaacggcccaacaaaaggagattgtcgctctttaagggcataatcatcgcaaagcacaaagctggtgttcacaccacaatccgtgtcagaaggatcattgctggtgtaggagttgagattaccttcccagtgtactcacccaggatcaaggaaatcacggttatcaggcacaagaaagtgaggagagcaaagttgtactacctgaaagacaagcttccccgcttttcaacattcaagtgaaatcagatatgctgacagaacaacttttccaccaccatctcgatttctcttaaacctttttttcacttccctatcgatatcatcatatttcactgtaatctctgggtatcagatatgtaatatctacagctttatagcatacttggcttagcgcaatgttttgtttgttgtcagtgtacaaaattcatactagcaccttgttattatgaatttgcaaatacaaggttatgtaaaaaaaaaaaaaaaaaaaaaaaagaaaaaacccgcggcc

SEQ ID NO: 10953 - DNA, 843 bp, Zea mays
  misc_feature (18)..(18): n is a, c, g, or t
caagtagcgacagctcgnacaagggggggggggggggtgcggcgctgaaaagagaggctaagatcgccgcagccgccgcggcggcggcggcgctgtgcttcgcggccctggtggccgtggccgtctgccaaggcgaggtcgagcggcagaggctcagggacctgcagtgctggcaggaggggcaggagagcccgctcgacgcgtgccgccaggtcctcgaccggcagctaaccggcggcggcgtcggcggcccgttggcccgttccggtggggcaccgggctccggatgcggtgctgccagcagctccaggacgtgagccgcgagtgccgctgcgccgccatccggagcatggtcaggggatacgaggaggccatgccgccgctggagaaaggctggtggccatgggggcggcggcagcagccgcccccgcagggaggaggaggaggacaggggggctactactacccctgcagccgggcaggagagggataccaaacgcagatgtatcccccgtgtcgtcccggcaccaccgggccaaggatcggccgcgtgaggcttacgaaggcccgggagtaccccgcggggttgccgataatgtgccggctgtcggagccacaggagtgcagcatcttttccggcggcgaccagtactagctaccatggttaaaaaaaatgcgagtcggcgcgaggtgcaagacgcagcatgtgtactgtgcgcgtgcaagtccagaatggcgtagttctgacgtgggctcgcattgtcgcgtgttacaataatgataataactatgcggaataaatatgggaatgttgccagatagtactggcgccggttattcgat

SEQ ID NO: 10954 - DNA, 6877 bp, Zea mays
  misc_feature (188)..(188): n is a, c, g, or t
  misc_feature (862)..(862): n is a, c, g, or t
ccctgtttagcgaagttgatgggcgccaagacccggtctcctggacggctggatcccaactggcccggggtttgctccggcctccgggcagaaacaccggtcaccggtgtgtggacggatcgaatcctattgctgggtcgatcttccatggcacggttcagctttggagcttcagctcggagtgactngatcgaaggagtgccagacaagagctgaagaaatctgtaccggttaaaaaaaccctactacatatgaaaggagaatcatgttcatggatgcgatcaagctagtaccaactgatgttgcaatttgcaaagcctgttttgcacgaatgagcagcgaaggttgcgcagcagagggcatcttcatcaacgtcgcctccgcatgcacatgtatagggccaatttgcaaatgtttcttttctgatttctgagctttacttcttgatcttcccttcctagagtttttctgacgagagagcctataagaattaatttgtgaaatatatatacacccgtaaggcctagtttgaacactcaaatcttcttcgggatcgaagaggattgaagataaaattagtttatttccactttaatcccctccgatcccgaagggtatttgaggttttcaaagtagccctaagttagtagaggttggcagttggcgacttggcgtagttgtagatttttttttaaaaaaaaatatttcttatagttgcacgttgttgtaatctgaatgaattttgatgatggctatgttgtatgtgaagagcaatcactataggaattctgaagattcccgtcggctacaggccagccgacgggcgccagccgacgggccttaacttaactcccgtcggctntgacaaaagccgacggaattaggttattcccgtcgatctatgctctggccgatgaggattaaaggtttataaacgcccgtgggcaccccgcgcgggctcattctctgtttctttcgctcaaaaccgctgccgccgtgccgtccgtccccgccgcgtccgtccccgccgccgcacccggccgcctgtccctaccgcgcatattctttaatctttcatccctggaaaggatgaagccctaaacactggtgctgctgcagatgtagcatcagcatcgaatcttgatgctttaatggaaccataaaaatctggagtagatgctggtggcaactggtttaaataactctgataatggacggagtaagccctatactcgatgtatctgagtgacagtgcagccgtcttggtttgactggtttgctgttatggttaagtaagttgtacgcctgtatagggtttttcatggttttctacccattttggtgttgttcgtttaaaccaatctagctctggattagtatggattgaaattaaatccatgtcacactccatacctcaaaataatccaagtctaatcgaattttttattcggttaaatccattatggattataacccaagggtttggaaaattttaaactatgaaagtcatggattgtattcatagcttatcaaagggttaagttacaaatttcgatatatttttgtgtgtcttcaactggtgaacgtgagagaccgaagtgtgtgggatgcacgattttctagctcgtccggttgcacccttcggaaattttgttaagtaaacccaaaagccgtcttctgtcaaaacaaagtgcctttgcccacacttttcagtcctacttacccttcgcatgacatcagcatctccatatttccaaacaaccgcaaaaaaaacacacacacacacacagagatcacgcacatccatgcgtccgtcagcacgtagtagaagccatgcatgcatgcttatcagtgaagcagccatgtatagctgagttgtagatacgtccatcaaccacacagacacaaagacaggcgcacgtactagcacactttgccatcccagctagacgcgcgtccatgccagatttttatccacgtgaggggtcgttaacgtgaagtgttacattaccaacacgaacagtgactttacttttttttccaaaaatctgttctacaaagctccaaatcatcatcgccacatacttccttcctgccggccggcatcgagctagctttttcaattaacagtgtgcgttttcccacctcaactgcctttctccctataaaaaaaccccctcgtcgatcaccaccaaagaacacagtaactagcagctagcacatcaaacaagtggcgacagacaaagatttgtgagggtgatccgcgctgagaagagatggctaagatcgccgcggcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcggcggcggcggcgttggcccgttccggtggggcaccgggctccggatgcggtgctgccagcagctccaggacgtgagccgcgagtgccgctgcgccgccatccggagcatggtcaggggatacgaggaggccatgccgccgctggagaaaggctggtggccatgggggcggcagcagcagccgccgccgcagggaggaggaggaggacaggggggctactactacccctgcagccggccaggagagggatacggctacggtcagggtggccagcggcagatgtatccaccgtgtcgtcccggcaccaccggcggcgggccaaggatcggccgcgtgaggcttacgaaggcccgggagtacgccgcggggttgccgatgatgtgccggctgtcggagccccaggagtgcagcatcttctccggcggcgaccagtactagctaccatggttaaagcgagtcggcgcgaggtgcaagacgcagcatgtgtactgtgcgcgtgcaaatccagaatgacgtagctctgacgtgggctcgcaatattgtcgcgtgttcgttacaataatgataataactatgaggaataaatatgggaatgttgccagatagtaccggccccggcggcttgttcgaaaaaaaaaaaaaaaaaaaactagatattatgttaatcttccaaacactagatacgtctaataaaatcattcatacaattaactcaatgtatttaagtcttgaacccctaatgataagactcatttaagacttattcggtttgatacaaattcacgtgaaataggtggttttgagtcggtttaaatctatagtaaattaaaatccacatcagtacatcataatcacctccaattcacatggaatatacagaaataactgctacagatagcctaagttccaaaacttcgtattgagtctgcgactgctttgatgaagttttttatggctgaacaagggtgaacaagaacaagtgactttagtcttcgtatatggtcttcgcgtttgagtatacagggacattcatctttccctttgttatgatggtcttcgcgtttgaaatacacatgacgtacgagggcaacaagcgagccgaggtgcccgccctccgggtccggggcggcgtaggcggccggagggctggtcattaacagtacggcaccgcggttttcgctttcctttctccccaagaaaaagaaaagattggaacggtgggcgcggcgtcaatggctcaaagcaaaggccatcgtggcccttgggctgtgcacgcatgcaaggcctgattgaagggagacgcgagcgcagggggagacgtcataacgaatttaattgggctgagttcacgccggccaattaagggctcgttcgtttcgacgtgaattcattagtttaaatttataataagtcaaaatttaccttaattacacctaatttcaaacaatccacctagacggaaataatcgaacaagccctaaaatgtttatataattatagcataaaagatgtctatgagcttatgacgtacaattccaagaatgatcttacgggaacaatcacaaatgaatatatatatatataggccgcgtgaaaatagctctagaagattcaaaatatatttagattctataaagatggggaagcacccattgaaatctaaaaaaaatctaaaacattctaaaccatgcatgtctaaataagttttaaaaaattggacaacagagcaatatgcgtttttttaaatataaattaatgaattttgtgccaattgcatctcatgcttttgtcatgaaaatacctctatatataacgactttgattgccatgaaaagactgatgggcagatcatcggttgttggctgtatataatgcagcagtgtgcgcttgtatatagatatgtaaaaaaaatacatggtacatggttaattagaatattgcatcacgtacaggaacaataatatgtgttaatgtgtataccacatgttcgttgtttcaccccctatatatatatgggctatatatgtatgcatggctatatccatctatatatgcacagtcacgagtcacgactccatggtctccgggatgctctcgagcgcgggctcccagccgcgccgtcggtggcgggcgtcgactaccacctcgccggcgctcacgatctccgccagcacgctccccagcgtcgtcgtcatcccttcggcgccgccgacgccactcgccatcagcttctgcagccggttcctgctgatcctgaccgtcaccttgacgctcctctccctctcctgccccagctctgcccacgccggcggctcggcgccgtgccgggacgacgatgcgtggcacgcgcagttgcccatcgccgatccgaggagaggagaagaaggcggtcggtggtctcttcgcttgctcgctccttcagtgaagagacaagaggctgctagctgtgttccttcgtgcgaaactagatgtgtagatggacgtatacacagactcacggagcgtgcacgtacgtgggcgggcgggttgcgtatatatacagtagtgtcctcgtcttggagacagcgccgggcacagggtccggaaggagtgaaagggagcagagcaatcccgtgcgccgctcacgtacgctagctagctagttaggtcagagagggaggctgccagctgcctaacccggccagcgcgggcgtctccatggtccatgccatgcatgctgcgtgcgagctacggattccgtccgcaactccgcggcggcacagtgaattggctctgtgtctgaatttcaaggtcccggccgtactgatggtaggcgatgtgatttaggcctgaattgaacattgcaggcaggaaatggtacggcatgcagtcggtagcgtacgatgcatctcgcgcccacattctcgcctgaacccccaagtccccaacgcagcggccagacaagactgatgggtgcatgcgccggttggtccagggtccagggctcaggctgtagcaagaagcgctaacagtcaaaacgaaacgtgttaatcgttctcctctgcaggtgtgctgcttcgtcgtccctcaggttgcacgttgcatatgcagtcctttcttcacgaggaggagggtggcgaaatgcggaactggccggccggcaagaagcagcagctagctagctagctctctcgccgtgtgcatgtgaaccttgttagaacactggctgactgctgacatgcagtcgaaagggcacgggcttccgttgaattggataggacgttctcgcgaagaagcgagcattttcacaaacgtacgtatctgaacatgtgacggaagcgttcaatcggccggcgacgagctagcaggccgcgaaatttaaccccccgctttcccactactcattgccgttgaatcagcgacacccaccctgccacacgtgtgtcttaggaattacagtgttacgggagcatatttggatccaaggtgatttctctttcgagatcgcgtggtagagagagaagcggtcgttctgcagagatgaaattcatggacaaacgtaactaactccggcaaggaccaggacaaggagtagcctcacaagtaggtggtaataggctctatattttatattataaaatttaagaatcaaattagattaggatccaactctatttttatttatttttaaattaaaattaattaagagatcaaataaatatgaaggggcattaagagaaggcggggacgtgagaagaaatatgtgcacgtcgtagaataccgcgtttagcatggacagatcaaaaactatgggcgaaatccaaagcccactcaagttttcccccctactctctgctgcatcacactgttgctcttttccatcggtaaattttcgtagcttcaaagatttttttttttttgaaaattttagttggctagagcttgtttagcattacaccaatgcacatgtgtcgatagtgaagatgatcagagagggtgaatcggacagagtaaaatacgattttttttccctctgattctaccaccacaaaactacaccatacggtgccaataagagtgacttcttcatatagtatataccttgttggggattcagccttgttcaacgcagtccaccgaagtcaattgtcaatcttcacataatggtctagcttccttcttgaatcatgttggcgcatctttgtgcatcatagaacgtaaggaggctttcatgccttggccaaccaagttttgaagaacgatgtgaaggtggttagaaaggaactcctctatagattgcatacatagtaatctaactggtctcctctatttctttagatagaaagcttggggataaatccggtggtgataagagggggtgaagtgaattagccaatctaacttgtcataaagatatcaaaagatatcaagaagcgcac

SEQ ID NO: 10955 - DNA, 1014 bp, Zea mays
accgaacaagccctaacagtgtgcgttttcgcaccccaactgcctttctctctataagggaaactcctcatcgatcaccaccaaagaacacagtaactagctagcagatcaaacaagtagcgacagctcgacaaagatttgtgagagtgatccggcgctgagaagagatggctaagatcgccgcagccgccgcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcgtcggcggcccgttccggtggggcaccgggctccggatgcggtgctgccagcagctccaggacgtgagccgcgagtgccgctgcgccgccatccggagcatggtcaggggctacgaggaggccatgccgcctctggagaaaggctggtggccatgggggcggcagcagcagccgccgccgcagggaggaggaggaggacaggggggctactactacccctgcagccgggcaggagagggataccaaacgcagatgtatccaccgtgtcgtcccggcaccaccgggccaaggatcggccgcgtgaggcttacgaaggcccgggagtacgccgcggggttgccgatgatgtgccggctgtcggagccccaggagtgcagcatcttctccggcggcgaccagtactagctaccagggttaaaaaaaaaagagtgagtcggcgcgacgtgcaaggcgcagcatgtgtactgtgcgcgtgcaaatccagaatgacgtagctctgacgtgggctcgcaatattctcgcgtgttcgttacaataatgataataactatgaggaataaatatgggaatgttgccagtgccagatagtactggcgccggttcttcgtaatgaaaaattatcctctctccttttatattattttttttttttattttt

SEQ ID NO: 10956 - DNA, 1914 bp, Zea mays
gggacctcgaggcggccgggattcgttctcgccgcccccacctcgctctcgctcactctcgccgtccgcacagccgctcatcgtctcccactgcctgccctctccctgcgccggccggtgccccgacgcgccatgtcgtacaacaaggccccgtccatcaccgccgagaccataaatcccagggtcaagatcatcagatacgcgccttgcggggagatcgtcaagcacgcagcgcggctggagcaggagatagaggagaaccctgcttctatccctttccaagagataatatactgcaacctcgggaacccccaggtccttggtcagccgccactaactttctttcgtgaggttctctccctgtgcgacaacccagccctcatggacagagatgaagctcgtgccttattcagcccttgtagcataagaagggccaggaggatcctaaactcgatccccagcaaagacactggtggatatactgattgccggggaatcaaatgcctgcgtcaagtagtagcagatgggattaccgcaagagacggttttccatcgacagcggacgatatctttctgacagatggagccacctcagcgatcaacttgatgatgcagatactcatcaggtctcacgaagacggcatcttgagccctctacccgaataccccttgtactcggcctccatcatactgcacggtggaacgatggtgccgtacaatctcactgaagataacggttggggcctagagatctttgaagtcaagaggtgcttggaagaggctcgttcggctggcctcctgttagagctatggtggtaataaatcccggcaaccctactggacagctcaggttgtaccagagtttctcttcgtcaacacatctcattcctttagttataggtgctatccgtcacaaaccaggaggagatagtggagttttgtcggaaggaaggtctggttatacttgctgatgaggtataccaggaaaatatctacgcagagaacaagaagttccattccttcaagaaagtggccagatcacttgcttacgacgaaaatgacctcaccctagtatctcttctttccgtttcaatgagctatggggagagtggcagaagaggaggctacatggaggtgtctggcgttgcagctaatgtgaaggatcagatttacaaggtggcttctttaacactctgccccaacattgctggccagattctcgtcagccttgcaatggatccaccgaagctaggagatgaatctttcgagtcatttgataaggagaaggaacagatccgttcatccttctgcaagcgagccaagaccctggagaaagctttcagcggcctggagggcgtgacttgcaacaagttagagggtgcgctgtacttgttcccacggctccacctcccctccgctgcgatcagggccgccgatttcgagggagtttcacctgacatattctacgctcaccgcctgcttgatgccaccgggattgccgttgtgccgggctctgggttccaccaggcctctgggacgatccatatccgatgcacgatccttcctgacgaaagaaaaatcgaggcgatggtcgcacgcttgagggcgttccataaggcgttcatgaacgagttccggggctctcagcaggtcatgaacgatctccgtcgctgatggtgtcgatgcatggcacggttaggcctgtgcgtgtgcccatgggcaatcaagacaacttctgagctctggagttgttgtttgttgttctgtgttcttgcttcctcgttgagctgtgcccgtttgtcctcacttatgcagtcagtggtctgtctgtagtctgtactgcttaaagataagctgtgctttcaggaataaaaagtctgcagcttgtgcataaaaaaaaaaaaaaaaaatcgg

SEQ ID NO: 10957 - DNA, 2013 bp, Zea mays
  misc_feature (1915)..(1915): n is a, c, g, or t
accaggaagggtatgcgaggaacattaattggggttggcctccaacgcgaaccccttggtggccgcctccagctgcgcgaatgtgaactctccatggggtccttgaacgatgacgatccgctccgcttccgcgtcatcacacgcgacagctgccatcggaataggatgcgcgcccgcgacccgtacggtttgtgacttcaaaaataatagcaagaagcctcgaagacattcttttggataaagttaggaaagtaccatgcatcccactttcagatggttcatttacctctatttcagatggtcgtatatggttgccatatgatgttgccaattccattcctgaatgcagtagcattccgaattttctagctctatatggtaatcttcgaactgtaagtccaaaccttctccctgcatgctgcaaaaataaatatctcatggaggaagtcagaataaatgatctagcagacatgctccaaaggatcggggtgcggaagttgtctgggcatgacattgttaaaaatcacatcatggtgtccttgcgtaacagtttagatgctaatgtggctgatatagtgattagagagtatgtgagctttattatggttcatcttcagtcttcttgcaccagctgtaactttgaaagaggagagatagtgtcagaactacggaagagtcctatattccttacaaaccatggatacaagagcccagctgatgaaccaattcacttcagtaaagattatggaaattccgtggatgctactagactcttcagaatgtagaaataagttggattgaacttgatagtacctatttgcagcatcatggttcacagtcgtcatcatttgcactggaaaaatggaggcaattttttgaagaaatgggtgtgactgattttgtgcaggtagcgaaagttgaatcatcatttatcccaagtgcattcaaagcttcaaatggatagcatcaagaatggatgaggatcttcattatgcaacagatttattctatgattgtgaaaatgtccgctctctttttggtagtgtggctccatatgttgtatcgcaggtatctagcagttcacttaagaaggccattggattcaaaacagaggtatcttactgtgatgcattgatggtcctgaagtcttgcataatgtcaaaggttccctttagagcaagtatgagccatatgtggaaattctataccttattgtctgaaggcgtggcagacgcaaagattgacattaaacgggagttcatgtcgtctccctctatatttacaccactacagcgtcctcgggcaagtggaagagactttgttaaaacgaactaaagtgtttctctgctcatattccagtgtttatttataacatgcctttgttttattattttggttttttaaatgtcatgcttatatcctggtttggatatccagtttaaagacatctcatctattggacgctccatcactagttgcaatagacaaaactcagaggcaattacttatctcaatcttacttctacatttatatttccctcttgtgttttaccttttgcttatatcctttgcgtgacataggagccatttccaatatttcatctattaaaacaagtaagaaaatagaaaggcttggaagcaatggtgcttgaaagtcgcctagaggggggtgaatagggcgaaactgaaattctcaaaataatcacaactacaagccgggttagcgttagaaatataatcgagtccgcgagagagggtgcaaaacaaatcgcaagcaaataagaggtgtgacacgcggatttgttttaccgaggttcggttcttgcaaacctactccccgttgaggtggtcataaagaccgggtctctttcaaccctttccctctctcaaacggtccctcggaccgagtgagctnttcttctcaatcacttggaacacaaagttcccgcaaggaccaccacaagattgggtgtctcttgcctcaattacaattgagttttgatcgcaatgaag

SEQ ID NO: 10958 - DNA, 2253 bp, Zea mays
  misc_feature (1933)..(1933): n is a, c, g, or t
  misc_feature (1936)..(1936): n is a, c, g, or t
gagtgctataggggtgagattggcgacgagatgctcgtcggtgaactgaaagaaagaggcgagaggttagggatgaaacccaggttccacgtgtcagatacagagggaacaaatgagtgcatgtgaggagtactgacaacatgggcatgcttgttggcggacgagcgaacgagagcacgggcgcgcacggtttaataggccgaatgccattggaccgtctgagttctacctttttagttttattctttttagaattagatttggatttaaatttcaaattcaaattccaataacttcagttaaatttgacatttggtaaaaaaatttacatacaacaaagaaacaatgtagcataatttggacacataccacacacaaatttgtttcccctctcctctttaatttggaaaggtcgcatacaattaagattttttttcaagttcaaagcatgggtttacacaattacaagtgagtttgcacattacataagtaaggtgttacagaggagaaggatggagcaatgaagctacacaaagggtatgtaaccattaaaacaattataaatatatgtatagatacatcattataaagatgagaatgtatttggtgcaatcaggctaattggtacaaccggtttaaccaagacacatgaatgaaggtggaaaaactttttagaaaacatcgtttttcaaaacaaccctgccacatttcgctagaatttttaaaaaggtcctcacctctatttttgtgtcttggttgcacggttcaccaattggtctgattgcaataaatacattttttataatatagtataatatatagatacagatgttactatagaaggtgtgtttatctacatcattttagctgcccaagaccgagaagcaaccaggacccccgttgtcaatgatgattggctcacgcagtagtcactcgcgtgtccctagaaactcggcgtgtcaataggaactgcccaaaggcgcccaactaccggagtttctcgtacgccggtacgcccagcagccgcaccatctctttcggcgcggacgcctgacccaaccgaacggcggccagccgcgagccgtctacctgtggctacgaaattgcacgccaaggcgcgagccgctttaactttcatccccgcaccggcacgtccggccggccaaccgaaaccacgccgaggcctatctctctccgagtttgatccagctccgtcccagcgccaactgctaatccggtaatccctcgccggcttggtgtcccggtcaaacctgccccgaccgacgggaggatccaacggcggccgctcgcccacacaacaaccatgcatctgcaccgctcctccacgtgccgcgtcgcggtcgtcacggcccacggcccggcgctcctcccccctcgccgaccaccccctctcccttcttctattccccaccccccgcctcgtctcctccaccgccgcccccacatctattcacccatccattcgttccttcgtctctacgcacaaacgagagaaggctaggtcgtcgtcgttgtcattgtcgtcgtgacgcggagagatctgggaggaggagcgatggacgggaagttgccgccgccgaacccgaacctggcgtactgggaggactgttggagcgagggcgagaaggtcgcgcttgtcgacgcctggggctcgcgctacctcgacctcaaccgtgggagcctccgccagccgcagtggcgggaggtcgccgacgccgtcaactctcgccccggggcctccgcgcgccgctgcctgccgcgcaccgacatccagtgcaagaaccgcgttgacacgctcaagaagaagtacaaggtcgagtgcgcgcggcgggccatcgtcgtggaacttctacagccagttcggacctcctcgtcgggcccacgctcaccggcatcaagaagttgtccccanccngcgccgcgctgcctgtgttctggagggggcactagtacaaagaagttctatagtggcggttgtaaacctatttatagtggcgtttttcgtaaccgccagtgctaggggccagtagaaatcatcatttgtacaggcgggtaactgaggaccgccagtgaaaatcaattttcactggcggtcggcgtaataaaaccgccagtgaaaatcgattttcactagcggtcgacgtaataaaccgccagtgcaaatcgtttccaggaaacataaaacatattttaaaaatagttaaaaattttattttaaaaaaaaaaaaaaaa

SEQ ID NO: 10959 - DNA, 2825 bp, Zea mays
aaatttttggtcttctttctttaattcttaacaaatagggtatagaatttgttatgtaaatttatatttttattctcaatattgagtttaatgtgattcataaaaaaaatctccaattcattttatttccttttaaataattaatataaaattttggatacagatacttgtagggagaaaataatgcaaacaaaattataaaaaaacattatttttgtctataacaatatgataacaacatggctaaaggttaacaccaaattatatatacatcgatattaaaacattaaatttgttatacaatttggatgttttaggagcatcctagctccgggtgccatggaaaaagccacggcggacagccggcacacgagaaaaaaccgtaacggcgcggtaaaaaaaacgccacggcgagcagatggggcttgaccgctgaacagccccgaaaaaacagggatatcgtcattccgtcaaccaagcattatcagcaaaaaaaaaaaaaccggttgacgctacgggataaagaaccatctctttcggcacgggcggctgtttcggcacggcgcgagccgcgtaacttccccgccccgcacccgcacgtccgtcccgtcccactccacccacctatcccgcgccgtgccgcccggccggccaaccgaagtactgaaccacgccgaggccgccgatctcgctctccgactccaattccgctccgtccccagcgccagcaggtaatccctcgccggctcggtgtcccggtcaaacccgcccggccccaaacgacgagctgatccaacggcggctgctcccccacgcaccaaactccatggatctgcgccgctcgtccacgtgccgtgtcgcggactcgcggtcgccacggtccacgggccggcgctcctcccctcgccgcccgcccctcccccttcttttaatccccaccccgcctcgtctcctacaccgccgcccccacatctatccacccgcccgcccgtccgtccgttcgttcgtctccacgcgcaaacgagagagagaaggctaggtcgtcgtcgtcgtgaggcggagagatctgggaggaggaggagcgatggacgggaagctacccccgccgaacccgaacctgccgtaccgggaggactgctggagcgagggcgagacggcggcgctcgtcgacgcctggggctcgcgctacctcgacctcaaccgcgggagcctccgccagccgcagtggcgggaggtcgccgacgccgtcaactcccgcccgggggcctccgcgcgcggccgcccgccgcgcaccgacatccagtgcaagaaccgcgtcgacacgctcaagaagaagtacaaggccgagcgcgcgcgtggcgggccgtcgccgtggtccttctacggccagctcgacatcctcgtcgggcccacgctcaacggcaccaagaaaccgtccccgccgcgcgccgcgctgcccgtgttccggaggcgccagacgccgccgcgctccccgtcgccgcaatcgccgccgccgcttcccgtggccctcccgctgcacaattaccgccgtggctccgacctcccttccgcaaacttcatccataaggccgccgcggcggccgccgccgccgccgccgccgcggagtccgactcggaagatggctacaacaacaacgagtacgacgatgacgaaggctctcagcagtcgccgtcacgttctgtatcttctcgctccggtggtgctcctgctgttggcaccaagaggaagaggcgcagcgggagcggtggattcggggagctagcgagggcaatcgagaccttcgcggatatgtacgagcgcatggaagcagccaagcagcgacacgcagaggagatggagaggcagcgaatcaagttcctcaaggatctggagctgaagcggatgcggtcttttgtggacatgcagctgcagctttcgagggcaaagcacgccaggaacggggatgcttcctcggagatgctcatgtctctcgctgcactgcccttcctcagcagctctgcttatctttaagggcctgttcagttagggatggattctccaatcccctcaatccacccctagccttaaattggaagagtttggtaaaggaatattttgaccttcaattaggaatttaggatacagtgagttggttgctgtgctagacttgttcgtggattgtttgtgtttcctaagatactgtaatttttcatacgaaccacggaggtattgcaggtcttcaaaatttaaatgtaccttgcaatgcattatgcccaagttttttcttagatggaatgaaatttactggtttacaacacttactgtcagtgtaatacgaatctcatctcaactacctttgttgtgtatcacttacaatctttttgggcactttctgtttatacatgatattggtttgcaagtttgcatgatgagaaccctatgctttatttatgataccacaatattttgtgactgttctgttatttcattgtcagtttgtcaccagcctttctagttggggaagggaactatagttttcttaaggtttgtttgggagtaagggcaatagaggggattgaaggggctataatcctccactattcaattttaaatagtgagggattctagccccatcaatactcttcattacacttgttcccaaacaagcccttagtgtatgtgaccctctgctataatgttacatcaagttttgtgttcccattctctcatttgagatgcttggttgtcatagatgatatagggtaatttgtctgcctttctagtagctggggacgggatgtcaaatatatttttttggatagtg

SEQ ID NO: 10960 - DNA, 7598 bp, Zea mays
aggtccgaactgttgaagagcaagtcagggcttcagcagaacacaaattaggtgttgctaatcagagtataactgctggtttttttgacaataacacaaggtaaatccttctattgtctagaataatttagcacccataggtcccatcttcaccctcactaatttatacaatggagtgccatttcagtgctgaagatcgaagagagtatcttgaatcactcctacgtgagtctaaaaaggaagaagcagctccagtgttagatgatgatgctctgaatgacattctagctcggaggtaagacctgattgctcgagatcatgaatgtctgtatttacataacattgcttcacttgctggcctgcagcgaagctgagattgacatattcgaatctattgacaagcaaaggagagaagaagaaatggtatgctgaatttatgcaagttgctttcagctaaatcttctacgttttccatcttgtaatattgttgtgtcttcacaggcagcttggcaaaaggtggttcaggatggttcaactagtgggctagaccctggagtattgccttctcgtcttgtaactgatgatgatctgaagcccttctgccatgctatgaaactttatgagccatcaaatgtgaaaacagtaaatgtgaatgtgaggaagaagggtgaacttgggggccttgatacacagcactatggaaggggtaaacgagcccgtgaggtcagttgcacagtgtcttttaatgtatcttccaattgtagtctaatgaactttgctaattcgtgaatacccatataggttcgctcttatgaagaccaatggactgaagaagaatttgaaaaactttgtcaagctgattctcctgaatcatcccaacctggtggcatgtcgaaggatttggatattcttaataaaggcattaagactgaaattcttgtggagagttcaaaagaaccagaacaaacgaagatggaggcatccccaactgtcggtgactctccaccagccaaacggcggagaggtagacctaaaaggtcagatgtttttgtatctcctactgctggtctgactgatgctgtcaaacaagacacaggaaccacacaggacggtagttctgctacaccagcaagtaccatccactctgatgcaccagctactgcaatcaattcagctgtttcagatgttaatatacattctattccaccagctgataccaagaaacaagagttcagtactgataccaaggtttccagttctgtttctgttttggaaggatctgtgccgaatgaaattggtacaccattacagagtgttcataatgtagcagtttctgcaccaccgcatcaatcagctaggggcaggaaatgccaagcaggagaaacacctcgtaggcgaggccgaaaaccaaaatctctatcttcatctggtgtagatgatgttagtcttaacccaaccttttcaactgttagtggtgtagcagacactagttatgttccttcatattctcaggtctcatcacaaggcactgctgtggcactggcaggaatccagaaggattttgtgacagttaagttggatacattgttaccagatagtggtaagggtgctcctcctgttaatgagggagataaaggtgctactgttacaacacctgtggcaaaagatatatgtgctgggactgtgacaacatcagacaacactgtcaccctgacaccaaatactcttaaggaaaacattggattagttcaagtggcatctgcaccttctatgctcgtggcttctgaagaactaatgaaaatagcacatgttgcggtggccgataagcctgttgagaagcaaactgcttcacgtcgccgcagaaagaaaacatctagtagcgaggatactggagtcagcactagacaaagatcagctatgaaaagatcttactacaacacctctgttgccgttgatgatattggttctgctgtgatcccaaatgaaaaatcaggaataacgaaggaaagagatgtcagttcaattcaaagtacatccaatgaactaccaaatattaactcaccattgtatgagaagtctggatatgattctcaaccaagcacacctatagctgtccccatcaatgaagacactcttcctagtggttttgacacctgtactaattctatgataactcttgccacatctgccaactctgctgaagatgataaaccagttgatttgcaccttaatgcacctcgtttctgttgattcccaaaaccaagaacaacacatgacagggaaggaccatttggcagtgtgttctagaatctttgctactcagttacagacggacactgcaaatcctgctattgatcataaaccaggaactgcccagtttgaaccatctgcttccttgccccagaattcaggcaaggatgctactgcactaccttctgaggttgacagtgctgctccaaatagggcatcaagcaggaggaggaaagggtcaactcgagaaccacgcaccacgaagtaattctgcatcagctgcaagtgaacgtcgtgcccgacttactggattgaagcaggcagaggacataaagaagttagagatgtcagcaacgccgaccacaacagtgtgtatttcatcggtagagcaacagggagctgcttctttaagtgcgaagattaccaatgcttctgtttctgaaggacagaagaatcctggaaattatatgccttctgccatttcaattcccgtggggagccatgttctgggcctgggcgcaacaagtattgaagaaacaactgccactatgataactcaggctcctgcagtttcaaaatcagaacgaagaaaacttccaggaggcagtcaacaaggtattcagtttgagagttcagcatcaaaaacaaagatggtatcagctgtggaaccagcacctgcaaatgttgaatgcatgcaaggtactgaagttaatagttcagaacagacaatagtttctgctactgaaccagcacctgcaaatgatgaacacatgcaagagcaaccaacaaatatcgtttcatctgtggaatcagaaccttcaaatgatgaagagcacacaaagcatgaagtgtttcttgcgactactggtgataatatgcttgcttctagtgcaggaactgaaatattgcgggatacagttgagcatgctgcttgccagccagaagcagtatgcacagatggaactgcaaggcagtctgaattgtcgcaacttgatagaaaagcctttcatgatgcctcatataaatacactcatgggtccactaaagatgatggtatcttgcccagtgaaggtacttctgttgatgttactggttctaagcaggatgatgtgaacattgttggcacacaaactgatgatgtttctcggggttctagtcattttccagttattttacagtcaactgagtcagatcggcctccaggtcaagtgaagaatttggagagtaggatggagcaggtgaaaacagaagaagctttggttaacagttctggtggcaatcaaactcacagtctgggcgatgaaccttctcataatacatcattagcaagaaattctccctcagaacactcgaatgagcgttgctctgatcaagtaattggtgaaaatttcaaaagtaaagaaaatattgttgaagtccattctggcattaatactgatggccccgatgaagctctgaatgcattgcacacccaatctaaggaggccagcatgacagatattggtgtacctactgatggtgatagatgtgaaggtaaagggactagtgtcgaggtctgtgctgacatgaatactgatgggcctgtggctacccaggatgcttcgtccacgaaatctgataaagagtcctgcatgatggaatgtggtgtgtctaccgatggctgtcccacagtttgcaaaacacacaatgatctccagggtcatgtatcttgtgaagaaacctttgttaggactggtggtgatgacacaacccatatcaccaatgcaaattatggttctaataatgaaagtgaggccaccattgctagtcctgttgaaaccacacaaaaactgatggaagggagcactgttattgtgtcggagaattctgatttaaataagcaatgccacacattgcatactagaaatgatcctcctgcaaataccctgttgatagttgagtctaacaaagttacttgtgatgctgaaattgtttgtgctagcaggttagaatcttctggcattgaggctgaaacagtgggtatccaagagtcagctcttactgattttgagggaacaaaaggaactggggatttgggtgacagaactaacagtcaactgcatgatgatgttcatgggacatcatgttccacgatagctcttgtatctgagaaagaaccttccgaagatcttaccaccggtagccattcagaagcatctaatttacttgctgctgtagaacaaactcaagaaactactgttgagaaccaagagatcatagatgcagtagtgtttatggatgcctgcaaggcagaacctgttggtgattttactattgctaaaggagctgaacagactgtagaaatggttcattatgttgataagcaatctgctgtattagactatgttgagacacagacaaaacgaacttcggtttgtggttctacggtaaatgaatcccctcaggctgcagggttggaagaagactgctctgtactgaagcatggtgatcctacttcatctgagcttcttactgtagcacctaatccaatcggtgaaacttctgttattcaagtggaaccagaggcaagaaactcagatggatactgcacaacagaggctggcagtgctttatctgaaactgtcatgggattggagccaaataaagaaactgcggttccaatgcaagagaatattggagaagctaatgataattttaataattgcgaagcacacaataattcggagattcatgcatttgaagtgtcgatggaaacacagtcatcagaagtcaaggaagtatcttctattcagtctggtgcagcaaatttgagcacacagacaactgcactgcctgatgtaacaggacaaaccagtatggcatcgactggagaactagtacctacaaatgaacacatacacatgcaaggcactgaaatcaattcagagcaacaaacaaagatggtttcacctgctgaatcagcacctgctaatgatgaacacgtgcaagacattgtgattcttagttcagaacagcaaacaaagatggttttagctgcagagattgacgcattatgcgtccaggagactgcaattattgatcttgggggagcaagaggaacagttgacctgaatgacataagaacacaggttcctgcattacctggaagggatgtgctagatgtggaggcacatattttggagcaaaaaaaaacatcttcaccaggtgatgaaattaagggttcagaacaagcaaaaatcgaatcgattgcagagatcgaaacagtgggcgtcaaggagaatgtcattgctgatcataaggaaacaggtaacaacagtggcgtaagtatacatgcgcctctattagttgaatctggacaaaaggcatcacctggagttgaattgcgtggtattgaggttgatgctcatgttttggaacaagcaaagatggtttcagctctagaaccagactctactccagaagtttgtgctgacaagttagaaccttctggtgctgatgatgttggaatgattgttgtccaggaggctgcttctgttgatgatcacaatagagcacaaggtggtgaggctcattgttcagaacaaataaagatggcttcaattgcacaagcggtgtctagcatggctttagtaggatattcttcttcagaagactcaatggtggatgctgctgcccgagtaactgatgctgattttgtggatagtaaagcagctggtgtttatcgccaagaaactatgcctactcaaaccacctctaccctcccagagaacatggattctcctgcaactgctgctaccatggttgaatcgaagtttgctgcctcgtctgagcacgttgcaggacccgagccaattgatgaaacttctgttatgcaagtggaactggcaacaagcacaggggatggatgtgcagcagatggtcacaatcttgtttcatctgaaactgttgttgaagtgaagcttgctcaagaaattgttgttcctagtccaggtggtagcatagaagctaataatacttctaccatcagcgaagtatacaaagatacccagtctcgtgcatctggtgaagcatgcaatgatggtcagtctcatggtgatgaaaatatgaaacttggtgaagcttacactgaactgcagctggcaccttcctctggtgaggaggccatgacatgtatgtgtagtgagctgcccagccaggaggtggaggctccaagcagtgaccctttggagaataatgaagaaacgaaaaatgaagctgctgctcaaggatcagtaaatgaggattctgctcctcgtgctgaaaatgcaaagattgatgaagctgacacagaacaggaactgcttccatctggtgaggccacggtagacgaatccagcgagctactcagccaagacgaaaaggtggctcgtaaagatgcaaagatggaagagtctgctgctgctgctgctgcacagagacagctaactactgaagttgctcatgcaagtgaaaacgcgaaacttggtgaagatggcacggagctgcaactgccaccaccttcaatggtagacatatctagggagcaactcagccaggaagtggaggttgcaagctctgggccttcaggaactgatgaaactgctgagatgaaacggctaaacactgaacattcacctggtgatgaaacttcaaaacttgttggaactgatctaggactgcaattgtcaccttctggtgatgccatggtagatatatctaataagccacccagctgccaagacgtaaaggaggccccgagcagtgacattttgggaaatgatgaaaattcagacaccgagaagactcctgctgccttgcatggacggctgaacaccgaacttgctcctagtggcagaaatacagaatttagtgaagctgacactggaaaacaagagacacccgtgtctgctgaggctatggtagaatcatcgagcgagcctcgcagccatgaggcaaaggaagctccaacccctgacctgtctggggatgatgaaaaagcgaagtcagcaagggctgctgttgttgcggaactttttggagatgcaacagaaggtggttcggatcagccattgccgtctcctagagaacaaggcaaggaagcagaggccgatggaggcttttagagtaaagttgcaaatattgtatcaagagatactagaatccgtgtaagtaagaactgctaatagtgcttttagttgtaactggtgtaagcttctactcagaatcaaaagcgacgtgctgagattacagcaacagtggcctacggcagtttactactgttttgtgcaatattgctgctgagttttgttgagacaggcaattgatctgtc

SEQ ID NO: 10961 - DNA, 1583 bp, Zea mays
atgcgagccttccaatctctaggagaaacgtcttgccctccactccaacatcgacacgactactcgtccgactagaaccaaacttttcaatccatcgttcgcagttcagttcacacttcacaggcgagcagcgaccatggatacccaagcacgtccggttcctccccgcgtcaagctcggcatccagggattcgaggtgtccaagctggggttcgggtgcatggggctgacgggcgcgtacaactccccgctggacgacgaggccggcatcgccgtcatcgcgcacgctttcagccgcggagtcaccttgttcgacacctccgacgtatacgggcccctcaccaacgaaatcctcctcggcaaggcgctgaagcagctgccgcgggagcaggtgcaggtggccaccaagttcgggatacggcatgacgagagcggcacgcggaccgtgtgcggccggccggagtacgttcgcgcctgctgcgaggccagcctgcgccgcctcggcatcgactgcatcgacctctactaccagcaccgcattgacaccacaactcccatcgaggagacgattggcgagctcaagaagctggtggaggagggtaaggtcaagtacatcggattgtcagaggcgagcccggacaccatcaggcgtgcacatgctgtgcacccgatcaccgcggtgcagatggagtggtctctctggtctcgcgacattgagcccgaaattgtgccgctctgcagagaattgggcattggaattgtaccatacagtcctcttggccgtgggttttttggtggaagaggagtgaaagaacaagtgtctgctgaatctaatctgcatgggatcccaaggtttgctccagaaaatttggagaagaacaagcaaatttatttgcgaatggaagaactggccaataagcaccagtgcagccctgctcagctagctttagcatgggttctgcatcaaggagatgatgtggttcctataccagggacaaccaaaatcaagaatctagattccaacattgactccttgaaggtgaaactgacagacgaagatctgaaagaaatgggcagccagatacgggaagaagatgtggctggtggaagacaattcacttcatttgcacataccacctggaagtacgctgatacgccaaagaagcagagctaaaaaatacttgaaagcaacaatgatgatgcgattggtatggccctctccctgcagatgccctcaggaacattgccgatgcccctttgtgaacagcctcttctagtaaataataatgtatggagaagaacaatgaagggcccagtcttgttggaagtacgaataatgtacagttacaggaatgtgtgctaccatatatttcgtcgcatcagtttgagttgtggttgtgtgaacctaccatatatttcctcgcaaaagaataatgtatagttacaataatgtgtgctatctcaatcagcatgcaggcaggaaaaacatggcaccatatgtagtacagtacatgaattctcgcttgtaatccacatttagacctgaaaatgcgaaaaagaaaaaccgaaaaaaaaaaaaaaaa

SEQ ID NO: 10962 - DNA, 1755 bp, Zea mays
atatattcacctgagccaggtcgctgtttcatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgccacctgcttaccacttggatcctggctccggagcgggcagcagaagctggattgtgaacttagagggaggtgcgtggtgcaacagcgccaagacatgccggctcaccaggagctccggccgtggctcgtcggaccacatggccaaagagatccccttcaccggcatcatgagcagcagccgtaccgtgaatcctgatttctacatctggaaccgggtcaaggttcgctactgtgacggtggatcttttgccggcgaggccttcgacaaggacactgggatctacttccgagggcagcgcatctggaacgcggtcatccggcacctcctctccattgggatggccaatgctgaccaggtgctgctcgccggctgctcctcgggcggtctggcggtgatactgcactgcgaccagctccgcgccttcttcccgtccggctccaccgtcgtcaagtgcatctccgacggcggcctctacctcgacgccgtggacgtctccgggggccgcagcctgagatcctacttccaagacatcgtggccatgcaaggaatagcacagaacctgccgccggcttgcaccgcccgcctcgacgccacctcgtgcttcttcccgcagaacataatcgacggcgttaaaactccactgttcctgctaaatgccgcatacgacttcattcagattgtgctcagcctggcgccagacagagctgacccaagcggcgcttggcgagcctgcaagtccaaccgcacggcctgcagcgcatcccagatgagtttcctgcaagatttcagggaccagatggtggcgtccgtcaaaggcttctccggctccaggagcaacggggtcttcctaagctcctgcttcgcgcactgccagtccgagcagctgggcacctggaacaccaaaccaggtggctcccccaccattcaaaacaaggggatttcaaaatccgttggcgactggtactttgatcgagctgaggtgaaggcggtcgactgccgctatccctgcgacaacacttgccaccacattatatgagaggatccacgtttttttattagtttatgcatagggaagaacattcgctctctcaacgaagtgtacatcgtatttgattttgggaatgcaattggatacagccatcaaaggaacaccaacacgcgaaaataaatggtaatggcgtgttccagtaagacaatggagtgattcaacagctgttgtttagcatttgatccatgcaatggagttgctctgtattatcattctagtcagttggcactgctaccagcaaatatcttctactagtacattcggaattctgcgtgcctgttcatgctaatcctgcaaaaactgaaggattgagctttcagtaatcagtgccgataagaatgaattacattattatacg

SEQ ID NO: 10963 - DNA, 831 bp, Zea mays
gctacagctcgctcgctgagttagtggctctggccgtctgtgaaccaagagggcttgtgtgaggtaggtgaaacaaagtcgtcgagcgctctttccctctctctatacctctctgtctgcgacgcggttggataggctaccgccgctaggtgccgactgccgaggccctcaccggcggcgaagagcgcccgccagcaatggcagcaaggtgtagtagcctttcctcgccatccttgtcggtccatggacccctccgccgcaataaacccagcaagagactcgctccatgcctgccatcgtcgccaagaccaggagccgctgctctgagagcgcgtgctgcgaaacttcctccaggggttgaagcgcccagggtgcaaccgaagctgagcgagcccttcttggggttcacccagaccgcggagatttggaactccagggcctgcatgatcggcctcatcggcaccttcattgtggagctggtgctgaacaaggggattcttcagatgattggggtggaggtgggcaagggtctggaccttcctctttgaagggtgaccaaacagtaacattatcgtttgctggtgtattatgctggccgaaaaacatgaggggtttcacttgcttttgacttggtggctacatatgcatgttcatcatgcatgtccttggatatccggatgttacaacatcaactgtgttaatgacttggtggctggccgtttgacagggttaattggtgaacaaaaacgtgtgccttgtgaaacagagaaagataattgatgccaccgagaaaaaagtactggtttacaagccagtaaaaaaaaagcggcc

SEQ ID NO: 10964 - DNA, 870 bp, Zea mays
cattgggtacctcgaggccggccggggttgcttgctcatgtgtggccggcgctgagacgcacggctacagctcgctggctgagttagtggctctggccgtctgtgaaccaagaggacttgtgtgaggtaggtgaaacgaagtcgtcgagcgctctttccctctctctatacctctctgtctgcgacgcggttggataggctaccgccaggtgccgactgccgaggccctcaccggcggcgaagagcgcccgccagtcccagcaatggcagcaaggtgtagcctttcctcgtcatccctgtcggtccatggacccctccgccacaataaacccagcaagagactcgctccatgcctgccatcggcgccaagaccaggagccgctgctctgagagcgcgtgctgcgaaacttcctccaggggttgaagcgcccagggtgcagccgaagctgagcgagcccttcttggggttcacccagaccgcggagatttggaactccagggcctgcatgatcggcctcatcggcaccttcattgtggagctggtgctgaacaaggggattcttcagatgattggggtggaggtgggcaagggtctggaccttcctctttgaagggtgaccaaatagtaacattatcgtttgatggcgtattatgctggccgaaaaacatgagggtttcacttgcttttgacttggtggctacatatgcatgttcatcaagcatgtccttggatatccggatgttacaacatcaactatgttaatgacttggtggctggccgtttgacagggttaattggtgaacaaaaacgtgtgccttgtgaaacagagaaagataattgatgccaaaaaaaaaaaaaaaaaagtggcc

SEQ ID NO: 10965 - DNA, 1004 bp, Zea mays
  misc_feature (989)..(989): n is a, c, g, or t
  misc_feature (1002)..(1002): n is a, c, g, or t
agccgccgccgcctctacctcttcctacgcttccttctctccaccgcggtcccgcaccacgggcacgcgccgtcgcctcgcccccacggcctacgccgccgccgcggcagctgcggctgaggccccgctccccatgacgccccgtccgaccattcattcgttcaccggccagcgtcagccagccaggcgtccagctccaacactgttgccaaatgccaacactccagtctctaggtgatggtcggtcagccaccagggcctccccgttcggccatcgtgcgtccaacagtcgggcaccggcgggcggcggccgctcgcccctgcggcttgggcgctcggccacggccagtgcgggacggggggggggggggaatgcttatggtaactgcccaaaaaacaaagagagggttagctggtgttcattttttctgctgtgcgttcaggttgaagcgcccagggtgcagccgaagctgagcgagcccttcttggggttcacccagaccgcagagatttggaactccagggcttgcatgatcggcctcatcggcaccttcattgtggagctggtgctgaacaaggggattcttcagatgattggggtggaggtgggcaagggtctggaccttcctctttgaagggtgaccaaatagtgacattatcgtttgctggcgtattatgctggccgaaaaacatgagggtttcacttgcttttgacttggtggctacatatgcatgttcatcatgcatgtccttggatatccggatgttacaacatcaactatgttaatgacttggtggctggccgtttgacagggttaattggtgaacaaaaacgtgtgccttgtgaaacagagaaagataattgatgccacccgtgaaattagtactggttttataagataagatcaatgcaaaaatgggagaaggtggtcttctccgttgcgctcctaaaatatttgagcagtctggagtggctagtttgttttcanacattggactttntc

SEQ ID NO: 10966 - DNA, 2219 bp, Zea mays
cctcgaggccggccggggcggccctcgccgcggccggccaaaccgtctaagacgtcatcctaattccttcacgacgctaatctctctgcttcctctgttcctcccctttcccctcctccccctcccgttttcctttccctttttcctccacacaagcaaggcgctcaacctgccgcccgggaaaaaccctagaccggcgatgtccgtccccggcgcccccgcgggcggcggttcccgcagcttcgacttcggcgccgacgacgtgctctgctcctacgatgacttcgccgcctcgtccgagcccaagcgccccgatccggccgacagtgtgcccgattttcatgatagcagattggggaggccatttgtgaaaccttatgaacaagaaagttatgggaaagaggatgtgctttctgctgttgagaaatgcatgaaaaagtatgctgataatttgctacgatctcttgagggaatcactagtcggctttcgcaactggagatttattgctataagcttgagagatccataggtgaacttcgaagtgatgtgcttcgtgatgagactgaccataggttgaagtctcttgagaaacatctaaatgaagtacacaggtctatccaaattcttagggacaaacaggagttagctgaagctcagaaggaattggccaaatttcagcttacacaagatacatctaaaaagaaggaagatgtaccaacatttattcctgagcaaaagaagcctgaagaaaaccctgacacatcaaaccagcaactggctcttgttttgcctcatcaggtgaacctgccatcacttgcccctagagcttctgaatcagtccaacagtacaagaatcaacctgtgcaaccatcagacccaacccctcctgtgccacagcaggaccgctatgttcttagccaagccatcgtctactacccacagcgccaagctccaggtatccaggacacacaagggcaaaaattgcaaccagaagtgcaatacttaccagcaagacccccagcacaagatgttccggtccatgctccatcccaaccacctcaggctggaaaccaaacacagccacagccttaccctccttaccagcagcagtggcaccagcaatcctcccagccagctcctgcaccggtggcccagacacagcagactttctcacagacatttcctccacccgcacagcagcctcagttatcaaacgtgcagcagtttccaccgcaaccagtacagcagccccaatccaatgctcaacagtatcctccaccagtgcaaccacagcaatctagcccacagcttcctcaggcaatgcaaccacaacatcctcctatgcaaactcagatgagacctcaaaccccaccaaactacccgcattatccaccccaccagccattgaaccccacccctgaaactcttcctggcaatgtggctatgcaaggatcatacaacacttctgttccatcaggtgccaaccgtcctgaactgccatattcgtatggaggggctggcatcccactgccacagcacaacatgcaaaggcaccagctaccaccttcaagtcagggctcctttgggccacctccaagcaaagggtcctatgctggctctccacagtatgcaccacagggcaatccgcaaggctacagcacaggttacgcttacccaccaaacggccctccagcagtccagccgcaacagatgccccctggcggagttggcatgagtcatccgggatcgcatatgatgcgtggccatccctacggagaaatgatggagaaggcgatcaccatgggataccctagggaccaagtgctgaacgtcacccaaaggatggccgagagtggccagtcaatggatttcaacaccttgctcgacaggctgaacgaagcagggtcgggagctccaccaccacgcgcgtggtgattggatccagtttgggcgccgtgcttggtgtcggttatgtgacttacgactgttatcatgcagctaaataaataagatttgggttgatgccgtgtactgcttatctgtacaatgtgcatatgtgattttttttccatgtaactgccactggtactacgaacgcatcgcaccaattggactgttcagatattatgtatatatattcggaagcaattactggcaggcatcctaaaaaaaaaaaaaaaaaaaaagcggccaagtactctgcgttgttaccactgct

SEQ ID NO: 10967 - DNA, 3246 bp, Zea mays
tttatcaggccccttcccccccccccccgccctccttccccccgctcctgtgcgcgttgtttctcgtcgccgtcgtccgtcctccggcgtccggcaacctgcaaccggcgacgacgatggaggcggcgctgggggcgctgtgccgcgccggaggctggtcgtacgcggccgtctggcgcttccatccccaagaccctcgattgctcacattgggggactgctactgtgaagatgaggcaaaagcaatggttcacaagatgcttaatcttgttgaagttgttggagaaggcatcctaggacaagctctagtaagcggagagtgtcaatggatttacgacgatacttgccacgcgttgaatcagataagccatgctgataacggagatttacatcagggttatacttggtggcagcatcagtttctcagtgggataaagactattgcagtgttacctcttcagttgcatggactggtgcaatttggttccacacggaaggttcccaggagctcagtttttttgaatcaggtcagagatatatttgatcggatgaagaatgcttcaagcgatagtccaatggagtatacccagaataactctcttgcatacggtcagcaacctatccttacttcatcgagacctgtcaatgacatgctcgtacatagcaaggtcaacccattgcaaactgagaaacttttggaggatattgagagaacagaatctataaggagttcgatctgttctccaagcaattcacagagatctttaaatgatctaacctcccatggtactggtaacagcagcatggatactaatatgattagccatgcctgttaactccaagtctatatatgatctcaaacgatttgataacgtcacagagttgtttcatcgaagttctaatgacagaattggttttcaagtcagctctagtaaagagcctggttctaccattgctggtgtaatgtcaggatacaaaagtttgaacaatattcatatgacagaaaatgattcatgtgatcaaaacatagaatataccccgtacctttacactaccaccaactcttcaaatttctggccttgatgaactttcttattctggcgttgctttgtcgtcatcgtttacagcagtatcagggaaagttaaagattgcctgcaaactgagagtgacaagtttctatgtaaatctgtatcattcggcagcaacccttgtgcttctaaattccaagaaaatcgcctatcaccataccatgccctcatgcacgaacaatccctgatacctgaccctggagaatctgtgaggctcctctcacaagaagaatccttcattgttcaaggtgactcaagtcaattcaaggatactgccgactttacaagccagggtaacagtacatttcctgaattacctaacagatcacctgaagaagctactgctgaaactctagaaaacaacatgaaggactgtagtggaaacaacagtctgctggaaactatgatgcttgatcttagcactaacagctttgtgcaagattggtgggacaacagtgttctactggcagaaaaccttccaaattcaagcgaaaaggacccagagcctgctatggaattggccaataggcattcattgccaactggggagagaggctcgcctttcatacctgtcatcgaacaaatgctaggtgatgttgcacatccacctacacctaccgggcatagttcacttgaggctgaagctactgctttagctggccgtatttcagattatcagctgccccagtttgctttccgagactgcctaacagtagacaacgcacaaatcccagcattggcctgcagtaattatacatgcagaagtagaagtgcacaaaatggttcttcagaggtgccatcagcaaacgtatctgtggacgacacctgcagtttgaacacagcaaactccaatggcagtcagtcgagcaatcctgagggaacgaaggttgctaagagaagagctagagctggggagagtacccgacctagaccaaaagaccgacaactgatacaagatcgcgttaaagaattacgagagattgtccctaatggtgcaaagtgcagcattgatgctttgttggagcgaacaattaagcacatgctgtttctacaaagtgtaaacaaatatgcagagaaaattaagcaagctgatgaaccaaagataatcgacaaagggagcggtgttatcttgaaagacaacccagttgctggcacaaatggtggtgccacgtgggcctacgaggttgctggccaaactatggtttgcccaataatcattgaggatctttcgccacctggtcagatgcttgttgagatgctttgcgaggaacaagggctctttctggagatagctgacaacatacgtggaattggtctgacggtcttgaaaggacggatggagctctgtgatggcaagatatggtcgcggtttcttgtcgaggcaaacagagaggtcacaaggatggatatatttctgtcgcttgttcagttactggaacagaacagccttgttcgatctactgaccagatggccaaggtcatgaataatggggttccatcctttgcaaaccaccaacggtctccgctgctagttccagtgggcattcctgagagactacagtgacatgcagatgcttcaactagatagagttaggtaccacgactgttaacatatctggtagccggaactccatgcattagactgagcctagtgataacatctgaatgaagatagtctcactgctgctaaagatgactgtatcaagaacatgcatgactggtgcagacatgagcctctagcgcagaaattatgaactttccctgattattagtggtgtgatcagtgaaatggcattatctcctgcttagttggttgacaccttgctcctgagtaactgggtcttgatagtggtgtttcttatgcagcgatggcagtgtattagggtagtagtgctagcttgcagttcgttgcccctgagtcaaccttgggcagttcgtggtaggttcttcatgggcttgggcccaggaccgggccccatgcacgtgcaataagtgcgactgcacagggctcaaaattctgaggggccaatatgtatcaataagcagactaatattacaccatctaagttgaactcagttagcagctagactgttgctcttcaaacacatctattaatacatatgtttatttaaaaaaaaaaaaaaaaaaactcgagg

SEQ ID NO: 10968 - DNA, 881 bp, Zea mays
atgtacagaaacaaaagggctctgcctgacagaattgaactagatcgcttggtacttgtacatggccgccctttgcgattatctttctcactattctcagtctactatagagatgaatgccatggcatggtagcctcaataacaacagatatactttacttgtgataaactgaagagatagtcatgaacagcgtcctggaaaatcgccagatactgcccaatctgaatctatagagctaagggaattctgtctgtgttatgctcctctaagtgctgagcctcctgatctgatgttgccccgtgaactttgagttccaaaactacacaatcatcacaagcaagtgcaaagggccaaagtttccagccggcccatgctgtgccgcactcaaggagttcgcgtgcccttactatacgtacctcaatgacgagagcaacgactgtgcatcgacaatgttcagctacatcaacctgtatggcaagtatccaccgggcctgttctccagcgagtgcaaagaaggcaagcaggggctctcttgcgcagatgtcctcgagagagacagtgccactgcaagcagtggtcatcacgctcaaatcagcttgcttgcgttgattactgtcttgagtgtggtagtagcgttgttccactgaactatatatgcattctcccaaatatggtgtgttacaactaatgaggtttgaattgcaccttttggtgctcatggtgggattctaggttcttcctttttgtgtgtaaagtctcacataatgttattcatggcctattgcatactctttttaattcaatttaatatggcagcgggtctgattaaggcccccaaaaaaaaaaaaaaaaaaaaaaaaaatataaaaaagggcggccg

SEQ ID NO: 10969 - DNA, 1076 bp, Zea mays
gcacgagaaacagggaatcaccaaacaaaccgcgtttgctccgcgcctccactccaccccgcgacgctaattaactcctccagctgtaaacctgcaacacttgggttggaggctagagcttgcaaacaccaccagcgaagacgtcgtggcgcgcatgtgggcggtctctgcacccggcgtcccaccgccaccgctactgtcgtagtcctagatccgacagcctcacgagctacattccctcgaggccggccttcccggtgtctcagcagcggcggcgcatggcgatggctgcggggcgtgggctcttggccctcttctcggtcgtcgtagtggctgggctcacctctgcggcgaatggtcctttcctgtccgatagcgtcttccagccgagcgccggatctacagggaggagcttactgcaggccaagaacagttgccccgtgaactttgagttccaaaactacacaatcatcacaagcaagtgcaaagggccaaagtttccagccggcccatgctgtgccgcactcaaggagttcgcgtgcccttactatacgtacctcaatgacgagagcaacgactgtgcatcgacaatgttcagctacatcaacctgtatggcaagtatccaccgggcctgttctccagcgagtgcaaagaaggcaagcaggggctctcttgcgcagatgtcctcgagagagacagtgccactgcaagcagtggtcatcacgctcaaatcagcttgcttgcgttgattactgtcttgagtgtggtagtagcgttgttccactgaactatatatgcattctccccaaatatggtgtgttacaactaatgaggtttgaattgcaccttttggtgctcatggtgggattctaggttcttcctttttgtgtgtaaagtctcacataatgttattcatggcctattgcatactctttttaattcaatttaatatggcagcgggtctgattaaggctatgactagtagatcgtccgtatgaccgtacaaaaatattgtttacattatagactattgttttacattgtgtacttcgaaaaaaaaaaaaaaaaagcggcc

SEQ ID NO: 10970 - DNA, 1664 bp, Zea mays
ggccgcggtgtgggggggttttttggcgggacaaacacttttatgaataccatcacaaaggggccaccagagcgtctaagtgtgatgtttacaagccagtggtagctaaccaattattacggaccataagcacaaacggacatgagctcaagttcagatttttgtcgggcgtggcttggctaccgatgcgttaaatgggaactggtgcatcagatttcgtacaaaatccaacagcctcataaccacccttcctgacacttccataaaccaccacatatacgtagcttattttgattgaaattattgctgatactaacaaaattatgttcagtgcaacacctaacaagctgatcttggggagaactaagccaccactagtgcggccggtattgtgttatcaaatgtatctcgtagttcaggcctcattgaacttgaagacgcaatcataaagtcttcctcctaaaaattgggcgacctcaggatgcttaaccattccaatcttgatcgagtcacatttcatctgcgcatataggttagtttcaattgctcttcccatgccttcgagcaccaccaggtcagcatcatttgccataaaggcaagctctggtgatacactagacaaatcaattacaggcagatcgttgccagagttggcaacaaggaggccagatgcgtccacatttgatagctttccatctgcatccttgagcttgtttataatctcaacaagctctggatacgtgacatcgttgatcgaaggcatatcattagcagcaagtatcacctttgtgccacgtcggagcaactccctcgcaaatggtaatatacccaagataatatcagcaccagagttatcaacaaaaataactgccttttcccatgatttcttggtccatttactcttaaaagcatcaaggtcatcaataacccatggtcgagatacaagattctggcaacttgccaaaaatgacatgccatctttagcaaaaacttctgcaagctgtgcagatcctagatcaaaaatgtttccagctaaaattccacggaccaagttctcaattcttttgccgtcatcctcaatttcgtcattccgcttaataactccctcaaaaagtgacatagccttggcattctcctcatccttgaccttcttgaagatatccctaaatcccagctctctgagtactagctcacgaagcctacaaagaagtatgcaatctggtggtcctccatggctctccggattcttcttcaactcttcaagcattgacgtgtacctctgcgcgaacttctccgctttcgcgggcgcatcgggtacggtggggtcgttctccgcccgctgtttgaaggacgggacagagttgagaaagaggtcaatccattggatctcgacaggggtggccttgcgcgggttgtcggaggggaaacggtaggggatggtgcaggcgcggtaggtgctctcgaccggcgcctgcagcagcgggaacggcactgacggcgacgagctctccatggtatgccacaccctgccgaggcgaactcaccctgctggaggcgagatgcgactgtatttttttcttttagaaaaggaactgacagaaacggatgatgtttcgcttggggtgttctaggtaatggtctcgtgcgcctcgaggtacccaatg

SEQ ID NO: 10971 - DNA, 1326 bp, Zea mays
ggaaaactgtttgtcctgtaatctttgcccctggatctcataccgtttacatatgcgttgttttttctaaaccaaacatcacctaaattcatgggattagccattcacaaatgtcacagcatatccaacttggcatctgctgtccagaatacgttacatcacaattccagtcgcactagtcaccaaagattgacagttatggacatcacaagtacacattcaacttcccacgttatttttggtttcaagatttttcagcatacaataagatctccttttctcattcctgtgatcatctcccattgaaattctttatacctggcacagctcgacatttgatttattccctccttgttctggtttcttgatcatatcaatggattcctattgacatctttgtacagcaagtatctcgtcctggtcttaccaagggcagcataccactgaggaacaaacggtgccatccaaatggtatccccagcttgcacgggataccaactctctcccagtcggtatattccttgcccctctaaaagaagaagtccatgttgattataatgaacctcctttacattgagatattcgcctggttgaaagtccattatatggatattaaagtcataggacagagaagtcggtagcagcttccttagttgaaatacctctcccggggtttcgagaaggggttgcttatctgttgaacccacaattagatcaggatgggaatcctcaatggcattgtacctcctctcaaatattacaagagtggttggttcatctgagatcatagaatgctttgtgtttgcaggaagatatccataagaatccacctttcaacatctttcggtggtagggctgattttgaaccatcttgcatgtttgctagatacataatgaagtgtgcaccaatagctggactgatcaaatatgctcctactgtattgatccaatcaggcaaaggactgaatacatgactctctggtgttattaaagcatgatcccttttgaaaacactacgtgtgaagccaggtaaatcttggaggtgcgcgggcgcgagggtgggatgggtgaccttccagtagagcggctgatccccggagcacttgctggacggctccgccgagcagaacccctcggcgccacctccgtatccagccgccgccgtcgccgcaccgcattgcagcgacgccaagagaacgaagaggaagagggggcggaggcggtggatgcgcgtcatgttgtgcggaggaactggcaatgctttcgggaggcagcggaggcgcggagtcggagatggctacaaggaacgcacaaggacaaggttgg

SEQ ID NO: 10972 - DNA, 1097 bp, Zea mays
  misc_feature (2)..(2): n is a, c, g, or t
gnacttattgtatgctgaaaaacttgaaacctggcacagctcgacatttgatttattccctccttgttctggttcattgtaaacaacatgggcttcctattgacaagggggaacggcaagtctgtcgggctgggcgtaccaagggcaggctaccactgaggaacaaacggtgccatccaaatggtatccccagcttgcacgggataccaactctctcccagtcggtatattccttgcccctctaaaagaagaagtccatgttgattataatgaacctcctttacattgagatattcgcctggttgaaagtccattatatggatattaaagtcataggacagagaagtcggtagcagcttccttagttgaaatacctctcccggggtttcgagaaggggttgcttatctgttgaacccacaattagatcaggatgggaatcctcaatggcattgtacctcctctcaaatattacaagagtggttggttcatctgagatcatagaatgctttgtgtttgcaggaagatatccataagaatccaccagcagagaatggatagttccagtccccacagtcaatgaaatgctcccttgtagtacaaaaacaaacctttcaacatctttcggtggtagggctgattttgaaccatcttgcatgtttgctagatacataatgaagtgtgcaccaatagctggactgatcaaatatgctcctactgtattgatccaatcaggcaaaggactgaatacatgactctctggtgttattaaagcatgatcccttttgaaaacactacgtgtgaagccaggtaaatcttggaggtgcgcgggcgcgagggtgggatgggtgaccttccagtagagcggctgatccccggagcacttgctggacggctccgccgagcagaacccctcggcgccacctccgtatccagccgccgccgtcgccgcaccgcattgcagcgacgccaagagaacgaagaggaagagggggcggaggcggtggatgcgcgtcatgttgtgcggaggaactggcaatgctttcgggaggcagcggaggcgcggagtcggagatcccggccgggaacccccgccggc

SEQ ID NO: 10973 - DNA, 2270 bp, Zea mays
  misc_feature (200)..(200): n is a, c, g, or t
  misc_feature (215)..(215): n is a, c, g, or t
  misc_feature (219)..(219): n is a, c, g, or t
  misc_feature (279)..(280): n is a, c, g, or t
  misc_feature (1648)..(1648): n is a, c, g, or t
agcctgtgtgccctatgatggtgaagcaggaaccctttttccttctaaactgaactgttcagaattcagatatgaaaaaatggatatttctagataatggttaaaatccggcttcaaaccttttaaagaatgggcatcagtccaaaattgatccaaattttggctaactccacacaatgtgtttagcataatatctaatngttaacgtgacatgnaaantttcattgaggaactaaaagtcagttaagaagcctggttctagcactaatcggcaacaannaaaccaaaatcttcgagatagcccccctacgactttgatggttcactgcaattaggagtacatatatattgcttttatcttgtgttttgtctcttaacacacctcctgtgttttgtctcttaacacacctctggtcacattccataatttttactacttaaatattacataattgtattttataattttattaatgcctacctgtgcttatcatcaggttgcccccgggcctttgagttccaaaactacacaatcatcacaagcaagtgcaaagggccaaagtttccagccggcccatgctgtgccgcactcaaggagttcgcgtgcccttactatacgtacctcaatgacgagagcaacgactgtgcatcgacaatgttcagctacatcaacctgtatggtaagtatccaccgggcctgttctccagcgagtgcaaagaaggcaagcaggggctctcttgcgcagatgtcctcgagagagacagtgccactgcaagcagtggtcatcacgctcaaatcagcttgcttgcgttgattactgtcttgagtgtggtagtagcgttgttccactgaactatatatgcattctccccaaatatggtgtgttacaactaatgaggtttgaattgcaccttttggtgctcatggtgggtgggattctaggttcttcctttttgtgtgtaaagtctcacataatgttattcatggcctattgcatacttttttaattcaatttaatatcgcagcgggtctgattaaggctatgactagtagatcgtccgtatgactgtacaaaatattgtttacattatagactattgttttacattgtgtactttgaaatgagagataattgtttacattatagactattgttttacattgtgtactttgaaatgagagataaagacgaggatgagtaaactgttggagtggagatagcttaagaggtgggtaaagcatttactcatatgtcccatgacaattcatccttctctatcaactagtacaatatttgtgtgtgcgatgtcatatcaatcatattggacggtatagtggtacaatggttgtatgacgtgatggtctagtggtaagacaatgtgatgtacccttttcacaaaaaataaatttaaaattaacaatatgatggactctttcaaaaaaataaatttaaaattaaagtgaatcctctccgcttaaaataaatttaaaattaaagtaggcatataacccacacgctagatattaaactatagatattgtattttatcttagccaaaaaattgagatagttatgagttgaaaaagaagttttatagctagcttgatcgctcgtcctcttttagcaagcggggtggtactatccgnaagctgtgtgcgacttggtgtcatattgggcttaggtgttttctcacggtctatctcagaggtaacgacccacgccaggacctcatgctagattagaaagaagtgtaaggattttttttgtaaaaaagacgatggtgaaaaccagaaaaatttgtgctttataggagtattcatttttagattaaatccaacctaggactatgtttaaaattcaaatccaacatgataacacgttttaagtaacatatgtctagacacaatataaaatctgattctaagttattagaattaattacacattcatcgtataaattctcaaactaaaaatcatccaaatgactctacttttataaaagcgacatttttaactgtcgttctgcctcatcatttttacccctcactaccataatatccatgtgttgcgatggtacataatcacgaaaacaatgcactagtacaaagaagctctatagtgacgattgtgaacctattttcgttaacgtttcctaaaaccgtcggtgttaggggtcagtagaaatcatcatttttacaagcgggtaattgaggaccgccagtgaaaatcgatttccacttgcggttgagttaagaaaaccgctaataa

SEQ ID NO: 10974 - DNA, 2095 bp, Zea mays
ggccaccacaagcgaaaggttcatcattgcgagcgatcgattttcctcccagctctggcaaggtccggggatcgtcgcccctccctccgtgtccacgactccacccccgcccctaaaccaaccacgtcggcgtccatctcctccacaacacaacacccctccctttccaggattctcctctcctccaaaagatcggtggcgggtcacgggtgagacgagaaggaaagaagctgacaaaggcgagaagggatagagagaggagagaaagggaaggtagaaactggacagaaagtttctccccgctagaagtagctcggcggtgagggagcgagagacctgccgcctacccttgccccaccgtttttttcataccgtctcgccggaatcctgctttattttcccggccagtccaccgccttctcgggctaccacgctgatccggcgtcgtctgcggtccttccgaccaactcttcaatcttgtgaattgcttttcgcccagttagggcagatcaccattccttgcaggagttcgttgccgtctctccaatcctccctggctcgactgctcagtggtgactgatgtggtccactgccctgccctgcacctgcaagttagtttcactcgtgatccgtcagcttgccacccagcaaccgctgattatcagaaatccacttctcaaagcttcaaggagcatccttcgaacaagttcctgattccttcgcctcccgccctccccgtttcttctctggcatccttgtccgttgaccacagagggaagaaatctgttccgggcaggcaggcgcattctccgccacaatggacgatggagctgacctcccctgccagttgctcttctcccacccggagatgcctcacagcttcgacgagttcttcagcagcgccacgaccacgaccacctgcacccacacgcacagctgcgaccctccgggcccctcggccgccatgcatacccacacgtgcctgcacacgcacacccaggtcctgggcagcggcggggaggacgacggctcagcgaagccgcggaggcccctgggaaacagggaagccgtgcgcaagtaccgcgagaagaagaaggcgcgcgcggccttcctggaaggggaggtcaagaagctgcgcgccgccaaccagcagctcgtgcggcggctgcaagaccacgcggctctggaggcggaggtggcgaggctcaggggcctcctgctcgacgtccggggcaggatcgacgccgaggtcggcgtgtccccgtttcagaggccatgcagcgcgggctctgtggagtgcggcgctgatccagctctgcgcttcgatggcagctcggaggtagtaggaggtggtggctgggagaagagctcaagccctcaagttgcggactgcaggatcgatgaagggggaggagggaagtcacgggaacttgatgttctagaaggtttgcgtcactccattgatgctggggcgacctttgtgagttctgactctcttgctgaacgatcgtgtttgcctggttgacagtttcggggcctctgccagcttctttgggctttgcttgaaagagaaatcacattattcatggagttaggaggatgaggaaccgacagtgagtagaactatcttcgcatcgctgtggtttatgtttcttatgctggtgttcagtgtgtatagatagggtacagaatacttgcatatgagcactgaagaaatcgaaattgacaatgtttcatgcgaaattgtactgcgggtatgtaaatgaagtgcgcctgacttctgacttgtagcctgtttgtgcttagctgaaatattattaagctattaatacaaaaaaaaaaaaaaaatgcacatggtaccgtttgagtctgaaaactcatttacatgggcacactattttttattttatgcaattataagacaacagccactgaattaccaaattatttgttcattttgtggagcatagaggatatttttcgccctttcgttcattttgttcatggtgtgggattatttggcaaggttgtggtctgcatactgtgttgagctttcactgctgtctgaaccaacttgaatttagtagttgaccag

SEQ ID NO: 10975 - DNA, 2657 bp, Zea mays
cgtgattttaaccaagttcaaaaaaattcataattattattttttttatctgatatcatttaacatatactctcttcatgctaatttataattcatttgacttttttatatcaaatttgatcggtttgtcttattccaaaaaatcaaaaatcaaaaaaatcaaaacaatacttaaaatatattatatgataaataatatcacagtgaaaactaataataattataatatttttgaataagacaagtcggtcaaagttagtaaacaatcaaacaaattataaattgagacagagagcaatatactttaagtatgaatttaatttttttatttttcgtaaaaaaattaataaaacgaatcggtcaaattggatttaaaaaagtgaaataaattataaattatgacagaatgggtattaaacaacacttggatgctcaagttttatacataagctttctccattctacctctttatatagtttgattgaataatattgtagcaactttaccgactcttctctgctggcatgttcgtgttatttatgaacaatgacgtgcattgtcaactaggcaacaatattgaggtgcaaaaaagtccaactgaaagacaaaaccaggccaagtggcaggccaccgctcgcggccggccgcgggcattgcgagccaacaaaaacctcccagcactggcaagaacaggggatcgtcccctccctccgtctccaccgcccaccactgatcggatcacgtcggcgtcccatctcctcctccacgacacagaacgccgctccctttccgggattctcctctccaatcgcagctaaaacgcaacgcactggatcggacgtcgccaaaaagatcggtggcgacaccataaagaaagaatccgagaaaaggcgaaaggggaggagagaaaggggaggtacaaaatttctacccgctagaggttagctagctcggcggcgagggaacgagagacgccctaccgtcgattccatatcgtcgctccgatattctgatgccggaatcctgcttttccggctagcttaccgatacctcctaggtggtttccagtcctcacccttccaacctctactatctttttttgtgaatttacctccaccgaattcgggcagctcaccatttcttggagtttggtgtcctttctcgagtgtttccttcctccctcccgggttctactgctgagtggtgaggtctactgccctgcacctgcaagtttgtttcatttgtgatgtgatccgttagtttgccccccagcaaccgttgctcagaaattcagttcttattaaagcttcaagacccttcaaggaacatcttttagacaagctcttgattccttcacctctctctctcttttcaggcatctttcttgtgcgacttgtccgttgaccacaggcggagaaatttgttctcggcacacattctctgccacaatggacgatggagctgacctcccctgccaactgctcttctcccacccggagatgcctgacagcttcgacgagttcttcaacagcgccacgacgacctgcacccacacgcacagctgcaacccgcccggcccctcggtcgccatgcacacccacacgtgcctgcacgcgcacaccctggtcctgggcagcggcggggaggacgacgacgacgccagggaggactcggcgaagccgcgcagaccgctggggaacagggaagctgtgcgcaagtaccgggagaagaagaaggcgcacgcggcctttctggaagaggaggtcaagaagctccgcgccgccaaccagcagctccagagacggctgcagggccatgcagctttggaggcggaggtggcgaggctccggggtctcctgctcgatatccggggcaagatcgacgccgaggtcggcggcgtgctcccttttcagaagccgtgcagtgtgggctccgtggcgtgtgccgatcctgctctgtgcttcaacggcaactcggaggttggaggcggctgggaggagagctcaagaccggcagccgcggactgcaggatcgatgaagtgcgagggatgtcacgggaaattgatgtcccagaaggcttgcgtcattccatggatgttgttgcgagcttcgtgagttctgatcccctggctgaatgagcgcgtttgcctgattggcagttttttttttttggggcctctgccagtgccagcttcttttggcttgcttgaaaggtcaaattttcatgtaattagaagaattgaggaactgataatgagtggaactacctccactgtggtccatgcttcttgtgctggtgttcagtgtgtatagctgagattatattgaactaatataaatgcactgaacactgtttacgtccgaaaaaaggtcatttctgtgggtgcaagattttttattttatttttctgcaattacaggacgactacaaaatcgtcagattgtttgttcattctgcagaacgtagaggattttttttccgcccagagtttctctggaataccactagcccgattgtactttgttcatgatgtgggatcacgtagcaaggttgtggtggtgtgcatacggtgttgggctttcagtactgccttaacccagcttaaatttagtagttgaccagctgtcaggaggattctgctgcaaagagaaagat

SEQ ID NO: 10976 - DNA, 4108 bp, Zea mays
tgatgttggtgtcggtttgctgcataccctaatcatgatgctcatcttggcaaatggaccatgatgcataaattaacaacttttcttcagatgttcactgtcatcatttgtaattatccaataccacgtacagtttgaagcctgaatctggtgctggtgttgcttacctgccttttcacattggaaccatttgcgtgactcggggccaggatatatttctttcttgtcagaataaagataaaaaatatggaactggaaattaggcgtagggaatcaacaggatcaggctctaacacatatgttgaaactgagactcttgcaaagtttgagttgatggatggtgctcctgtgagaggtgaatctattccagtgaggctgttcctgacaccctatgagttgaccccgacttaccgcaacataaacaacaaattcagcgtcaagtattacctgaatctggtccttgtggacgaggaagatcggaggtacttcaagcagcaagagatcacaatgtaccgtctccaagaatctccccctgcctcctagatcccaacctgttgcatcatgttcacttctcaggttttgtacaagtggacgctgaggttagagcaatgtcctgtatataaactaaaatccagaagagcgccacagctggttactgctatggccatgcacgctgcactgtcgtgttcattgtttatgtttcgttgttctttcccttgagtatgacgccaccttgatagcccggggtagaattacctgcctatatttatcgtccttgtggtctgcaagaatcatgacgttattacttaggcacttattcatcttactatctggaagtgatgtgatttgttttggtaagtcgaacgatatagatttatctgtgtttcatgcgaaatgcacttaatcttggttgttgatcaattcattagcttttctcagctcgtctacacctacttatcaagctgttcatctaggtatccaattccttgactgttgtgatgctatcagagtacaatggaagtcttatggatggcacacaactccaagttatgctgcttgatttttattgcaaaaacgcaatccatgatatcatgtcagttctaaaacagcaacaaaacacagcccacagcaatctactgcattaattattatttttgcggcccataaatactatgcctataaacctgagccactccgttcgctattccactatagtcaagccaggagccagaaatccctctgccgcctggtggtgatgaggtagccgccccctcgccggctcttgcgccggacggccagcgccatgcacgccgcgtgctgcacgcagtagtcggcggcgctggtgtagccgcccccgcccccgcccttgacgccggcgatccacatggacagcagccgccacgtgacggaccgcttcttctgccccacgacgaggagcgaaacgccctgcttcctcgccgcctccactatcgccggcccccggtccttgccgccctccgccagcgaaagttccacgcacacctggcagaacaaacacattatcagcagcttgcattgggcacacaggagccaggaggcatcctccaagtcaagctggaaatggggtggggggacatgatcgatcctgtctaggacgacatgcctgtacccctttgatgattagcacatgctgcccccccgctcccgttgttagctgtctgatctttgcttgcgatggcagctctgtgctgttggcatctctctttcccctttgatctgacagtaacagggcccgcccctcttttctttgcactgtttctgtttgacatggaacgaacgccatgtctcgtgggcgttccaacgacctaccacctgtatgtctctatttatacgggaatttccatctgctaactcactgctcgatggacacttcttcgtctatatatggtacccaaaggttaaaaaaatgccatggagtgaccctcctgaggtgtcggcaaagagttttacagcatcagattcagagatctgtgatgtcactccacattactccagcaacgaaaggtacagtcttggacgtttccacgaatcgcacggatcagtaaacagtggtccttgtttggaaacaccactgtttactgattaggcaacacgataagtatctgtcaagaatacttgttatcgtaggtacgcagacatgccatgcgtcaacaactgaatcttactatcgtacattaattggattctgttgcatgtacgcaccaaagagaacgcaacttgttcaacacatactacttgttgtaccatcccaaagaggtcaattatttgggaggaggaaggaccagggtacagttattatgggctatgggatggatgccatcagatcagggactcgacagtcgctaagccattgaatgcgtaccagttgtagctttggaacgccaacatcaatgccaatcttaatctttgacgtcacatttagttaggtgatgtttgaatgcactaaaactaattagctaaaaaaattgctagtgtaatcagctagttaaatattagttaatttgctaaacaatatctcatatctaaactattagctagaggatgtcttcagctaattttggtgctggttagttacctctggtctcttggcctggcagatgctcctcaaggcctccaggtgcggactccctctcggatcgcgtcctgatcgagacgaccacgcaacaaaaacaaggaagagccatctccctctgttttcaagcacgcgacggagcctgtactgtaaccagcaggacttaaaatagatggttattggtcacacgcagcttacgcacgtacggttcttgccgctggcgacgtcgagcaggaccaccgtgtcgcagggccggacggcgtgcgacagcgcccactgcagcgccgtgcgggcctcctcgccgccgccgtccgccgccgccaccatcaccttcctccccacgacgacggcctctgcgctgcccttctcgttagcctcctcccactcgtccttttgcttgccatcctttagggacctgctctctccgccgccgccgccgccgccgtcgtccttgttggcgcatatcgatggaggcgcggcggtggacgcggtgccgccggacctgatccggtggaggcagaaggaagagagcggcctggacatggaggatgctcgctcgtttgcagggcgagtgtgtgtgagtgagcttattattcagcgctctcagtctcaggtgaagagagagggcagagtgccagagtggcatggcgcagaccaattagtaccggctggcatgtgggcccggcgcaagtgtaggggcaaaaccgtaagaagtactcggcgaactggtcaatgatcaattttacgttggctggtgggtggtgagactggtgactggtgcgtgcgccttttcttttcatttagctatattctatgcatttttgcctttcccagctgatgagggggcctcatgcagcaggccgttcccagctgtgcgacgaaaatcatcaggtgaatttggtactaaattacattcagttaaccacagttgaattgattaattaacataccgacccctttataataataagctgagcacagcatcatgcatgcccaataaacagatctttacacaataatttaacagatttaccatcatatatatgtacacattatctaaacctgaaatttcaaacgtgtgctgtctatatatttctttggtacgtaatccctatatatcaaacaaatcatgcactaatttagggcattattctgtcagtcaatcatcatggcccacacacggatcttagcttcaaataaatccttatcttatcctagccttttttgtttggccagaaagggctggcagtgtggcatgatttggtgacaaaaatgcaggcatgttttgacagtgtgtgtgtcctcatcattgccatctacatcaatatataaatatatatatgtgtgtgcacatattccgtttgtctgcgttaattacatcaccgacaaggccggcacagctctgggcttgttgctatgcgtgcactcatgacagcaccatagtacacgggtcctcatctggtgggtttctttgtgatcgatagatagccgtgatag

SEQ ID NO: 10977 - DNA, 1518 bp, Zea mays
  misc_feature (1509)..(1509): n is a, c, g, or t
  misc_feature (1511)..(1511): n is a, c, g, or t
  misc_feature (1516)..(1517): n is a, c, g, or t
atatactttccaaagagagaaagggcaggcccagctctagcctttccaaagtgcgcgcaatctcctctgccgcatccgatattccgatctcgatcccgcgacgcggtgtctccggtcagcgccgccgccttctccctcgccggccgccactgcatcgccgcagtcgccatgaattatatcattggagcattcaagccaccttgtgacatctcgatcacattctctgatgcgaggactaggaagcaggtttcggttaagaaggacaatgggaagacaacgatggtccctgttttccagagcctcgaaactatatctggagaagtatcaatagcaccagttccaggtaaaaggattgaacacacgggtgtcaaaattgagttgctaggccaaatagagctctattttgaccgagggaacttctatgacttcacttcgttagtacgtgagttagatattcctggtgaaatctatgaaaggaagacgtttccatttgaattttcaactgttgaaatgccatatgagtcttacaatgggacgaatgtcagactcaggtacattttgaaggtgacaattggcagaaactatgttgggaatattgtggaatatcgggatttctgtgtgagaaactactcacctgtccctacaatcaataacagcattaagatggaagtaggaattgaggattgcttacatattgagtttgaatacagcaaaagcaagtaccatctcaatgatgtgattattgggaagatatatttccttcttgtcagaataaagataaaaaatatggaactggaaattaggcgtagggaatcaacaggatcaggctctaacacatatgttgaaactgagactcttgcaaagtttgagttgatggatggtgctcctgtgagaggtgaatctattccagtgaggctgttcctgacaccctatgagttgaccccgacttaccgcaacataaacaacaaattcagcgtcaagtattacctgaatctggtccttgtggacgaggaagatcggaggtacttcaagcagcaagagatcacaatgtaccgtctccaagaatctccccctgcctcctagatcccaacctgttgcatcatgttcacttctcaggttttgtacaagtggacgctgaggttagagcaatgtcctgtatataaactaaaatccagaagagcgccacagctggttactgctatggccatgcacgctgcactgtcgtgttcattgtttatgtttcgttgttctttcccttgagtatgacgccaccttgatagcccggggtagaattacctgcctatatttatcgtccttgtggtctgcaagaatcatgacgttattacttaggcacttattcatcttactatctggaagtgatgtgatttgttttggtaagtcgaacgatatagatttatctgtgtttcatgccaaatgcacttaatcttggttgttgatccattcattagcttttcccaaaaaaaaaaaaaaaaaaaaaaaaaaaaaaantnaaganng

SEQ ID NO: 10978 - DNA, 1328 bp, Zea mays
cacgagaccattacctagaacatcctaatcgaaaactgggccctgggtcccttcgtcctgctcatcccctactactagttgagtttttcaagtgaagagaagccattagccatggcggcggtggatctgtccaagctggtgaaggagaagcgcttctgggtggcctccttcctcgtcgtatgggcagcagcgctgcagggccacatgatgtggatgcagcgccaggacaccttcaagcacaagtttggtatcgaccaagcagacggacccgatgctcaggattcctcatcttcgtcttcgtcttcctcttcttaatgtgtgatatgctgttccctcaattatgcctgagaattccatccacaaatgcgatgcatgtcaggggccttcagtcccttggtcaactttttggttgtacatccaagaacatcgataatcatttggatgcccttgcatcacaccaaagtgttggaaacaagaatctttgccagagtgagacattgcaagatatgggcatggatcaatctggtcaacccactttattctgcgaagcatcaatggcaacactactcctgagaggacttgcaatagctcccattcagcttagcccgtgtaccaacttctttattttgctggccattgatacagcctgaaggggcagccagcgatgacattgcattgggtattgctgttggtagcacaggaagaggcaaccttcctggttctacatcagatattcgagcagcgcttcttttacttttgattggtaaatgcacagctgatcaggaggcactaaaggaggtagaaggcaatggggttcttcaggggccttctggatgacacagattcaagggtagcatatactattctgctgcttttcttttgaagagaatgatgacagaggaactagagatctaccaacggatgcttgaaagcctcatctcaaaagctcagcagatgctatgcgtgtgtttggttgcacgtccagtgatagtccgcatggagatggttgagcatgttacgtatttgtgggatacgcgtgaaatcgccgtatgtgttgggccatactcacatcctatgtgaatgatgtaaattatcgatgggggcatgagcctctgaatttgtttgtttattctttgttagactagtcactgtacaagggagtcactgtggataatcctgtgttatggacagagacacagttctacaattttgtattgctgaaccagaggcgtgtatgtttgtaattgtgtagggtggaatatattgatttggggaccctttattgcattgtgcggaactgcagaacttgtctaaaaaaaaaaaaaaaa

SEQ ID NO: 10979 - DNA, 1673 bp, Zea mays
cccggctcccgcagccagcccctacatcccccgctccgctccgcaagcgaaagcgaggcgaggtagggataccgtcgatacgggcccacttcctcctccacctcatttttccgtctcgccccaactgccgaccgccgccctcgccccggctcctccctttccctctagctagcaccaatcgttcatccagtctcacaaccgagctccccgaccaccagcacgcctcgcgcgtccctcccaacagcgtgctccagttccttcaatggcatctcgggcgcgcctgccgggcaccccggcctcgatcgccgtcctcatcctctccttcttccaaggtacgtacgtggtggctctgatccacttgcccgccgtggactgacgggctgcttgggtttgtgggtggtggtggatggaacccggtgcggcaccacgttcaccttcagcaaccgctgcggcgacacggtgtggccgggcctgctcgccggctcggggacgccgccgctggagaccacgggcttcgcgctggcgccggggcagtcgcgcgcgctgtacgcgccgcaggggtggtcgggccgcttctggggccgctccggctgcgacttcgacgccgcctccgccaagggctcctgcgccacgggcgactgcggctccggcgaggtcgagtgccgcggcgcgggggcgtccccgcccgccacgctcgccgagttcacgctcgacggcgccggcggcaaggacttctacgacgtcagcctcgtcgacggctacaacctgcccatgctcgtgcgggccaccgcgcccgaatgccccgacacggggtgcctcgtcgacctcaacgggctctgccccgacgagctccgcgccgcccacggccgcgcctgccgcagcgcctgcgaggcgttcggcagccccgagtactgctgcaacggcgcctacggcaaccccaacacctgccacccgtcacagtactcccagctcttcaagtcggcgtgccccaactcctacagctacgcctacgacgacgccacctccaccttcacctgcaaccacaccgattacaccatcaccttctgccccaaatccactccaaccagcgacaaatccgaacattcgtctcggaggccaagccacgagcaactggaagattcggtgtggcttgcatccttgaaggcaagtgacgccagtgctctggcaacaacgtcatggtcggcgtccattgtgctccgatctgccttggcaattgcagtggcgaccttgcttgctgcacaacttgcaccagatcatcctatggtcagcttgctatgattcatcatggttgcggttcttgatcggtaggagtcatctaagttattttctgacaagaagaggattagagcagtagcagtgatcagcaatgggaagagaatattgtgtaggctttttgtttgtggataggtgctagagaaggaatgatgtgttacaagttggcaactggaatttcatgaacgcattgcaaggcgattcaggttgctctgttgtcatcggcccctttttctatttttgcagtaaagcgcataaaaaacatctcgaatggatactgtaaccatttgatgtgcagaggttcacagagtaatgtgattttggttagaactccaaaaaaaaaaaaaaaaggcggccctttgttatctcctcgaatgtta

SEQ ID NO: 10980 - DNA, 1896 bp, Zea mays
gattgatcttttttacatggtcaagttaagatgccggccgggcttgatcagcgaattttcccaccgctcagcagtgacctcgttcccgtcctcctcgcatccctctcgtccgccgccgcctggctcgcgccgccgacagtttctcggcccagatcgagacacgcccgccatcctacaccaggtgccgaggccttcgccgatcaaagagatcccagacagcagatccgtccgtgccctgctcctcgaaccatggggacctctgcccaggaatcgcctctctggaagcgtatcgacgatgccgagtactatctagtcagtggatcatttgaccaggcggtgttgactgctttatccgtcgccgatgaaatacacatggcttctttggagagcgctagcgaccaggatgagctcctggagatgcttgaatcggctgggatggtgcttgtgcaggcactaaaagaactcaggagggcctctgagatgtttgctcagcttaagatgatgtttggttcagtgccatcagtgcctgctagagttttccttacaggagctaccattcaaatggcagaaggatctatatctgacctcagaccaatctttgaggagtaccttgccaattggagatatacggatgatgaggtttatgtttttgatggaaaatgacagcacttcaaatggttttgtcgttaaatctattatgtcaactggccagtattttgaggtggcagaattgtatacagtaacattcctctgtattgtctctcaagatagtgaaactgctatctcatgggcagaaaaggctcatctaactgagcaaagccggcaggacctactaaaaaagcttcatgcagtgcaattagctgcaaataaaaaactgtccactgttgaaggggtaaaacaaacagcagagaggaacctttctacttctacaaatgactcaacaccatcgccacatgaggatcctccaaagatagttcctgcgtgcgatgggctcaaaaaggtcctgctgaagtctgctcaacaagctcagcatgttgcaaatcattttgatccgtttttctggtggtttcattcaattcgcctgaagtttgggaaaatacatattgttctacccagtggtaagttagtgtttctgttctctctgctgttctcagccatgtacgtgctgcgaaggaaaactgctggcttgaagagggctgtgttccagcaagctgcttccctgcgacgagcattttttgatgcacttcagcttgcgttctctgtccagatgaaccctctagctgctgttcaacaagtgccacaagcccctcgaggaagctggtgattggtgatgttctttatgccttgatctatgtaacattataactcaactgaaattcaacaggcaaccagatttcatgtcgcggaaaatgtggctgtgtaaatactagtgtgcttaatgcagcatgaatgtgatgatgacctgggtttttttgtgtccaaaaaaaaaaaaaaaatattggactggggattatttacaagagctatggcttttgaattggggaaacggattaagtgcaaccaaaccaattagtgtaaccgatgaaaccaagacataaggatggatattttttaaaaaggttctgtgtcttggttgtactgttataacaattggtttggttgcatctcatacgtacctttgattggataggccaaactcgttctggacttgtcttcaacatctcatctgctgctctatgaatcatatccttgacttatcttggcaagattggagcggtggaacaagagggccatcctatgagctctgtgtcagtacaacaatctaggagttgcatggtttctcaaccagcttgtctcgcctagcctatatgggcaagcaaaaccttgccagtccag

SEQ ID NO: 10981 - DNA, 1555 bp, Zea mays
aatacatcaaaaataaatatattacaacatagtatgattatccttaccacggacaagataaatgggtaggtgagagaacaaacttgcttaagcaagccgaggatttatgagcacaacatgccacaacatcaagctgcctaccgtatcatcggtttatccatcatggtgctacacttgacatcgctgagcacggcgctcagacgtattacctcgacgccgtaagtcagggcttcgaacttatggtcttgaaaattaaattaaaatacacaaagctctcaatataaatacttctcaataaaaactaaatcttaacaaattcggacaggcggacagtcaccgtgaccagaaatcctttgccatcgggcatcacgatgacgagcccttcatccccggcagtcacgatgctgcaggacacgtgcacgggcttgctctccctgagcgcaaactcctccagcccgaggtcctgccactgcgcaacctcaggcttgtcgccagtggagccgccggggaccgacaggctatccgcggcgcacgtctcaacggtcatcgctctcgggttgtccccgacaccgtctctagcgacgacgaggagcgtgaaccgcggcacctcggccgcgccgagcctgtctctggcctcgccaacgcaggccccggcgagcgcgcggtggtcgggcgccccggaggctctgaagagcacggtgtcggtgtcggtgtcggtgccgacgccgtcggcggcgaaggcgtcgagcgggacggacttgatgcggcgggtcatggtgttggggcgctggaagtagcccgcgtaccgcatcatcgggatggtggcggccttgttccgggccttgatcgccgcgtgcgtgcgcgcccacgacagcaggaaccgcgccagcgacagcgggtcgcacagcatcaggctgcagctcacgccgacggcgtatcccccgtcgccctggaaccgtgtcagctgaacgaagcagagggcgcacatatcgggaccgtcggcgtccacgtcggtccacggcgcgagagcggcttccctgcgcttgcggtcctgctcgctgacgccggcgccgacgaagtcgtcgaccgcggcctccacggtggccagcacgagcctgacgcccgtgtcgttgagcttcacctcccacagcccgtccgcgcggcgccggaggcggcctgccatctccgggtggtcggccacggcctcgctcagcgactccttcgccaggagagcctcctccgggctccacggcgccgacgcgtcggcggctgcgcggtagtagagcacaacgcgggctcggcgctgcagcgcggcgccagcgacgagcgcgggcgcggccacggccacggggcgcgcccgcccgggctccaccgcgcgcgttggcagcgccgtctgcagggcctcgatatggacgtggcacgcgggcgcggcggccgccatgttctctgttccaatttcagtgaggtgcgctgtgactgccggtgcccggtggtggatgattccgttacgtggaacgggtgcgagagagggcgttggcacttggcacttagcaga

SEQ ID NO: 10982 - DNA, 748 bp, Zea mays
gcacgaggaacacggtgatgggcgggtactacaaggacgcggccgcgacggcggaggccatggccggcgggtggctgcggtcgggcgacctggcggtgcggcacgccggcgacggctacgtgcggatcctggaccggtccaaggacatcatcatctccggcggggagaacatcagcaccatcgaggtggaggcggcgctgttcgcgcacccggccgtggcggaggccgcagtggtggggcggcccgacgagtactggggcgagacgccgtgcgcattcgtgacgctcagggagggcgcggccggcagcgtgcgcgccgaggaggtggtggcgttctgccaggcgcgcctgccgcggtacatggcgccccggacggtggtgttcgtggccgagctgcccaagacagccacggggaaggtgcagaagttcgcgctccgggagcaggccagggccatgggcagcatctccagctccgagcagcaggatggggcagggacgaggagcaagctctgatctgaactcgcatgcccacatggatgtctcctccattccactgacgagtagttgagcagcaacgaacctaagtgtgctgagctgtgctgtgctgtgcttggacatgtagagaaagagaatcaccacactcagtgatacagattcgtcatttcagtaatataatttacagtatcaaccttcaaaaaaaaaaaaaaaaaagcggcgcagccgagaattctgcccggccccggtaccca

SEQ ID NO: 10983 - DNA, 5042 bp, Zea mays
  misc_feature (5025)..(5027): n is a, c, g, or t
ggccggtgtgtttttcttttctttctgttcacttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggacctctggatgcaacagaagaggtgcatcatggagtcgaaaaaggtgatggacatgttacccgcaagagaccaaggagagcagcggcctgttctgatttcaaagagaaatccatacgcttatccgaaaaaaaatctgttgttatggtcaagaagaatcggatggaggaggaagaagtagatgctgtcaatcttacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaagaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttgtctttggatctggtttcatgagagatgatgatggcagttgctgttctacagctgagtctgtgaaatcttcgtcttcctccagcaaagctgaccaactggatgcgggaatccctatttatctgagcccaatcaaagaatggattatagagtttggtggctcaatgatttgtataaccattcggactgatgtggcctggtacaagctacgccaaccaacaaaacaatatgctccatggtgtgagcctgtactgaaaacagcaaggcttgctgttagcatcattaccctgttgaaagagcagagtcgtgcctcaaagctttcttttgcagatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaacaaaagaaattgatgatgaacaagaagaaaatgaagatgaggatgctgaagatgaagggcagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtggctctagaagatgattcaggagacacagtcatttgttttgttgagtacatgttccagaaagttgatggttcaaaaatggttcatgggaggattctgcaaaaaggttcacagacaattcttggcaatgcggcaaatgagagggaggttttcttaactaatgactgcttagaattcaaattagatgacatcaaggaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattgaaaatattctcgaagaccagctttgtctacagaaaggttacatataatgtcaatgagtttttatacataagccctgatttttttgctgaagatgaggatcgtgcaaccttcaaggctggccgaaatgtgggtctaaagccctatgcagtttgtcaaatattgtccatccctgaaggggctggatctaaaaaactcaatccagcatcagcaaatatcagtgctagaagattttacagaccagatgacatttcatcagccaaagcctatgcatctgacatcagagaggtctactatagtgaggatgtaattgatgtgcctgtggatatgatagagggaaaatgtgaggttagaaagaagaacgatcttgcaagttcagaccttccagtgatgtttgaacatgtatttttctgtgaactcatatatgaccgtgccagtggagctctcaagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtgtatcttttacaaaatgggcgattgaatacgaagagcctgctggtgaagcatttaataaaaatcatccagaggctgtggtctttgtagataactgcaatgtgattctaaaggcaattatggataaatgtggggatactgatgattgtgtttcaacttctgaagctgctgaacaagcagcaaaacttccagaagtgaacattaataatcttccagtccctggcgaagttgaattcataaatggtggtcctccgtgtcagggattctctgggatgaatagattcaaccaaagcccatggagtaaagttcagtgtgagatgattctagcattcctctcattcgctgagtatttccgtcccagattctttctgttagaaaatgttcggaactttgtttccttcaacaaagggcagaccttccgtttggcagttgcatctcttctggagatgggataccaggtccggtttggaattctagaagcaggggcttttggtgttgcccagtccaggaaaagggcgtttatttgggctgctgcacctggagagatgcttcctgattggccagagccgatgcatgtgtttgctagccctgagctgaagataacactgcctgatggccaatactatgcagctgcaagaagcactgctggtggagcgcctttccgagcgattactgttagagatacaattggggatctgcctaaagtgggaaatggtgccagcaaactcacgcttgagtatggaggtgagcccgtgtcttggttccagaagaagataagagggaatatgatggtactgaatgatcacatatctaaggagatgaatgagctgaacctaataaggtgtcaacacattccgaaacggccgggttgtgattggcatgacctaccggacgagaaggttaagctgtcaaatgggcagatggctgacctgataccttggtgcctgcccaacacagccaagaggcacaatcagtggaaaggactgtacgggaggctggactgggaaggcaacttccccacatccgtcactgatccccagccaatgggcaaggtcggcatgtgcttccaccctgatcaagacaggatcatcacagtccgggaatgtgctcggtcacagggctttcctgacagctatgaatttgcgggcaacatccagaacaagcaccggcagattggcaatgccgtgcccccgcctcttgcctatgcacttgggaggaagctgaaggaagccgttgacaagcgtcaggaagccagcgcaggcgtgcctgcaccatgagaagttttccttccatcaaaccatgacccatgaagctaagcgctgaggtcgtccttgaggaccagttaattttggttttatcagtcttaatggactcctgaatgtatatgttagagaagtgtcgattgctgattgttaccctgattcagggtagcggttatatctaaaaacttgagaaaatctagtgtactctagttgccatgtgttccattttgttggctctaaactttcaactagttttggtgattaatgacaacatgagattaacttaaaaagaaaaaaaaaaaaaaaaaaaactcgagggggggcccggtacccactcctnnnaaaaaaaaaaaaaaa

SEQ ID NO: 10984 - DNA, 3316 bp, Zea mays
  misc_feature (499)..(499): n is a, c, g, or t
  misc_feature (548)..(548): n is a, c, g, or t
  misc_feature (1031)..(1031): n is a, c, g, or t
gggccgaaatgtggggtctaaagccctatgcagtttgtcaaatattatccatccctgaaggggctggatctaaaaaactcaatccagcatcagcaaatatcagtgctagaagattttacagaccagatgacatttcatcagccaaagcctatgcttctgacatcagagaggtcatctttttttctatcttgtatgcttgatttatctactccataacttcattgttactttttctcaaacatgtgagcaaatcctagagtcctgagaatggtcattcttgtttctttcttgttaactttagtttgttcgattcaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcaggttagctgtactgtactgnagttgctattctgattcattgagtggcagttttgatagtttcctgaatntgtgttccatgtctggagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtatgtattgttaacactgatgctgtataccatgaacatgaccaacaaataaaaaatttcctcattgttcaatgctgtaggtgtatcttttacaaaatgggcgattgaatacgaagagcctgctggtgaagcatttaataaaaatcatccagaggctgtggtctttgtagataactgcaatgtgattctaaagtaagtgcaaattgtttgatgccattattatattttttgttgttgaacagaaccaatatttttggtaatgcagggcnattatggataaatgtggggatactgatgattgtgtttcaacttctgaagctgctgaacaagcagcaaaacttccagaagtgaacattaataatcttccagtccctggcgaagttgaattcataaatggtggtcctccgtgtcaggtttgttattatctacagttctatgtataggccagaaaatcatcagtcacctgttcagttttgtcattcaaatgcttgaattgtttattcttttgttgtcagggattctctgggatgaatagattcaaccaaagcccatggagtaaagttcagtgtgagatgattctagcattcctctcattcgctgagtatttccgtcccagattctttctgttagaaaatgttcggaactttgtttccttcaacaaagggcagaccttccgtttggcagttgcatctcttctggagatgggataccaggtatttctgttaattcattatctgctaagacctatagcttacactttttatggtggtttaaatctgtatactcagaaattgtttgccatttggttaggtccggtttggaattctagaagcaggggcttttggtgttgcccagtccaggaaaagggcgtttatttgggctgctgcacctggagagatgcttcctgattggccagagccgatgcatgtgtttgctagccctgagctgaagataacactgcctgatggccaatactatgcagctgcaagaagcactgctggtggagcgcctttccgagcgattactgttagagatacagttggggatctgcctaaagtgggaaatggtgccagcaaactcacgcttgaggtaactggtgcttcttgatcatctatttttttcttttctttgagctatatgctaaatgagctactgattatcttgtgcagtatggaggtgagcctgtgtcttggttccagaagaagataagagggaatatgatggtactgaatgatcacatatctaaggagatgaatgagctgaacctaataaggtgtcaacacattccgaaacggccgggttgtgattggcatgacctaccggacgagaaggtaattttctgaaatctgttgttatattccttctgtccatggagcactgacccttggcccttgctattcttacaggttaagctgtcaaatgggcagatggctgacctgataccttggtgcctgcccaacacagccaagaggcacaatcagtggaaaggactgtacgggaggctggactgggaaggcaacttccccacatccgtcactgatccccagccaatgggcaaggtcggcatgtgcttccaccctgatcaagacaggatcatcacagtccgggaatgtgctcggtcacaggtaagctggtctacatccatttccatctgcaaaatgacaatgacactcctgtctaatatgatccaatctttgccgtgcagggctttcctgacagctatgaatttgcgggcaacatccagaacaagcaccggcagattggcaatgccgtgcccccgcctcttgcctatgcacttgggaggaagctgaaggaagccgttgacaagcgtcaggaagccagcgcaggcgtgcctgcaccatgagaagttttccttccatcaaaccatgacccatgaagctaagcgctgaggtcgtccttgaggaccagttaattttggttttatcagtcttaatggactcctgaatgtatatgttagagaagtgtcgattgctgattgttaccctgattcagggtagcggttatatctaaaaacttgagaaaatctagtgtactctagttgccatgtgttccattttgttggctctaaactttcaactagtgttggtgattaatgacaacatgagattaacttaaattttgtagaggcatttaaattaggccactaatagtgactatttagtcgctcaatttttttgcccctaattatggaatttgttttttaaaggatgaacaacaagattaaatggattagttcaagtgtcgattggggctaagactatccgtagcggttttttctaactttttctctatgtgccacctttatatcatgtcatactagcaatcctaattaattggttaagggcatcccattacatgcttgtggtagcactgtttttgggtggttttccatggcgcactcaaataatgtgatattatcatgaacaataaataaatcattaacaataaaacatgattataatttatatgtaggattaatcataaaactaggtagatcaacatcaaaagtaataattcattagtatgcaacgtg

SEQ ID NO: 10985 - DNA, 1018 bp, Zea mays
ctaacccaccaccaacgcaataatctacagcagcggaggaaagcactacagctcttggtcgagcagtgtataaatattagcaatcactcatgctcaccgggtgcacgcccacaaatcatccaaattaagctaacaacgaacgacaactccacgcagagcaacaatggcgccgccgatgaaggtgtacgggtgggccgtgtcgccgtggatggcgcgcgcgctggtgtgtctggaggaggccggcgccgactacgagatcgtccccatgagcaggtgtggcggcgaccaccgccggccggagcacctcgccaaaaacccgttcggtgaaatcccagttttagaggacggtgatctcacgctctaccaatcacgcgccatcgcacggtacgtcctccgcaagctcaagccagagctcctccgcgaaggcgacctcgaggggtcggcgatggtggacgcgtggatggaggtggaagcccaccacatggagccggccctgtggcccatcatccgccacagcatcatcggccagtacgtcggccgcgagcgcgaccaccaggccgtcatcgacgagaacctcgacaggctgaggaaggtgctgccggcgtacgaggcgaggctgtccgtctgcaagtacctggccggggacgtaatcagcgccgccgacctctgccacttcggcttcatgcgctacttcatggccacggagtacgccggcttggtgcacgcgtacccgcacgtcaaggcctggtgggacgccctgctggcgaggccctcggtgcagaaggtcatggcaggcatgccgccggattttgggtacgccagcgggaacataccataggctagagaggtgggcgtccgtcactccagatctgaggtctctgaacctcaacgtttccgataaacatgcatgctttatctactgtttaaaaaccaaaaaaaaaaaaaaaaaagtattttagtcctcttaaaaaaaaaaaaaaaaaaaaaaaaaaaaaaaaaaaaaaaaaaaaaaaaaaaa

SEQ ID NO: 10986 - DNA, 2141 bp, Zea mays
ccccaggacagccgtattcggactgtgcgtgaacgaactaaaaaggcgcaacaaactgtgggagtcgctagtcagtacaaaactgaagcggcctttgcccttttgtgactgtcagcacaagcaacaagtccaaactgttgagcacacgatccatccaagtcgacatcctactgctgatcgatcgcgagcttgtcaggttcttcccatccaacgtgcacagctcctatcacggcaaagcaaagcaccagcagcgtacgaggacaaggcctgaatttgttcccaggtgcaacaaacactttttgttctttttagctttgcatccttctcgttccacttacttaatggcacaccagcagcaatgcacaccacggcaacagcattcactgccaagagagtgagcgagcgagcagaggcagcgcagcaatggcggcggcaatagtactctccggccaggtgcggccgcttccctcgtcgctgcccctgtccctgctgctgctcctcctcctcctgtgctgctccggcacctcgtggggatggagcacgtcccggggaggagccgccagggagtgcggcttcgatggcaagctggaggccctggagccgcgccacaaggtgcagtctgaggccggctccgtccagtacttcagccggttcaacgaagccgaccgggagctcacctgcgccggcatcttcgccgtccgcgtcgtcgtcgacgccatgggcctcctgctccctcgatactccaacgtccattctcttgtctacatcgtccaagggagagggatcattgggttctcgtttccgggatgccaagaggagacccagcagcagcagtatggatacggatatggataccatcaccatcagcatgaccaccacaagatccaccgattcgagcagggcgacgtggtggccatgccggccggcgcccagcactggctgtacaacgacggcgacgcgccgcttgtggcggtctacgtcttcgacgagaacaacaacatcaaccagctcgagccgtccatgaggaaattcttgctggctgggggcttcagcaaggggcagccccacttcgccgagaacatcttcaaagggatcgacgcccggttcctgagcgaagccctgggcgtcagcatgcacgtcgccgagaagctgcagagccggcgtgaccagcgaggcgagatcgtccgcgtggagccggagcacggctttcaccagctgaatccgtcgccgtcgtcgtcgtcgttttcgttcccatcgtcacaaggccagtaccaaacgtgccagcgcgacgtcgacaggcacaacgtctgcgccatggaggtgaggcacagcgtcgaacggctggaccaggccgacgtctacagccctggggctgggaggatcacacgcctcaccagccacaagttccccgtcctcaacctcgtacagatgagcgcggtgcgggtagacctgtaccaggacgccatcatgtcgccgttctggaacttcaacgcccacagcgccatgtacggcatcaggggcagtgcaagggtccaggtcgccagcgacaacgggaccacggtgttcgacgacgtgctccgtgcggggcagctgctcatcgtaccccagggctacctcgtcgccaccaaggcgcagggagaaggcttccagtacatcgccttcgagacgaaccctgacaccatggtcagccacgttgccgggaagaactccgtcctgagcgacttgccggccgccgtcatcgccagctcgtatgccatctccatggaggaagctgcagagctcaagaacggtaggaagcatgagctggctgtgcttactcctgctggcagtggcagctaccaacaaggtcaagctggcagcgcccaacagtaggcacaacctcagagtgatctgcctgaataagtactcgtagactgtaataattaaacaaagcttgctcatggttaaactgcgtgttgattagtctttcaactacatagctctaaagtttttgatacaccgagtgatttgccaggaaaaaaatgagcagattgttgtaagcaaaacatgtttgttatggctaaactgcatgtctacctggatttgtattttttttcaaaaaaaaaaaaaaaaaaaaaaaaaaaaaaaaaaaaaaaaaaaca

SEQ ID NO: 10987 - DNA, 1897 bp, Zea mays
cattgggtaccctccgggccggccgggatccttgctcctcctttccttcttcctccattctcctcctcaactccatcgcattgctattccagtcctcacagagaagaatcccgcgagcgagcgagcgagcgcgcgaggcggcaaggacgaacccaagacgtacgatggcgaggaggctggcgtacacgacggcgctgaccacgctcttcagctacgggctgctcttcgccttcggccagctcagggatctcttccgccacctgctcggctgcttcagacccaacaaggacgacgacgtcaagcaggggtacgcgccgatctgcgtcggcctggaggatttcttcgtgcgacgcctctacctgcgggttcaggattgcttcggcaggccaatcgctagcgcaccggactcatggttcgatgtggtggagcgtacctcagacgacaacaacaagacattgcagcgcacctcaaagaccactagatgcctgaacctgacgtcctacaactacctcgggttcgccgcggccgatgagtactgcgtcccacgcgttgtcgactccctcaagaaatactcggcgagcacctgcagtgctcgagttgatggcggcacgaccaagcttcacaccgagctggaggagctggttgcgcgttttgtcgggaagcctgctgctgtcgtcttcggcatgggttacgttacaaactctgccaccattccctgcctaatcggaaagggtgggctgattatcagtgactcactgaaccacaactcgatcgtcaatggcgcaagaggatccgatgcgactgtcagggttttccggcacaactgccctgcccatctggagaaggtcctgagagagcaggtagctggtggccagccgcggacgcacagagcgtggaagaagatcgtcgtcgtcgtcgaggggatctacagcatggaaggggagctgtgcaaactccccgagatcatagccgtctgcaagaagtacaaggcctacacgtacctggacgaggctcacagcatcggcgccgtcggacggtcgggccgcggcgtctgcgagctcctcggcgtcgacccggccgacgtcgacgtaatgatgggcactttcaccaagtctttcggatcatgcggtggatatatcgctgcatccgaggagatagtccagcacttgaagcacacctgtccgggccatctgtacgctacctccatgtcgccgcctgcagtgcagcaggtcatctcggctattagagttgtccttggggaggatggctccagcagaggtgcccagaaactggcgcgcatccgtgagaacagcaacttcttcaggtcagagctcaagaagatgggctttgaggttcttggtgacaacgactctcctgtcatgcccataatgctctacaatccggccaagattcctgcgttttctcgggagtgctttagacaaaaggttgccgttatcactgtggcgtttcctgtgactcctctccttctcgcaagagcacgtttctgcatttcagcttcgcacactagggaggacctgacgaaagccctcgatgttatcagcagagttggtgacctcgtgggcatcaagtacttccctgcacaacgaccaaagattgctgaagctggtcacggcaattgaggcggtagagaggaatgagccctgaaattaccccatgagtggctgaagttgttaagagtccttttaataaagctatcaaataaatagattatcatggaaacaagcacgcgcgcattgatcagtttcgtcgggattctgtcgtattagctgaatattttgttcctgatcttacttacaattacctctccaactccgaatttgtataactggttaagttcaatctgacctgtggtaaacatcaaggcccccttttattt

SEQ ID NO: 10988 - DNA, 1972 bp, Zea mays
ccggggccgttctcctacatcccttttccctctctgcccctgcctccgggccgcccccgccctcccgttatctccctccgctgcgcagcccctctgttagaccgtcgttgccgccctactccaggtgggtaggtcttcttcgggcccttcgccggcgacaagcaccaccaggggacctcgccggcgcaggggagggggcaccgtcgccaggagcaaagagccagcagccgggaaccagagccgccgccacttctagagctcaatcgatcagcgactcagattttcatctgaggatgggtagggactatgaccctatggagattgacgaccagaagcagcaacagctagaagtcaccgctgcggtgccagaagggttcaacactgactatctccgtgtctactacggaaagctcttcccatatggtgatttcttcaaatggctttgctatggaaatgatggaaagcaccctggatgtgatcaatcatatgttggacgtcgagagttttcgtttacactggagaatgacatttacttgcgcttccaatcctttgatactgctactgaattagagagttctatcaaggagaagtgccctttcaagattgatattggacctgtctacagcgtagatccttcaaagcgtcacgcttacgcccaatctggcaataatgtctttgtaccagtcgagagggaactaatttttgacattgatatatctgattatgatgatgttcgctactgctgctctggagctgatgtctgcagagactgctggcccttgatgacaattgctatcaaaattttggatacttctcttagagatgattttggtttcagtcacatactatgggtatacagtggacgtcgtggtgtccattgctgggtctgtgatagcagagcaagaaagctcagcaatgaacaaagggctgcaattgctgactactttcgagtctacaagggtggtgaaaatgcactgaagaaagtatccttggctggacctgttctccatcccttccttgcccggtcatacatggatgttcttaaaaccttctttgaagataggttgctccttaaccaacaactctttgcatcagaggagagatgtcggaagatactcgatctcatccctgatgaaagtgttgctagtgaggtccatgacaagtggcagggaaatagacgatcttctatttcaaaagaagatgtcaatgcgaccagatgggagcaattgaagatgactttacagtctggaaaaaaggctcaggggcttcgtagatgtgtggaagagattgtcttctcatacacataccctagacttgacatggaggtatcaaagcacatgaatcatttactaaaagctcccttttgtatacatccaaagacaggccgtgtttgtgttccgattgaccccagtaactgtgatgattttgatcctgcggctgttccgactctatcacagcttttaggagagctgaatgctactggttttcagacagatcctgaaaataattgggaaagaacgtcccttgggaaatccatcagttttttcagaacttccttcctgcacccattgctgaaagcatgcaaggaggaactggaaagtgcatatagcgcgaagcttcagcagtccaagaattccttggactggtaaaatctacgcatgtttctgcctctgttttatcatcagcccccgttcggccctccctgagcatccaacgggtaacatggacctggtgctaggtggaatatctatgacgctgccaacccgtgttgcatgcctgggatgcatgcaaccatgtcagtttgaagttgcgtcttaggattcatgttaacatggaacaagtccgagtacatgctttgtggtatttttacctttggattagtttattaggttgaagggttataatgacggtcaaacactcgaaaatggatgcatggagatctgcctcggtcatttcgccaaaccacccacac

SEQ ID NO: 10989 - DNA, 1383 bp, Zea mays
atctcacatctcccaccccccggcacgcgccgaaacccaagctcgcgcgaaatccaaggtaagaatccatggggggcggcggcgccctcaccccctcctcaccgtcgagcccgtcggagtcctttcctcccgagttcgtcgagtgcgtagccgtctcgccggtctccgatgacgacgaatcagatgagtgctgcgtttgcgacggcgacgatgtggactccatccgctacttcaaccgccaactgcgtgaggcgaaagagttcatcaggaggtataagcctggggactggattgagggagtcggaggcgcaaaggctggacattttgtcttgcctgaggtcaccacattgctcctggtgggccctagaggttctggcaagagcacacttgtaaaccgaattactagggtctttgacaaggatgatgatccttttgcaccagatcgagcacaggtgtcatgcaattcaaaatcaaatggtacaatgtttcttcgcgagtatccaattccaaggaattcaagtgccgtatgtatttacgatacacgtggctggtcaaacgacctagagaaaaatttcaaaatgctgcatcagtggatgacaaaaggaataagccatggggagacaacaatgtgggatgatgatgaaggcaataagatagggaacatgaaaccattggggaggcaatacagttttcttcgttacaaaatccggaaggtcaatttcgtgatatttgttgttgatggtgttgctgtcctcgagtcaatggatgacagcaataaaggatacactgagatacttcgtcaaacttttatgtatccgttcttgtcgattggagatgataaacctgttgttgttgtcacacatggtgatagactgtcgatacagcaacgtgttcacgttcaagctgagttagcagagctactagatattcctgcccagcaaatttatgatataccaggatccgatgatgaccaaactgatatggctgtactggatatgctacattactgtgtccgacatgcagagcagaacctccctgttaagttaaactaccatttggaggtgcttgggcgtgaaactctcaataaaatggcagagcaattgatgggcttagatgcagtcattgaagtcgccattattttcctatgcatcctggtcctgctgcttcgattttccgataaattggtgcagccgtagctatgttctgcacttgggttgtaactaagaaaacatcatggtgactacttgtcctcctcagctagtagagtaccctaactactttgtgtgcattgtatatattgacagaacgcactgtgctggaaatctgtatatatttacaataatactaaatccgatctcgaatatttgtcgcaaaaaaaaaaaa

SEQ ID NO: 10990 - DNA, 1254 bp, Zea mays
gggtacctcgaggccggccagtgaaggtgaaggaccaaagctaaaccccacgtccccctcacgcgctcccatctcccaccccccggcacgcgccgaaacccaagctcgcgcgaaatccaaggtaagaatccatggggggcggcggcgccctcacccccaccagcaccccctcctcaccgtcgagcccgtcggagtcctttcctcccgagttcgtcgagtgcgtagccgtctcgccggtctccgatgacgacgaatcagatgattgctgcgtttgcgacggcgacgatgtggactccatccgctacttcaaccgccaactgcgtgaggcgaaagagttcatcaggaggtataagcctggggactggattgagggagtcggaagtgcaaaggctggacattttgtcttgcctgaggtcaccacattgctcttggtgggccctagaggttctggcaagagcacacttgtaaaccgaattactagggtctttgacaaggatgatgatccttttgcaccagatcgagcacaggtgtcatgcaattcaaaatcaaatggtacaatgtttcttcgcgagtatccaattccaaggaattcaagtgccgtatgtatttacgatacacgtggctggtcaaacgacctagagaaaaatttcaaaatgctgcatcagtggatgacaaaaggaataagccatggggagacaacaatgtgggatgatgatgaaggcaataagatagggaacatgaaaccattggggaggcaatacagttttcttcgttacaaaatccggaaggtcaatttcgtgttatttgttgttgatggtgttgctgccctcgagtcaatggatgacagcaataaaggatacactgagatacttcgtcaaacttttatgtatccgttcttgtcgattggagatgataaacctgttgttgttgtcacacatggtgatagactgtcgatacagcaacgtgttcacgttcaagctgagttagcagagctactagatattcctgcccagcaaatttatgatataccaggtgcttgggcatgaaactctcaataaaatggcagagcaattgatgggcttagatgcagtcattgaagtcgccattattttcctatgcatcctggtcctgctgcttcgattttccgataaattggtgcagccgtagctacgttctgcacttggggttgtaactaagaaaacatcatggtgactacttgtcctcctcagctagtagagtaccctaactactttt

SEQ ID NO: 10991 - DNA, 775 bp, Zea mays
  misc_feature (12)..(12): n is a, c, g, or t
catgacacaagntggaactttcaaatactatatcaaggttgttccgactgagtacaaatatctgtcaaagaaaatattgccaacaaatcagtattctgtcacggagtattttcttcccattcgcccaactgagagggcctggccaggtaggtacccccctcccttccttttcaagcatgctcccttccttttcaagcatgctatcttcatttattctaaaagctgaagtgtttttttttcatgtagcggtgtacttcctgtatgatctctcaccaattacagccccggtcaaagcggagagaacgcgcgtccttcattttataactcgtctttgtgcagttcttggtggcacatttgccatgacaggaatgcttgaccgatggatgtaccggcttgtcgagtcagtcaccaactcgaagaccagaagtgtactgcggtaactgcacaattcatgataggcggaaaacagctggtaccgtggctaatgaagccaatagacggacctttgcccccaagctaacggatgaagcaatgctgatttgcatgttttattttctccgtacatgactaactttatcatcagttatgttaaattgacactaagtccacggactacagttttgtaaaacttgatgaggaatatgtatgcaaagaaagcgtgggtccagaatagttttctgtgaaaaatcaatacaaatgtagcttcagtgtgctctgttcccaaaaaaaaaaaaaaaaaaaaaaaaaaaggtactctggcgttgttaccactgct

SEQ ID NO: 10992 - DNA, 1525 bp, Zea mays
ttgccccaaaagtaaatgtcataatagaggaaaccagctgtcttgcatcaccacgagcgtgggctctctcctttctcgacgacgactgggccaccgtcgctgccgcctgccgcctgccgccctgcgccaggtgccaagcagccaggtgttcttggggcccttcgccggcgacgagcaccaccagctgaaagatggcgaggataccgtctctgaagagcctcaatgcgtttccacatgcggaagagcacttgttgaagaagacttactctggcgctgttgtgacaatttttgggctacttataatgattacactgtttgtgcatgagctgcagttttatcttaccacctacacggtgcatcagatgtctgtagatctgaaacgaggagaaactctgccaatccatatcaatatgtcatttccttctttgccatgtgaagtattgagtgtggatgcaattgacatgtctgggaaacatgaagttgatttgcatacaaatatttggaagcttcgcttggataagtatggccatatcatcggtacagagtacttgtctgacctagttgaaaaggggcatggggcacatcatgatcatgaccatgatcatgaccatcacgatgaacaaaagaagcatgaacaaaccttcaacgaagaagcagaaaaaatgatcaagagtgtgaaacaagcactcggaaatggtgaaggctgccgggtctatgggatgttggatgtgcagagggtggctggtaacttccatatctcagtgcatggtttgaacatttttgttgctgaaaagatttttgaagggtcaaaccatgtgaacgtcagtcatgttatccacgagctgtcatttggcccaaagtatccaggaattcataacccactggatgaaacttcaaggatacttcatgacacaagtggaaccttcaaatactatattaaggttgttccgactgagtacaaatatctgtcaaagaaagtattgccaacaaatcagttttctgtcactgagtattttcttcccatccgtccaactgacagggcctggccagcggtttacttcctgtatgatctgtcaccaattacagtcaccatcaaagaggaaagaaggaacttccttcattttgtaactcgtctatgtgcagttcttggtggcacatttgccatgacaggaatgcttgaccggtggatgtaccagcttatcaagacagtcaccaactcaaagaccagaagtgtactgcggtaattgcacaagtcatgatggatggaaaaccgttggtagtgtggtaccgtggctaatgaagcctttgcccgaagctaactgatcaagccatgttgatttttgcatgttttattttcttcttacatggttaacttataatacgtcgttgtttttttttccatcaactatgttagattaacacagtccacggactacatggttaactatgttgctagtggaactgaaatgccaagccgatcttgatcaaccccataaaaaaaaaaaaaaaagcgcgagggggggcc

SEQ ID NO: 10993 - DNA, 1606 bp, Zea mays
aacacactaggagaggtaaaaacgaacgaagttgcatctgggtagacggtagaggcaaccacacaattgccccaaaagtaaatgtcataataggagaaaacaactgtcttgcatcaccacgagcgtgggctctctctctcctttctcgacgacgactgggccaccgtcgctgccgcctgccgccctacgccaggtgccaagcagccaggtgttcttggggcccttcgccggcgacgagcaccaccagctgaaagatggcgaggataccgtctctgaagagcctcaatgcgtttccacatgcggaagagcacttgttgaagaagacttactctggcgctgttgtgacaatttttgggctacttataatgattacactgtttgtgcatgagctgcagttttatcttaccacctacacggtgcatcagatgtctgtagatctgaaacgaggagaaactctgccaatccatatcaatatgtcatttccttctttgccatgtgaagtattgagtgtggatgcaattgacatgtctgggaaacatgaagttgatttgcatacaaatatttggaagcttcgcttggataagtatggccatatcatcggtacagagtacttgtctgacctagttgaaaaggggcatggggcacatcatgatcatgaccatgatcatgaccatcacgatgaacaaaagaagcatgaacaaaccttcaacgaagaagcagaaaaaatgatcaagagtgtgaaacaagcactcggaaatggtgaaggctgccgagtctatgggatgttggatgtgcagagggtggctggtaacttccatatctcagtgcatggtttgaacatttttgttgctgaaaagatttttgaagggtcaaaccatgtgaacgtcagtcatgttatccacgagctgtcatttggcccaaagtatccaggaattcataacccactggatgaaacttcaaggatacttcatgacacaagtggaaccttcaaatactatattaaggttgttccgactgagtacaaatatctgtcaaagaaagtattgccaacaaatcagttttctgtcactgagtattttcttcccatccgtccaactgacagggcctggccagcggtttacttcctgtatgatctgtcaccaattacagtcaccatcaaagaggaaagaaggaacttccttcattttgtaactcgtctatgtgcagttcttggtggcacatttgccatgacaggaatgcttgaccggtggatgtaccagcttatcaagacagtcaccaactcaaagaccagaagtgtactgcggtaattgcacaagtcatgatggatggaaaaccgttggtagtgtggtacccgtggctaatggagcccatagatctttgcccgaagctaactgatcaagccatgttgatttttgcatgttttattttcttcttacatggttaacttataatacgtcgttgttttttttttcatcaactatgttagattaacacagtccacggactacattgttaactatgttggtagtggaactgaaatgccaagccgatcttgatcaaccctatagtcccatcgtgccaaaaaaaaaaaaaaaaaaggccccta

SEQ ID NO: 10994 - DNA, 1813 bp, Zea mays
agagccggcgactgccctttcctcttatttccattaccccgagcgtacattctctcctctctctcttggcggcgactcggcgaccggcgctgctgccccacgtttggtgcccaggtcttcgtgggccccttagccggcgacgagcatcaccagctgaaagatggcgaggataccgtctttgaagagcctcaatgcgtttccacatgcggaggaacacttgttgaagaagacttactctggtgctgttgtgacaattcttgggctacttataatgattacactgtttgtacatgagctgcagttttatctcaccacatacacagtgcatcagatgtctgtagatctaaaacgaggagagactctgccaattcatgtcaacatgtcatttccttctttgccatgtgaagtattgagtgtggatgcaattgacatgtctgggaaacatgaagttgatttgcatacaaatatttggaagcttcgcttggacaagcatggccatatcatcggtacagagtacttgtctgacctagttgaaaaggagcatggggcacatcatgatcatgaccacgaacaggagcatcatgatgaacaaaagaagcatgaacaaaccttcaacgaagaagcacagaaaatgatcaagagtgtcaaacaagcactgggaaatggtgaagggtgtcgagtctatgggacgttggatgtgcagagggtggctggtaacttccatatctcagtgcatggtttgaacatctttgttgctgaaaagatttttgaagggtcaagccatgtaaacgtcagtcatgttatccacgagctctcatttggcccaaagtatccaggaattgacaacccactggatgatacttcaaggatacttcatgacacaagtggaaccttcaaatactatatcaaggttgttccgactgagtacaaatatctgtcaaagaaagtattgccaacaaatcagttttctgtcacggagtattttcttcccatccgcccaactgacagggcctggccagcggtttacttcctgtatgatctctcaccaattacagtcaccatcaaagaggaaagaaggaacttccttcattttataactcgcctttgtgcagttcttggtggcacatttgccatgacaggaatgcttgaccgatggatgtaccggcttgtcgagtcagtcaccaactcgaagaccagaagtgtactgcggtaactgcacaattcatgataggcggaaaacagctggtaccgtggctaagagcatctccaagagactttttatttttggctctctatttaactctctatttattttttcataaagattacattatatatatagcatctcactccaacagactatctatctagttttgctagtcaggtggctagtcaaatttggctagtgagagagctgatttggagagtcagatagcttagcgagttagataactagtctgttggaaagttattttattgttgagtagctaaaatttggcttgacgagtcatttaactagtctcttggagctgaaatctattctggacccacgcttcctttgcccccaagctaacggatgaagccatgctgatttgcatgttttattttctccgtacatgactaactttatcatcagttatgttaaattgacacaaagtccacggactacagttttgtaaaacttgatgaggaatatgtatgcaaagaaagcgtgggtccagaatagttttctgtgcatacatattcctcatcaagtttcactgtgctctgtaatagcaacctgatgctttatttataggacgactttcgtcgc

SEQ ID NO: 10995 - DNA, 1711 bp, Zea mays
ctaccgcaagtagggccaaggacgacaaagaagaaacgaatccgaaacctctccaagaatccatcgcagccgccatcatgtccgccgccggtggccgaacccttggccggagcagcttctcccgcgccacatctaaactggtggcgtcctcatccggctctgctggcgttaagattggcccgaacggtgcttctttcgtctcctcgggcattcccgacctcgacaggattttgggtggtggattccttcttggctcagttgtaatgatcatggaggacactgatgcgccacaccacctcttgcttcttcggtgcttcatgtctcagggtgttgtgcacaaacaacccctgctcttttcaggagctatgaaagagcctgtgttgttccttggtacactacctgctccagtttcatcttcaaaggaggatggacgacacagagcaatgggtcctgcagcaagtagtgatggacgagcaaatgatgagggtttgaggatagcttggcagtacaagaaatactttggggatgacaagacttcgcgagctgaacataaagacaataaacaggaattcagcaatgattttgatttgaggaagcccttggaaaggcatttacttaatggacagaatattgaatgtgtaagcactcaagatgctgacacactcagcagcctccaggattgttgttctgctttcttatccaagcttccaagaaaagatggtgggagttcaactgctgggagaattgctatacaatcactctgtgcaccgcagtgcagatactttgaaaaggactgggacatggtctcatttatcagatcactgaaggccatggtgcgctcatctaactctgttgctgttgtaacatttccgagtacagttctgtcaaattcgttctgtaagagatggcagcacctggcggatacactgctgtccatcaaagcaattccagatgaggacaaagacttggcaaaactcctcacaggatatcaagatatggttggttttttgcatgtccacaaggtggcacaacctaacagtcaggtccctgtgatcttagaggcatccacgctctctctaaagctgcgaaagaggaggtccctggtcttagaacggttgaatcaggctccagtcgatgggtcaagtgggccttcgtctgctgcatcaagcagttgctcatcgcaaggttcacagcttgatttctaattggtatggctggatttccttgagaggagctcagaagtgctgtgtactagttactcgtggcagaatgcagcttttggaggtttaggttttagataggagtcagtttgatggttcactgttaaccatcctccctcatgtaaccccactttcaacagtattagaaccgtcgaaacttgtatatttttcgggtagttgtccaagtttgttgaactgccttgaacaggttacaaaagtgtggggttttcttgttttgtctgttccaaatgatcatgttttttgcgtagaacggaaatggttgagttgctgatgcaactgaagaattgttggtcttcacgaagatggagctctgtcagacaatgcagcaatcttgctatgttaatgtcaaagatgcagaaggcaattgtaacaacgggaagtagatttttgtaatactggcatcggcattcttgagcttcatggaaatggcagcgccaagcacacaattgcatttgtggcattaaaaaaag

SEQ ID NO: 10996 - DNA, 1278 bp, Zea mays
cctcgaggccggccggtaccgtgtgacgctgtggatatctgacccactctcgtcgcacgcaacgcaagtagcaaagcaggacccatcctctcccatctctcggtctccccatcccaacccgccgccgccgccgcttctcccgtctccagcgcccacagcgccattgtatccgcggggcgagctgagtcaccaagctggtctagggcccatccatttggaaccctcgcgagaagcaaagcggacggagcgccagcgttcttagatcgattgctcgccaggctgttggcgaggagtcgtcaaccctcacggcagccatgtctgtggagctcatcctgtggcttttctccttcgtctccgtcatggtcctcatcggcctcaccgcataccagcttatctgtctgtcagatttggagtatgattatatcaacccatatgattcatcgtctcgcatcaacgctgtggtgctgatagaatactcactccaaggggccctgtgtgcttctttcctcttgacattgcattggttcccgtttctagtcatgacaccagtaacatactaccatgtcaaactgtatttggctcggaaacatcttgtagatgtcactgaaatttttagacaattaagtgacgagaagaagtacaggatgatcaagcttgccttctacttctgcctatttattataactatttacaggcttgtaatgacagctgtgatgttgtttattgatgaggacataaatttggcagaaactaggagtatctagacttcgccaccaacttgtcatggggatggagcagagttgtagcttgaaccagggagaccacaactcaatgccttgacttagttgtgagaaacaagatcagtttgtgccctgtagctggaggagctaacctggtactccttttaccctaaatcgtaagttgttttagttttttctagatgcatagcttttacgatgtatcctccagatgcatagtaaaagttatatatttagaaaaaacagaacaacttataatttggaatggagtattcatttcatccatcagattgtgatgtacaatgaattcccatagtttggtccatcggtaccatgtttgtaaattgggcagtcaatgatgtgcatcactgcaggatgaacgcacgtttggtaattgttgtgcaattctttgtacttgtggacaagtgctgtattctacacattgtttgcatacagacaatgtgtggttggtgtcataatttaccactaaacctttggtaaaaaaaaaaaataaaataaa

SEQ ID NO: 10997 - DNA, 1724 bp, Zea mays
gggtacctcgaggccggccggcaaacgccgggagccaccgcgatgtcgcccaagccggcgaagccgacacccgccaccgagttcgagtactgcgagctgtgccgccatcaccacgaccatggccggcgccatcgctacatcgtcaagcacaggagaaatctcgacgccgcgctcacctccttccgctccaagctctccgacctccgccgcgccttcctccccggctccccctcttcccagccgccgcggacccgtctctggtgccccttctgctccattgacctcgtcgacctcgacagccgctccgctggtaacaatgccatttaccatatggcaagcagtgagcacctgaagggtgtgaaggatttcctgtggaagcacgggggacggatggatcaggtggtctcgcttaggatttcagaggatgtgcttgccaagtgggagaaaggccctgaatgcttgagcacaggaacgaagaaggggactgaagagctgattggaccatctctgaagcagataaaagcaatggggcatatggctctattagtacagcgtgtcatggagcttccagttctggaagtgcttcacattctgctccatatggaactgtcggcctgcccatcacaccttggggatcggccgaaacacataagctgcagggtgcactgtctacaaactggtttcacagcagtggtactgaaacaaaaggccatcagtctactgtctttgtgaatggcgcaagccaatcactttcttgttctgatcatatgttacctttgcgggttcaacaaagtcacactggaggaaatttgagcaatggctcaaaagcaaatgtgcatacgggtgctcctcctccttggttaaaagctaaccaacacgatccaaagaatttgtcactcaaaagctgtggtctttcttcccggaaaggaaaattgaggaaactcaatccaaacagggtcggtgctgcatgggcagaaagaagagctgagatggaaatggagaagcaaggtgaaattgttccagcaacatctgattctagttggctgcctaattttggtagtgtctggcaatctggcacaaggaaggaatcaaggaaagaatttgagaaaagccacaagattcatgacacgaagagcaaccatgacttatccttggagataaaaccatatatcagcaaacggatgcgtgtaggtgctgagaaagcttctgacaaagctgaagagcttggcagccacctaccgcagtaaacagatgtacaacccggtggatgtcgtcgcgtgggcgtctctgcggaaaaagccgccagggcgcgcggcttgattagcgattggtttggtttccatgtcaggtcgtgcctgggaagcccgccgcgagtacggaatgccaagccagtagtagtttttgttctcggcacgaagccatttgatgttcgttttgtgcgggtacggtttgcggcttgatcgcgattggcctcgtagcctttttgaccgaacgagagaagcagcagctctgcaaagctacctccagcttccaggttcattcgagacgggaggctgggagggatagcgtcattgcggtcaaaaaaaaaaaaaaaatttccacttgtgcacaacgtcataaacccgagaaactgtttacagcctcacagggcaccacctctcatagaaccagagactccggttccgttggggtaaaaccgtaaaatggccgccgcttgtcttgtt

SEQ ID NO: 10998 - DNA, 2319 bp, Zea mays
  misc_feature (525)..(525): n is a, c, g, or t
  misc_feature (569)..(569): n is a, c, g, or t
  misc_feature (584)..(584): n is a, c, g, or t
aattgcatatgtcaccctatttaaacccctctgttggtgataataaggtgggttgatgtttggtacagatttacttctttttgtaatagcttctaagagtatagctctttttggttttaatacttgttcttgttctttttcagattgtaaagcagctcgtccactgttccctgctcgtgaagatcgcctttctctccaatcgtgacgccgatagtgagttctctgcttcgtcgagtcacgcacttaattgctagaggtcgcaaacgttttgaagtctgtgtgtacgatagctgaaagagactatcctttaaaaatgtagaaattgtttgatccagattcggatttattaattccgttcaaatggactatgtaacattttctcgtaatagtataacacacattagtaataagttatcatgatattatatgttttcgttgcaacgcacgggcattcaactagtgattgaatatggacggaaaaaatatggggtaaaaagaactatattttggaacggagagtacttnattcagttttgatgtggcggtgacagtcagaaagattttaaagnagtttgctcaagcgntataaaccatcgaagacaaccaggtttccggttgccttgtgcccgtgtaaccgtgtccgtcgatgcagaagagcgaataccatgcaacattgggggcaagaactgtcagtctgtgtgtgtagccagctaagcatactgacatactgtcattgtgtgaaagattgcagttgatgcaatgatgctgtgtttccccttgtatgcaggttcttgtaattctgacagaataaacttgagagacaacgagattttgcacagaagaacggatgcacgaattgtttagaccggcagatggccatggcctaagccattccgctctgatcacggctgtctttgtgggatggagtaagagacgaacgctcacaagattccctttccatgatttgggccacatacatggctgcttttttttttggttggattaatctgaacgtttattgcgtctgatcatggcctaataaaacatcgcagtaataattgcatcaatagattgcagcagctatggcgaagtaggacggcctcagttcctgctctgctgctgctgggcctggtgctgctgcttgtgcagctgcgctgacgcgatggccagcatggacctcaccttggccacagccgcggccttgtccggcgggcagctcgccagcgccgcccgcagcgaccgcacggcggcgtcgggccgtcccgctcccagcgccgcgcacgccgcgcggtacgcctcgtccgcgaccctcgcgtcgtagcaggccggaggcagaggggaggctccccggtccccctggccctcgggatcgatctcgggcggcgacgaggctgagacttgggaggggtcgaggagggcgcaggcgcgggcgtactcggtggagacgatggccgcgtcgatctgcgacattagcgactcgggcgtcgacgggaagctgcggatcacgtcgaaagggctccaccctcgcagcccgccgccgccgacctggctgcccgacatggtttggtggatcggactaccgagagagagagagagagagagagagagagaggttggatcttggatgctccggcgggagcccgccgcctcgcgagaaagaatggaaaccgactacactaccagtacacactacacaccggcagtgtgaagtggggcctgggggggctgctgaagcgataatcaaccggattgatctgaaccgatcacacttcatcgccgttcagggacaggtagagatcaaaattaacaaatgagcatatccgtgaactgataacaatcagtattaatcagaggaaaattaaggtcgccaataggtgaatcactggattcaatcaaccaccacccaccaaatccaattgccaggttgactaagctaagttttacttttacatcgtatataccggggccaaacgaagaaaaagaaaagagtatattcccaaaatgaaaagaaaaaatatgtacggtggaactggttggatcagcacagcactagtctaattaattcctgagtctcgatgctgttcgtttggtaagaggtagtgcaagcacaggtgacaccagacatccacggcacgacaacaggtgcattgggacgagcatcttgtaaggctctgaatacttaacttgtctttgaagttcagtttggggtggtcagcctgcaagcagcagcaaaaaccatcataaacgagatatatatgcgagggaaacggaaatggcttagcgtccactcccacatgataaattaaaaaacaagagacc

SEQ ID NO: 10999 - DNA, 762 bp, Zea mays
gattttgacacccattcaggagtgttctcactcgtggctcgtcgcgagcctctcttacgggtcgtactagaggtctatgatgagacagcaagattcctcagagagctagaattggatgatgatgcactcacaaaagctattattggaaccataggcgatgttgacgcctaccagctaccagatgctaaaggttacagcagcctaatgagatatttgctgggcatcacggatgaggaacgccaacaaagacgtgaagagatactagcaacaagcccgaaggatttcaaggagttcgctgatgctgttgaaaccatcaaggacaatggggtcgtggttgccgttgcctcgatagatgatgttgaagctgcgaataaggaaaacccgctattccctgaagtaaagaagtgtctgtgaggtccaccaccacttgataaggattctagtcgggaggtgtttttttaccagtgaatgcggagtgtgacaatatacgtaacatattgcaagagcaccatctctccgaccacggttatagctagccgaatcttggcttctcttccatgcgattttaaatttggcagtcaataattagttcagatgtagacatagatgcatgctggtagatggctagcgtcttcccatgttggctcaaacgtcggatgtacccaatgattcataaaaaatagaaacggatggtgagatttctccaaaaaaaaaaaaaaaaaaaaaaaaaaaaaaaaaaaaaaaaaaaaaaaaaaactcgac

SEQ ID NO: 11000 - DNA, 1922 bp, Zea mays
  misc_feature (1909)..(1909): n is a, c, g, or t
aattcggcacgaggggagagcccaggaactgaaagcctaatcgcaatcccactcgcagcaacgacctacccccccgcgccgcccctaactccaatccagaaccccagagtccagaggcagaccggcaagctggacacctgcggcatggagcgggtggcgctgctccgcacctcaggccgccgcctcctacaccgctgccgcaggggcaggcccgtcgtcgtgcccgctgccgcggcctcatccttggcacgccgggcgtcctcgttctcactcccggcgcgcggctactcggctctgccccgcggcggcgcgcgattcctggtcgctgcggcgccgctgcactgctccggccggtactggccggccgctgcgccccagctcgcgcggaggctgtccgcctccgctgtatctacctcgccctctcccgtgccctatgatacagatgacgtacatgagtatgccacaaagctcggatttgaaaaggtctctgaacagactatagatgagtgcaaatcaattgctgttctttacaagcacaagaagacgggtgctgaagtaatgtctgtgtcaaatgatgatgagaataaagtttttggcattgttttccgtacccctccgaaaaattcaactggcataccccacatccttgaacatagtgttctctgcggatcaagaaaatatcctttaaaagaaccgtttgtggagctcctaaagggtagtttgcatacattcctgaatgcgttcacatatcccgatcggacatgttatccggttgcatcaacaaacactaaggatttctacaacttggtagatgtatatctttgatgccgtctttttccctaaatgtgttgacgacttccaaacatttcaacaagaaggttggcactatgagcttgacaaccctgaagaagagataacatacaaaggtgtcgtcttcaatgagatgaaaggagtttactctcaacctgataacataatgggacgtgtatcccaacaggcactttcccctgataacacatatggtgttgatagtggtggggacccaaatgaaatcccaaaacttacttttgaagaattcaaggagttccatagtaagtattatcatccaagcaatgctaggatctggttctatggtgatgatgacccaaaagagcggctgcgcattctaagtgaataccttgaccagtttgaagccaaccctgctcctaatgaatcgaaggtttggccacagaggctattcaaggaacctgtgaggatcgtagagaagtaccctgctggtcaagaaggtgatttgacaaagaaatatatggtgtgcatcaattggcttttgtcagaagagccattagatgtagaaactgagcttgcacttggtttcctggatcatctattgctggggactccagcttcaccacttagaaggattcttcttgaaagtggtttaggagaagctattgtgggaggtggtgttgaggatgagctccttcaaccacaatttagcataggcctgaaagtgtatcagaggataatattgaaaaagttgaagagttggttatgcaaactttgaataatttagcagaggaaggatttgcaacagaagcggtggaggcttccatgaacacgatcgaatttagtcttagggagaacaacacagggtcattccctcgtggcttgtcactgatgcttcgttcaattgggaaatggatatatgatatggacccttttgagcctctgaaatatgaacaaccactgcaacaattgaaagcacgaattgcagaggagggatcaaaagctgtgttctcaccgctcattgaaaaatttattttgaagaattcacatcgtgtcacagttgaaatgcagcctgatccagagaaagcatcacgtgatgaagcagctgagaaagagatcctanaacaagtcaaagc

SEQ ID NO: 11001 - DNA, 2114 bp, Zea mays
  misc_feature (5)..(5): n is a, c, g, or t
ggtanccatgaacacgatcgaatttagtctgagggggatcatcacagggtcattgcgtctcccccgcgcccggatgcttcgttcaattgggaaatggatatatgatatggacccttttgagcctctgaaatatgaacaaccactgcaacaattgaaagcacgaattgcagaggagggatcaaaagctgtgttctcaccgctcattgaaaaatttattttgaagaattcacatcgtgtcacagttgaaatgcagcctgatccagagaaagcatcacgtgatgaagcagctgagaaagagatcctaaaacaagtcaaagctagcatgactcaggaggatcttgcagagttggcacgttctacaaaggagctaaaggaaaaacaagaaacaccagatcctccagaagctctcaaggctgtccctagtctgtcattgcaagatatcccaaaaaagcctattcatgtaccagttgaggttggagagataaacggtgtcaaggttttgcaacatgatctcttcaccaatgatgtcatctactctgaggtcgtatttgatatgggtttgatgaaaaaagaacatttgcaattgttgccattgttctgccaatccttactggagatgggcacaaaagatatggactttgtgcaacttaatcaattaattggtagaaaaactggaggcatatcagtatacccattcacatcatcagttaggggaaaagaagatcctctcactcgcataatcgttcggggaaaggcaatggcgccacgagtagaagatttgtttaatctgatgtacatcattcttcaagatgttcaattcacagaacagcagagattcaagcagtttgtttctcagagtaaagcaagaatggagaatcgattgaggggcagtggccatggcatagcggcagctagaatggatgctaagttaaatgcagctggatggatttcggaacaaatgggtggtgttagttatcttgagtatctgcgggacctggaaactaagattgatcaagattgggacagcatatcatcttcactcgaggaaatgagaaaatcactcttttccaagaatggttgcttgatcaaccttactagtgacgggaaaaatcttgaaaaatcaaggcaacatattgccaaatttcttgattcactcccaagtagcccatccattggaagtgatccatggctttctcgtctaccttctgtgaatgaagccattgttgtcccaactcaggttaattatgttggaaaagctggaaacctttaccaaagtggataccagctcaatggaagcgcctatgtcatctcaaagcacataagcaatacatggttatgggatcgtgttcgagttagcggtggtgcatatggaggattttgtgattttgacacccattcaggagtgttctcatatttatcatatcgtgatccaaacttactgaaaacactagaggtctatgatgagacagcaagattcctcagagagctagaattggatgatgatgcactcacaaaagctattattggaaccataggcgatgttgacgcctaccagctaccagatgctaaaggttacagcagcctaatgagatatttgctgggcatcacggatgaggaacgccagcaaagacgtgaagagatactagcaacaagcccgaaggatttcaaggagttcgctgatgctgttgaaaccatcaaggacaatggggtcgtggttgccgttgcctcgatagatgatgttgaagctgcgaataaggaaaacccggtattccctgaagtaaagaagtgcctgtgaggtccaccaccacttcttgataaggattctagccgggaggtgttttttttaccagtgaatgcggagtctgacaatgtacgtaacatattgcaagagcaccatctctccgaccacggttatagttagccgaatcttggcttctcttctcccatgcgattttaattttggcagtcaataattagttcagatgtagacatagatgcatgctggtagatggctagcgtcttcccatgttggctcaaacgtcggatgtacacaatgattcataaaaaatagaaacggatggtgagatttctacaaaaaaaaaaaaaaaaactcg

SEQ ID NO: 11002 - DNA, 1658 bp, Zea mays
gatgggctcaccagcaggcagtggcttaggagcttgaagttgaccgggtccacccgaagcttttttttttttttttttaaaagatcaccaataggtgaatccctgttcactaaatttaattaaccaacaccaaatccaatgtgtaccccaataagcaaccctcaaaatttttcgctgccaggttacatcgtatatgccagggcagaaagaagaaaaggaaaaagagtatagtcacgaaaagaaaaagaaaagctgtattgttgtctgtagaagttggatcagcaggagtctcaactggcagctcatgcaccgatgacaccagacatccacggcacgacaacaggtgcagtgggatgagcgtctctgtaaggctctgaatacttgtctttgaagttcagtttggggtggtcagcctgtttcaaccagcactcctgatgtttatgctcatatttgtctggcgagaagcatccaaattccgatgggcagtaaacccatatattgcacttcaattcccctggcttggcattcttagcttgatcaaggcaagcttgacaacaatcagcagcagattctttgtggtgtgttaaaccccatctaacagcggcgccatcataatctgtatgtagctcagcattacattgtggggataagggtggacctgctactatctcttcttcttctggttcattttcaggtttatcatcatgtacagtatgtgtgacttcatctggtatccaaaggccaatatcctccaggagcatatgccagttgaactccagggcttgttttaacattctggtttcctcactagataagtccaaacttgattgattccgagtggatgcactgttttttaacttctcaacacgccatgattccaccacttctctttgctgcgcgaggctgctgttatcccccaactcgtgcagcccccgcgcaatatcataataaaccttctgcttcagcaccagcgacagctcctcccgccgcttcacctcctgggcgagtttcttccgcagcttctttaccgccagaacgagctcgacgggctcagcctcgcggcgaatccggatcgactcctccacccacctaatctgctcctccgtgtactgcaccacttccccgcggttgggagcggtgggtgcgaaggaagcgggggcggtgagggagcggagcacgagcagcacggcgacaaggttgccgatgcagacggccacggtgacgcgccggtaggagcaccaccccgttgtggcacggcgcccgaaagacaccgcccgcgctacgcccctcgccatggcgccgcctccgccatccctaccgacgcggcattgcgccccgcggcctccgattcgcgagctccccgcctcgatctcgcacgaccgcgcaccccacgactcgaccgacgccgacgtccgacgagcagaccaatgcgcaggctacacaagatcgtcacggcgcggcgatggaaacttctggaatcgaacggcgcctccgacctcgctattccttcgggcgctctcgtttccgcgaacgaagaagggggaaattctggggcggcgccgcggcggtaaaggtagtggacgtcggacgaagcaaatccctttgttgcgtcgggaggctacgcccgccgcgtgggtcgactccgaggggggaacccg

SEQ ID NO: 11003 - DNA, 806 bp, Zea mays
cccagcgtccggccgtgcgtgtgtgttgctctttagatggtcaggtacgaaccagggtacgccttcgaggaactgaacccggttcagtggcggtgcagcggcacgcccagggtcctgataccagtggccaacggcagcgaggagatggaggtgctcgtgaccgtcgacgtgctgcgccgggccaaggcggacgtcgtggtcgcgtcggccgaggaggtcgtcgtcgcgcgccacggcaccaggatcgtcgccgacgcgctgctgcaggacgccgccggccagcagttcgacctcatcgtcgtaccgggtggcatgccgggcgtgaagacgacgctggcagacaaggtggagctcatggcgctgctgaaggagcatgcggcggcgggcagggcgtacggcgccattggcgccgccacggcgcaggtgctggagccgcacggcctcatcgggggcagcatgaaggcgacgacgtgcgcgtccagggcggaccggcccagcgagtgcgggagcagggtggtggtggacgggaacctggccacgagcgggagcaccgggacggccatggagttcgcgctggccgtcgtggagaagctgctcggccccgaggcggcgcgggaggtggcggaagccctgctcttcgtctgaccatcactggaccagcgaccacgtacggagtgtagctgttgggccctttcgcgtgtaccgtcgtgtgcaccggatcgtgtttgatccttcctcgcttgataacgtcggacccaaagtaattatcttcgtaataaaaactcaaaagtatcgttatctatctc

SEQ ID NO: 11004 - DNA, 2777 bp, Zea mays
acccctgcacctgcagtgcactgtgcaccccacacagcccgtccccaaggctcccagcagcatcggagcgagcgatcggacaacattttcgcgtggagcaagccgggccacgccttcctcttccttccacggatccaattccccatgcaacccaccgtgtccgtgtgggggtgagggtcaatgattgcggtggcatggtatgtacccgcgtcggcggcgtcaatgccgcgccgcacccgtcctccactgacctcgcgccagctgccctgcagctccccaaaccccccctccgcatccacgagccggcgcatcgttcatgtgagtgtgaccaccggcacgtcccctgctgtattttaaggccacctaccttaaccaccgtgctgcaccacctccactcccccgtcactccggcgagcgagcaggagcagaccgatggcgtctcccgctgccgtcaagaaggtacgcactcgtctctggcttccttgtccgtaccggcactacaccgccctcgcacggaggactactgcgcgttgatgtgccgtgccgcaccgtacccgcgcaggtgctggtgccgatcgcggcgggctcggagcccgcggaggcgttcgtccccatcgccgtcctccgccgcgcgggcgccgacgtcaccgtggcggccgccggagccggaaccggcctgcgcgtccacgctatgtacggggtcaccgtcgtcgcggacgccagcgtcgccgactgcgccgacgcctcctacgacctcgtcgtcctccccgtaagaacccgccgccagccagagacactagcgcgacctagtccgtccggccgctcacgctgacgacgcagtgacgctcaacgacgcacagggcggcgtccccggcgcggacaacctgggcggctgcgcggcgctggagggcatcgtgaggcgccacgcgctcgggggcgggctctgcgccgccatctgcgccgcgccgccgctggcgctggcgcgctggggcctgctcgacggcgtcaaggtgacgacgtagtgtgcctctccctcaacgtcgttcgcgccgcgcgcgcgtctagctacatgctctttaggtcctacctagcctacatacacgtgcgtgcaggcaacggctcacccggagttcgtggacaagttcccggcagaggtggccggcgtggacgcgaacgtggtggtcgacggcagggtcgtgacggggcgtggccccgcggcggccatggagttcgctctcgctctcgtggaccagctctacggcaagggcaaggtcgacgagatcgccaaacccatggtgcgtggaaacgtgacccgagtactttgactgaccaaaccccgaacaaaagataggaaaaaaaggacaaaatttctgttctatttttcttcgcctatttgatttaaaaggaaaaaaaaccgccgtgcgtgtgtgtttctctttagatggtcaggtacgaaccagggtacgccttcgaggaactgaacccggttcagtggcggtgcagcggcacgcccagggtaattttgctctctgcatactgcatgcatgcctgcgtagcaaagacatggcgggtgaccgccctgactcctcttgccgcgcactgcacgtgctcaggtcctgataccagtggccaacggcagcgaggagatggaggtgctcgtgaccgtcgacgtgctgcgccgggccaaggcggacgtcgtggtcgcgtcggccgaggaggtcgtcgtcgcgcgccacggcaccaggatcgtcgccgacgcgctgctgcaggacgccgccggccagcagttcgacctcatcgtcgtaccggcaagtggtcgccccctgctatgctcctcggtatacgtttccactgacaccacatggcgctgactgtctgtccagggtggcatgccgggcgtgaagacgacgctggcagacaaggtggagctcatggcgctgctgaaggagcatgcggcggcgggcagggcgtacggcgccattggcgccgccacggcgcaggtgctggagccgcacggcctcatcgggggcagcatgaaggcgacgacgtgcgcgtccagggcggaccggcccagcgagtgcgggagcagggtggtggtggacgggaacctggccacgagcgggagcaccgggacggccatggagttcgcgctggccgtcgtggagaagctgctcggccccgaggcggcgcgggaggtggcggaagccctgctcttcgtctgaccatcactggaccagcgaccacgtacggagtgtagctgttgggccctttcgcgtgtaccgtcgtgtgcaccggatcgtgtttgatccttcctcgcttgataacgtcggacccaaagtaattatcttcgtaataaaaactcaaaaagtatcgttatctatctcagagtcaaaggtgggatttggaacttaaaaaaaagccttcaccacacgtacggtgcaagccgaaagccctcctaagtttccactcgggagcggagaggggaggatccggatcctcggcagtcgtgcaatggactacccggaggcaggtccacaggttgaacccaacgatgttcgatattgtgtcgtgatgtgaatcatgtgatgatgtaacctgtttgtactgatcgatgttatagtcggtcggtttgatcagttcgtcgttgatcagtccagtcggtaccgactacattaaaattgaaccggttaataccgatcaacatgttgtagatcgagttagttagtacactcttgttgacgtgacacctcctcgttagttgacgctaacttaaccga

SEQ ID NO: 11005 - DNA, 1330 bp, Zea mays
cattgggtacctcgaggccggccgcacggcccatcacccatcacgtatcgctccctccctcggccctcgatcgtacggcgcgagcgttgcgctccacgccttcctcttcctcgtctggcatcgcgaaccgccgcaccccacccacccgcccacaggccacagcccacccccttctccaggtctctccccggcggcggcgggtgcggttctccggccatcaccgtgcgcaccaggaaaaactatgaggaggtacagccccccttatcgcagcccccccaggaggggatatggtggcagaggaagaagcccccctcctcccaggaggggatatggaggacgcaaggagggtagtggaagccttttggtccgcaacatcccattaagtgtcagagcggaggatcttcgagttccttttgaaaggtttggccctgttcgggatgtttacattccaaaggactattactctggggagcctcgaggatttgcctttgtagagtttgttgatccttacgatgcctctgaagcccagtatcacatgaatcgccaagttttctttggtcgggaaatagctgttgttcttgctgctgagtcacgaaaaaggccagaagaaatgcgcagcagaactagagtaagaggttactctggtcatgaaggtcgccggtcttcttactatggtcggtctcgttctcgctctcctcgctatcggggccgtcctcggtcgagatcatactctcctgctccaaggcgggggaatgactactctgcctctccaaggagacaggaagcccatcgctcatctcctcccaggcgcccgccaaaggagcatgatgaagataagaagcggaggtcctactctcctgccagtagagatgatgctgacaatgtttatgagaagaggtcgcccccagcagacagcgatggatctcctctgcatcgcaggtcccccaaggagtactcgggctcacctcctggatcccgctccaggtccgccgacgaatcccctgttgccagtgactgatcgaccgatggatgctacaatatgaatgatatgcgcatgaccagcatggtcatgcggtcatcagtcctatgcctttgtcagactgagctcactaaacttacccccctttgggggtcgatgttgtattgctaagttccgtttgtgctaagtattagcgcatactgctagactgccactgtcgtctgtactatgcatgcttttgatctcgagtgatcgtgttgatggtgctgaatattggaacctgcagtacagtagtagcatgatgcttgcttgctgggccacggctcgtacaaaaaaaaaaaaaggccccta

SEQ ID NO: 11006 - DNA, 1134 bp, Zea mays
tggctggtacatgagaagataaaagagagtcaagtcaatttcaagtacttttgtgactttttcaaatgttggggaacttgaagcgaacgatttttatgaagatactctttatgaggatcaccttacgtagttgtatacaagaaacttggacactagagcctgggcatcttactgctttttgcaacacttgcttctcttctcccgcgcggccggtaagttgttgactgtgcttcgctgagaaccatagagggcacagtgagtatttgaatttgatgggagcctcgaggatttgcctttgtagagtttgttgatccttacgatgcctctgaagcccagtatcacatgaatcgccaagttttctttggtcgggaaatagctgttgttcttgctgctgagtcacgaaaaaggccagaagaaatgcgcagcagaactagagtaagaggttactctggtcatgaaggtcgccggtcttcttactatggtcggtctcgttctcgctctcctcgctatcggggccgtcctcggtcgagatcatactctcctgctccaaggcgggggaatgactactctgcctctccaaggagacaggaagcccatcgctcatctcctcccaggcgcctgccaaaggagcatgatgaagataagaagcggaggtcctactctcctgccagtagagatgatgctgacaatgtttatgagaagaggtcgcccccagcagacagcgatggatctcctctgcaccgcaggtcccccaaggagtactcgggctcacctcctggatcccgctccaggtccgccgacgattctcctgttgccagtgactgatcgaccgatggatgctacaatatgaatggtatgcgcatgaccagcatggtcatgcggtcatcagtcctatgtctttgtcagaccgagctcactaaacttacccccctttgggggtcgatgttgtattgctaagttccgtttgtgctaagtattagcgcatactgctagactgccactgtcgtctgtgctatgcatgcttttgatctcgagtgatgtttgaggaaccagtgatcgtgttgatggtgccgaacattggaacctgcagtacagtgtagcatgatgcttgcttgctgggccacggcccgttcc

SEQ ID NO: 11007 - DNA, 1143 bp, Zea mays
ctccccctctggcctctaccctgcctgccgtttccatctccatccagttctccgcacccacccacgaccacgacccacccacccactcctttccccaacccatggccgccgccgccgccgccgccggcacccgggaggagatggtctacatggccaagctagcggagcaggcggagcggtacgaggagatggtcgagttcatggagaaggtcgcggccgccgcagagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgcgcgcgcgtggaggccgagctctccgggatctgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgccctcaacttctccgtcttctactacgagatcctcagctcgccggaccgcgcctgctcgctggccaagcaggccttcgacgaagctatttcagagctggatagtcttggggaagagtcgtacaaggatagcaccctcatcatgcagcttcttcgtgacaacctcaccttgtggacttctgacatgcaggaggatggtggcgatgaaatgcgggatgcaaacaagcctgacgaggagcagtagtagccaaacatctccatcgatcatgccatgccatgccatgcttgtacaaggaccattttcgtgtgtcctttccttcaatcgtcgacctttcgttttgttgttatactgctattgtggaaccctgttactgttactgttagtgtatcctattggcaataatcaaatgtggtatggttgactactatactaatgggcgatccggaggcacacaaaatggggtgagggttatatctacacaaagaatgacgggggcgtcgcttgc

SEQ ID NO: 11008 - DNA, 1000 bp, Zea mays
tctccccctctggcctctaccctgcctgccgtttccatctccatccagttctccgcacccacccacccacccactcctttccccaacccatggccgccgccgccgccggcacccgggaggagatggtctacatggccaagctagcggagcaggcggagcggtacgaggagatggtggagttcatggagaaggtcgcggccgccgccgagctcaccgtcgaggagcgcaacctgctctccgtcgcctacaagaacgtcatcggcgcgcgccgcgcctcctggcgcatcgtctcctccatcgagcacaaggaggagacgcggggcgcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgccctcaacttctccgtcttctactacgagatcctcagctcgccggaccgcgcctgctcgctggccaagcaggccttcgacgaagctatttcagagctggatagtcttggggaagagtcgtacaaggatagcaccctcatcatgcagcttcttcgtgacaacctcaccttgtggacttctgacatgcaggaggatggtggcgatgaaatgcgggatgcaaacaagcctgacgaggagcagtagtagtcgtcatgccatgccatgccatgctttgtacaaggaccattttcgtgtgtcctttccttcaatcgtcgacctttcgttttgttgttatactgctattgtggaaccctgttactgttactgttagtgtatcctattggcaataatcaaatgtggtatggttgactactacaaaaaaaaaaaaaaaaggcccgcttttttttttttttttttcgatatttgacgcgaattcgcgcaccacagttctt

SEQ ID NO: 11009 - DNA, 5467 bp, Zea mays
  misc_feature (2169)..(2169): n is a, c, g, or t
catacttattggccatctatagttgattcaagaaaaattgagggttttttacaaaattacaatggacacacgaaaaagctcgttatttaggctatcttcatcaacttacacatttctatacctatattcaaactaatcactatgtggatagtatattctatagtgtataactgctgcagacgaccttatattagtaaagataaagatcaacagctgcaccatttaaatattttcacgttgaacagcaacaaaatattttatgaatcattagccaagttaattatttaaaataattactattgtatcttaataatttttgcaaaataaataatgaaccaaatttcgggtcgggtttgggtcactcgcgagttgaaatagaaacatgcacccatacccgcgaaacatcgggtcaggtgcgagttgcacccgcgggtcaaaatcttcactcatatccgcacccagcgggtcggttatccgtcgggtttcgggtttgtgggttaaaattgtcattgctattggagataccactcaagcactcagcacaagatcatagacattgaaacctgaaccatccaaatggcctataatttatactctcatacacatcgagtatttaattgtttgtggagactatgaaacaacacatgatactatgcattatgacaattatgtcttctatagtaacatatgatgtgccaattttaaatattgtgataagaaataattggttgcaaatagaattttaagtgtcagtatttaacaagaaaagagctgcttatttatgtgcactccaacaaactatattggatacaagcaaatacatcagtactggattgttaatcatcaattggggcagaacgtccaattatcatcgaaaaagacacccaccattccaccaagagctgcgccatttgattccgctggctttcgttccacggaacgctgtgtactccgctcccggttgtcaacgacattatcgatcgtcaccatcgaccttctcatgtaccaagattattttggcttatggcatgttacaaggtacaagaaaagacatccagtccgccataaaccgcaaacgggaacatgcgtccgctgcagctagcaatcttgttcgctagttcaaacccatccagatcggcatccccacaatccccatctcaacctcacatgcatatgctaactactagttgattacagcgccatcgcgctctgttccggccacctataaatactgcaaccgaacgccgtctgcaacccccgcgtccgcggccgagcgatcgaggcatcgcaagcagagctcctcacgaagctcagtctgctttgtgccttgtggtcaaggaggacactgctgtgcagcaataatggcaggcaacgcatcgatgacgctgttcctggccgttagcctagtgatgttcgccatggccagcgcgtgcggtggcaactgccccacgccgaccccgtccaccccgaccccaacgccggcctcgttcggcaagtgcccccgcgacgcgctcaagctgggcgtgtgcgctaatgttctggggctgatcaaggccaaggtgggcgtgccgcccacggagccatgctgcccgctgctgaagggactcgtcgacctcgaggccgccgtgtgcctctgcaccgccatcaagggagaggtcctcggaatcaagctcaacctaccggtcgacctcagccttatcctcaaccactgcggcaagagagtgcccaccggattcaagtgcctctaagctataagccgcggggagcatgccgacgtgctcttctgcttgccattcttcgtcttactgtctcaataatgcagccttcttatcatgtgctacgtacgtacgtgcttactagctagctctgctacctctgcatgcatagcatccgcacgaacacgcgtagtagctagtagctacgtatgtagagccggccgttttgatgagcagctttcgcttttgggtgtttcttttatgtaagtgtctcgtcctttgaatggacgtgaccctgaactattaagatttttgttcttttatttgtatccggcaatctgcttgatgaataaagcttatatattgttcgaaaaacaaaaaaaaaaaaaaaagggttcagattttgttatgagtcatatttcattttcatacacgtttgcaaatgcactacatnaaacataattaattgaggcaacgatccatatacatttgagacgtcgaattactagtattcatgcatgatacatttgaggcaattatccataattaatcgatcggcaacggctagcttccaaccgttagctagtccatgtagaaggcactagacgtgtctagtggcacgccatacatatcggttcctgtccaaaaaactctaccacgcctttcaatagctcttttgggcttgagggctataaatagcaccacaatgggtcatttctcaagttttgtgctgaaaaacatagcaagagaattgagactccgatctattagttcttagacatctaagtgctttaaggttactcggtgattcgtgtaggtgttttgcaaagtacttaagtcagttagaccgtcactatgacacttgctctaggttatgcctagttgagctagacaccctcaaacccttgatgcttgtgcgcaccattatatgcattgacacttgcgcgtgttcgtagagttgtaccagtaagggttgtatcttgtgagatcacactaaccatgtttgtgctgcggcctccaccgtatactagagcgaacgaggtcatgatgtttcagtcagaagttcgatagtgaagacaaccaagagcatccgagagaggccaaatgcggagcgccacttatgagtggtgaaggctcgtgactatctgcggagttacatggctaggagcttggccctcgtgtgggctaccctttgcgtaggggctctaacgaggattaggaagaagcttacgtatttcttgataccttagtaaaaatatcagcgtgtccacatgacttatatctctatctcatttaagcttccgcatttatattgctaactttggttgtgtgctttacctttcctaacttagttatatgctagttagtaggactgaaaacctaggttacataactccattatagagatagcaacacttaaacaaaaccttagttgcactagctttcttggttatatatttgtataggttttgcttaagagattcaattaaaagcctaaattagcgtgaatagttgttcggattcatccctctcttagatgcccacgttccttctagagagcatttgatcctgcttgcacggatgaagggggagcgacacacttacatgggtgctctaacaaggatcaatgaggagtgttgactctctgatatctcgataaaacatcatcatattaataatccttctttactttgaacatttacattcaagcaattcaattcttgttttgtattactataattgtcatgctgaaatatggttgaaacgcagtaggacgtagaaattttatgatataattgaaaatttatgtatgcttaaagagtgaagtgggctattcgatagcattgatctattataagaagtattattttaatataatttaccgttcttttggacatcttagtcttgtattaaactatttttgaacttatgcacgtcatttatgtttcttaagcttggagcttgccaagtgttttctggactttgtgaagtgcatgaagcactcggcaaaagagttatctgcggtagtgaagagttcgggtaaatttattagtacactcttttttcataaacaagcggaaccatctagccaacagtacgtcatacaaaaagggcacccaccgttgtttgtgggaatgctttttaagcaaattcaagcctctaactttgaatgttccaactgaacataataaaccttgacccgatcaggaacagagctaaagcaaattttagtgattgcaattgccttctgagcgcattcagttttaccatgcaagggtgcacccgtacccaccgctatatgcaattatgcatagctctgcgcttggatcccgtgaagtgcagaaaaaaaaatacttcaactgttcaacaacttgggcgtccaccgtccatgcatcaccatgatacctctgctgatgtttagcactcgatcacgttactagatacaagcagccaacccatatgacaagttcgtcctaaactgaataaaaatgatcaaccatcaagcgagaacaaacatcaacatgcatccaccagtggagcaatcttggccacttgcgctgttctgcattgatcagccatctaattaataatcgccctcacatgcactcatgctcacgggaatgtaaactcacacaacaacactgctattacaataatcggcactgcgccgatggttctcctatcattgggaccctcgaggccggccgggccgggatccaagcgcttagtgatcagttaatactaagggcaggcacacctctgcttcgcgctagtgatcaagcaagtgcttctgtactctgcagcaatggcaggcaatgcctcggtcgcgctgttcctcgccgtgaacctggtggtgttcgccatggccagcgcctgcggtggcaactgccccacgccgaccccgtccaccccgtcgacgccgaccccgacgccggcctcgttcggcaagtgcccccgcgacgcgctcaagctgggcgtgtgcgccaacgtgctgggactgatcaaggccaaggtgggcgtgccgcccacggagccatgctgcccgctgctgaagggactcgtcgacctcgaggccgccgtgtgcctctgcaccgccatcaagggcgaggtcctcggaatcaagctcaacctgcccgtcgacctcagcctcatcctcaaccactgcggcaagaccgtgcccaccggattcaaatgcctctaagctagccgcgagcatgcggatatatatgtgttcttttggttgccattcgcctgcagacttcttgtcgtttgctacttattaagcgagtgctagctctgcatgcatgactacgtcctttgcatgttgatgagcaactttcgatacttttgggtgtttgttttatgtaagtgcttcgtcctttacatcgacagtgtcccagaactatttgtactgttattcttttatttgtacccagcaatctgctcgatgaaataaagcttattatatttattggaaaaaaaaaaaaaaaaaaggcccctagggcccttgggctccatgcatattttgtacacatttgcgaatactacacaaattaaaacatagatacttaagacaataacccatagccatttgaggcataaaatcactaatatccatgataatattcatccgtgtgcaatctccaaccgacaaacaacagtctggcaggcaaagagtatacagtttttgtttagcttaagccctgctcctttttttgctatccatatatataaatctcagaatactccta

SEQ ID NO: 11010 - DNA, 3705 bp, Zea mays
tggacagagagagtatttttataaacaaaagggaaccacctagccacattcaaacaaaaagaacaaaatatcccaaaaggagggcaacccccaccgttgttgcttacactcttttcaagcacattcaagcctctttgtatgaacataacaacaatagatgacgctgacctcgcaagtgccacaaagaaccatttcaagcaaatgcgcccatcatcgtggtacctctgccgttcgtgtgatcactaataggacagtgacgacaggcgtaaaacgttctaaaatatttcttgggcacttgagcatgttacaagatacaggcaaccaacccatatgacaaattgctgaactgaataagtgatcaaccatcaagcgagaacaaacatgaacatgtgtgtcaaccaatgcagcaaatcttggccactagcgctgttctacatcgaaacctatttctagcagtaccgcccaaatatttgtggaacaaatccagatcacccatctaatcgccctcacatgcatgaatgctcacgggaatgttaactcaccaccaactactcagtattgcatcgatatataaaatgcaaccgctcaagcgaccatataaaatgctacttaatggaagagttgaaccatctcggttttttttataaaaaaaatgagacaacaaagtaccaaaattctaatctattactccctccgtttctttttagttgtcgctggatagttcaattttgcactatccagcgacaaataaaacgaaacggagggagtaactttcaatgaatttgttttaaactcctccgatcctccttggctccttgtactcgtgtgcctcatgtactctccttgtggtcgcccttcggtggctgtgggcgcgaggtatccgctgtcgacaataagcgaagtcctcagctgttgtgggtcctgcgctcaaacatggtgaaatcaaactgggtaaatttgatcgcgatcgggttcagccttcgctccaacactatactcatcagatcgagaaattagaatccaaaacattttagaggtgtgaaatatttttaaaaaattatacatgtatactcaaggttaaatcgattaggaaaccttactatccttactgggcatgaagcaatttcaatagcatttcagctaaccacaacttatgtgaagtttttcctggtttttaggtagctaaagcaacctagatacatgatgagagagaaatatcactactaaacttttctagagaatagccaaacaacagatttcataacttgcatacttatagagtgtttgaatatactagagctaatagtgtaactaaacaatgtaactaataggttagctattatattagctacttttagtaaattagctaatagttagctagctatttgttagctagctaattccactagtaattttttgccaactaactattagctctagtgcattcaaacacccctagattttttttgagacaaactcaacaattggccttttcttttgaagctaacaattgtgcccatactacatgtcaaagaaaaacgcagattaacacaacaacgacacgaagtcaccagttgacgcccttcgtctcagctctgctgtcctctgattaacacgacaatttgaaacccgtttccatggcatggcatgttacaaggtacaaaccagccaacccatatatatggcaagttactgaactaaactagtacgagatccaccatcgagcgagaataacaaacgtcaacatgcatcaacaaatgcagcaatcttgatcgctagcactgttgggctttacatattcgaaacaaatcatgatcacccatcaaataataatcaccgtcacatgcattgatgcatccacggtcacgggaagtttaacgctctaataatttatcaaacgttgcaccagtggggtccgcgcccccaactcgcccgccgagcagccgctccccccaccatcacatcacaggcgcttattagcagtcgggttattaatataaggccgcccagccagcctaatcactccgcataattcgtgcttgtgatcgagcagctgtcgctgtgtgtgtataatggcactggcaggcaaggcatcggtcgcgctgttcctcgccgtgaacctggcggtgttcatcgccatggccagcgcctgcggtggcaactgccccacgccgaccccgtccaccccgtcgacgccgaccccgacgccggcctcgttcggcaagtgcccccgcgacgcgctcaagctgggcgtgtgcgccaacgtgctgggactgatcaaggccaaggtgggcgtgccgcccacggagccatgctgccggctgctggaggggctcgtcgacctcgaggccgccgtgtgcctctgcaccgccatcaagggcgaggtcctcggaatcaagctcaacctgcccgtcgacctcagcctcatcctcaaccactgcggcaagaccgtgcccaccggattcaaatgcctctaagtctaagcacgcattcagccgcgcgctcgtcgctgaagagtgtagctggatcgtttggattcagatttatttggtttgtatcgtttgtactggtctgtacacgtagctcttgtctgatcagatttggtttcccttgcttgcattgattttcgatctgtttgttttaatcgttttgtattattcgatctctgtatgaataaatacttttatctgttcagtaaaaaaaaaaaaaaaaaaaaaaacgggcagccccgggtcccgtattcttaatgcagtgcgtacgtcgtgacacgcgccctgtgcaaactcccataacattacatcgatactaggcccaagtgctggctatgctaaaagatgagacatactattctcaattgttggcacaagtttgatgcaacatcttatgcattagattccaattggccaggcagacataggagctatatatagatcatatcacataagaacttgaaaagctaacagtctgagataaatacaaaaggactgaacagatccacatgacaagtggtgcaggtatatgtgaagattagccatattggacactctattgttaaaacttaaagctgcaatcctttcttaaacaatattctttatgtttctaataacgctagtaaaagtcttaattctgtacattgccatgctaaagataattatgcatatcttgaattttgtcctagtgtcttctttgtcgagaatcagaccatgaggataactcttcttataggtcagtgccatcagggactttgtcttcttccatccttaccgtccaccaaatcaagtcttccatacaacaaaaccaagtttcgtcaagtgacataatagattagtcatgctttggttcctatagttgtaaagtcattagtagatttagtaatgtttggccgagtcctatgaacaaacaatatgtaattcttgtaaaaaggcaaaaagttatctaatgccttataataaatttaataatgtgtctcattatccttttggagcttatcttctctaatgtttggggccctgcctccaactcaattactagacataaatattgtgttgttttattgatgattatagtaaatatgcatgaatcttgctcctaaagtgcaagtttcaagcatttcaaatattttgtgaattgtaagcctagttgagcgccaattgaatcagaaaattcttaccatacagactcactagggaggcaatatgacaatca

SEQ ID NO: 11011 - DNA, 1574 bp, Zea mays
cattgggaccccccggccgggccgtccggagacatcctctccagtctccacccccactccacgaacacgattgctgcttgcctgctgctgctgcggctcgcggccatcagatccagcgccaccgatgccgccgcagccgaacgggggcaaggtgaccccgaacctggcgatggacgcggaggccacgcgcctgctcaacctcacggtgctccagcgcttggaccccgccgtcgaggacatccttatcaccgccgcgcacgtcacactctacgatttcaacatcgacctcaaccagtggagccggaaggacgtcgaggggtcgctgtttgtcgtcaagaggaactctcagccccgattccagttcatcgtcatgaaccggcgcaacactgataatctggtggaggatctcttaagtgattttgaatacgagcttcaacctccatatttgttgtaccggaacgcttcacaagaagtcaatggaatttggttttacaaccaacaggactgtgaagctgttgcaagtctatttggaaggatactgaatgcttacgccaaagtacctccaaaacctaaagtgccttccacaaaaagtgagtttgaggaactggaggctgttcctacatctgctgctatagacggcccccttgaacctccgccagcgtctgccgctgtagtccttgatacccctgatgaatcattaatcagttacttcagtggcgctgctagcattggaagtgtatcaaacgcacaaccgtctggaagagtgcacccatctactgagagcatcccatcttcccatgtgccattgatcgttccatctgctgcttcaacacatcaactgcccccttcagtagcttcaacagcttcaccattgcccgtccatggaactaatgcccacactagccggccaacaaatcttgtgacaccagatttctttgcgcctccaccatcctcttcagctccactggctccgccgggtgcatctgtggttcctactgcgccacctcttcatcccacttcggcggcatctattcaacgttctcagtatggcaccccactgctccagccctttccaccgcccactccacctccttcccttaacccctcacacagtgatagacttactgttacaagggatagagtcaaagacgctctacagagacttgttcagagcgacgagttcgttgatctggtgtgccgggaattgcagagatcacttgtataggctgcttgcttagtcttgtcgggagttttctggctcgtggcaagaatgtgcctgtaattttcctttgacttttttgcatgcttcccttcccgtactattgtataggtttgtgttagtgtattggtgtagagtactataggaatggttggtagtatctgtggggtcccttggttccaaatatccgtgttggcagtgtgagaagcggaagtaaaactagcctgttcaagaacgttggaatttgatgtgctttggcgtggacaaattacagcactgagattctagaagtttttttttaattcttattaacttcgctttctggaaaaaaaaaaaaaaaaaaaaaaaaaaaaaa

SEQ ID NO: 11012 - DNA, 3026 bp, Zea mays
  misc_feature (3007)..(3010): n is a, c, g, or t
  misc_feature (3012)..(3012): n is a, c, g, or t
  misc_feature (3015)..(3015): n is a, c, g, or t
  misc_feature (3021)..(3021): n is a, c, g, or t
ctggaaagatccactgtctctatgaactttcaactcttattactacatccaagaaaaaaaaggctctggtttcagcaacattttaatctcattttcatttgctgttgtgcagtaagattaactccaaagaacagagttgttggtcatctggttggaaaagttaaccatgctgatgatgaaccatttgagttgacaaaggaaatcgaggcccaaataattggcaacctgctccctgatgacgacgacttattgtcaagtgtttgtggtgatattgggtataataccaatgcgaataatcaggatgagattgatgatgatattttttgtactggaggtggaatggaattggaagcagatggaaatagcaaattgttaaactttaatggtggagccagtcagactaggtcaattgtccaactcaatggtgagcgatcctcgagaatcctttttgtcggaaacattgatagcaacgtcgaggattctgaattgaaattcatgtttgagcgccggccgggccggcagacacttaatgcttcttgcaaacatcatggttttgtgatggtatcttactatgatataagatcggcagaaaatgctatgagggcccttcaaagcaagccactcagatgtaggaaacttgacatacgttactcgagtccaaaggactatcctttggataaagatatcaacctgtccatggtaatagttaatcttgaagcttcgataactaatgatgacctgcaccagatatttggtgtctttggtgaaatcaaggagattcaccctacttcagataatgaccattacaaatcgatagaattttttgatgtcagagcagctgaagctgcacaatatgccttaaacaggagtgaaatttcaggaaataaaaacaaattggagcctagctgtctgggtggtactaaacgtttgatgcagcagatgtcttgtgcattggaacatgaacagtttggtgcatgtaaactcggaagcccaaacagtccttcaacatgctttgggtctgtcaatatggcacccatcagatccactagcacagaaagtggaactgttcaggttttacgttctagagttcagacaccgataaaccaattccaagagggaaggaattttctggatcttccctcaactaccataagtagatcctctcctgttggaattacacctgcaggatcacaaagcggccaccacgctcttgatgagcacatccattcacttggaaagatgaatgtacagaacaagggacgaatggattgtggatttcaagagagtactgctttccatcctcattctctccctgacttcaatgacagactaagaaatggtatctcctataactgctcaatacctcccatcggtgttaagagcaatgctagagctgctgaagcaatggatgtcaggcacatttacaaaggaggttgtgggcatctcagcaatcaatcttctgctcatactgaagcacttgggttttcaagaactggtagctgccctctctatggtcaccaactagcatggagtaattctaataacctacaccagcagccttcttctcccatgatatggcctagcatgggcccatttaccaataatatgccatctcgccagttgatgcaagtgcatggaatttcaagagcaccattgcgcatgcttgaaaataatatccctatgaatcaccaacatgtgggatctgccccagctgtcaatccatcaatttgggatagacgacatggatatgcaggggagatgatggaaacaccaggattccacccagggagtgctggaagcatgggtttccctggcagcacacatctgcatcagttggagaccaatggtatgtttcctcacaatggagggactttcatggacccagctatgtctcctgtgcacatgagtgctcgctctcctcagcagagggggcatattttccatcgaaggagccatgtggctcctattccatcctctttcgattctgctggtgaacggatgcggagccgaagaaatgactcgaatgtaaatcaatctgacaacaaaaggctgtttgagcttgacattgagcgtatagtccggggcgaggactcccggactacactgatgataaagaatatcccaaacaagtacacatcaaagatgcttctggcagctattgatgaaagtcaccggggaacttatgattttatctacctgccaattgactttaagaataagtgcaatgttggttatgcattcatcaacatgatcaatcctgacaatattgttccattttataagacatttcatgggaaaaggtgggagaaattcaacagtgagaaagtggcctcacttgcttatgctagaatccaaggaaaatcagctctagttgctcatttccagaactcaagtttgatgaatgaggataaacgctgccgccctatactcttccactctgatggtccgaatgcaggagatcaagaaccattccctgtgggatcaaatgtccgttccaggcctggaaggtccaggattttgagctgggaacaaaaccaccaggacattgtgtctgatcataccaaaggtggaactccgagcagggctggtggcactccaggttacatcgccacggatactgatcatacggctgttgattgacgaacttgcgacaacacccgacattctgacaattgcaatccagtttttttttttgaaattgcatcctctcctacctcttttttccttttgttatgttgtatctatatctacttccgcgtgatattttggcaccggaggctctagacggctgcagatttggtcgctgacaagtagcgaggagatggatgttgtgccgtcagtttctccttactttggcacagacccctcagcgggattttgttggacagtttgaccccctttcaccaggaaagatatccatatttgggggagtttccctattgctgtttgacagtgctgtcatgaacattttcctaatgctgtggatgtgaaatttcagaatgatccnnnnanaanaaaaanaaaaa

SEQ ID NO: 11013 - DNA, 4852 bp, Zea mays
  misc_feature (4065)..(4065): n is a, c, g, or t
  misc_feature (4075)..(4075): n is a, c, g, or t
cacacgagttccgccgaagagtggagtacaaggatgtctacgaagttgggtaccagccaccaagaggtgatgaatatccaaggaggaggaggccgagtgaagatcatgacaagagaaggatggatcttgtccgccagaagtttgttgaagcaaagcggcttgcgtcacatgataatatcccccgcccgttcggggtccccgatgctcttgaggttctgaattcaaacaaagatctgtttctcaaatttctcgaagaacctaactctctctttgcgaagcagtctgggggactcggttctgcaccaacatcacctcagagaaagcacattactgtgttgaagccctcgaaatcagtggagatgaagggtgacaaagcaattagaaggcagacaaaccatgcagccggaaacagaacagacaggagcaacgtgcacaagtctgatgcagctcatgtgaaggaagataagcttcccaaacacaccaggatagtggtcttgaaacctacctcggtaattgcttccatggagcaatctgagcaaagttatcatgctgatctcgatgattctgaagcccctgctctgtcaaggcatctgagcgaggagatagattggtcggtgcatggaatttctcgacgccacactgcatccctgcagggttgcatgcagtcaaatatgttcggcgcagatagaccataccatcagtatgctgaagaagagggcaatagcttgagtgactcagatattggaaccccaacatcacatcactcttgggagtacatctaccggtttagcaatccttactttggctctttgagccatgcttcttgctcccctgagtcacatgtaactagggaggctaagaagcatgcttctgacagatgggcaatcgttccatccagtgagatgacccaggacaaggtaccagtgcgaagaagtttgagcacacttggtgaaatgcttgccatgccggatatgaagaaagaagaggctgctgaacaagcatctcctgatgctacccaccagttgtgtgagccaacagttggcgtatcatctaactgtgctgttggcgaaggtgagggagaaagctccctcaggaaaatctcgaggtcacgatctgttccggtctcttcaacagcttttgatagcctgcggttagatggtggatgtttggatgctcagcataaagaacctacagtgccgaaggaggtcaaacctaagagtgggaaatcatctttgaagggaagaatcacgagtttcttctcaaaacgtaagaaagcagagaaggagaagcctagcccatctcccttgggaaccctgaacggtcgaggttcgtcagtcagcactgtagcagttgctaaaccagacgctccacagcatgtttgtgctagttcacaggatgatgtttccttcgaaagtttagaagaccagtttaatcacggaccaatcggagctccggttgatgaacccgaagcaccctctgtgtctaaggtacgtttgcttatctgggtatgcaagtttagctttattcggactggaatatgaataacgtttgttaattttggatggttctgtttgcagcctccagcttcgcttgagaagacgctatcatttgagattcgagcttcccacttcgaccagcccagccctacatcggtttttgatgtacaatttgaggatatcagcgagaaatcccccatttcatcagaaagcgcgattactgctaaacaaggtaagggcatcatgagagctcttatgcgataagttccctcgaactcacctgtattctgtagcatgtttgctgttgagaacatcatgattagccctactgtttgttatggccatgagttgttttgtatgtaaatgaagtaggtttgcagtgtcaataatatgcgtgtgaataagtgcaaattatatcctgcttgcagagcctctatccaggtctataccaatcggatcgatcgcgaggaccttatcatgggacgacgcttcccaagaggctcctccgcagtgttctaccaaaggagacagcaaccccgcgcacgcgcagcacgagttcgtcgagaagacgctggcatccgctggcttctgcaacgagaagacccaggacatctttgcccggtggcattcgctcgaccggcccttggaccccgccgtggtcgagcagctgctggaacgcaaggtggaggacgccaagtgccgagagaggcggtcgaaccagaggctcctaatcgactctgtcaacgccgccctgctcgacatcggccagagcaaagtctgggggggcgcgtacccttgcaccgcacggcactattccaacgctccgggagttggcacgtgcgatgatgatgtgctagtgaccgacgaggcgtggaggctggtgaggagctggctcttcgatgacgagaacgacatcgccgggttgggggacaacgcgggccttgcggcggactgggttgtcggtagggagatccacggcaaagggtgggccgagacgctgcggatggaggtggacgagatgagcagggagatatgtggcgaggtcctgggcgagttggttggggaggcgttttcggagcttgccggcgctgcggggtggcattgaagctgcctgccttctattttccctgcttgtggtggcgtccacctgctgctgctgcttttacttccaatccggttcttgtgtgtatattaccctcgtaactgctcaaagtgttccctgctgctgcctctctatctgtgttgcatctctttcagcattgatacattcacggtaataacatttacggatgaatacagctgctgcactgcacttgaaatcctctctctttttcctggccacatgttcctttctctgctatggctatgaggttgcacaacgtaattactacctgtgtgctgtgcagcctgttagtggtataatcgcaggctcaatgtcgtgggggcttaattacctgtgtccatcactcccaagcaagtagggttaaaaaggagagaggccatgtgcctccttccttgaaagcctacaacagtccaagcaaaggcgccacctttcgctttcagcgcatttctttactgatcctcctgtcctgtcctcctctgccttttagcctacagagctctgcatgcaatgtggaggtggattaaaaagggggcctgcagcaaagctcctccattgacattctggggaataaacggcctttatgtcgccgtgaggagaatcctcgcgttctttttatggatcccatggctagcgctagcctctcagatgcgattgcttttgttttttttttttgcctacctacggtagcatctttcaggctacatttgtatatatagtgtttgttattgcctgcttcaaagtgctgtccctcgcgtgccagcccggcgcggcgtggtcccggcgtcccgcgatgtgtaaagtgttgtgatctgtccagctggaactccagcgctggtcgccgggacgaggacgctgcgctgcgctgtgcctgggcgcggtccatgggatgggaagacgcaggacttgccttgccccagtcccccctgctgctgagctactagtcaactttttttccccgaatctttttggttgctgcctttgctgcggctaactaatcggtgccgtgctatgacagcgctaaagcgctggggcctgggtgagttctttgtcccttcccttccgagcaggacagctgacggtggttaacttgcctccgcgttggctttaggctttcacctgctcgttttggaggacctgctgcaagtctgcaatgcaggtttcgatgaggtgatgattaatagcagcagttcttttcgcaggcttttaggcggtctagagtctagatatgctgaaagagagacctggcattttgttcgtctactctctctggtttatgggctgttccgatatgactagcaaataacgagctactactgtgtcctgttcgttcaaaagctcgcaagtacagaaccgtggatggtggttgcgcttgcaatcgacccacccatgccactgccgtgaagcaatttatggatcatgtttcgtgtaagcgtcctgcaaagcgangaatgacgcntacgccaccaagtgatttttcgctttctggttctctccgccgtaccgtgttattattactccagactccggatagtttgcttgccccctcgaatcgatagttgtatatatacatacatgcgtgcatacgcagactatcaccggtcccatcgcatgcatgccgtccttctctctccgatcatgcaacggctcttcattccgctctgtctcttccttcgtctcggcatgccgttgaagattccacgtcctgtctgtctgtctgccgtgtgctgggctgccctgccttgcatttagcaatgaagccaacagtgtttatcgtggacagacagacagctcacagctgcgctgcgtgaaatctctaaaacgtatcttcagccttgggaaaacacaacgccagacgccactaggcgccattattatattgccactaatccgctggtccagcagaggggccacattgcacagtggggggccaggggacggttggtggtggctccactccatctccatgccacccgcgttgaatgcccctgaccgtgcaatgcatgcagcaagcggcggggcggccacaccacaggcccacagccgtcgagcagcaaatcgcggtggcccggacccggagcgggcttggatccgctcagtcgcaggtgggaattgggccgaaccgggttaagctcattgtacttcgtgtcaaacggttgtggaccaagaaatcctgaaaaaaaaaattggtcgtgtcgtgtcaccccgaaatataaaagaggacccagcccgacac

SEQ ID NO: 11014 - DNA, 1731 bp, Zea mays
gtctcgcttctccccaccccgcccgctacagcgccggtggggggcccccgcggctgccggcgaccggtcgccgccgccgaggccgtcctcgccgccccgacattctccagctggcagcattagccatggtttagcggaggcgattctcgttgcagctgtttccggggtggtgggttttcaaggaataaagaatgatcaacctcttcgaattgagcgttggagccagcgccaaggtctcctcaagagatggctctccggtgagaggaactcagtcggagcggaaggagtacgccggatcaaaggcccgcctccagcttcccttgagaagacgctatcatttgagattcgagcttcccacttcgaccagcccagccctacatcggtttttgatgtacaatttgaggatatcagcgagaaatcccccatttcatcagaaagtgcaattactgctaaacaagagcctctatccaggtctataccaatcggatcgatcgcgaggaccttgtcgtgggacgacgcttcccaagaggctcctccgcagtgttgtaccaaaggagacaacagccacgagcaggagcagcacgagttcgtcgagaagaccctggcatccgctggcttctgcaacgagaagacccaggacatctttgcccggtggcattcgctcgaccggcccttggaccccgccgtggtcgagcagctgctggaacgcaaggtggaggacgccaagtgccgagagaggcggtcgaaccagaggctcctaatcgactctgtcaacgccgccctgctcgacatcggccagagcaaagtctgggggggcgcgtacccttgcaccgcacggcactattccaacgctccgggagttggcacgtgcgatgatgatgtgctagtgaccgacgaggcgtggaggctggtgaggagctggctcttcgatgacgagaacgacatcgccgggttgggggacaacgcgggccttgcggcggactgggttgtcggtagggagatccacggcaaagggtgggccgagacgctgcggatggaggtggacgagatgagcagggagatatgtggcgaggtcctgggcgagttggttggggaggcgttttcggagcttgccggcgctgcggggtggcactgaagctgcctgccttctattttccctgcttgtggcgtccacctgctgctgctgcttttacttccaatccggttcttgtgtgtatattaccccctcgtaactgctctgttctgtacgccgctcaaagtgttccctgctgctgcttctctgtctgtgttgcatctcttcagcattgatacattcacggtaataacatttacggatgaatacagctgctgcacttgaaatccaaaaaaaaaaaatctcttcttcctggccacatgttcctttctctgctatggcaatgaggttgcaaaacgtaattactacctgtgtgctgtgcagcctgttagtggtataatcgcaggctcattgtcgtgggggataatttacctgtgtccatcactcccaagcaagtagggttaaaaaggagggaggccatgtgcctccttccttgaaagcctacaacagtccaagcaaaggcgccacctttcgctttcagcgcatttctttactgatcctcctgtcctcctctgccttttagcctacatgagctctgcatgcaatgtggaggtggattaaaaagggggggccctgcaggtagacaaaaaggatcgcgg

SEQ ID NO: 11015 - DNA, 1806 bp, Zea mays
cattgggacctcgagccggccggtgggaatagcttgagtgactcagatattgaacccacatccatcactcttgggagtacatctaccggtttagcaatccttactttggctctttgagccatgcttcttgctcccctgagtcacatgtaactagggaggctaagaagcatgcttctgacagatgggcaatcgttccatccagtgagatgacccaggaaaaggtaccagtgcgaagaagtttgggcacacttggtgaaatgcttgccatgcctgatatgaagaaagaagaggctgccgatcaagcatctcctgatgctacccaccagttgtgtgagccaacagttggcgtatcatctaactgtgctgttggcgaaggtgagggcgattcggcacgacggaagatctcgaggtcacgatctgttccggtctcttcaacagcttttgatagcctgcggttagatggtggatgtttggatgctcagcataaagaacctacagtgccgaaggaggtcaaacctaagagtgggaaatcatctttgaagggaagaatcacgagtttcttctcaaaacgtaagaaagcagagaaggagaagcctagcccatctcccttgggaaccctgaacggtcgaggttcgtcagtcagcactgtagcagttgctaaaccagatgttccacagcatgtttgtgctagttcacaggatgatgtttccttcgaaagtttagaagaccagtttaatcacggaccaatcggagctccggttgatgaacccgaagcaccctctgtgtctaagcctccagcttcgcttgagaagacgctatcatttgagattcgagcttcccacttcgaccagcccagccctacatcggtttttgatgtacaatttgaggatatcagcgagaaatcccccatttcatcagaaagcgcaattactgctaaacaagagcctctatccaggtctataccaatcggatcgatcgcgaggaccttatcgtgggacgacgcttcccaagaggctcctccgcagtgttgtaccaaaggagacaacaaccacgagcaggagcagcacgagttcgtcgagaagaccctggcatccgctggcttctgcaacgagaagacccaggacatctttgcccggtggcattcgctcgaccggcccttggaccccgccgtggtcgagcagctgctggaacgcaaggtggaggacgccaagtgccgagagaaggcggtcgaaccagaggctcctaatcgactctgtcaacgccgccctgctcgacatcggccagagcaaagtctgggggggcgcgtacccttgcaccgcacggcactattccaacgctccgggagttggcacatgcgacgatgcgctagtgaccgacgaggcgtggaggctggtgaggagctggctcttcgatgacgagaacgacatcgccgggttgggggacaacgcgggccttgcggcggactgggttgtcggtagggagatccccggcaaagggtggcccgcgacgctgcggatggaggtggacgagatgaccagggagatatgtggcgaggtcctgggcgagttggttggggaggcgttttcggagcttgccggcgctgggggatggccctgaagctgcctgccttctattttccctgcttgtggcgtccaggcgtccagctgctgctgcttttacttccaatccggttcttgtgtgtatattaccctcgtaactgctctgttctgtacgccgctcaaagtgttccctgctgctgcctctctatctgtgttgcatctcttcagcattgatacattcacggta

SEQ ID NO: 11016 - DNA, 1134 bp, Zea mays
gcattgcactggggggagcgtgcgcggtaggagtggatcggaggagcatgtggaggctaaagattggagagggaggagggccatggatgcagacggcgagcgacttccatggccggcaggtttgggagtacgacccggacgccggcaccgacgaggagcgcagcaaggtggagcagcttcgccgggcgttcacagagaaccgcttccgaaggagggaatcgcaggacctcctaatgcgtatgcagttcgctggacaaaaatatgtgcatgcggatctgcctgcggccaccaagatagaggaggatggcgacgaggtgccgctgacggaggagaggttgagggagtcgctgaggcgagcgctgggttgcatggctgctctccaagctgaagatggccactggccgcctggtgattacagtggggttatgtacctcatgccgttctggattttcgcactgcacatcacaggcacggtcgatgctgtcctatcgaaagagcatagacgtgagatctgccgccatatctacaaccatcagaacgaggacggcggatggggcttcaatgtcatagacgagagcgccatgttttcgacgtgcttaaactacaccagcttgagacttctagatgaggtgcagcgggaggagaacgatgggctagctaaaggtcgagcatggatcctatcccatggaactgcaactgcagcaccgcactgggcaaagatactactctcggttattggtgtatatgactggcgtggcaataatccagttgtgcctgaactatggctggttccacgtttcctcccaattcacccagggcggttctggtgcttcaccaggattatgtacatgtcaatagcttttctttatggcaaaaaatttgttggtcccattacaccaactatattagcactaagggatgaactctacagttcggcttatgttcacattgattggagcaaagctcgtaattcttgtgccaaggtttgccatcgttcttcattaactcttaattattattttatagctataaattattaaagtgtgcattgtcatttgtacaatttggtactttggggacatgaaatttgtgcaatgttaggatgacactatttttgcaaaaaaaaaaataaaa

SEQ ID NO: 11017 - DNA, 2679 bp, Zea mays
  misc_feature (17)..(17): n is a, c, g, or t
  misc_feature (430)..(430): n is a, c, g, or t
  misc_feature (484)..(484): n is a, c, g, or t
  misc_feature (524)..(524): n is a, c, g, or t
  misc_feature (2544)..(2544): n is a, c, g, or t
  misc_feature (2657)..(2657): n is a, c, g, or t
tagtcactagccacgtnccatgcacaaaaatcatgatgctctctgtctctctctcatgaagaactagcgatgctgcgatggtagttgctccactactcaaaaagctcagtggtaatcaagaaactagctatagtagtatgtagatgatatatatatatatattcatgaatataatcctgctgaataaattataacaaaagagggggagggagaaataacctccctgcagctctgctgcatcagggcggagagaatatcgaacgaagaagcaaaacgaacaggtgctgcgggctaagcgcctaagccacgatcagctggccagcggctagcacggcggccaagccaagaacactagaaccggtccccctcgccgccccagacggcggcggccggcggccgtcttgtagtaccaggggtaccacggcaggantggggttgggcggcggcggcgccgggtagccgtaccccgcccccgcctctccgnctggaggattcaagtagggaatgtagccccccgacggcgngcggcggcggcgggtagctccaggaggacgaaggcggagtgttgtaggaggacgatggcggcggcggcgggcagttggcggtgacgacggcgggcgccgcgggcggaggcaggcacgggtaagggcagtcggctgggtacgtgctgccgtctgcggcggaagcagtgtgtgcctggaggagtaggagcagcagcagcagcgccgagaagagcatggcctcgaagaggaagagcctgccgccgtgcgccgtggccatggcgagagccgagggaccggccgcgcggagagggatggcagagctgtaggctgctggtgatctggtgatcaccggccggccgcgcgggtccctgtgaaatataagtgaggactcgtcgactagctcggctgatcagctctcctcagcctggtacttcccataaagcttggttactcttaggagcaatggaacccaggcacgggcgttcagcattcactataagtttctcaaatccaaatggctttgcgtatcagtgcactcccattccagccgtcagttatccagcaactggttctagccagcttgatgtgctagctcctagaggttgcaagagaaagtggactgagttggccctaggtctgggtgactcatcaagctcagacagcagcaagaggagcatgggtactggctgcactgtatcttctgccaagggaagcgatgacgtctcatgtatggactacgacataggttttgagctatctctcggcaatgaaggtacttcgaggctgtgtaaacaggcctgtgactctacaaggactatggagaagcctgggttggatcttaagttatctttggctccatctcaatctgatgtaactgatgcagatgtaattagaagcagtgcacctcaggacatgtttgtgcatcatcagtacttaatgtcgtcagcgccaacagttgatgaaggatctacatccgctcgacgcttatctggaggcatggtgggttcctttcttaaccaggatgggatttctctggaccaagcgctcccagttaacgctaatcaggttcaagtcccagctccttcagcaccaacagtgctccaactgccaaaaagttcagcggcctcttcttctgggtttgtccatccacagcagcgcagcagtatcacaaaaatctgttcacacccaggctgtgcaaaaggagcgaggggttcatctgggcggtgcattgcgcacggtgggggcagaaggtgccagaaaggaggctgcagcaaaggagctgagggaaagaccatcttctgtaaagcccatggaggggggaagcggtgtgaacaccttggatgcaccaaaagtgcggaaggccggactgatttctgcatagcccatggcggcgggcggcgctgcagccatgaagggtgcaagagggcagcacgaggcaaatcgggcctctgtatcaagcacggtggtgggaagaggtgcgaaaagccaaactgcacaaagagcgccgaagggcgttcaggcatgtgcattgcccatggtggcgggcgccgctgccagtacgctggctgcgggaagggagctcagggcagcaccagtttctgcaaagcccacggtggcgggcaagagatgcacacgccccgactgttccaagggcgcagagggaagcacggcgttctgcaaagcgcacgggggcggcaagcgatgctcggctgacgggtgcacgaagagcgtgcatggtgggacccagttctgcgtcgcgcatggaggcgggaagaggtgcgtggtggaaggatgcaggaagagcgcgagaggccggagcgaccgctgcgtcgggcacggcgggggcaagcggtgccactccgctggctgtgggaagagcgcacagggaagcaccgatttctgcaagtcgcacggtggaggcaggcgctgttggtggggacatctcgggtcgggtggcgctccttgcgaccgtctggcgagaggcaggaaggggctttgcgatcgacacaacccgctggtggacgacaacagcgtccacggnggtgtatcgtttggtgggttttccaccctctctgagggaggcgccgaaaacagcttctcatgcacacggtggaggatcctcgccacgtggcgccctcggcccgtgaaagccgngtgcatgggggcaacttatgcc

SEQ ID NO: 11018 - DNA, 4303 bp, Zea mays
  misc_feature (93)..(93): n is a, c, g, or t
  misc_feature (232)..(232): n is a, c, g, or t
tgcatggaaacttttaactgttttattgcattgcagtgatgagatacgtgttgcagcattgaatattgaagaactttgcaaattgtgatatgnttgtttagttgttgtgaaattctaacgtctatctatgatccaaccatccagatccaaacaagtctggtatcaactagcctcttggattttgtaggaaataatgagtggccttaaatatgaactggtctgaggcccaagnaaaaatcctgcattcagctgctatctcactatggctgttttcttctaaagtccttcgacatgtaagtatttgcttgttaatggtccctgcaactgctgccccccttttgattaatgcaacttatgtgattaagattgtctgcttcttgcgcataaaattgaatcatcctttgacttaactgcctctgaaatttgggatagcatgagcacgagagtgaaaaaaaaatggttctatgtctgttttgtgaatcatatcaccgatacaatcactattgaagacctgccaaccagagctgttaacacagaaaaaagatgacataaataaataagcgttttcattaagctaaggtcgtctgaaactcacagttcacgcggttcactgtatattaaaagtagtggcaaaaaatatttgtaagttgctccttgtcaggtattgatagattttttctgtacttcaacctggatagcttcatgcttgttcggttaatgtaccttcgttaggtaactttacctgtatcttgtgttctaaaatacggatgctcattgttttggtccatatttacatgttgaaggcatgttccttcctcctgaggtttaaacagttctgccaaggattggcaagtgattgggatatgatcaacagactaaggaagcatggattcccaaaaaaaagataaccaaccaaatgggcctgattttctagtagctatagagctaaagtgtgaaactttggcaagagagatgggtctcagatatcccatgccactaggagtaccatttgcaggagcagtcgagcggtccaaattcctatcggatgctcttctactttcttttattgggccttcgtatgaaggggtaatattcgaactaacaaaagattggttatgtacaacagcattatttcaagaagcattattaatattattattattcaactggttgcagaagtgcgttgagttttctacacacttaatattaccagaaatagtttgaaacatgtttcgagaatagcgtatttgaacaggcacagaccatagtcccatgcatgagctagttcgtcagcaacattcatttttaccttgaaatgttgctctggtgtttagaaacaaaacaaaacaaaaaagaaaaagaacggtagatgcttgagactattgcatggttaaccttttttttagtatttggatgtgcagaaagaatcctctcattttggcgtgtaataaaggcgtattccttgggacaacctagcagctttcgaggaattctttgggaaatttcctttctttgcctaccccgtgtacccgcgcgcatttctggtaaccgtggccttgtctttgcctactgctctgttcatatgtactacaggacagatagagcgtttgtcgtctggtgccatcgaccggcatcgtgaacgggacgcaagaacagaaagaggagtagagagtccgtgccatgccggagagcggagaacgtgccagattttcgcggtcggcgttttttcgtcagagtccgcgcgcagtgctgccggagaaaacgcgtcgacgcgtgtgtcggtgccctagcttatggttccacttgcagccaccattgtccattctccgtgccgtgccgtgccgtgcggctccaggaaccagagtcagcaggaggaagaagaatacaatgtgtgtatttggaagacccgcacccaccacgcgcacagaacagtgcagtgcagtcggggaagggattccaatcatgccatgccatggcaccactgctgcacctaccaagacgtcgccgggtttttgccgtgtgggcagcagctggcacgctctcgcgaatcgccggggagtccttttgggcgccacgccatgccaacctaacattacattacacgaggagatggatggatcgatcgatccaggcctctctttcttttcctcctgtaaaaagtagagtagactttattccttgtttcttttctctcccgcgcgctttccctccgctttgctcgcccgtggccgtggctccctttcttcttgcttccctcgatcgccaccgtccaccggtgctgactgctgtgggctgcggtcaggtcagtggtagtggaagagttcgcgcggcggcagggaagcttcgcggcgacggcactgctgcatgcctctctgcgcgccgctaacggatcggaatcgcgtgccaaggaacctccgaaggcaagcgaccgatcgatcgagcaactttagcttcacggcttttgtaccagtcgtccgtagcatctggtcggaactggactgatggtgccgtccaacgcggaccgtgtacatggttgcgttcaacaatgtgcatactgcgtagcagctgcaatcaagcaagcaatcaagccccccggccccactctgggtcgtcgtcatctgatcttcatgttccccaaaccatgcatgcatgcatggaaggatcgacgtacgaacgccaccaaacgctgttgataaaccagggccaggcctgcttgcgatggccacgacgcggtgagccgctgacagatcccgacatggaaacgacgcctagctccaccgcgcgccttcgttagttcgtcaccaaatccgtccatggcatgtacagtaccagcagcgtgcaggattatattattgaagatacagcgccgtaacttttgcaatttcttcgctgatacgacttattgtacagtgttgtaccaccattagctagtatcgaacgaataaagcgtattttgacagggtatcgagcattttaaacaagaaataaagcgttaatgttgtttatacacaaattaaaagttgacaggaagaactagtacttcagatgtaacacaaaacaaaaaacggacaggggggcaccgtcgcaccgagacaaaaggcaaatattcttgtagtcactagccacgtccatgcacatatacatgatgctctctgtctctctctcatgaagaactagcgatgctgcgatggtagttgctccactactcaaaagctcagtggtaatcaagaaactagctatagtagtatgtagatgatatatatatatatatatatatatatatatatatatatatatatatatatatatatatatattcatgaatataatcctgctgaattttttttttttttttttgtaacaaaagagggggagggagaaataacctctgcagctctgctgcatcagggcggagagaatatcgaacgaagaagcaaaacgaacaggtgctgcggctaagcgcctaagccacgatcagctggccagcggctagcacggcggccaagccaagaacactagaaccggtccccctcgccgccgcagacggcggcggcggcggcgtcttgtagtaccaggggtaccacggcaggatggggttgggcggcggcggagccgggtagccgtaccccgccccgcctcccgctggaggattcaagtagggaatgtagccccccgacggtggcggcggcggcgggtagctccaggaggacgaaggcggcgtgttgtaggaggacgatggcggcggcggcgggcagttggcggtgacgacggcgggcgccgcgggcggaggcaggcacgggtaagggcagtcggctgggtacgtgctgccgtctgcggcggaagcagggcgtgcatggaggagtaggagcagcagcagcggcagcgccgagaagagcatggcctcgaagaggaagagcctgccgccgtgcgccgtggccatggcgagagccgagggaccggccgcgcggagagggatggcagagctgtaggctgctggtgatctggtgatgagatggcgtgggtgcgtgtgcgtgtgaaatataagtgaggactcgtcgactagctcggctgatcagctctcctcagcagctgaaggtgacggtggtcggtggcgctgcagagcgtgtggagcggaataaaacggccgctttgattgcgattagcgagtgtgggttccttggaaaaaaatttggtgcagcactgctgcaaaccagactggtttgcagcccctcacaaataggaggatagaccccacctgcaggtccagcagataacgttttagttgtattattattgctgcggg

SEQ ID NO: 11019 - DNA, 2965 bp, Zea mays
tgctctcttttctgggcatgattgaactcctcaattttgttaactcttttggctatgtaatatgacttcagtcctgaccttttatcgttgaactctggttgagcagtaagaatttaagattgtgttttcacatacaagattttctcccttctattcttgccaacaacatgtaagagtcaacattgattacatttatggaactgaatgcactgtgatacctgatttcttttcaactgtatcactagtctctatttgttgcatgtttcttacagtctttatacattattttcttctctccgtaattattttaactcgatgagaacagatctcatctgtgtgctgtttgattattactgagattcaatcatttggtcagatgagagttctggctggggacttacaagtgtagcactgttgtcggcttgtgactaaatagcatcacttcacatacaacactggataatggatcgtagggatacttcagggtttgttagtggaggatgcaaaaataatgaagcctactagtttctctatatcttctaacttggtagctttattgacaattatttaacccagaagtgaggccagctggtacttcccataaagtttggttactctaatagcaatggaacccaggcatgggcgttcagcattcactataagtttctcaaatccaaatggctttgctaatcagtgcaccgccattccagccgtcagttattcagcggctggttctagccaacttgatgtgctggctcctactagaggttgcaagagaaagtggactgagttggctctaggtctgggtgacacatcaagctcagacagcagcaagcagagcatgggtactggctgcactgtttcttctctcaagggaagcgatgatgtctcatgtatggattacgacataagtttcaagttatctcttggcaatgaagatacttccaagctgcataaacaggcttgtggttctaaaaggactatggagaagcctcggttggatcttaagttatctttggctccatctcaatccgatgtaactgacgcggatctaatcagaagcagtgcacctcaggacatgtttgtgcagccgtacttgatgtcctcagtgccaacagtcgatgaaggatctacatctgctcgacatccatctggaggcatggtggtttccttccttaaccaggctgggatttctccgaaccagttgcccccacttaactctcatctggtccagggtccagcttgttcagcaccaacagtgctccaactgccaaaaagttcagctgccacttcttctgggtttgtccgcccacagcaacgcaacggtagcacaaagatctgttcagagccaggttgtgcaaaaggagccaggggttcatctgggcggtgcattgcccacggtgggggcagaaggtgccagaaagaaggctgcaacaaaggagccgaggggaggaccatcttctgtaaagcccatggagggggcaagcgctgtgagcgccttggatgcaccaaaagtgccgaaggccggacagatttctgcatagctcacggcggcgggcggcgttgcagtcatgacgggtgcaagagggcggcgcgaggcagatcgggcctgtgtatcaagcatggtggcgggaagaggtgccaaacgctgaactgcacaaagagcgcggaagggcggtcaggcatgtgcatcgctcatggtggcgggcggcgctgccagtacgctggctgcgggaagggagcccagggcagcacaaacttctgcaaggcccacggcggcggcaagagatgcacgcaccccgactgctccaagggcgcggaggggagcacggcgttctgcaaagcccacggaggcggcaagcgctgctcggctgacggctgcacgaagagcgtgcacggcgggacccagttctgcgtcgcgcacggaggcgggaagaggtgcgtggtggaagggtgcgggaagagcgcgagaggcaggaccgaccgctgcgtcggccatggcgggggcaagcggtgccactccgccggctgcgggaagagcgcgcaggggagcaccgatttctgcaagtcccacggcggtggcaggcgctgctcgtgggggcaccctggctcagacctcgggtctggtggcgctccctgcgaccggctggcgagaggcaagaaggggctgtgcgaccggcacaacccgctggtccatgacaacagcgtgcatgggggtgcgtcgttcggtggcttcagtgtcgtcagtgccgccgccctttctgagggagatggctctccatctccaggcaccgagacaagcatgcgcagcttcttcatgcacgcggtggaggctcctcgctgtgtggcggcctcggcccatgaaggccgggtgcatgggggcaacttcatgcctatcatgctcgacggtggcgtgggactcgggaagaggccggccgacaacgctgatgctggtgcctctgcccctcctcgcagctggaaaagtatggagaaggcctgtggatctgcgccgcgcagctggctgtagtatttgccagaagttcgtgacctgctcacagctcactctctccatctgggtctcctctgctcctgctccaagtgtctcccgtgtcctctggtcatgcgtggtatggtatgataacatgaactgtgtgtgtactggttggtcaggactcgggacttgtttggtactgtggatattgtggttgtttgtgctcttgtagcataggtctggtcgaacatacctactagtaacagtcgtcgtgtgcggtgtgtgattgaattgtaaatgaaaggaacgcctcgtcatgatacaaataaaaaatagtacctttcctcgcggcgcccgccaaaaaaaaaaaaaaaatggtttcccccctctgccgctccagggcgcaggggcactccgatttctgcaagtcccacggcgggtggcagcgcgctgctccgcgggggcaccctgggc

SEQ ID NO: 11020 - DNA, 2118 bp, Zea mays
tgttacttagtattttgatttatttatatatttgtagaatttatttacattttagattcaatggaactagaaggataaccttcatgcgtggtcgcaacatctttagagggtgtcgggactgtccatgaactgcatatgaaaaaaaaaagactgagtaatcttcaaaattgattttaaaaaagcctacgacaaaatgaagtagcgttccagacccttagattcaatggaactggaaggatagactgtatatgatatttgagctcagcggagtttttcaaattcatgacaaatgaggaacgaaaacggacttcattcttataagcaaataagattattattaggatggaggatggtcgcgtgattacgacttagcatcaaggccaatcaaccagagacagaaacgacattattatcgcgggccttgctttcggtttctttttggccaaactagccaggcagatatcagcaccattactgtacgtcgccgcctttttttctttttgctttgaacgaagttgcttttgcttatgatgaatggatgttcattcacaaagaagtaacacagggccggacatgcgctgcagcagagagcagaactgtcctacagcggaggatttgaacaaacggtgctaacgacgaaatgattcatcgccgtcggtgtgccaccccctctacgaaccacgccgccgccgtcgagtagacgccagcaggaagaactcctgccggcagtggcggtagagggagccgaagaggtcgcggagctccggcagcagcgcggtgaggttacgtgccgacggcgacagggcggggaaggggcagagcaggaagcccagagcgaacatcgtcgccgccggccacatgccgatctcgattcgccggcgcgtgctcgcgtagtaggtggtagaacttgcagagctggccggccggccggccgcgtgggtagccacagaagaagtggcgctggtttccacgtgcctggatgaatagcaggtgagaccaatagttgcgctggaggcccgttgctttcatgcttctgcaatggcgttcacgtttggacagacttcgaatccgaatcttttctcactagttatatgttcgctttgcttccaaattctgatttctcatttttggaagcgagatgatggtttgttcgttacgtataattaggggcatgtttggattaatgttactaaagtttagcgctaaatttttagctaaactttagtacttatcggatgtttgaatgcactagtgctaatatttagtgactaaaattagttggagacatccaaacatcatagcagttcaactattagctatttttagtaaattagttaatagttagctatctatttgttagctagctaatttcactagtaatttttagccaactaactattagctttagtgcattcaaacaccaccttaaacatccaacagaaatgttaaaggataataaaaatgaggtgctaaactttatcatcaaatatatatttagcttctcaagatatactaaattttaacatcttactaaagtttagcacatgagatccaaacatacccttaataggatatttggtttaagaaatgaggtagtgcatcaccttcactctttacttttttgtttggcttgtgaaataaaataacttgattcatcgccatttcatttctcataagctaatatttaataataatacgagaaatgagttcattccatcaaatttatgaaatagatttataacacatcaccttatctagaatggattgattcttccaaccaaacaccatctaaactagtttgcaggggacaatactcctaaaaagacaaatgctaactattgtggtctttctctctaaatttgttcacatctcgctgctcccaagttggcagcagttatcatgtgcgttattaattaggtgacacatatcatcttttagtgatgtttagacagaggacaacatggcaaaaagatacaaataagaaaaaatagaatataaataggagagagaataaaacatactctatcttttgtaagatagtatagttttgacacaataccttctgcattattgatagtctggatccaatgcactggacctacatctaccaccaaaagg

SEQ ID NO: 11021 - DNA, 1428 bp, Zea mays
gtgacgtcacctcttctaagccccctgtggtgccaattcagatgggctccaggatgaggccaggcccatgggggcacgattcggccttttcttgtcttgctcgtcaaaagaataaaatcccaacccataggaaagcgtagcataggaggccaggaggggagaaaggcgaactcgaattgggggaagagagcgagagacgaatcgcatcgagccggagaggatcgtcagagacagggaggagggcggcggaatcggcgccggcgggaggcaggcatggaggacttgagcgtggaggagctcgcctccaacctctccacctacaaagagcagctacgcgaggtcaagaagcttatcaaggagaagaaggatgatgctggaatttctgaatatattgatatggagaaagagcttcaagaggtcataacgttaaccgaagagattttggcaactgcaaagcaaactgagagtgcccagaatgttgcaggtctatcaccgccaagctattcagctggagtgcagtctgagggactggatgacctttcacattcccataagtttgccgttggtactagagttcaagctgtgtggagtgaagatggagaatggtataatgcaaccgttgaagctttgacaccaaatggatactatgtagcctacgatggctggggaaacagtgaagaggtggacccagataatgtgaggctgcttgaggaagaagcagctgatgccttgggacaagctgaaaaggaagctgaagctacaaaaatggcaataaagaggaaaattgaacaagcagcaacatctgattttcaggcgcgtagcttgccggccaaacttcgtatcgaaccaagtgaccctgaggatgttaaagctgcaaagcgtaagaaaatacatgctttcaaatcaaaatcccgctttgagcagcttgaatttgcccaaaacaaaaggcagaatgcatggcagcagtttcaaaccaaagggaaagccaaaaaggtggggttcttctccggtcgcaagaaggagagcatcttcaagtcaccggacgaccacagaggtaaggtgggtgtcactgggagtggcaaaggcctgaccgacttccagaggagggagaagcatctgcaccttaaaggtgggtccggggatgcagcggatgatgacgaggagtaaactgaagaaccgagcttctgtttgtatctcgccgaacagacatttccatacctgttctttagcgccgacatggcctcgaggggactcttgacttaaaccagaaaatttcaatgtttgtcccattctcattgttgaatgtcgctgccgttttgaagctgcattctggtggcgaggtcacgctgctagaggagggcgtcctgagcgtacagatcgacttgtcttgctagtctgtagcgaagtattaatccttaaacgtttact

SEQ ID NO: 11022 - DNA, 1423 bp, Zea mays
aataggaggccaggaggggagaaaggcgaactcgaattgggggaagagagcgagagacgaatcgcatcgagccggagaggatcgtcagagacagggaggagggcggcggaatcggcgccggcgggaggcaggcatggaggacttgagcgtggaggagctcgcctccaacctctccacctacaaagagcagctacgcgaggtcaagaagcttatcaaggagaagaaggatgatgctggaatttctgaatatattgatatggagaaagagcttcaagaagagccatgcccagcaaggtagcatgaaaaggccgcttgcaacagaagatttgttttggggaatttagatttttgtaaccttgaaaggtgagaaggttaattatggcaatggtttgtactactacagattttggtgttggtgctgctgttctaagttggatcttgaaatatgggcacatgtttaatactactgggaggttgcttgtgtttatgatgcttaatatcattttttgtgtttgctgcaggtcataacgttaaccgaagagattttggcaactgcaaagcaaactgagagtgcccagaatgttgcaggtctatcaccgccaagctattcagctggagtgcagtctgagggactggatgacctttcacattcccataagtttgccgttggtactagagttcaagctgtgtggagtgaagatggagaatgctgaattgccaggtataatgcaaccgttgaagctttgacaccaaatggatactatgtagcctacgatggctggggaaacagtgaagaggtggacccagataatgtgaggctgcttgaggaagaagcagctgatgccttgggacaagctgaaaaggaagctgaagctacaaaaatggcaataaagaggaaaattgaacaagcagcaacatctgattttcaggcgcgtagcttgccggccaaacttcgtatcgaaccaagtgaccctgaggatgttaaagctgcaaagcgtaagaaaatacatgctttcaaatcaaaatcccgctttgagcagcttgaatttgcccaaaacaaaaggcagaatgcatggcagcagtttcaaaccaaggggaaagccaaaaaggtggggttcttctccggtcgcaagaaggagagcatcttcaagtcaccggacgaccacagaggtaaggtgggtgtcactgggagtggcaagggcctgaccgacttccagaggagggagaagcatctgcaccttaaaggtgggtccggggatgcagcggatgatgacgaggagtaaactgaagaaccgagcctctgtttgtatcccgccgaacagacatttccatacctgttctttagcgccgacatggcctcgaggggactcttgacttaaaccagaaaatttcaatgtttgtcccattctcaaaaagagagagg

SEQ ID NO: 11023 - DNA, 2306 bp, Zea mays
acctcgagccggccgggggccgcgcggggaggaggaaaaaacgactggctgtccgaacggggacgtctggttcctctcattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcgggggcgatctgatgcgggcgcggcggtgatggcagcgccatccggcggtgggggcggcggtgcgggggagggctcctcctcggccgccgcagctgcgacgatcggggtccacggggtggaccaagttgcagaggcgatgtggcagatgaatttggaagaagccatggaactggggccatacccagagcgtgttggtgagccagactgtagctattacatgaggactggcatgtgcaggtttgggatgacctgtaaatttaatcacccagcagacagaaagctggctgttgctgctgcaagaatgaagggagaatatcctcaaagaattgggcagcctgaatgtcaatactatctgaagactggcacgtgcaagtttggagcaacttgcaagtttcatcatccccgagaaaaggctgcaatggcaactcgagttcagttgaatgaactgggctacccactccgcccgaatgaaaaagagtgtgcttattatttaagaacagggcagtgcaagtttggaagcacatgtaagtttcaccattcacaaccatccaccatgatggttgctgtacgtggctctgtttattcacctggacagtctgcaacttctcctggccagcatgcttaccagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctgttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaagccatcctcggtgtcttcgttcatgctgcctcccctcccctcccctcccattcttgacgagtaattaaatgcaacaacatctgagaatccgaagctgtacaggtcttttgcctcatctttgagctttacataccggagcttgcttcaacatgtattgcatccaggcatgaaaaagttcttgccggttcgggatgctcatttgcccccataaaaacgggaacaaacctaccttatttaaacatatgtatgaaactcactcacctctggacattcaaacccattcgagtaatggtcccggtgttgtagtttatagagctgtgtttcagtggacaaacctttgcgaaactgactggggatgcgcaagcatagcctcctttattaattattatctcgtttttttcctagcatctctcttttcataagggcaacccaaagtgttggaataatagattgccaccataatgctctgtattacccaccatatttaaacctggttacttgtgagtaattttctctttgtagttctgacttactcgatcaatctgccaggagattttgattattatctgtcggatatcgtaattagaggtacctggattgtgtccctaaaaacatgcttaaccccaagactatcgtcagacacattcctcaaggtcaagagagcataaaccgcgctttgcccgaggcctttcttgatggtcaacataactccgctttgc

SEQ ID NO: 11024 - DNA, 3167 bp, Zea mays
  misc_feature (137)..(137): n is a, c, g, or t
  misc_feature (143)..(143): n is a, c, g, or t
  misc_feature (3023)..(3023): n is a, c, g, or t
cgactgtggtcatcctgcctaagccctcttctaagattaatgactgctcccggtattccattcaacaaagttgccaatagaccactaagaatatctctccaaatctgtccaaaacccagtttttgaagtacttccancatagnaggccaagaaaccgagtcgaaggctttggtaatgtcaagttttaggaggatccgaggtcttttattttgctgcagcagcctggcagtttgctgtaataacatgaagttgtcctggatgaacgtccttttgataaaagcactttgcttcactgaaaccatgccctgcagtttacgagccatcctgcttgcaagcaatttggtgatcagtttggcaatgctatgaaccaagctaataggacgaaaagctttaacctactccgctccctattgcttaggaatgagtgtgacatagcctgtgttcagccaccccaaattagagaatttccggctcgctgagattgcagccattacatcatccttgataatggcccagcaagacttataaaacctgcccgtgaaaccatcaggccccggcgccttgtcagacggtagctgcttgatggtctcccaaacttcattatctgtgaaaggtaaatccaaatcagccaggtcataagtaggcaatcccaaggcatccaaatcaaatggttaaagacctgtccgagctgctgcccaacagatcactatagaactcatcaactagactcgccttgtcctcatggtcagtgaagatggcacttcccgatatcagtttggcaacaaagttctttcgcttccggtacctagcatgcatatggaataactttgtgttggcatccccctcctttatccagtgaattctggatctcaagcgagctatagcgcacagaggcaagagcaagggtatgctttttcagcccacactttagccaattttctgctggtgataggtttctcatgtcttgagcgatttcaagttgatgcaagatctcccttgctaagggcaagctgggaagtcacatgcccaacttttctatcgctccacccctgaagtgcctttgcaacagcttttagtttaagatccaggtttagaaaggggcagttcaccctgctagccgacccccatgattcctggaccacctcctggaagccatctaattttggccagaaggactcgaaatggaaccgtcgttttcctgtacagtatcctttaagaccaagaatgagagggcaatgatcagaatcctctaaagcggtgttctggagaaggtttccagggatctagggtttagggtttaacctcctccactccctctttcttaggaatgaggtaattaaaggagaatcctaatcctaaccctaaacaggagtctagcactgaccacatggtgcagcattagggggtattagtttctcgtactatagcgatttctttaccaagacttgctctggtgtattctcttgggttcatctgtgagagctactcgttaagtaacatatcatgattaacttgtaggctgttaattatcgctctttcttttattggaacatgcttctttgttgtactgctcataatttctacccgaacttgtgaataatgattttagtggtctgactgttaggctgttgctgctgcaagaatgaagggagaatatcctcaaagaattgggcagcctgaatgtcaagtgagattcctctcttctcgtttttctcatctgtttctttcgacaatgcaaaatatgattgttgatttatatccacttgtgcctcaatgctcatgaggtcctgccatgagttgctacttgtctacttgagatgtctagtttaggactttagatcactattcttgttttaaagacgtttaactgtcattgccttcttgtgcttcaagtgcggtgcccctgcatattggtaggtctttgctgaagtttttagtcaaatgaatatatataacactaataatacagtatatggtcctagagtatgtgttgttatagttgagcttgatatatgttattattaattaatttcatgctgtttcttggggtggcataaatggtgtttgttgtgcttttcaatgcatttatctttcctttttggtccatgcaggagtacagttagaatcttttaaatgaggtcacataacattctcttgattgaaattccgactcatattgttagctgtacatggttctacagtgagtttgcattttaatccaagtgttagttgatttaggttaataaaattcaactgtgcatgcctatgttacaactatattttgcttgtctgaatgacctgaacttttgtaattaagttgctcatacattttgtccttttctatgtgagcatataatttcttttggaaagtgtttggttacattattggtgaatttgcatttttattgttttcataccccccttttagtactatctgaagactggcacgtgcaagtttggagcaacttgcaagtttcatcatccccgagaaaaggctgcaatggcaactcgagttcagttgaatgaactgggctacccactccgcccggtttgttctgaatttctattacaattcacaatgtttcatgatatgaatgcatactattgtgccgcctttctatgcaacgtttttgcaagatttgtgttgtttacttgaattttattactgcagaatgaaaaagagtgtgcttattatttaagaacagggcagtgcaagtttggaagcacatgtaagtttcaccattcacaaccatccaccatgatggttgctgtacgtggctctgtttattcacctggacagtctgcaacttctcctggccagcatgcttaccaaggggctgtaacaagctggcccttgtcgagatctgcttctttcattgcaagtccaaggtggccaggtcattcaagttatgcacaagtgattgttcctcccgggcttgttcaggtcccagggtggagtccttatactgtatgttctctgatctctgttttactttttacgtagcctaacaagttcatatttnatcaccttattacatggcacttacgatctggttatcaagaatgttgtgaaagatcacaactttgtttgtagtaaaacaaaaaaatttcgattacatgttacttatactgagccgatcttaacaaggcataagtctgaccggtgc

SEQ ID NO: 11025 - DNA, 1171 bp, Zea mays
gatctcacctagccgccgcacgagcacggcgtcatcgacaaccatcgacgattgctccatccccgccagccgccgaccagctgctacatcctgcaacacgaggacaagtgctgcatcctacagtccgttcgagatgccagaaattgattggaaccttgagaatacacagattgtttgtaagttgtttgtcgaacaagttggcaaagggaatcgaccaaacacttacctcaattcagttgggtacgctgaggtggagaaaggattcaaagataggacaggtattgatgttacaaagtcacaactcaagaataaatgggacaaattgaaagaagatttcaaggcatggaggaaacttaagttgcggcaaacaggaacggttggaaccgtgaaaagggcactattgatatggatgatgattggtggaaaagagctagagcggatataccaggatgtggaaagttcaggaagcttggccttcaaaatgaagatgagatggctaggtgctttggagacatcacaaatattggttgtgatcactggtctcctcgtgttgcaaatgattctattgcaactaatgttgagcaaccggacgttgtaccaatgtttgaaacacaggatgaggaattcattcctgcaactcaagataatgaagacaatgctagcactccatctccaggtagtgggaaaaggttggctaggccagttcaaggaaaaggaaagaaagctaagacaggaaatgcactcctcatccaagaagcagtctcaagcatggctagctcggccaatgaatttgttgccaagaaagatggaaaatattctattgatcaagtgatggaaattgttattgcttgtggtgctggctatgagacaaatgagcattacattgcttctgagttgtttgtgaagaaagagcagagggagatgtttatgacattacctactaatgagataaggttcaattggttgaggaggaaatataatgacaagcatgcaaaatagaagtggtcctcaatgactattatcacttgtatcccgtgtttttttattttccagttggtactgccaatgtaattttttgcttaaacttgagtttcggcatgtggaaccaatgtaattttgtcgttaatgcaaaactgaattggaaccaaaaaaaaaaaaaaaaaaagcgccc

SEQ ID NO: 11026 - DNA, 750 bp, Zea mays
  misc_feature (707)..(707): n is a, c, g, or t
  misc_feature (742)..(742): n is a, c, g, or t
cggatcttctctcaaacgagtccacatccacatcggcgtgctcccgagccctgaaccctgtccctgacccgttcacccgtcgaaggcgagcagcagacagccagaggagacgtcgcgcctgtgcctaccatggacgagaaggagttctggcgcatgctcgacctcttccccgtcgtccgctcccgtggctattgcgctgatcctggaacatctatcagaggaaccagacagcgctcacgagttcaggaggcagcgaagggcaatgacaaggactcatccgacgcacaagatttgtttatgcagaagttgaagatggctgcagagaaaaagattggaacaacaaaagcagagttcttctgcaaggcatttgaagaaactcatgagaagcttgtttacaaagagctgaatttggatgctgctaagaagtttctgagcgcatatgagagctgatgatgaacagtaggtagatgctgctcaaggatcggcaggtgccaatgatcctagaaagttgttgatgctgtcgagattttgatcattgacaaacttgtgttgtgtgcagacagtagacatccctttttggtcagctacacttcttttttcagagaagcttttgaagttgtccaattgtacgctgatatacgtttttctaaaaaaaaaaaaaaaaaagtttccgctccaaaaaaaaaaaaaaaaaaaaaaaaaaaaanaaaaaaaaaaaaaaaaaaaaaaaaaaaaaaaaaanggggcccc

SEQ ID NO: 11027 - DNA, 3156 bp, Zea mays
  misc_feature (2997)..(2997): n is a, c, g, or t
aattcggcacgaggtttcttcccatctccatcttcctcgcagcttcgacgctccatcttccgctccctcccttacccgcggtcggcacgcaggcgacgccggcggcgccggcggcgctcaggctcgggctctcatctactgcgtcagcagcttcccctcccgcatctcgccagtcggcgcgcgctctcacctccggtcttccgcacactggccggtgaccctgccttataatattctgccacatcactctgggtgaagcaagattgggtagctttctggtgcctacttcattcttgagtttgtcaatataagccactgaagccaaggatgcatgaaaattaacccaatgaaatagttccccccgcggctggccgggcatttacctatcaaacttgataatgctggatgctattctcaggcagacctatatggtgatcttgccatttattgtcgtgtttctatgttatggaaattttaagagcgctgatgttacctgtagtgctctttaaatttggaacatggaacatggagcatgtgctgattagtagaaggtttccaactgatcctgctctctaaatttggaacatggagcatgtgctgagtagtagaaggtttccaactgatcccaatgagtataagttatatgaggaaattggagatggtgttagtgccacagtataccgagctctttgtgtcccacttgacatcttggttgccatcagagtgcttgaccttgagaaatgtaacaatgacctggatgggataagacgggaagtgcaaactatgagtttgattgatcacccaaatcttcttcgtgcatattgctcatttacaaatgggcaccagctttgggttgtcatgccttacatggctgctggatctgctctccacattatgaaaacttcttttccagaagggtttgatgagccagtcattgctactcttttgcgtgaagttttgcaagctcttgtctacctacattctcaaggacatattcacagagatgtcaaggctggaaacatcttaatagatacaaatggggctgttaagctaggagactttggtgtgtcagcctgtatgttcgatactggaaataggcaaagagcaagaaatacatttgtagggacgccttgctggatggctcctgaagtcatgcaacaactgcatggttatgattacaaagctgacatttggtcctttggaataacggcattagaactagcacatggtcatgctccattttcgaagtaccctccaatgaaggtgttgcttatgaccttgcaaaatgcaccaccaggtttagattatgagagggacaagcggttttcaaagtctttcaaggatttggttgctacatgcttagtcaaggatccacgcaagcgtccttcgtctgaaaagctgctgaagcattctttctttaagcatgctcgctcagctgaatatctagcacggagtattcttgatggcctccctccattgggtgaacgctttagggaactgaagagcaaagaggctgagttgcttctcaataacaaacttggtcaggagagcaaggagccgcggtcgcggccggggtacataaggggcatcagtggctggaacttcaatctagaggacttgaaaaatgcagctgcccttatagacagttcaaatggcacttgttatttagatgtcagggagaacagagttaaggatgactcacaagaagcttacaatggcccagaacatatttaccaggaaaggctcaaccatgttgcttctagaaggcctgaagaggatgagatacaagaagttgaagccttgaatgatgctgtctcctcttcgttttcaagccgctcccttgaggcactaaaatcttgctttgatgtttgtggtgttgatgatccgagcccaactgctactgattcaagagcgcaaccaagtgtcggaactttacctttccagcagttgcaaaaattggagcattgtaaaagtggcgactgcaatggtgaaagcttggaaagaagcgtttctgtacctacgaatctggtcactagtggataccacaagcattcaagtggttctcttatacctgagcaagttctttctccctacttgagcagtgatttggaaagggatggatttcgtcagaaaaacttaagcagcaggaactgtagtggccctttattgttccgccaaatgaaggattcacgcacacatcaatctgttgcgccagacgagtcgtcggaaggaaaaattatccatcgaagggggcgcttccaggttacatcagatagtatttctgaaaaggtagctacatcatcctgcaacagcagcaggataaatctaccaattgatgcagcacgttcaagtcccaagttgtctgcaattcttccaactttgcaattcttgatgaagcagaatactatgcaaaaggaagtactcagtaggctgatttcttcaattgaggaaacatctgatgattctgaagcaaccggaagcagttcatatcagtcttctggagggcctgcccgagaaaaggaattgcatttgtatgttctccaattgcagcgaagtgtcaccgaacttgctgaggaagtgcaaagattaaagctccaaaacaataagcttgagcatcagatcaatatattgtcaagaaaagatgaaaggtcgtcaacgcaagataactgacaatgatgatatgccccttctaccacactgtaattcgattacccaattttgctttgttagaaagttatttgtattctgcctgcagtcagagttgtatcattgtaagctgtaagtatttagcgaagtgtgaaatcatagtaattttgatctgtacagctttgtttggttaaccatgaagatataattgtgttataagtaatgtgctgataatattgttttgcgtggaagcctgtgaaagtttatctgagcaaaaaaaaaaaaaaaaaaaaaaaaaaaaaaaaaaaaaaaaaaaaaaaaaaaaaaaaaaaaaaaaaaaaaaaggggggngcggttttaaaggatccaagtttaggtccccgtgcttgcaaagtaatagtttttttttggggccccctaaattaaattcccgggccgtggtttaacaacgtcgggactggaaaaacccgggggttccccaattaaatcgctttgaagaaaatccctttt

SEQ ID NO: 11028 - DNA, 2103 bp, Zea mays
ttttttttttttttttaagtaacataataataacgatgaggtaaaaaaaggccgcaaattattgtttcacctttcgttcatctcagaagagatgctatatattattattacaatgcctgattaaataaagagctaataaaaacagcaaaaacaaattttgcactgacagaactgaccatggcattgcttacacgttaggagttaatcaaaacttttctaatcgcgacggccaagcccaaaatcaagaggcacctaaacagtgacatggatgcagcggccttcatcagaggtctaacaacggtagtagcagagaaggtgagaccacgtacctcaatgaaatggttcatcagcacgtcagcctgccactggtattggtagctctgctccttggaagacgaagaactgttgctgctgcctcctctggtggccttcttcagcagcagctcagaccttggttcgaagttcgtctgtcgccgcggcgtgacgccgtcgagctttgcgtggatctcggctagtatctgggaatgtgcgtctgccatggacaaggtggattctcttagctttgtgaggtcggtgtggagagacagcacggtggccttgatctgctcgatgtcggcttccagtgcggcgttgctcttgcacgatttctcgtcttcctcggcgatgatctctggcgaggcccggcctgcggagcgcacgccacactgcgcggagcagcacgtcgcgcgccgggggaggccgtgggagtgtgaggccgaccggtacagcctgggcgttggcgccgtctgattgggtctcgtcgcccactccttctccctgctgatcacctcgccgatgtccgagaccgtccttgctggcctccggtcgcccaccctcttcttgtcggcgtccgtgtcgacgacgacgtcgagctccgagcagagctcctccaggtgtgccgccgggagggacgcgttcctcctggacgccacgccgctcttggccagcttcctcagccaggggagatcgactgccggcgaaaggggatcgtccccggtggcgtggacggcgagcagcctgcggttgagcgagctgatctccatctcctggtggaagacgacggccctaaggaaagccagcgtgtcctcatcatactggatccgctccttggccacccggtggaactgctccgcctccatacgctccgccgccttctccgcctgcagacgcaggatcatagccagtgcctcatcggctcctgacgccgccgcctgccgctcctcctccagctccgcccgcagctcctccacggcctgcacctgctgcctcagggcctcccgcagggccgccacctcgccttcttcctcaaccccggccatcgattcgcatccacggccacgggaccttcagagcgtctagtctctagtaactgatttcaatcaagcgattaagagaggaaaaaggatttgcacggacacagaaatgtcaaattcaatacaacagtggctgcacacctctgggaagaaccgaatcttcagagaaaccaaaaataaataaatgatttaggctcaaaggattatgacaaatcttgctttttggctgggttgtgtaacgtggagttggtgagtccacaaagtacggattaccgtgtgtttacccaaatccgaaagaagaaaaaaacgcgaccaggcagacaaggcaccaacctttgagagagatagtgttgctgaagcggaacggacgccggaagctccgattttccgacgaggatgttgagtgatcttcaagcgtcaataattggcaactttaggagcaaggaaagctatacttgttgtataaacaaatcattttgttaactgacattgcgaaagcgacaagaagaaagctcaaagagaggcttttaatccattgcctccatacataaggtacccattcaattttgtttaaataatttccctgatttgttaaatcacattagccagcacaattatgtcccagttcctccagaatctgtcagcctggccctaaataaattatgaagaatttaaattaaaataaaaactgaatcttagtcaactcggtagcaactgtgggcctcacatatatttatctgtttcaatggat

SEQ ID NO: 11029 - DNA, 2185 bp, Zea mays
ggtaccctttgggccggccggccacttgcccgggtcccccgccccccgccgccgtttcgtccgtgcgccgccgccagcatctcgcccgggcccagacagagcaaaccccccctctaaaattcggttatatttgggctcccgcctccgccgtcgcccctacagtcctacaccaggtgccgaggccttcgccggtcaagagcgcccagcagatccgccactgggtttttggatttggagacatggcggaagtggatgacaagctcaaggactacgagatcaggaaggagggagaggcagagatcctcttgcacaagaggaacgccgtcttttacaatcccgtgcaggttcacaacagagacatgtctattgctgttttaaggacctttattgccaagcgcaaggaagaacatgaagcgctggtggacaagaggaacacatcgcatggaaaagacaaactgagtgaaatatcctgtcaaaatggagaggatgcgtcaactggccagcaagatgaaatggaactaaataaagctgaagttcaaattgatgatctgtcaaaagaagcaacaaaacctccttggaaagtaaccagagaacttaagccaccacttgtcctcgaggctttggctgcaactgggttgcgatctctccggtatgcccgtgaagttgagggcttaggaaagatagttgctctggacaatgataaagcttccgtcgaagattgcaagcgaaacataaagtttaatggtgcttccactactagtaaggtggaaacttacttggttgatgctcgaattcacatgctgatgcatccaaaagaatttgatgtggttgatcttgacccttatggatcaccatctatatttctagactcagctgtacaggctgttgctgatggcggtttattgatgtgcactgccactgatatggcagttctttgtggtgccaatggagaagtttgttactctaagtatggttcattcccaaccaagggcaagtattgtcatgaaatggctttgagaattctcctagccagtattgagagccatgcgaatcggtacaagcgatatattgtgcctgttctctctgtgttcatggatttttatatccgtgtttttgttcgagtattcacttctgcaagtgaaataaagaatacacctctaaaactttcttacatatatcagtgtgttggctgcgactcttttcatcttcaatgtcttgcgaggactgttccgaagaagaataatggtgtgaagcatgcacctgctattggacctgttgttcctcaagagtgcagtgattgtggaaagaaatttaatgtaggtgggccaatatggtcagctcctattcatgatcaagactgggtagtttctactttgacgggtgttaagtcaatgaaggatagatatcctgcgtatgataaaattacttcagttctaactactgtgtcagaggagctacatgacattccactgtttttcagtctccataacatagcaggcactgtcaagtgcacgtctccgtctctggttatgttccggtccgcagttctaaatgcagggtatcggatctcaagcacccatgtcaacccacttggggttaaatctgacgccccttgggatgttatttgggacatcatgcgctgctgggtgaagaaccatcctatcaaggaacaggcacgtgactcacctggcacggtgatcctttcaaaatcgccaaagctagaagcagacttttccagagcagttgctgccctcggcaaatctggggcaaagaagacgaaacgattccttccaaacccagagcggcactggggcccgaaggtcagagcaggccggaagatcacgagcaaacacgtctctctgttgggccctgaggccatcaacgctgccgtgaacggcggcggcggcggtgactgccacagagaagggagcggtgccgcgccagatagtagcaatacagccccagaacccgaggggctggaggacgaaccctcgaacaaacgccagaaagccagcggcgacggggaaccagaaggacagaaggccagcgacggggaaccggcaagcgaagcttgatctgtttggcagtcgttgttgtgcctgtcagcctgtgcttttgctccttttgtggcccgatgggtattacctgttgaattttgatgcaacgaattttgcttggttttgac

SEQ ID NO: 11030 - DNA, 2380 bp, Zea mays
agaaaggccacattgccggcacgggagagaggtccgcggggcgtctgccacaacccacaaggaggccagggaccaatcacagtcatcttctcccgttcacgtaacgtgcactagggtttatggtttagggcgaccgccgccgtcctacgtccagcggccaggttttcttctggccctctgcgctgactacaacccaccacctccgggttaggttttggatttggagacatggcggaagtggtggacaagctcaaggactacgatatcaagaaggagggagaagcagagatcctcctgcacaagaagaactccgtcttctttaatcccgtgcaggttcacaacagagacatgtccattgctgttttaaggacctttgttgccaagcgtaaggaagaacatgaagcgctggtggacaagaggaatacatcacataaaaaaaataaacaaagtgaaacatccagtcaaaatggagaggatgcgtcaactggccagcaagatgaaatggatgttgtttgtgaaaaggagctgaataaagctgaagatcaaattgatgatctgtcgaaagaagcaacagaaccttcttggaaagtaaccagagagcttaagccaccacttgttcttgaggctttggctgctactgggttgcggtctctccggtatgcccgtgaagttgagggcttaggaaaggtagttgctctggacaatgataaagcttctattgaagattgcaaacgaaacataaagttcaatggtgcttccgctactagtaaggtggaagcttacttggttgatgctcgaattcacatgctgacgcatccaaaagaatttgatgtggttgatcttgacccttatggatcaccatctatatttctcgactcagctgtacaggctgttgctgatggtggtctattgatgtgcactgccactgatttggcagttctttgtggtaccaatggagaagtttgttacgcgaagtatggttcattcccaaccaagggcaagtattgccatgaaatggctttgagaattctccttgccagtattgagagccatgctaatcggtacaagcgatatattgtgcctgttctctctgttttcatggatttttatatccgtgtttttgttcgagtattcacttctgcaagtgaaataaagaatacacctcttaaactttcttacatatatcagtgtgttggctgtgattctttccatcttcaatgtcttgcaaggactgttcagaagaagaataatggtgtgaagcatgcacctgctattggacctgttgttcctcaggagtgcagtgactgtggaaagaaatttaatgtaggtggaccaatatggtcagctcctattcatgaccaagactgggtactttctactttgacaggtgttaagtcaatgaaggatagataccctgcatatgataaaataacttcagttctaaatactatgtcagaggagttacatgacgttccattgtttttcagtctccataacatagcaggcactgttaagtgcacatctccatctttggttatgtttcggtctgcagttctaaatgcagggtatcggatctcaagcacccatgttaacccacttgggattaaatctgatgccccttgggatgttatttgggacatcatgcggtgctgggtgaagaatcatcctattaaggaacagccacgtgactcacctggcacggtgatcctttcaaaatcgccaaagctagaagcaaatttttcaagagcagttgctgccctcagcaaggctcagacaaataagattaaacgattccttccaaaccccgaacggcactggggtccgaaggtcagagcaggccggaagatcacgagcaaacatgtctctctgttgggccctgacgctatcaagggtgctgtgaacggtggtgactgccagaaagaaggaaacggtgctgagccagatagtacagcctcagaacccgaggggatcaaagacgttgaggatgagccctcaaacaaacgccaaaaaaccagcgacggcgaaccagcaagcgaaccttgatttgtttgtcaatctttcgcgtctccattgtgttgtgcctgtgcttttcttgtttgtaggtggtcgatggttatttataccacctgttggattttgatcgaacaaattgtggcaggtttttattaaacttttgttgcatgtgtgatgctcctcctagtcacagagggaaaagacctattaaagcataatatatagtatagctttctgcaaaaaaaaaaaaaaaaaaaaaaccccagcccggtcgatgcttgtattcacaccggacgcatacagaaatctcgactccaggtacaatccttcaatagaacctacgacttctgaggtcagccatctgcag

SEQ ID NO: 11031 - DNA, 1121 bp, Zea mays
cctcgaggccggccgggctgagatgcctgttagtgaagttagaagtttggaaagggatcaagtagagagcgatctaacatttgctggttttgcggtcttcaattgtcctataaggagcgactctggtgctgtcctacaagaactgggacaatcttcccatgacttggtcatgatcaccggagaccaagctttgactgcctgccatgttgctagccaagtacatatatcttccaaacctgttttgattttgacacggataaagactggtggttttgagtgggtttcgccagatgaaactgatagagctccatacagtgctgtggaggttgcagtgttatcagaatctcacgacctttgtattaatggggactgttttgaaatgctacaaagtactgaggctgttctccaggttatcccttatgtgaaggttttttcacgtgttgctccagaacaaaaagaacttgtactaactacattcaaaagtgttgggagggtgacactgatgtgtggagatggaaccaatgatgttggtgcactgaagcaggcacatgtcggcgttgctcttttgaatgctgaaccagttcagaaagtggattcaaaatctaaagctgaaaataaatctgggaaattgaaaaacaagaagcctgctaatgaagcatcatcacaagtgactccggtagctaatagttctggtaaagcatccagcagcctttccttgactgctgctgagaggcagcgagaaaagctgcagaagatgttggatgaaatgaatgatgaaagtgatggtcgttcagcaccaattgttaagcttggtgatgcttctatggcttcacctttcacagcaaagcatgcatctgttacccctactcttgatatcatccgtcagggaagaagcaccctagtcactacacttcaaatgttcaagattcttgggctcaattgccttgcgacagcttacgttctcagtgtcatgtacttggatggtgtcaaactgggcgatgttcaggctacaattagtggtgtcttcactgcagccttcttcctcttcatctccaatgctcggccactccaaacgctgtctgcagagcggcctcagcctaacatattctgtgcatacgttc

SEQ ID NO: 11032 - DNA, 773 bp, Zea mays
ggaacgggaatatccccggccgcgccgaggccggggtcggcatccctacgcacccgctgaaatcccttcaccaagtcgaggaccccctccgaatccgagggttcaagcgaccgacggcgaacatggcggcggacggcggcccagcgacgtcggcgctggaagaggccctcaagcccttccaggaaagagcctccgaggctgagatacgcatagcgaagctggaagccttgctgtacaacaaagatggtccgagcggtggatccgaggcaacttcctctgccgtgaaggatctccagtcgaagctagatgtggttactgcagaatgcttgactgaaaaggagaagaacaagaagctgaccatggagaacgagaagctccagtaccgcatgacccatctgattcgtgcgataaaagaggcggaatcgagataggagcagcccggcgaggccgattcaaagcctgatgtcgaagtgttccccacccgccttgctgatcctacacgctgttcctgcatctacctcaagttatcattgtgatcttgagatagagcttggtcacaagtcaagactgtattatcaaactgtcgattgaaaatgatgatgtgtgcacagctttctgtcttcacctgaccccatctcgaagggcacattggaacacaaaatgttatctgaaatgacagttcatattttgaaaaaaaaaaaaaaaaaacccgcggccggcccctagggccaaaaaaaaaaagaaaaaaaaaaaaaaaaaaggcccctagggcc

SEQ ID NO: 11033 - DNA, 1038 bp, Zea mays
  misc_feature (386)..(386): n is a, c, g, or t
ctcaccacatttcccaagcgtgcaggggacaccgcccgtcatccgcgcgccgaggatcttctacccagccatcaacgccctcctccatcaacggaaggtggccgaggatccgccccaccctcctccccacgccgtcgtcgatggaagatccgaggatccgccatcaacgccgcgcccaccctcctccccctctgctccgcgacgacaggggtctgaggccgccatcaacgccctcctccccacgccgtcgatggcgcgcgcagatccagtctccttcaggcaacaccgcgccatcagcggaatctccttccgccatcagcagaaggtgctgaggatcttgggcaagcaggagagggggagaggaggccaaggacacaaccgcgaancaaactcatccaatccagtcccttctgtcggccgcacctcgacggcttcaccgtgcccccgccacatcgcgaccatggcgaaggagcaggctggctagccctcggtccgcctcagcccgccgccaggagagataagatacgcatagcgaagctggaagccttgctgtacaacaaagatggtccgagcggtggatccgaggcaacttcctctgccgtgaaggatctccagtcgaagctagatgtggttactgcagaatgcttgactgaaaaggagaagaacaagaagctgaccatggagaacgagaagctccagtaccgcatgacccatctgattcgtgcgataaaagaggcggaatcgagataggagcagcccggcgaggccgattcaaagcctgatgtcgaagtgttccccacccgccttgctgatccttcacgttgttcctgcatctacctcaagctatcattgtgatcttgagttagagcttggtcacaagtcaagactgtattatcaaactgtcgattgaaaatgatgatgtgtgcacagctttctgtcttcacctgaccccatctcgaagggcacattggaacacaaaatgttatctgaaatgacagttcatattttgaaacatttcgcctcaaaaaaaaaaaaaaa

SEQ ID NO: 11034 - DNA, 786 bp, Zea mays
gcacgagaccattacctagaacatcctaatcgaaaaggggtattttagctattgtcaagagcattttggggaatgggaatatatagggatccaaataagcaaatttgccctccctacgcacccactgaaatcccttcaccaagtcgaggaccccctccgaatccgagggttcaagcgaccgacggcgaacatggcggcggacggcggcccagcgacgtcggcgctggaagaggccctcaagcccttccaggaaagagcctccgaggctgagatacgcatagcgaagctggaagccttgctgtacaacaaagatggtccgagcggtggatccgaggcaacttcctctgccgtgaaggatctccagtcgaagctagatgtggttactgcagaatgcttgactgaaaaggagaagaacaagaagctgaccatggagaacgagaagctccagtaccgcatgacccatctgattcgtgcgataaaagaggcggaatcgagataggagcagcccggcgaggccgattcaaagcctgatgtcgaagtgttccccacccgccttgctgatccttcacgttgttcctgcatctacctcaagctatcattgtgatcttgagatagagcttggtcacaagtcaagactgtattatcaaactgtcgattgaagtgatgatgtgtgcacagctttctgtcttcatctgaccccatctcgaagggcacattggaacacaaaatgttatctgaaatgacagttcatattttgaaacatttcgcctcaaaaaaaaaaaaaaa

SEQ ID NO: 11035 - DNA, 1339 bp, Zea mays
cattgggaccctcgaggccggccggggcctcagcctgtctttcttgtgtgcactgcacccaccctgcctcagcttgggcttggctgcctcttcgtttccccagggccgcgcaggcgcagcagcccaggaagcaacacccagccgcctaatcccgcaacaactcgccctcttctacccccatcggctcctctgcatccgcataccggtggcctacaggtttgctggagtgcagtgcacgggcggtggagcagcaaatctgcaactgattcaggatggatcaggaggcgaaggactctaggccctcaaggtctcccagcgagccaaacctcttcctgcaatggggtagccgtaagaggctgcgatgtgtcaagacgcgtgatgacggctcaccatcgccgtcgccgtctcaaggtcttaggcgtgccataccccgttctactcggcccctccttggagcagacattgcagcatttcgttcaccgcggcgccctagcacccttaaccgcaggaaatccgatttgctggtgaatgagtacaagcacacgatggcgctatcgccagagaaggacaagtattacacaacgaggggttcaccatttccctttgaaggaaatgggtttgactttggtaccataacagaggataagggaaccacatcgttgccgagattcttcattgcattgtcaaacaaggagaaggaggaggacttcatggcgatgaagggctccaagctgccacagaggccaaagaagaggcccaagctgatgcagaagtgcttgcttatggtgagcccaggagcttggttatcagatctatctcatgagagatatgaagttagagagaagaagagttctaaaaagagggctagaggcttgaaggctttgagcatggcgagtgattcagaatagagtttgaggcgaatggatttttggacttgactttagctggtggcaagaatctgtagttaggtggcactgccttctgcctgtcagacaaacctctgcatctaatttggtgctatgagtgctctgatcaaggtctattgatgtcaacagcaaagatgatattagattcctgatctagtgaggtgcagctccatctttctgggtagtgggcgcctttgtgggagagaaaatggagggtgggatacaatagatggtttctcaaaaccacagaggaagtaatgttcaactgttgggaaacattgaaagctggatgttggctgagaaccaatgaatcatgatgtttaatcgtcataaacttgtagctgtaagacttatggtgaccattctgtccattcaatcaagactgaccaaaattttcaaaaaaaaaaaaaaaa

SEQ ID NO: 11036 - DNA, 1429 bp, Zea mays
aggccggccgggctcagcctggctttcttgtgtgcactgcacccaccctgcctcagcttcgtttcgccaggaacgcgtaggcgcagcagcccaggaagcaacacccagccgcctaatcccgcaacaactcgccctcttctaccccagcggctcatctgcatccgcctaccggtgtcctacaggtttgctggagtgcagtgcacgggcggtggagcagcaaatctgcaactgattcaggatggatcaggaggcgaaggactcgaggccctcaaggtctcccagcgagccaaacctcttcctgcaatggggtagccgtaagaggctgcgatgtgtcaagacgcgtgatgatggctcaccatcgccgtcgccgtctcaaggtcttagacgtgccataccccgtgctactcggcccctccttggagctgacattgcaacatttcgttcaccgcggcgccctagcacccttaaccgcaggaaatccgatttgctggtgaatgagtacaagcacacgatggcgctatcgccagagaaggacaagtattacacaacgaggggttcaccatttccctttgaaggaaatgggtttgactttggtaccataacagaggataagggaaccacatcgttgccgagattcttcattgcattgtcaaacaaggagaaggaggaggacttcatggcgatgaagggctccaagctgccacagaggccaaagaagaggcccaagctgatgcagaagtgcttgcttatggtgagcccaggagcttggttatcagatctatctcatgagagatatgaagttagagagaagaagagttctaaaaaggtaccctgcatatagatatctttgttttgcttaaagaaagaagtacattttgtacctgagacctctcaattcaactccaaattgacattctcttaatgcctgttgctgatatgagtgaaacaacctgcagagggctagaggcttgaaggctttgagcatggagagtgattcagaatagagtttgaggcgaatggatttttggacttgactttagctggtggcaagaatctgtagttaggtggcactgccttctgcctgtcagacaaacctcagcatctaatttggtgctatgagtgctctgatcaagatctattggttgatgtcaacagcaaagatgatattagattcctgatctagtgaggtgcagctccatctttctgggtagtgggcgcctttgtgagagaaaaaatggaggtgggatacaatagatggtttctcaaaaccacagaggaagtaatgttcaactgttgggaaacaacgaaagctggatgttcgctgagaaccaatgattcatgatgtttaattgtcataaacttgtagctgtaagactcatggtgaccattcaatcaagactgaccaaaatttccaaaaaaaaaaaaaaaa

SEQ ID NO: 11037 - DNA, 573 bp, Zea mays
gctgcctgcctgtcagtcctgtctggtgtgtgcacgcgcgtccgctcccgcctggctgccttcgtctcgcccagaacgcgtaggcgcagcaaacaaactaggaagcaacacccagctgccccggcgcaacccgtcctcttctactccagaggcacctcggcatccgccgaccggtttccgagaggtttgctggagtgcaccagcggtggggcagcaaatctgtaactgacacacgatgaatcaggaggcgaaggactcgaggccctcaaggtctcccagcgagccaaacctcttcctgcaatggggcagccggaagaggctgcgatgcgtcaaggcgcgtgacgatggctcgccatcgccgtcgccgtctgaaggtcttagacgcgccataccccgtgctactaggcccctccttggagctgacattgcggcattccggcgccctagcacctttaaccgcagaaatcagattcactagtgaacgagtacaggcactcgatgggcgctatcgctggagaaggacaagtattacacaacgaggggttcaccgttcgatggaaacgggttcgactt

SEQ ID NO: 11038 - DNA, 1520 bp, Zea mays
ttttttttttttttttgacgaatcattgatatagaggcaaaaagtacaattttctttcagaaatggctatgcaagctatcaaactttatgctatacaataagtgaatcatcagccaatgtactaagggtctgtttcgccacaccctaagatcttaactgctctcaaatacatcattttcagtaaagaacaaatacaataaaaaacaatcatcatggccacatggtaaaggatactctacaagcgcttgacatacagccaaaaaaagatgttggcaagtaatatcttctgcgtttgatttttggctgctgcatacaccgtttggtttagatggatactggcttcaatagtcaaataccaattacaaaattgtgatgctgcagcaagaagaaatgtgtttcagccttgatcgctcagattctgccaagcggtgactcatcgctgtgctcatctaccaaccacaacccatgatcccggaaccgctttatcttcttctcaaaccctgtgatgtagttattatgtataatgacatgcttgccctttgtctccttgacccattttttattcttgaaatataggcctccggttggaaatgcagactgaggcaggaggtaaacatcaacctgcccggcagtcttgttcaaagcccagttgaatgctggctgatcatttgacttcatttgcttcgaccagggctgctccttaagctcctcgatccacttccttaacaggagcttggcaccttcagtgggcctgaggaatagcatgcagctgcaaatatatgtgcgccctttcttcccgggtggtggcaattcatgtgaatgatcaagtggtttcacaggagtcatatcgtccataaagtacacgtcgtgattctcgacgatgtaagcgaacgggtcggcaagccacaccatgtcgacatcgttgtacatgacgctgtacccgagctcaaggatctgcagcaggtgccgtggacggcgcgaggtgaagttgaagaacccctgagatccgaatttgtgggcggtctgggcatcgggcgcggggggcacgaggacggcgtgtcctggccaggcggcattgatgcggtcgagggtctcgtagtcctcggcgatgacgagcacctgatccgcgcggccggcgcgacggacgctgatgagccaattggagaggaaggggaggtacggtccggagacagcagcgaggagcacggtgccgtttcccgctgcggcagccgaggcggcggcatcctggagggtgtaggaacgccacgaggacgaggacgagggcgggcgcgctgctgggccccagggcacgaggagtgcaacgaacaggagaaccgcaaggagggagaagaggtaggggagtgtgaggagggggtgcgggcgtgatgcggcggtggaggcggttggggaggaaactgggagagagtcgcccgcggccggcggcttctggtgcggccgctggtggagcgacattgccaaacgctggagacgagtgtcaggcttcccgggacccggccggc

SEQ ID NO: 11039 - DNA, 2248 bp, Zea mays
ggccgggccgggatctgaatcgggggggctcggcgttgatgtagcctcatcccttttcttcaccgcttcgaatcctccgccggtcgccaaaaaaccaccctcgttttcgtccaccctcgccgcttccgcccatttcacctcgtcttcttctgtttcccccccccccccgccgcctctctcgctagcaccagaatccatctctactcgctgccaccatgcacctcacggtcatgtccctctcggcggcggttgccaacggcgccgctgcctacaggtacgacacgatccagccggttgcgaggctccgcttctgcggcctcaggcgcaaggcccaccggctccactcgccccggtactcgcggcacttggtggccgctaggcggagcgtggtggttgcggcgacggctggcaatggcgcggccgcgagcggcacgttcgactacgacctcgtgatcatcggagctggcgtcggcggccacggcgccgccctccatgcagtcgagaagggtttgaaaactgccataattgagggagacgtcgtgggtggaacttgtgtcaacagaggctgtgttccgtcaaaggctctccttgctgtaagtggtaggatgcgagaacttcaagatgaacatcacatgaaatcactgggcctacaggtctcatcaccaggatatgacaggcaggttgttgctgaccatgcaaataatcttgcatctaaaatccgcagcaacttgactaattcaatgaaagctctgggtgtggatatactcactggtattggcaccattgtggggaagcaaaaagtgagatatgggaaagttggtttcccagacaatgaaatcactgctagaaacatcataattgccactggatctgttccttttgtccccaagggcattgaaatagatggtaaaactgtatttactagtgatcatgcactaaaacttgagtcagtccctgaatggattgctattgttggaagtggttacattggacttgaattcagtgatgtatacacagctctaggaagtgaggttacttttgttgaagctcttgatcaattaatgcctgggtttgatcccgagattgcaaaattggcgcagaggattcttattagtcctcgtaaaattgactatcacactggtgtttttgcaagcaagattaccccagcaaaggatggtaagcctgttttgattgagctgattgatgctaaaacaaaagaacacaaggagacacttgaggtggatgcagcactcatagctactggaagggcacccttcaccaaaggacttggcttggaaaatatcaatgtcgttacacaacaagggtttgttcctgttgatgagcggatgcaagttatggatgcaactggcaatgtggttcctaatttatattgtatcggagatgccaatggtaagctcatgcttgctcatgcagccagcgcacaaggaatctcagttgtggagcaaatcagtgggagggacaacattttaaatcacctaagcatcccagctgcttgtttcactcaccctgagatcagtatggttggcttgacagagccacaggctagggagaaggctgacaaggaaggatttgaaataagtgttgtaaagaccagttttaaggctaacacaaaggccctggcagagaatgaaggagatggacttgctaagatgatttatcgccctgacaccggagaaattcttggagttcatattttgggcttgcatgctgctgatctcatccatgaggcatcaaatgccattgcccttggaacccatgtgcaggacatcaagtttgctgttcatgcacacccaacgttgtctgaagttctggatgaactcttcaaggctgccaaggttaacacagctggttcgcattctatgaatgagccagttgcggtgtagagaggagccatagttgaaacaatctatctgctgcagccccacaccccagttatattgcctttagtacttaactagcctgctactcagaaaactgattttgtagccatttgcggacattttcgttatgagattcaggattagtgccagcactatctatttcatgagaaaatagaaatccaatgatctgtcccatgtatggaaaaatgtaaattttgtagtccttgtagagtaaatgtagtgcctttacgtggcaaaactcgctcttatgaatctatgattacttcaattcataagatgggcttgtttggtcagcattatgaaaaaaaaaaaaaaaaaggccccgg

SEQ ID NO: 11040 - DNA, 2044 bp, Zea mays
ctggacgctgcttgcttccacagctccaccgtcatccattgcatcgcgtaatcctgcaggtgcagctaccggcatcctatcgcggcttcgcttcgagacggaaggctgtcccgcgaggtgtggagccgagaggggttcgccgtccgagaagggttcacatcacctcttcctctgccggtctgcccccctccggtctgtcttcggggtctctcattggtggctgcagttgttttgatgggaactcagtaaccgctcgagaggaaaggagcggatgctcaactgtagcaggaagatgggtagatccgcgagtgttcttcaagtccttctggtttccgcaaccatcgttgttgctcagacccaatgggctagtggtgtatggggcatgtactgcgaggacttgacagcgagtgtagaaaggccgcacagggcctcggtaacagatttcggcgccgtcggagatggttcgactcttaacacgaaggcgtttcagaatgcgctcttccacctcgactcattcgcgaagaagggcggggcgcagctgttcgtgcctgctgggaggtggttgactgggagttttagcctgatcagccatctcacgctgtcgctggataaggacgcagtgattcttggatcaccagactcctctgactggccagtgatttatgctcttccatcctatgggcgcggtagagaactccccggcaaaagacatcaaagtctaatatttggatccaatcttaccgatgtgataataaccggtgccaatggcaccgtctatggccagggtgcggtttggtgggactggtttcacaaccacacattgaactatactagaccaccgctcgttgagctgatgtactctaccagagttgttatttccaacctgaccttcataaattcgccgttctggaatatccatcctgtgtactgcaggttcctttcgaggatttcctcttgtcatttattactgaagcaccgtttcaatcgcgatggtaattatcatcctttgtaccgtatttttcccccccgaatgaacagccaggttctggtccagcatctcacaatcctagcacctatcagttcaccaaacaccgacggcatcgatccagactcatccacaaacgtctgcatcgaagactgctacgtcagaaacggcgacgacattgtcgtcatcaagagcgggtgggacgagtacggcatctccttcgcccaccccagctccaacatcagcatccgcaacatcacaggacagacaaggaacagcgccgggctcgcctttggaagcgagatgtcaggcggcatatcggacgtccgagcggagggggtccggatcgtcaactcggtgcacgggatccgcatcaagacagccccggggcgcggagggtacgtgaagaacgtgtatgtagctgacgtcagcttcgacaacgtttccatagccatcaggatcactggaaactatggtgaacaccctgacgatggctacgacaggaacgcgcttcccacgataagcaacataaccatcaaggatgtcgtgggtgtcaacattggtgttgcaggaatgctgcagggcattccgggggatagcttcagtggcatctgcttgtcaaatgtttctctaagtgtcaggtctactgatccatggaattgttcacttgtcgaagggtattcgagctctgtgtcacctgaggtgtgtgagcaactgagagccactcctggtcctgggtccggacagatgtgctatggaggtaactatccggcagctgcggcacaaccgcagccgccgcagaagtcaggtgctagccggctggtaagtcctttcctctcgataagttggtttctacgtaggtaaccttgagcatagtatctacttatcattttcccccctgttcccacttcccagcagcttggtaattgtagtttatggagttcagtaccatgtacacttgttccaaaaactacttgctggggcatgtagctactgattattcttactcagaaatggaatggatttgtttgacttgaaaaaaaaaaaaaaaaagcggcc

SEQ ID NO: 11041 - DNA, 2527 bp, Zea mays
tccttcaccatcctaagctagccaagcatgtggaggctaaagatcggcgagaggccaagcaacccgctgcttcgctcgcccaatggcttccttgggagagaggtgtgggagttcgaccccgccgcaggcacgccggaggagcgcgccgaggtcgataggctgcgccaggagtacacccgcaaccgcttcacgcgacggcaatgcagtgaccttctcatgcgcatgcagtatgcaaaacagaaccttcataatacaaaccttccggctatcaagattgaccaggattcagacgtcacagaagaaactatactaattacattgaggcgtgctcttaatcaatattcttctttgcaaggacctgctgggcattggcctggggattacggcgggatttcgttcattttaccactcatgatatttgcattacatgtcacacgatcaatggatgaagttttgtcaatagagcatatacgtgagatatgtcgctacatttataacatgcagaatgaggatggaggctggggaacacataccttgggaccaagctccatgtttggcacatgtgtaaactatgcaaccttaaggattctaggagaggtgcttgatggagaaaatgatgcattatccaaagggcgttcttggattttgtctcatggaagtgcaactgcagcaccacaatgggcaaagatatatctctcgatgataggtgtatacgattgggctgggaacaatgcaatcattcctgagttatggatgcttccacattttctcccaattcatcctggaaggttttggtgcttttgtcggatggtttacatgccaatggcttacatttatggaaaaaagtttgttgggcctatcactacaactattttagaaataagaaatgagctctacaatataccatataataagatcaactggaacaaggcttgcaattcttgtgccaaggaagaccttatctatgagccttcatggttgcaaagtattgcaatggcttatttgaataagtttatagaaccattatcaaatctttggccaatgaataagctacgagaaagagctatgagtgacctcatggaacatatccactatgaagatgaaaccagcaactatgttggcttatgccctataaacaaggcattaaatatgatatgttgttggatagaaaaaccaaactcaaatgaatttagacaacatctcccaaggattcatgatttcctatggcttggagaagacggaatgaagtcaaaggtgtatgttggttgccatagttgggaaactgcgctcatagttcaggctttttgctcaacagggctcaccgaggagttttgttcgactcttcaaaaagctcatcagttcttaaaaaatgcacaggttatcgaaaacattcctgattacaagagctactaccgtgaaagaactaaaggttcttggactctatccaatggagaaaacttttggcctattgctgatacaactgctgaggcacttaaggcaatactgttgctgtctaacattccttcagaacttgtcggggatccaataaaacaagaacgactatatgatgccgttgattgcctcctttctttcgtgaacaaagatggtacattatcatcagctgaatgtaaacgaacaacttcatgggtggagtttatcaatccttctgagagttttcgtaatatcatcgtcgactatccatatcctgaatgcacatcatcattaattcaagctttagtgctgtttagaggcaagcatccaatatatcgtcgtgatgagatagacaaaattatcaaaagtggtgcatcattcattgagaaagtacaacgaaaggatgggtcctggtatggttcttgggctgtgtgtttcacttatgcaacattctttgctataaaaggattagttgctgcaggaagaacataccggaatagtttggctattaggaaagcatgcaacttcttgttgtcaaagcaactaggaaccggtggatggggagaaaactatcttggttgtcaaattgaggagtatgttgacagtggcagtccacatggagtcaacactgcacaggcgatgctagctttactctacgctgggcaggtcgaacaagacccagcgccactataccgtgctgcaaaagaattaattaacatgcagatggagaacggagaatttccccaacaagaaattgttggcaacttcaactcctcacttttcttcaattacccgaactaccgaaacttatttcccatctgggctttaggagaatttcgccgccgacttgttgcaaaaaaaggttaagatgggtatcttaagctatttctaataattgtatttgggatacaagtatccatgtatattttatttttcgtgatgatgggaatgtaacacaaaataaaatttatatttagtacgtatatgttaatatttgtaagattatcacaaacaagttgataatcatcagtgatctggttcctcaaattcaataacaaggatgcaaaatgtttggtagcaagaaaaaaaaaaaaaa

SEQ ID NO: 11042 - DNA, 4352 bp, Zea mays
cccttttgctctccgccgcctggtgcttcgcccccctcgctctccgacgactggtgggccgccggcgccggtgccgccctacggcagttgggccttcgttggcctcttcgccggccttttcgccggtgacgagcagccactaggaaagcttctgttgctctgcatgcaacgatgaactgatgattattgttgataacagaaatgtgctgttaggttttgttcacatgtgaccatgggcagtcaaagatttctgcaacctgcattgcacctcttattcttagagaactactgcagtggttactaatatattgtgctagccactaggtaatctaacatttctgcaacgataccagcttctcttcttgtttacatggagtgcaacagagatgaggctgctagagcgaaagttcttgcggaaagaaaaatgctggacaaggattttgttggtgcaaaaaagttgattatcaaggtgcagcaactcctcaaagaagtggaagatattgacattccaaaaatgttaactgtttgtgatgttcattgtgctgctggagctaaggtaaatactgagattgattggtacggaatactgcaagtacctgtaaatgctgacgacgcactgataaagaagcagtatcgtaagcttgcccttttgctacaccctgacaagaacaaatttggaggtgcggaggcagcattcaaattagttggagaagcaaacataactctcacagacccatcaaaacgttatgtgcatgacatgaaaagaaacaccttcagaagcgttacggcaagacccaatcgtcagccaccaaaaagacctgcacctgctagatctagttctactcctgtgaatctctacaatatgcatcagcaacatcagcgtcaagcctcaaatcctacagggacgcaaacaacattttggactatttgtccagcttgtggcatgagatatcagtattacctctcgatcttgaagaaagctttgcgctgtcagaattgtttgaagccatttattgcacatgatttgaaggaccaagctattccttccggggcaaatcagcgatctgctggggtttggaaaaatgcaggcacaccacagaactctgcaggacctcaatcaaatgtcactggtcagaaaggctggtctgccacttcaggagttcatgttaataccggttctcatcatgctaatgtgaatacaaagaggaaaactgatggtaacgcaggtggactgaaaaacaaaatgaaatctgcccaggccaccaggaaaccttcaaaagcttcatcaactgctggattgaaaaggggcaggagggcggtgtttgaatctagtgaatctagcatatcagaaactgacagcgacggtgaggtagagattccaaaacatggtcctgctgaaaatagtgcagggccaggtcaacaaactcgcagatctagcaggcagaagcaagaagttaagtataatgaggatagtgatgatgataatgatgatgtggaagatgatgataacacggttgaggatgattttgttgattctcctgcgttgaaaaggctgagaaaaggtggcatgttccatggtgatcacagtactaaaacagcaaagctgaatgaagacaccgctggccataatagtgtgaatagctggggtaacataaaagataaaaagaacggtggtatgccatgtgaagagaaaacttccaatggggttgagcagatgaagagagaaacaatgcatgttggagaaaatagtgatggcaaagaagagctatttcattctgtcagcaacaatggccttggtctaaacgatgatgatgcttcagatgataacaaattcactttcccagatcctgaattttttgattttgacaaacttcgagatgcaagtcaatttagagccaaccaggtctgggctgtctatgatgatcaaggttgtatgcctagattttatgctcgaatcacaagggtaaaaatggttccaaagtttatgctacaatttgtttggctggagttcaatcctgcaaataaagcggaggaggcatggtcttacaggggtctgcctgttgcatgtggacactttacgcatggactgtcagagacaactagtgaaactggtatgttctcccggattatatcattagagagaagcaagacaaagaacttctatgaaatatatccaaggaaaggtgaagtttgggccctttttaagggatgggatattggttggagctcagatgctggcattcacaaaaaaatgaaccatcgctatgaagttgttcaagttctttctgatctcaccacgagcactagcattattgtcatgccacttgtgaagttaaaaggctatgttagcttatttgtgcagtctggagaggcagctccatatgtgatacctcaggttgacacactaaggttttctcattgtgtcccacattatttgacgagcggaactgaaaaagaaggcattccagaaggatctcttgaacttgatcctgcagcgcttccctccaacttggaagaggcttttccttctgctaacccagaatgcagttcagcaagaagccaggagtctgactccaaaaatgctggtttgtccagtggaaatcgcaaaggatccatgaatgtggggcaggggcaacataaaatagccgcgaatggaagggtttgtacaaagacaacaaaggtagagaatatcaagcataacattgatctgtctgaagttacagatgtcgttgacgatagcatttgccaaacagagtatgtatgcgccgattcagaattctacgatttttcagtaagaagatcgctccaaaggttttcacctgggcagatctgggctctctacagtgatatagataaattccccaattactatgcatttatacagaaagtagatctcaagaatgataaagtacaagttagatggcttgatgtctgtcctcaaggagaagtggagaaaagattgtcccaagatcggaccattggcattggaacctttagggttggctacatccacgacatgatgacttacactggtacagatgccttttctcatcttgttgaggccagacctactggcagaaaaggtgaatatgaaatacttcctcgtctcggtgagatatgggcagtttacaaaaattggagcgctggatggactgcgcaggattttgaaaaatgtgaatacgaactggtggagatatttggctatactgattcctccatacaagttcagcttgtgaggaaggtggatggttataagatggtatttatgtcatatagagcagggggtgtgaagacaatacggagggatgagtacccgaagttctctcaccagattccatgctttcacttgacacatgaaaaaggtggcaagcttcgaggctatttggagctcgatcccctatcactaccagaggaatttctctgctgattcgatctgagataaaccttatctacatcaaatctggagcctccggtaatgaagtttctggaacatccacaatttcgtagcactgacgttgttacggtggactcaatctgcacaactaaggcattggcttttggacttttttgctggatggctgtcctgcagctgcaattcacatgtctagtattttttttttgcagtaactatttgttgttagcattagctgtatctacggtttgagttctagtgtaaaaattgctacttttaacatcttgcagtgtactctaaattgcagtactgtgtttgaactgtgagatgctagcctgattaatttcctggaactgaaaaatgaaatcgagctggagcaaggttaggctgatcaatcaatgtgtcatgcttgtgttgctgtgcggggacatagatggcatccttcagcgtattatcagaatttatttctattcgcatctctctgtgtataaatgttacacgtcctaattttgatatgaccatgccttttcttgaactctttttatttgctgacaagtattaaagccttgtttgttcctatttgttttatgattaaagtttagttctaggactttagtctctacctgtttgtttgatctcagggactaaacaggttcagagcacattaaatacactatagaaagactaaaatacctcttatatgcttaagttgtctaagagagagaatgttaaaaacacattaatgcactatagaaaactgaaatacctcttgtatgtttaagggcttgattggtttgagggagtccctcctttttagtcttatttagttcctaattgccaaacggtggactaaaacaaggactaaattgtctcttaagaagtgactaaaaggaactaagctatattaatttcacttttgctcctcatctatttcaggggc

SEQ ID NO: 11043 - DNA, 2057 bp, Zea mays
gccgactgccgactgccgactaccgactgccgcgcgggggtggtctgccactgccagtctgccactgccaggcgccgtcctgcagagatggcagcggcgctgaggccgaggctgctcgtgctgctcgcggtggcggccgcggcgaccgggccgtcgtgcgccggcgccggccgcgtcgacctgtggccaatgccggcgtcggtcgcccgcggcgcgcagacgctcctcgtcagcaaggacctcaggctgtccacggccgggagcagctaccccgacggcaagggcatcctcacggaggcgttccggcggatggtggccgtcgtggagctggaccacgccatcaacgggacctactcccggggcgcgcccgtgctcgccggcgtccacgtcgccgtccgctcgcccaacgacgagctcaacttcggggtggatgaatcgtacaggttgtctgtgcctgccactggggatccgctgtatgcccagatcgaggctcaaacagtttacggagcccttcatgctttggagacatttagtcaactgtgcagctttgacttcaatgcaaacctgatcgaacttcattcagctccatggactatcctggacgctcccagattcccttaccgagggctcctcatcgatacttcaaggcactatcttcctgtcccagtgataaaaggtgtgatcgactcaatgaccttcagcaagctgaacgttcttcattggcatatcgtggacgagcaatcgtttccgctcgaaatatcttcctacccaaagttgtggaacggcgcttactcttattcagagagatatacagttgatgatgcactcgacatcgtacagtatgctgaaaaaagaggcgtgaatgtcttggctgagattgatgtacctggccatgctctttcatggggtgtcggatatccatcattgtggccatcagctacatgcaaagaaccgcttgatgtcagcaatgaatttacatttcaactgatcaatggaattctttcagatttcagcaagatttttaagttcaagtttgtccatttgggcggagatgaagtaaacacaagttgctggagtaccacaccacacattaagtcgtggttgatgcaacatagcatgaatgaatctgatgcctacagatattttgtactgagagctcaaaagatagcgatatcacatggttatgacatcattaactgggaagagacatttaacaactttggagacaagctggatcgcaaaacagtggtgcataactggcttggaagtggagttgcagagaaagtggttgctgctggtttgagatgcatcgtaagcaaccaggataagtggtacctagatcacttggatgctacatgggaaggattttacacgaatgaaccactgacaaatatctacaacccggagcagcagaaattagtacttggtggtgaggtatgcatgtggggcgaacacattgatgcatcagacattcagcagacaatttggccacgtgctgcagcagctgcagagcggctatggacaccaattgagaagctggcgaaggacacaagatcggtcactgcaagattggcacgcttcaggtgcttgctgaatcaaagaggggttgctgctgcaccactagctggttatggccgctcggcaccatcagaaccaggttcctgcttaaggcagtagatatttttcatagagtagattaataaacataattccaggcatccaatttacttctctgagcgattaaaaatagctcggatcgatgtaaggcgaacccgcagaatgttcctatttttctgatgcgctctattcatttggagatgtctggtcatgttttactttcagtgtaaggtcatgaatatcaagatttagtttcatacaccaatgaaacaaaaaaaataattagcatgtgttctaaagaaaggtgcttcaaaccttgcaagaaccaacattttagttcggatgttttaatggaaattgcatccataaaaaaaaaaaaaaaaaataaaaaaaaaaaaaaaaaaaaaaaaaaaaaaaaactcgagaaaggggccggtacc

SEQ ID NO: 11044 - DNA, 840 bp, Zea mays
ttttttttgtttttttgcatggtctatgtaaattaaacagtagttacacattccatcttctttatcagagagaaaaagaaatatgctcaactaacaattggaggcaatactatatgaacagtgtcgaggttgggtaacgtgacacatcacacatgagatggtagagttgtgattcacaggctatacaagagcctccatggagaggttgtacccggagacgagagcagagaggccaatggccacgaacgcgaagaaggccatgctgatcgccgccgccgccgagtccgtgaacaggttatccgccgcctggcgcatgtagtccgtcaccggcgccgccgcggacatggccgatatcaagaagtaagcgacgacctggtctccggcgaagtcgacgacggccgacgccttcctcgccgcgatgaggtcccgcccggagccgaggcggtggacgtcgcgcaggacctgcgccgtggcgtacagccacgccacgatcgagatgcccaggcagtagttgtattcggggtactcgcggaagtcctggctgccgccgtgctggttggacgccatgacgacgagggcgaggagggagaagagccacgccagggcccgcagcagcagccgcgcccgcgccggcgcgccgtccatcttccaccgctgcaccatggacctcaccccgccagcgtcagccggcccgcccccggcgcctccatcggcggccgggccggactctgacatatgcagatctctcgatctcgatcgggttgcgcgtttggtgactggctggctagttgctttcctcctcggccggggacgcaaacgcaacttggtggccaacacaat

SEQ ID NO: 11045 - DNA, 1099 bp, Zea mays
  misc_feature (13)..(13): n is a, c, g, or t
  misc_feature (20)..(20): n is a, c, g, or t
  misc_feature (37)..(37): n is a, c, g, or t
  misc_feature (42)..(42): n is a, c, g, or t
ccgtccggccggnagcaggnagggcgggtgccgcagnataanaagcccgaagcagagtcaaagaagaaggacggcggtgacagcaagggagctgagacgaaggccaagggctcagcagagccggcaaaggaagctgccgccgtccccgcccccgcccccgcccccgctgtcaatgacaaggccgaggcaaagaagagcgagaagcccaaggacgccggtaaggcggcggagccagccgccgtgacgacggagaggtcgctgcctgcgccgccggcgccggcgccaatgcccgcgtacgagcaggagttccgccacccctactacgccccgcagccggtggtgagctaccacgcgtcgcagccgagctcgagcgtgtcgtacacgtacttcgcgccgcagacgcagccggcgtactccatgcaacagccacagccgcacccacaggcggcggcctcctactccgtgcagccgacaccgccggcgtactactccgcgcaggagctgcagccgcagcagccggcgaagcagtggtcgccgtcgtacctgtacatgccgtacccgcacgcgcaggcggcgccggagccttactaccagcagcaggactactacagcccgcccgggacgcacgcgtcgccgatgcacgacccataccgcatcttcgacgacgagaaccccaactcctgcagcgtcatgtgagaggcgcgagctggtcggcgcggcccggacgccgccggccgccgtgggcagcgagtagtttgggggggaggcggcgccgcgcgctaccgcaacatcagagagagagacgtctctgtggctgtataggtagagtagcctgttactgtttaccacccctctaccctcttccttccatcctatttccacctagtatagaggtcaaacctcttctccgtgtagtgacggaaccttttcttaatttccatctttttactgttctgaatcaagtgattagaaagaacatgtaaattgtaacgagatacgttcatgttcaccgcgtctgtatatgccggctactagaactttgaatgagctaccacagatacataaagtatcagtatatataacagattatacatgtacg

SEQ ID NO: 11046 - DNA, 2004 bp, Zea mays
cctcgagggccggccgggaagaagcctggcaggcacacactgcacgcacacacagacagccatggcggtcgggggcgacgccaacggcggcggcggcggggtgcgtcagcgccagcgcgggtgctcgtgcaccaaggcggacttcttcccggaggagtcgttctcgagctggtcggcgtacgggcgggcgctgcgcagcacggggccccggctggcggaccgcctcacgtcgcggtcgctggagtcgacggagctgcacgaggtgcgcgcccgcagcggcgccgacatgaagcgggacctcacgtggtgggacctggtgtggtttggcgtcggcgccgtcatcggcgccgggatcttcgtgctcactggccaggaggccagggaggacgtcggccccgccgtcgtcgtctcctacgtcgtctccggcgtctccgccatgctctccgtcttctgctacaccgagttcgccgtcgagatccccgtcgcaggtggatcgttcgcgtacttgcgagtggagctcggcgacttcatggcgttcgtggcggcgggcaacatcctgctggagtactgcatcggcggcgcggccgtggcgcgcgcctggacgtcctacttcgccacgctgctgaaccaccagcccagcgacttccgcatccacgcgtcgtcgctctccgccgactactcggagctggaccccatcgccgtcgtcgtcatcgcgctcgtctgcatcttcgccgtggccagcaccaagggcacctcccgcttcaactacgtcctctccatcgtccacatcgccgtcatcgtcttcatcatcgtggccgggctcaccaaggccgacgctgccaacatgcgggacttcatccccttttcggcgtccgcggcatcttctccgcctccgccgtgctcttcttcgcctacatcggcttcgccgccgtgagcaccatggcggggggagaccaagaacccggcgcgggacatcccgatcggcctcgtgggcgccatgacgctcaccaccgcgctctactgcgtgctcgccgtcacgctctgcctcatgcagccgtacgcgtccatcgacaaggacgcgcccttctccgtggcgttctcggccaggggcatggactgggccaagtacatcgtcgccttcggcgcgctcaaggggatgaccaccgttctgctggtcagcgccgtcggccaggcgcggtacctcacgcacatcgcccggacgcacatgatgccgccgtggctcgcgcaggtgcacccgcggacggggacgcccgtcaatgccaccgtcgtcatgctcgtcgccaccgcgatcatcgccttcttcaccgaccttggcatcctctccaacctgctctccatctccacgctcttcatattcatgctcgtcgccgtcgcgctgctggtccgccgctactacgtcgccggggagaccacggtcgccaaccggaacaagctggcggcgtgcatcatcgccatcctggcgacgtcgtcggccacagcgacgtgctggggggtgaacgtgaacgggtgggtgccgtacgcggtgacggtgcccgcgtggtttgcgtcgacggtgtgcctgtgggcgttcgtgccgcaggccagggcgcccaagctgtggggcgtgccgctagtgccgtggctgccgtcagcgtccatcgccatcaacgtcttcctcctgggatccatcgactacaagtcgttcatgcgcttcggcttctggacggccgggcttctcgtttactacctcttcgtcggcctgcacgcgtcctacgacacagccaaggcgctcgccgccgagtctgccatggccaaggtggaggatggcgacggcaagccggcacgaggcgccgtccataacggtgagtactgaagggaaatgtaatcgtgaatatgaagtcctatactatggttgttagtcgccgacaagcgaacctaagtttgtacaaatcttcagttatcatcagactgtcatttatttatgtgattagcttgagtcgaaaa

SEQ ID NO: 11047 - DNA, 1473 bp, Zea mays
gggtacctcgaggccggcgcgtctggtcggacgggtgcatctaaatccgaacccccccgctcttggtcagagggggagtaaagcaaacaacggcggacatggtgcgcccaggaaaagcgcttgcggcgccccagctcctcctcctcgtgttcctctgcctcctagccggtggagcccgcgcatccccgcccacagacgcgctacgccgcgtctccccgcgcgcgggggccggtggcctctgccagcagctgctcctgccgcagggttacccgtgcaccgagcacaccgttcaaacggatgatggctttcttttgtctcttcagcatattccacatggcagaaatggaattgcagataatactggacctccagtttttcttcagcacggtcttttccagggtggagatacatggttcataaactccaatgaacaatcacttggatatatccttgctgacaatggttttgatgtttgggtcggaaatgttcgtggcacacgttggagtaaaggccactctactctctctgttcatgataagcttttctgggattggagttggcaagaccttgctgaatacgacgttttggcaatgttaagctatgtatatacagttgcacagtccaaaattttgtatgtgggacattcacagggaactatcatgggtttggctgcgtttacaatgcctgaaacagtaaagatgataagctctgctgcgcttctttgtcccatttcttaccttgatcacgtcagtgctagttttgttcttagagcagttgccatgcatcttgatgagatgcttgttattatgggcatccatcagttgaacttccggagcgatatgggtgtacagatattagattcgctgtgcgatgatgaacatttggactgcaacgatctgttatcttcaataacaggtcaaaactgttgtttcaattcatctcggattgactattatttggagtatgaaccccatccgtcatcatcaaaaaatttgcggcatcttttccagatgatcaggaaaggcagcttcgcaaagtacgactatggatggtggggaaacctaaggcgctacggccagctgcgtcctccctcattcgatctaagcagcataccggaatcactgccgatatggatggggtatgggggccttgatgccctggctgacgtaacagacgttgagcgcaccatcaaagagctgagatccacgccagagctcttgtacattggtggttatggccacattgatttcatcatgagcgtcaaggcaaaggaagatgtttatgttgacttaatgaggtttctcagggcccagcagggaatgcacagtagctattaggacgcacgtcacgtacgccttcaaataaatgcttatgctatgatgacagtacgaccatgtaaatacggacacagcatagcatgtaaatacaaacagtctattgcattgcaaaaaaaaaaaaaaaaggattgttctc

SEQ ID NO: 11048 - DNA, 2048 bp, Zea mays
gggtaccccctcgaggggccggcccgggctctttaatcatttccccaagcttcgcatccgtccttcggtccttcctcacccgttcgtctgtctcgcctcacccacccacccacagcatcagaacggagggaattagggagcttcggccggatccgcaacatcggggaacggcgggaaccagggagctcccgccgcctagaaccggagctcccaatcgatccactggccgttgagccgacacttcaatggaagcccacgcctcgcggggccgccgcaccctggaggagattcggcagaagagagccgcggagaggatgcaacacgccgtcccgatcgcggcgtctcacgtcgactctcacgggaaccaaagagctggagctgagcatcttgctcgagttcaagaacttgaaaatggcaacacggaattggagagggaaaacaaaatgctcttgtccaagatcgctgagaaggaagttgagaaggacgcccttgtaaaccgtttgaatgatctcgagcggaatgtagtgccctctttgaaaaaaagcttgaatgacatttatttggagaaagatgctgctgtagttgctaaggaggatgctctagctcaactcaggagcatgaagaaacgactcaaggaagcagaggaagaacagtatagggcagaagaagactcggcctccttgagagcacagctaaataccctgcagcagcaaatgggccacacttacagtggatatacaatgggaacatcaagtgaggaatctgttgccatggaaaaggagatacaagatttacaggcacagctaaagcaagagtcactgctaaggcaacaggagcaacaacaattagctgaacaatcccagctgaggcaacaagagcaagaaaaactagccaaagagcaaacccgtattgcttctctggaggctgaaaagcaacagttggaagaccaaattactatgttgacaaagaaagctacagaggacgcttctgagtttgctgcacgcaaggcattttcaatgcaagatagggaaaaacttgaacagcagttgcatgacatggctttgatgattgagaggctagaggggagtcgtcaaaaactgctaatggagattgattctcaatcgtcagaaatagagaaactgtttgaggagaactcagccttatctgcttcttatcaagaagccattgatgttactgtacaatgggaaaaccaggttagagactgtctgaagcaaaatgaagagctccgttctcacttggagaaactaagacttgaacaagttagcctgttgaaagtaagcaatatcgctacccaatcagatgggcaaactgaaaacagtatctcaaacccaccacaaatggtcatcgagaatatttctctaaaggatcagcttataaaagaacagagcagatctgaggggttgtcggcagagataatgaaactttcagctgagcttaggaaagcagtccatgcacagaataaccttgcacgcttatacagacctgtattaagagacattgagagcaatctgatgaaaatgaaacaagaaacttatgcgacgatccagtgatacatgttgacatgttgtgaaactcagtcctctggcatggccgcatgggctccacgttactgattttcgtcgtggatgtatttatctcatgccatcttcaagatgctggtgcaaagcagttcttttcgtggccaccatttataagtagagttcagtcgagatcgttgtacttgtatcatactcatgtatacccgattcccagactggttcatctcgtaaattggaagcgatgtttggatgcctatgtatcaagtggatcataaacatccaaacaacgccttaaaatagatcgtttcgacattattattttcctgcttgcaatccaggctctaacaacttctcggtcttgtttaagaaaaaaaaaaaaaaaaaaaaaaaaaaaaaaaaaaaaaaaaaaaaaaaaaaaaaaaaaaactaacaaaaaaaaaaaaaaaaaaaaaaaaaaaataaaaaaaaataaaggactgtctttaaaaa

SEQ ID NO: 11049 - DNA, 1944 bp, Zea mays
  misc_feature (1854)..(1858): n is a, c, g, or t
  misc_feature (1891)..(1918): n is a, c, g, or t
  misc_feature (1927)..(1931): n is a, c, g, or t
aaaacgctagctctgtatgcaaacatgcctgactcgcccgttcgcctatctcgcctcccccacagcatcggagaacggagggaaccagggagctccggccgcctagaaccggagctcccaaatagatcgatccatccgtcgttgagcggacacggcaatggaagcccacgcctcgcggggccgccgcaccctggaggagatccggcagaagagagccgccgagaggatgcagcacgccctcccgatcgcggcgtctcacgtcgactctcacgggaaccaaagagccggagctgagcttcttgctcgagttcaagaacttgaaaatgggaacacggaattgattgatgagaagggagttgagaaggatgcccttgtaaaccgtttgaatgatctcgtgagtcaagagtatattgttataggtgctgagctccaggttttggttctctttttttttggcatgatttgttttctgcaggagcggaatgtagttccctctttgaaaaaaaacttgaatgacatttctttggagaaagatgctgctgtagttgctaaggaggatgctctagctcaactcaggagcatgaagaaacggctcaaggaagcagaagaagaacagtataaggcagaagaagactcagcctccttgagagcacagctaaacaccctgcagcagcaagtaatgggacactcttacagtggatatacaatgggaatatcgagtgaggaatctgttgccatggaaaaggagatacaagatttacaggcacagctaaagcaagagtcactgctaagacaacaggagcaacaaaaattagctgaagagtcgcagctgaggcaacaagagcaagaaaaactagccaaagaacaaatccatattgcttctctggaggctgaaaagcaacagctggaagaccaaattactatgttgacaaagaaagctacagaggacgcttctgagtttgctgcttgcaaggcattttcaatgcaagatagggaaaaacttgaaaaccagttgcatgacatggctttgatgattgagaggctagaggggagtcgtcaaaaactgctaatggagattgattctcaatcgtcagaaatagagaaactgtttgaggagaattcggccttatctacttcttatcaagaagccatagctattacagtacaatgggaaaaccaggttagagattgtctgaagcaaaatgaagagctccgttctcacttggagaaactaagacttgaacaagctagcctgctggaagtaagcaatatcactaccaaatcagatggacaaattgaaaacagtatctcaaacctaccagaaatggtcaccgagaatatttctctgaagggtcagcttataaaagaacagagcagatctgagagtttgttggcagagataatgaaactttcagctgagcttaggaaagcagtccaagcacagaataaccttgtacgcttgtacaggcctgtattaagagacattgagagcaatctgatgaaaatgaaacaagaaacttatgcgacgatccaatgatacatggtgtcaaactcaatccacgatactgtggaatggccgcataggcacaagctccaccgtaggcctggttcggttgcatctgaatttgagacgcaaccaacaagcccttgctcaagatgctggtgaatgtattggtctcatgccattttcaagatgctggtggaaatcagttcttttggtggctaccattcataagtagagttctgtcgagatcgttgaacctgtatcatactgttgtatacccgattcccaccggttcatcttataaactgggggcaaatggagaaaaagattggtcaaaaaaaaaaaaaaannnnngattggttagggcttgtttggttacaacttacnnnnnnnnnnnnnnnnnnnnnnnnnnnntaaactaannnnncccttaatcccca

SEQ ID NO: 11050 - DNA, 4020 bp, Zea mays
  misc_feature (674)..(674): n is a, c, g, or t
  misc_feature (988)..(988): n is a, c, g, or t
ggctcctcgcgagagggggctgaagcacaggtcgtcacaacagaggggaccgaagaggcaggatgcacacgccgctggtagacatgagtgggatcagtgtagcgtgccacgagggacgcaggcgacatggtcgtgtgtggcacggacggggttgacagggccgcacgtggcgtaagcgatgacacaggtaaatgtagagacagcggggccacacgtggcataggcgctagcgatagggccgcatgtggcacatgctaacgcggcacgatcgcgtggggcgcaggtgacatggacgcatgtgacatgaaagagggcagtggaagaggaacagcgactcaagcgtcatcaaagcgggaatcaaggtcgaaagatggggatgagtcaccaaggggaaaaacatactcatcaaagacaacatgatgataggtgataatgcgatgggtgagaagattgaggcaccgaaacacctatgtgattaggggagtatccgaggaaaagacaacgaaaagagtgaggggctagtttgtgaggagtggtggtggaggtgttgggatagtaggcacatccgaagacccgacggtgctcataggagggagtagtggagaaaagggcgaagaacaaaatgggatggtaacccgccttaaagggaagacggttgagtaggtaggtggctntgttcagggcctcggcccagtagcgagcggaaagaggagactaaaaggggaggcaacgtaacataggttgttgttttgtagcagcacaacttaatagctatcggcttgaccatagccaactgcgtcagggataactccatcggttagctcagccgacagggattatgataatgtcgtcggctaggacggggccgataggagttaatgctcgccagcgttaactcccattggctatagtaagccaacgggagtcacttaattcctaacatttaattttcgtcggctacttaacgacgggaattaagtgtataccnatggaaataagtaatttctgtcggtaacaacgtaatttacgtcggtttttgaccgatgggaatttttttaattcattttgtgaatctaataactcgtcatgacggttacaaagattggtaaaaatttgtgatatacctggtagtccggtacttcatttcataccattccatatgaatctagtacaactttaacaaaaaaaagattatatacatcatcagagctagctatcaaatcatacacaaacagctagccgctgatttgtgccacgctgctgacggtgtgacatggcctggccatggagctcaagaatgctgtcacaacctcttcggaggcatctcttctaagcaaacacacatgacatttgcacaagtctcttggcactgatcatggttgccgagtcttcttttcctgactgaaattcagagaacctttgtatcaggtggtgttcagctaggtgaagtgtaatgcttaggttgctgatggactgatgaagagttggtgctacgctgatgcattttatagatgagaacgaactgatgagaaagagtagaagagcatgaggtccagctgtccaagtgcgtctatcgaactcgggcggtctagagacaagaccacgagctctgaacatgaagtgcaaacaaggagaaaatagtgtgtggttttgattagattgctctggggccatccgtttggtgcttgttggatccacatccagcaggctaagatatcacagtatgctgccatactgcaatgccttatgctgccataccacatggagtgatggagattgggtccaaactgccagtaccagctgttatggagatgactctaagcgaccgcattaagcctgcccagcagcccagacaacttgctcgacaactttatcgaccattcgacccttcaatctccggtctgcagctggatcactagcacgtcatgtgagtgagccctatttggctatttcgcattgagacactcggtctatctctctctcctcatttttctgtgggcatgccttgttttcaatatgaaaggagacaagaaatcctcatggtcagaatctcatccaaatcgttcccgcagacgcgtcttgcaacaccgcacccgccgcgctcgtggccctgtcccttgcggccttgccggactgagctatatatactcagaatcaggtggcctcctaacctcatcacttgcagcttcacaaacaagctaagcaagcattcatccagaaagaagagaaggaaccaagccaacaaccaaccaaccatgatgagcggcaagaggattgctcatctggctaagaagtggcaaaggatggcggcacaacggaggcagcgcctcacctggggcggagcaggcgcggcagcaaagcaagccggcgagagctgcagctccgtggcgagcaagggccactgcgccgtgtacacggccgactgggcgcggttcgaggtgcccctggcgtgcctcagcactctggtcttcagggagctcctggaaatgtcgcaggaggagttcggcttctccggcggcgatggcagtggcaggatcacgctgccctgcgacacggcggtcatggagtacgccatgtgcttgctcaggaggagcgcctctgctgagctagagcaggcgttccttagcaccgtggcggcaacgtcgtgcctgtacgccagccgcgtggcgccgtgcgtaggagcctgccagcgggttgctgtttagtgctgttcagtgtagtgtaggtagtagataaatattattcagaaccttctgatcctgcaaatgatcaaggaaggtgttagtgttctgtacgtatgtatgatgctggatataattggcttatgagaattgtgaggactacttacattacgtggcaacaaagtttcttctgcagaattctgacttcaaatctgctgagactgagaggttgtcattcaaaaaacaaatactgagggttgcttcatgtggcacaactgcacaagtccaaagaaataaagaaagaccaaacacagaacataaaaactggctatcagaattcaggagatgccaaatggcatgtgcacagcattaccatatatttgtagctttcttcatttccataccatatctcctggcctatatgttatacattttaccggaaacatcatctgaatatatgagcacattaaaatctatagtattttgcaagtatttctcaaatacaaacctacaaacatcctagaaaatagcgctgcacatcagccacagtggaataatgttacggcgaaagttaataagatgtttttaccatgactagtgcttctcagagcagattctcacttctcttcaaccaaataacaaacttcacaaacatgctggtcggaagaagacaataatcacttctccaattacatttagcaaatttaaaatccgctcctcagcgctccttattctgttattcagtccccaccaagatcactccagaaatatgctcccccaccagaagcaatcaaaatcactttatcagataatcaaatagttgaggctctaccaaataggtcctaaggacactacagaatctaagtgcaaacttgttgggaggcacttacaggtagtgattttttttttgccatactagtaccttgatctagttttgagatgagaagtgttcaagtcaaagctctagaaaagcgtagatctaaagtaacaaaaaatttatactaaagcatattatatcatatattcactgtatagatctactcatatagagttcaaaaaaattatttttgcattttatgtattttatgtggtttactggaaaattttttaagattcaaccgaaataaatataaaacaaaaaaaggaaatcactgagaaaaacaaccattaatcacatgcccgattttgagagataagcgaggagatatccggttttatagtgagaaaaaaactgacttttgctatagtaaagtcttatgatgaattggtgatgagtttgcctcgttctttcagtccatgaggtattgcttcagacgcaacaagactgctagactgagca

SEQ ID NO: 11051 - DNA, 5954 bp, Zea mays
tgctaggcaagaatgacctggttaagagggatgatatcaaaggtgtgatttagtggcccatccggtcacgcttcggcattaagaggacgactattgtaaacattgaaagagcccaagcttgtctggtggctttcaacgtcatgtgcagctacatcagcaccagagacctggttcaggagcatatagcttttaaggtatggccccttgttagtgattggaaaataccgaaggagactgatgctagctcgagttagagtgctgggaagggtggcttggtgtatctgagatgtacctatcgttataggaatcaatttggtgaaccggacgatgagtggcttgaggctatcgaagcaactagtgatgagatgttgggggcctacaccaaggctgaggacgaagctatgaataccgcctttggtgcctgagggaagggaagattgaatagggttcttgatgtcattgaattcgtttatgaaagtcaccttgaggggggtgaataggcgaaacctgaaaaatataaactttgaacacgaacttcacccggggttaggattagaaataagtaataacgaaatcggagtgcagaagagagttcttcttgctatgagttgctcaatcaatgtggatgactttgggagctaactcaaagattgtgaacaagagaacttagagagaggggaaaggaagtatcaaatcgtaggataatgatcaacacaaatgaacacaatgatttgtttcccgaggttcggttccaaagaacttactccctgttgaggaggctgttgttcacttgttctcaattgttgtgaatcaagagcaaggcaacacatttgttatatattaaagactttcgtcctccaaagtattatgcccttttaagtataatgaatcttagacgaaggtcacaaataacaaagcatacattactcacaaataaaaatatactcgcaagatgtaatttcatgtcaagacgaaggaacatttttttccataatcaaaaaagaaaaggtttagagtccggttattaggattcagctgatttccccgattgtttgttgagtcaatccttgtaataaatacctatggctttgtccatgtaaggacaaatagagatcgtttgaatgaaagtttagtttacgttctgtccagccctggcgctctactgctcaatatcgttcttctctattattgccgtttagttcagggagagagcaagaacctggtcgatcctgcggtgattaatccaacattctcttctatggtcacggctatatatatcttttccgccaaatccatctacgaaaaattctggatacattgggtgcccttcgatccggcaccatgcatgtggacgccaaattaatacagcaaaggaaacatcatatttgatcgcaaggtgtcagaaccatcctgcaatatggctatcgcaatgtcatggccgcaccgcacctagacaggctagacttggagaagggagaggattgcggctgcgctaagctctcccaaagcccgctccgccggcaacgatgagggtgtggccggggctaggcactcggcgatgggcgagtcgcagcccgaccgccggccgagtcgccgcgagagtcgtaagctaagctctacgcaacacgaacacatgcatgatgaccaattccaatggggtctgtggcagagattttctagggattactatgctacggcgcgccaaccatgcagctcttggaggtcttgatgaagcgaggtgtatagtgctttagtggtatatggcgtgcatgagcagcagtgcctggcgcaacggaatagacatagagaacagtgctggtgggccggggcgggtatgttgttgctttggtcgtcccaatcctcccgtggatccagcaacatctatactcgcccgccccgtgcatggtcgccgtcgtcgtcgtcgtcgttcgtcggtaacacactggccgtgtttatcggcctagtactctactagtaagtagtacaagaggctgcagacacggacgcatcagtgtcacgttatcatcagagagaggggcagagaggacggagacttttttgggagctgcagcgagacacagcaggtacagtgatggggatgcacgagacgatcgagggaatttccttttcgacggctttttggaggacatctcgcaggccttctcttggaaggcgagaaagctgctgctgctggccctttggcctgcgctcgctcctcgctgagcctgtgcgcaagtgcatgcatggctgcccagtagctgatgggcgggcgagaggacgatgccaatagccaatgctctgttgctctctctctctctctctctctctctctctctctctctcgcccatactctctcagtctctccaagcgcgcgagaactgaactgagaaagaacaagcacatctcgacttgacctgggacggacgggcacggggaccaccacatgcgttttcagctcaggtggaaggatatacgacgacgcgggggccagggcggccagctgcctgcactgcgacaaccctgcgcccgagacaagagccttctgtttggcctggctcggccaccagcatcgccaaagcgcatggagctgactaccgggctagctaggctagggcatgcgctgcttccagttccagccttcgtcgcctgagtataaagcctagtgagaatttatttatggagtatatgaacataatttgcattattatattcatacagtcatctcaccaacagacgcaaatcttggtctttcctttagcttcccaacttatagtataagtgatgctaactccctatatatatccaaagttaaaaataaaaaatataaaaatatcatcaatatttatatattttaaaaagtttactaaaaaatatttttcatgaatggtttaatgatacttactacgaattatacatataacaccttattgtcgttttttctaggtgtatagtttttatccaatttagtacgtaaacggttgtttctaacattgctggttgagatcgttgtacgtgttgtgtggactttaaccctcgtacatatggcaaatgcttggttttgtttgaaaaattttggtgctacataactcacaacaaaaaaaaacagtggggggaggacatacaacaaagggtgttagggtctgtttggatccatagatgctaaagtttagtacttcacttttagtattttttagcattccggtttaaatctctatgtactaaaatttagctaaaaatatagtgctaactttagcatcatgaatccaaccatacccttagccccaactcccaagtactaaaaatatagtgctaactttagcatcatgaacacagtaatgtgtttttgtctgaaattttggaataatggtaccgctgcatgacgacgttctccgaaccgtgcttcactgctttgaacagcttgtaccaggggtccagtggcacattatatttgcacacagcacaagatggagtcagattacacaccttgcattgcacgcgtgtacgtacaggtacagctacgcactccccaagttccaagagcacctctccctcaggaataaagtgcaaacacttttgttccattggatatttgatacaccccaatgttaagccctctttgcattgcaacacatgagccatacattcatatatattgcaggaattttcagagcgaggataccgttcaatttcattggggaaacgtaggatgcatatcagctgtgttctaaagggggggcattaagcaggtcatatatacattactgtcacagcacatactgtgttctaaagcgtacatggtatttttgtctggcgagacaaaacaattagggctgtatgtttcacagcttccagtgtcttgcttagaccttatttggatactctagtattcactagaatcaagtattgtttcatgcttgagatgaatactagattacccaaacaaagcacggtacattcaatgcatgtatatgaactgatggtactaaattttcgtgtgtggagaaaaaagtattgttctaatgaagcgaaggatttcatctatggtttatttcgcaagtacattattatcattagtcatcgcaggagaaaccacatagcaatagcatcgtgatatctaagtatctcagttatcatatcgaaaatcccacacattggtttgtcatctgaatcttcagataacgagccccaacttacaggtacggtcgcttatcaaacatacggccagagagagttgtatacagcctagctagctcgcagtattttgcggtttatattgtttcttaccattcagaaattgggagaggatacagtacacatatatacattcaatccaaacatggtttattcttttgtggtaaaaaagaaactttgataatttgtgaagcatatgataagaacaagaaaaatcttagatgctcaagaacagtggaaataatgcactcgttgtaagacaaaaaaaaggtcaactaattctcagtcaaactgactactgcagttaggtactactaaagcagtaactgaagcttgctgtccattacacctggccatttgcagccgaaacatgaagtgcgtatcggctttccaaacgaaatccagctaagtccgtttcagatgcacactagtccagacgaaaactgacgaactaaattacaaaaagacttgcgcactgccgattccagtggccgcaaatggtcgtagagacaaaaaccaaaacaaacaaaaggtggacaaccactagcttagctcagatcggtgatcaaatggactacatctagcagacaacgggtggtttcctatggatacgacggaaaccaaacaaatcaacacagattcagcggcaagaggcggctaggctctcatgtaagcaaaagaaaagtagatgtgtttttaggataaaaaatgggcgaactgtaaactctctctcaatttcgtgatgtcgattgatggagctttgaaagaggattggaactcacctgccttctccaaaccagtcctaaattctaaccctgcagaagcaattcgaacccaagacaagcatacagatgcatgtaacagcatgaaataagtgcatcatcatctcgggaaaaaaaacacgatacagatatattcaacagatcagaggatagagaggaagtgatcatggcctgttatgcatgcttggctccttgcacgccacccacagcatccaatcacgccacgggttggctacatgtgtggcatacagggagccaggcacacacgacacgagccgatcgatcgaccaaacctgctagcttaatattgctatcatggcgtcccacggtggacgaggacgaataatccatagaagagccagctcggtgatggagtagatcgatcagctagcgtcagaacggccgggctgccagcagagacgacgcatatgcatgcttgaagtggaaagaggcatgagcaaatcttggccatgatatgagcacgcaccaagagaaggaagaggagccggcctggaagagctgctaaagtcttgtgagcggctaaggtaggggagaacagtggaagagtgaggtagaagaaagggggagaagatggattttatagagggggaaggggacggcgtgcctgctctctccttttgttgtcactaccagttactcctcctacgactcaacggttatctatgtacctgagtattttgtttacttatttattgtagatcataaagacacatgcaagaaatatcttagatatagtgctaatttggcaactcaattttgtcatgagatttttattttttttttgtcaaggaaaataatctaattttccttagaaaaatagaaatccctcgaaaatattgggttgccacactattccttatacttttttttacacatttatgagtcatgaagtgttatatcctcgcttttattttggaagtaacaggcaggcccggggggttggcaaaaaaaaagcattt

SEQ ID NO: 11052 - DNA, 1489 bp, Zea mays
  misc_feature (1094)..(1094): n is a, c, g, or t
gggaccctccacgccgccccgcccggcttcctctaagaggctcagaccctcatcaccaactcccctccatctcgctcccggtcctcactctcctctccgcctcctccctcctctcccttttgaaaccccatcttcgttggcgtagggctcgggggttggagtttgggctcgggggttagagtttggaggaagcattcgtgaagactctgtggcgacttctccagatcggcagatccgtctttctgggcgatttggagcgaagcccccaagtagtttgttacagaaagcagcggcttttgcgtcgctcctgcgtcagtgtacctgttgcgttcgtcgttcctggccccggccttcggatcatatatatccagctaggaaaaaggggcactttgcatttattctttggccccttcggagatcgccctcgtcaagatttgatcaatctgtggccgttgtttccatcggagctgttgaggtttgtcttcttcttggccgaagacatggcggcggcgaacggagctgccggtgcggtgctgttcagcgaggaggacctgagggaggtgagtggggtgcgctggggagaggacttcgtggaggtgacgtgcggatgcaccagccaccgctacggcgacgccgtcggccgcctccgcgtctttgcgtcaggcgacctggagatcaactgcgagtgcacgcccggctgccgcgaagacaagatgacacctgctgcctttgagaagcactccggaaaggagacagctggaaagtggaggaacaccgtctgggtaatggtccagggggaaaaagtgccactgtcaaagacggctctgctcaaatactactacctggcgcacaagtcaggcaacggttctcacaagggccgtaacggacgtccgtcccaccgcgacgagttcatctgctgcgcaggatgtggcaaggagaggaggtttcggctccggtcaaaggaagagtgccgtgtttaccatgacgctcttgccaaagctagttggacttgtgcggatttgacaactgataggccacagactggtaccatttgctacagttacagggaggcttccaggtcacctgtgacgacnaggaggagcgtgcaagccgcaaggtcctgcggggctgctcccgcgcgccgtcctgcacgggctgcatgaagtgcgtgtgcttcggctgcgagacctgccgcttcaaggactgcgactgccagacccggcgttggcttctgccgcaactccaaggaataataaagacgcaaggatccaacgccattggttccagcaggagtgctctcaacgacaatgccgatgactgtagggcaggccgctattctattctattctaaacaattccattcgccaaccattctccatggctggctggtgctatagtatccgtcgagcagcgatggacgccggccccttcccctacagtgcagtctaccaatggaacccgaattcccgttaaaaaaaaaacaaagggc

SEQ ID NO: 11053 - DNA, 1272 bp, Zea mays
gggcacagcagtactctgggtggtatgccattagtgctgcatttcctccagcttacctgcagggaccaggcagaaaaatctaccaagaggtatctaggtgggtcattcatgtgtacagaactgaatgctgctgcctattaatttgaagaaagggagttgctatatttcagattcttgaatttttatggtcaactttttttttaacaaaaatgacaaagataaaattgcatgttggatgaacaataacaaaacagtggtctgtacacatacaagtgcaggagaaatgatggttgctttgtacagggtattttgctgtgctatacagtactgcttgattcatctggcactttgtgttattttcttccccgccagggtcacctgtgacgacgaggaggagcgtgcaagccgcaaggtcctgcggggctgctcccgcgcgccgtcctgcacgggctgcatgaagtgcgtgtgcttcggctgcgagacctgccgcttcaaggactgcgactgccagacctgcgttgacttctaccgcaactccaaggaataataaaaacacaaggatctaacgccattggttccagcaggagtgctctcaacaacaatgccgatgactgtagggcaggccgctattctattctattctaaacaattccattcgcctaccattctccatggctggctggtgctatagtatccgtcgagcagcgatggacgccggccgattttgctacagtgcagtctaccaatggttcccgacttcccgttaaaacgcgcattgctcacatcaagatctctctcgtagtcgtgcaagtgaaaatgttcgttcggttgctttgatgcgcacgtaggactgtaggagtatagtgctactcctgtgtatgtcccccggttttttatttggtggtaaaaggagctctgacatgagagcagacacaaagattgacctttctcctgtagacgacgcagtatgctcgtcagctcgtcaggatgtagggctatagtagctgtgtagctgtactctttccctccgtccttgtcctgaacaagtgctctcgttgatgtttgtgtcattcaattattttaaatttattaataacatttatattgtaaatctttttattaaaaatagatttattaatttgtttgatcttaataactatatgatgctatatttttaaataaaattattataaaacatgtttaatgatttttttagtgacactaatcatatattataaatactagtatacatataattaaaatttaaatagt

SEQ ID NO: 11054 - DNA, 1666 bp, Zea mays
ttgcacgagaccaggcccgggaagaggctcagaccctcatcaccaactcccctccatctcgctcccggtcctcactctcctctccgcctcctccctcctctccctttcgaaaccccatcttcgttggcgtagggctcgggggttggagtttgggctcgggggttagagtttggaggaagcattcgtgaagactctgtggcgacttctccagatcggcagatccgtctttctgggcgatttggagcgaagcccccaagtagtttgttacagaaagcagcggcttttgcgtcgctcctgcgtcagtgtacctgttgcgttcgtcgttcctggccccggccttcggatcatatatatccagctaggaaaaggggcactttgcatttattctttggccccttcggagatcgccctcgtcaagatttggtgggaacccaattcgctgggattccctgtggaaaggcgccgctttggttcctgtttccccacagctcccaactctctatatctcaatctcttgttcatctaccgtttcttgctttgacgcaaaccagatcaatctgtggccgttgtttccatcggagctgttgaggtttgtcttcttctcggccgaagacatggcggcggcgaacggagctgccggtgcggtgctgttcagcgaggaggacctgagggaggtgagtggggtgcgctggggagaggacttcgtggaggtgacgtgcggatgcaccagccaccgctacggcgacgccgtcggccgcctccgcgtctttgcgtcaggcgacctggagatcaactgcgagtgcacgcccggctgccgcgaagacaagatgacacctgctgcctttgagaagcactccggaaaggagacagctggaaagtggaggaacaccgtctgggtaatggtccagggggaaaaagtgccactgtcaaagacggctctgctcaaatactactacctggcgcacaagtcaggcaacggttctcacaagggccgtaacggacgtccgtcccaccgcgacgagttcatctgctgcgcaggatgtggcaaggagaggaggtttcggctccggtcaaaggaagagtgccgtgtttaccatgacgctcttgccaaagctagctggacgtgtgcggatttgacaactgatagggtcacctgtgacgacgaggaggagcgtgcaagccgcaaggtcctgcggggctgctcccgcgcgccgtcctgcacgggctgcatgaagtgcgtgtgcttcggctgcgagacctgccgcttcaaggactgcgactgccagacctgcgttgacttctaccgcaactccaaggaataataaaaacacaaggatctaacgccattggttccagcaggagtgctctcaacaacaatgccgatgactgtagggcaggccgctattctattctattctaaacaattccattcgcctaccattctccatggctggctggtgctatagtatccgtcgagcagcgatggacgccggccgattttgctacagtgcagtctaccaatggttcccgacttcccgttaaaacgcgcattgctcataaaaaaaaaaaaaaaatagtcgtgcaagtgaaaatgttcgttcggttgctttgatgcgcacgtaggactgtaggagtatagtgctactacctgtgtatgtccccccgg

SEQ ID NO: 11055 - DNA, 1194 bp, Zea mays
ccggccgggtctaagtgctcacacacttctccctttccgccgccgccaccgaggaagacaccaggtcaccagccataggcccatagcaaaccaagcgcgaggaggaacaggcgtagctccgtagccatagatggctaacaagcgtcagcgggatgcgcggaagcgcttccgggaggcgaacccagacctattccctccgcaaaccgccccttctgccgacggaaccaagaacaagagcaagaagaagaagaataagagcatgttcaagaaggccaataagggcggcacgggaaggtttaagcacccgctacgggttcccgggatgcggcccggggaacgctgcttcatctgcaagtccaccgaccacgtcgccaaggcttgccccgagaaggccctctgggacaagaaaaagatttgcttgctttgcagggagcggggtcatagtctgaagaactgtcctgacaaaagcgagggaaatttgatgaaattttgctataactgtggtgaatctggacactctctttccaagtgccccaagcccattgagaatgggggtacgaattttgcaagctgttttatctgcaatcagcaagggcatttgagcaagaactgccctgaaaacaaacatggcatctatccaaagggtggttgttgtaaggtatgtggcgaagttacccacttggccagacattgtccgaataaagggagacaagatttgatatcctccagagatgatgatgtcaacatggaagagcacagtcaggaatgtcctgcggttcaccatggtggagatgacctagaagatgatttcgttaatgaagaagaaccaaaacccgccaaatcaaagaaggcaaagcaatcaggttcaagaccagccacagggacgggaaatgacgtgaagagcgccagtgccaagacaaaagcgaaacaagctcctaaagttgtaaaattctttggttaaagaatgggaattttgttgtagcttaagatacgaatgttccatctggacaaccttgtactgtcaagcggttgtgtgtaacgctgatgacgatgagaatacgtctgccaactgcatacgcctctcgttgcccctaggtgctcttctgtcttctcattgtttggctagcattgggttatgcgagaccagtagaacaattacaatataaaaaaaaagaaaaataaaaaaaaaaatct

SEQ ID NO: 11056 - DNA, 1939 bp, Zea mays
gacgacgagataaagaagagaacccaccaaatcaaaggcggacacatcgccacatcctccattccgccttctcggctcctccccacctggccaccactaccacctcccgtctcctcgcctccttccaaatccaccggttgccatccgtccgacgaggacggaaagggaccggcgtgagggaaacctagatgacccgttcctgggtcgggaccagagagccttccgggctgcgccttcgatcgccgccccgccgcctagggttcccgcgcctgtagatcgggtttgggggacgaggaaggggagtgccaagtaagggaacgatggggccgaggcgctccaagcgcgtttcgtgggccaccggggccaatctctgcaaggtaaggttttttatttcggaggattccccttctcaagctggattgagaccgcaggacaatctccaagcaaaaggctcatggttaatgcatgcagctggcccaagctcagatgattcgctgccacctggcttcgaatcattgcagccaacaagctgtctcaaaattgacatatcccaaatccatgttattaggtggagatgcccaccacaggtattgcataatcctgtttggcttgtagctgctggagaagaaagtgaggaggttgccttgcagaatgataggatatttggagcacttgaggctatatatccacggccgtcgaacattcctccaaacccatttgttactcctgatgtgaaagactcccaatatgatgattcccgaacccagttggttccgttgctcccagttgaagaggatgatgcctctgaccagttggaagaaccacctgttggtctatcaagtagttaccagcagtcagataagtacgactcagcaacattcagggtcccacaagcctcagacgctccctttaccactgcgcagcagcagcagcagccgaatggttccatcaacaacacaaggtctggtgcccccgctgagcctgacacagtggctgctgcatctgctgcttacactgcaataattcagagcaaccgaatgggaaatatgattgaccaagatctgctcgtcgaaatgctaagtgaccctgcccaacttgagaggttaatgaaagaatatgccgcgcttaagcacgaacagtcaactaacagttctgttgccccaatggtgaaaggtccaccacctcagatgacagctagtgttccggtctccttcccagatcacaccactgcttttcacaacataaactctacactgccgcctccacctgttctgaatcgtctgcctcctccagctattccttcagcagttaccatcaatccaccagcaagttcaagtcaagcaattagctttccaactggccgaaccagcggcttgaactattaccagaccctgatccttcagcatggaggggagaggcaggagccacagccacttcaacagcatggaatgcactttccaatgcatcaccgcactgtcgcttcccagtctagcgccactgatatcgtcagcagtggtactatgccagctagggatactaagcaaaggcctatgaagccttgtgcttacttcaacagcgccagaggatgccgcaatggtgcaaaatgcacgtttctgcacgacgtgtctgccgcgaggaaagaacagccaaagggacccaaaagaattaagctagacagtagaatagctggtcggtattgaggaggctgctgccggtttattttttactgttctttggttcaaaatccttttcctcctttttttccttcaaaaaattattcagtaaatattgcgccccagctcctttcctttctcttagccaatttctatttgtttactagaagaacatgctcttagcccatttctctttgttgactaaaagaaaatgttttagaagaaagaaaaaatatcccatgattgaatgaaaaaaaaaaaaaaaa

SEQ ID NO: 11057 - DNA, 3202 bp, Zea mays
ggtcggaaactatgatgtcatcatgttattttaccgtgcaatgtgtttgtacgatctcaccgtgaggtcaagtgaaacgaggcagagctgagaaaccactagttcaacttcacgatccatcttacggtcatctgcgacgcatgcatacatgcggcccatgtttacttgtccaggtctgcgatgagtgcaattacggtccattccaaggaaggtgtgtggtgatggagtcgacatctactactgtaactgcaaggagtggggaaggttcggggtggctgtcccgatatcgtcaatctcggaagcgccaagacggatagatctcttctacgatcgtaagaagtacaattttaagaagacggagctgtgtgtggttctcgttagctgtgtgttatgttatcatagtctgttcgtttgactttaatctatatcggcttttataatacatatgtctctatagattatatctacatcagtctaaacatgcggctttaatccgaagcgaacaagccagaaataaaacattaatacaatgtacaaagcccgactaatagaaaaaaatcaaagctaaacattatcaaagtccccaaagcagacgctaatcttcttgcttataagaaggataaaaaatcatatataaatgctatcccaaaccaaggtccatgtcctgctccttagcaacgaaaagaaaacacacatgccctgacctcgctgttctcccaaggggaaaaaaaaagacgcagaaaatgcgcgaaatccggcccacacacagtaccccaccacgcattattatcctaaaaaaaacaccacgcattatcctgaaaaaacagatcaaatcgacgcgacgacgagataaagaagagaacccaccaaatcaaaggcgggcacatcgccacatcctccattccgccttctcggctcctccccacctggccaccactaccacctcccgtctcctcgcctccttccaaatccaccggttgccatccgtccgacgaggacggaaagggaccggcgtgagggaaacctagatgacccgttcctgggtcgggaccagagagccttccgggctgcgccttcgatcgccgccccgccgcctagggttcccgcgcctgtagatcgggtttgggggacgaggaaggggagtgccaagtaagggaacgatggggccgaggcgctccaagcgcgtttcgtgggccaccggggccaatctctgcaaggtattgtgataacgtcctcgccggaatgggttcgtccgccgcggcgccgcccaacggcgaggagaacgattcgcgcctcacgcggctccccaacccatccatcctttgtggcttgcctgcagttgacgtttttttcttctttttttggctgtgttcctcgtgctgttgctatgcccttcatttccccatctctgccgaacgttctgatccttatgttttgattgcgaaatgtgttcggctcgactggaacggacatgcgatcttacattcccaatgcaatgctgtggctgagatgggttcatctggcctccgcaaataagccaggattgccgttgttccttgcatgaatatcagtcgattcagcaacagctctgacaaataatttttaaagagaatgaatgatcatctcatatatgagttagacaacagggatatgcaaatgagaagaatgacaacttggggactagccaaagaaataaatggcgcctcaaataacttataagaaaaaaaagatgaagagctacatgaattccattatacaaagaatttatttactctatataacctccatctctttgttttaaatgacatatgtgcttacgtatagccatgcaaagctcaacccttatcttctcagtgaagtttgtttgaaagtgtacctctatttatgccttctccaggcgaaaaatggagtccaggttataagcatgcatttaagttcaaattagtggacatttaattgaaatgtattgttctaattttatcctctattgtacttgtgttccaatttatcctgtagtctttttaatgccagccagacagtttaaacaaataattgtcggttttgccaagaataattgtagtttgataagattcataagattgacttgagtcatattgacactatttaatcagtaattaacgtttataaagatgaaattatttttcatggtgcagtgttaacatgtgtgataagacatgattttgcaaaaaaaaaaaagtcatcatctgcccttttaaaactattaattcattatttttccataaggttggctaaagtcgtctttttgtatactcaaggaagaaagtctatagccaccaaatgtctataaactataaagatgaaactgttttggatacaaacatctggtctcttttttttgacagtggtaatgataaaaaacattctttgttatcatgtacataaagcaatatttttaacatttgtccaagtagcaaattattacaagatactgtctggtttatgcataatagctaaggatgaaaatttgcattacctgggaatatttgagaaaagttctttggaaatattcgatatcactagcgagcactagtgcacaatatattctgtattctgcaagcattctactgttactcatttttagtgcacggatgaacatttcacttgatttgtgcagttgagtttcattgcactaaaggcaaaatctccttgtgttttgagatgacaaattcctctctgcacaattcaatggttttgcttaccttggactgtactggtaagctcatcaagtgctgttctattcgtaacgagttgatcacaccgagtgaatggattattgcagcataggaattttctcttatgcttatttaaaaaataaataaaaaggtcttcgtaatgaattttggcattcctgtatggaagctctctgtttcatagctaacaggtagacatgcaaatccacatctcacattgatgattttaatatgactacaggagctctcgcaacagctaaattactttcagtagatcatgagatttgtcacactgcttttgcacgatggatcattatggagggaatactaaattgagggagggcataaattgtatgcatattgatataacactatctacatagaaatgtatactattatttataagttagcaaatatttagtttgcaccggagacatagctgcatagattgataactgcaggcatgcaag

SEQ ID NO: 11058 - DNA, 2756 bp, Zea mays
ccacagacccaaatccgcaaatcggcaccccggaagcctcaaatccgctctattcctctctccccctctctcccccatcgcaccagcaggcgagcgcgaggcggaggagtagagatggagtcggaccagggcaagcttttcatcggcggcatctcctgggaaacgacggaggagaagctgagcgagcacttctccgcctacggcgaggtaacgcaggccgccgtcatgcgcgacaagatcaccggccgcccccgcggcttcgggttcgtcgtcttcgcggatcccgccgccgtcgacagagcgctgcaggacccccacaccctcgacggccgcacggtcgatgtgaagcgggcactctcgcgggaggagcagcaggcctccaaggccgcgaaccctagcggtggaaggaactccggtggcggaggaggcggcggtggcggcagcgatgcaagtggtgctcggacgaagaagatctttgtgggcgggctgccctctactctgactgaggatgggttccggcagtacttcgagacctttggcatagttactgacgtagttgtcatgtatgaccagaacacacagcgcccacgtggtttcgggttcatcacctttgattcggaggacgcggttgaccgcgtgctgcagaagaccttccatgatcttggtgggaagctggttgaggtgaagcgcgcattgccccgtgaggcgaatcctggcggctctggtggtggtcgttctgggggaggtgggggttatcagagcaacaatggccataacaccagctctggtagctatgatggtagaagtgatggtggcaggtacgggcagacacaacagggtagtggtggtggtggctatcctggttacggtgcaggaggctatggtgctggggcagctggatatggatatggtgctaaccctgcagttggatatggaaattatggggctggagggtatgggggtgttcctgctgcttatggtggacattatggaaacccaggtgcagctggttctggttaccaaggtggacatccaggctcaaatagaggaccttggggcagtcaagctccatctgcatatggaactggagggtatggtggcagtgctgggtatagtgcttggaacaactcttctggtggtggcaatgctctgaatagtcaagcccctggtggacctgcaggctatggaagccagggctatgggtatggtggatatggaggggatccatcatacgctagtcacggaggatatggggcttatggagcacgtattgatagtgctggcaatcctgctactggtggatcatctggatacaatgcaggctatggaagtggtggtgccaactctggctattcaagtgcttggagtgatccttcgcaaggtggtggatttggcggttcggtcaatggaggtgctgaaggacagtcaacttatggcactggctatggcagtgtgcagcccagggttgctcagtaaagagaggcattttgagtgtgcgaaatgaaccagtgcatctgggcagtctatgtattgatttgtcattccagtctctctggttgctctcagcattttgaagattgcccatttgctgcttaaatcagtatttatccgggttggaatgcttgatcctttagcggcttactactagaacgtctagtcaataagtagctaaaatgtggagtagcagtatcttgcggaatgcttttattaatttttacatttagctttatccatctgtgtggtttgccatgagtggagtttcaggttgcttcatctctagttataagctagagtagcttgactacttatgggcaaaattatctagttgtacctctattctacagatcatatatttgtgtttgacattagtatttatgctggatcttgctctacctacattctggaatgttctccatttggtggctgtattgacatgtggtattatcaacattgatgggtttgaaacagatgcaaaccctgaaatatgcaatcatagttacttgatgctgtagctgcttctaacagtattttcaactgtagtgcaagtgtttttatgtagctggaatggtacacccttcaagtatatcaccaagctatgaattccatccatttggtcctagatttcaatattttcaaagcagcagtaagcttattagcagcaagattgtagcgccaagtttctgaggttgaatgggatggcattctttttttagatatgcccaagcaaggtctatgaaatcaggcatttgaaaaaggcattttgcacagtgatttacatgaacaggcgagaagttccaatatcggggttctgacagaatgcaagataccagcttaagtgcttcattttctgaagggtcttgtgctgtgctacaagatagtggacgaagtgcaacatgttggctggatccactttggctgggtctgagggagcatgggccaagatcttgggggctcggctgtgtggtgcaacgggcagcttgcttgcatactggtgatcgtggatgcttgtgatatagcattgccccccaatgtataagtgaacttttagtgctagaggcttccttttgttggcatgatgtctatggtttataggtgcagtagttgcataacacatagtatactcagtatactttgtgtggaagctattgatgcttttctttttgtttaggcatgaatgccatataattgtacattgaattgacatattaagttattgctaaaacacactccagtgattttaaaaaaaaaaaaaaaaa

SEQ ID NO: 11059 - DNA, 2113 bp, Zea mays
atacattaaattatttaaaaaataccgatgcgcaccacgcgccggaacaaaaatatcccacccaaacaactccaccctaccgcaccccaaattcgcaatccctctccacctctcctcccaccgcagcagcaggcaagcgcgaggcggaggcggagagatggagtcggaccagggcaagctcttcatcggcggcatctcctgggaaacaacggaggagaagctgagcgagcacttctccgcctacggagaggttacgcaggccgccgtcatgcgcgacaagacgacgggccgcccccgaggcttcgggtttgtcgtcttcgccgaccccgccgtcgtcgaccgagcgctgcaggacccccacaccctcgacggccgcacggtcgatgtgaagcgggcactctcgcgggaggagcagcaggcctccaaggccgcaaaccctagcggtgggaggaacactggcggaggaaatggcggcggcgatgcaaatggtgctcggacgaagaaaatattcgtgggcgggctgccctctactctgactgaggatgggtttcggcagtatttccagaccttcggcatcgtcactgatgttgttgtcatgtatgaccagaacacgcagcgcccccgtggcttcggattcatcacctttgactcggaggacgcggttgaccacgtgctgcagaagaccttccatgatcttggtgggaagctggttgaggtgaagcgtgcattgccccgtgaggcgaaccctggtggctctggtagtgggcgttctggggtgagtgggggttaccagagcaacaatggccataacaccagctctggtagctatgatggtagaagtgatggtggcaggtacgggcaggcacagcagggtagtggtgtctatcctggctatggtgctggggcagctggatatggatatggtgctaaccctgcaattggatatggaaattatggggctggaggatatggaggtgctcctgctgcttatggtggacattatggaaacccaggtgcagctggttctggttaccaaggtggacccccaggctcaaatagaggaccttggggcagtcaagctccatctgcatatggaactggagggtatggtggcagtgctggctatagtgcttggaacaactcttctggtggtggcaatgctcccactagtcaagcccctggcggacctgcgggctatggaagccagggttttgggtatggtggatatggaggtgatccatcgtatggtagtcatgggggatatggagcttatggagcgcgaagtgatggtgctggcaatcctgctactggtggagcatctggatatggtgcagggtatggaagtgggggtgccaactctggctattcaagtgcttggagtgatccttcacaaggtggtggatttggtggttcagtcaatggaggttctgaagggcaatcaaactatggcactggctatggcagtgtgcagcccagggttgctcagtaaagaaggcattttgagtgtctgaaatgaaccagcacatctgggcagtctatgtattgatttgtcattccagttctgatttgttctcagcattctgaagattgcccatttgctggttaaatcagtatttctccgggttggaatgcttgatcctttagtggcttactactagaacttgtagtcaataagtagctataatgtggagtagcagtatcttgcagaatgcttttattaatttctacatttagctttatctatctgtgtgctttgccatgagtggagtttcaggttccttcatctctagttataagctagagtagcttgactgcttatggacaaaattatctagttgtacctctattctacagatcatacattcgtgtttgatggtagtatttatgctggatattgtacctctattctggaatgttctatatttggtggttgtattgacatatggtattatcaacattcatggtttgaaacagatgcaacccctgaaatatgcagtcataaaaaaaaaaaaaaaatagctgcttctaacattatgttcaaactgtagtgcaagtgtttatatagctggaatgctacatccttcaagtatgtcatcaagctatgaattccatc

SEQ ID NO: 11060 - DNA, 2848 bp, Zea mays
taagcaaagggcgatgggcaggcagacccgcgcggccatcctcctctagaaccttccacggccccacctcctccttcgttcctccgctcaccccaaccctcctcggcgagtcggctcctccctccacgcctctcctcgtcgacgagcggacccggtccacgcccccgacccccacccccgtccccgacccctccccgccccgctccctcccgatcccagatcccgccctccgatccggccgcgaccgtggtgggttcggtctccctctcatcggggcatcagccatggatcagagccggcgggcggtggattcgtactggcgatcgcggatggtggacggtgtcacggccgacgacgacaaggtcgcgcccgtctacaagctcgaggagatctgcgagctcctgcgcgcctccgacgccagcatcgtcaaggaggtcgccgatttcgtcctcaagcgccttgacaacaagagccccctcgtcaagcagaaggctttacggttgatcaaatacgcagttggaaaatctggtactgatttcaagagggagatgcaaaggcactcagcggctatgcgccaactagttcattacaaaggccaccctgatcccttaagaggggatgcccttaataaggctgttcgcgaaactgcgaatgaggctatagctgcaattttctccacagaggaccctaaacctgctgttgcaaccgaaagtcttggcaagcgcatacagggctttggaaatactaattacgagccatctagagatgacaagaagtctttccttagcgagcttagcgaggtagtgggtattggaagtgcatccattaagcaggggttgagcaactttgctgcagcgcatgcaatgatgacaaatgacaatggtagcacatacaggagccctaatctccgtagatctttgaccacggaatctgaaagatatggtcggtatgatccaagtgaaattcaacgtgagagccgagcctcatctgatgcttcaaagaatgcaccttctggtccttggggtccaacttccagttctacaccaactgatgaaactagctcaagtcaaccagggattaagactcgtgaagaaagacttctagagacaattgttactgcaagtggtgtgcgattgcaaccaacgcgagatgctctgcaaatttttttcgcagaagcttccaaattggatgcagttgccttgagccgtgcacttgagggcaaactgaattctccattatggcaggttcgcatgaaggctatttgtgtgttagaagccattgtaaggaaacaggatactgatccttactctatcatcgcttcatatttcactgagaacacagcttctgttgttaaatgctctgagctgccacaggtttctctcagagagaaagcctcaaaggtcttgaatatgctgattggggaacaacctaccggaaccgcagcaacaaaagctgcgatgcccacacctgttcagatgcctgatttgatcgatacaggtgatcaagatgatctggcaacaagttctggacatgcaagcattgaacagaattctgggaacagtgcatatgtttcttcagttgatgatttgcttggtggtgaacctatttctgatacaagtgtcactgctgatagtaatggaagcgacccatttgcagatgtatcattccatgaggcagagactaaggagactaatgatctgttctcagggttgacagtagaagagaaatcatcaactaccatgcatgatagttcttcggacaaaaatgaattaccagatatctttggcagctcccctgattctttcaaccagggtagtgttactgaccaaggaactgtcaatgatttgattgctggcttgaaccttaatggaacaggccatgctcagtctgcagttaaagcagaacccaatagcaacagtggttcacagttctttgatacaaaaaatgagtccggccatgtgccaagtgctgcaacattgaatgacattcttggtcaaaactcgctttaccaacagcagcagactccattgcagtacagctttcctcaacatatgatgctcaatcaatcatttcctggacaacaattaaattatggtgccatggggattcttcttgctcagcagcagcagttactgcaaagttttggaaatttcaatgctggacttgggaattcttctttcaattcgatgaacggtgggaatacatctgtgcttccagatattttcaattcaagtaatcaacctcaaaatcatgttgcagtgatgagcagttcgaagaaagatgacaataaagcttttgattttgtttcggatcaccttgcagcagcacgtggttcaagaaagtgaaacaggaagcaatgaacatgtccagatgctggaaagagctcaagtatttgatggacacaatagctgggaattccaaaaactgcatctcgtcacagcctcgcagattggatgcgtgattcacacggctggtttggcattgtttgaacacatgagaaggaagggttgttccatacggttggaagacgagatgttgcgttgtgtactatgtatttagacgaagactgttcttttttacgctgaaaaataaattgcatcttccgtctttctttgtgttgtgctccttttctctatcctttttcttttctagaaaaaaaaagagtgagacactatacgtgtttgttacctgcaggttttatgtttcttttctgtacaagtatatggaggatttttttggtggcaattgtaaagctttggaacgtgaataagagggtgcagtatgatatgtgctgctacatgatcctggcaatgctgcctcgtgatattgctcgtgtatgtttactctt

SEQ ID NO: 11061 - DNA, 831 bp, Zea mays
cgggcgctcgagccggcctggcagtaacataaccacaaccacagccagcaagatctagtcaaagaaacacatcaatccagagcgtccaccagagtcactaacttgtccagccgcagcaatggcggtgcggtggccatcgcccgccgtggccgcgttgtggatcggcgcgagcctcctagtcctgtgcacgctcatggcgtcgtcggcgtcagcccaggcgccgccgccacaggtgcgtaaggtgcccaagggcagcaacctggtggtgatcaagccgggggtcgggaagcgcaacagcaagttcacctgcaccgacaccaagaagaagcggcccgggtgcgaggccacctgccccagccgctgccccaaagagtgcctcgtcctctgcccatcctgcatgaccttctgcctgtgtgacttctacgcgggggcgtcgtgcggcgacccgcgcttcaccggcggcgacggcaacaacttctacttccacggcaagaagaaccaggacttctgcatcctctccgacgacgacctccacatcaacgcgcacttcatcggcaaccacaaccccgcgacgagccgcgacttcacctggatccaggccgtgggtgtcatgttcgcccaccaccgcctccacctcggcgcggtccgctccgcccactgggactccgccgtcgaccacctcgacctcgccttcgacgacgagcgcatcgaccttgctcccgccgacggcgcacgctggtcctccgcgtccgtgcccgggctctccatcacccgcacggcgcaggctaacaacgtcgtcgtcgagctcaaaggggtggttccggatcgtgg

SEQ ID NO: 11062 - DNA, 3484 bp, Zea mays
  misc_feature (1657)..(1657): n is a, c, g, or t
ctggtggcccatgttagcaggttattgttacttcatcaccctcctgagtttaatgagaatgtttccatagttgttctactgacattttctacatgtttatgattcggcagctctcatgtacgtccttgtaccaatgccatgcctgttttttggtggtggatccacacacttcttgaccagcagagaaggtggagggtaagtttgttagaaataaaatccagcactgtgtccgtagtgctggggtgtacgcgtgtgtgcttgcatgtgtcatgtgtgtgcatgcagccgttagatgctcttgggtgagtctattaagccgacgcgagaaggccgctgtccgtgtgtgcacgtcgtgtgcatggggccgggtcgtacgcccaacgtggcaggaagtttaggcgtgagggcgcgagtcttcagagttgcgtgcgtccatcttatgcggatcaaagtccgtcttatgcggatcaaaggcttcgtgccatgcaagcaacttaggctatttaaactcctgtaagcatcggcaagcatttaaacaagagaaaactggtgttcgagcaccagggtgtttgtgcgccaaattcttgcgtttagctactgtgcttcttctacctacagttctcttcctgttcttcacatctgagtggtagtagattccaacaaagttcagtgtccgatgctcttggttacctatggaaatgtacaattcacagatataaataatagaccactgagtgaatattacttcgtatatatactcaacagtttcattcatatgatcatatcctgtgctatatcacagtgtgatactgatcagctgtggtggtaataatttcaggtggattaatgctgcaaaattcttgactggtgcgtcggccatgggaagccttgctattccagcaattctgaggcacgctggcttaatcgagaccggggccatgttcatcgagttcacgtccttcttcatccttgtatgcacagtgctgtgcttccatagggcgactctggatgaagactggtaaatgcgcatttcaccgtcaccctgaaccctagcggttcttggctgcttctgtccatgctaagaaaaattcctgttggaagctaacatggatctgtacaaagaagcgtatttcgagcgtagccgtagctgatgtcttatgtagacacttgtgaagattatgtggtcatgtggcaatgcagatgttattaccttcactttgactttgtcgtcacatgttctatggtgaaggaaggaatcatccgtgtaaaccatggccagggcacgccctacttggctcctaattctatcgcaggctttggggttaacctattatgaatggaataataggatcttgatgaccgaaagaaaagggagagctaattagtcacatggctcggccgatgtatttttttttcatgtttgcattcatgaatctgtctaggatattacatattgtggtctgaatctttataaatcacttgttttgcggtctgaatctttataaaaaaaaaaaaaaactcctggttctatctctagtttcatgatcttgtgagagggaccttagtgttgttgtgcgacaatattttctaggtggatataaaactcatcaaatcgtgaaaattagttcaaccctaacatcagtttatttcccgcttnccttcgtttttcatgttgaagaaatccgcgagtcatcagttcgacatcattttgccgtgctatttggaaacccatcagccatggaatcgcaacccgcttccattcactcatttccctttcccacatggaagaaatttgcgagtcatcacaccgagagcattttcccttccctgactccaagtcaagattaaactcagaataactcaatgagttttacccgatataaaagcgggataagatgatttcttaactcgcgggtatgctaatacacaagaacctgtacccatcgggtagacgggtacgagtataagtgggtactacacatgcctgtatactcatgagtaaaatatacctgtgtcatatcactatttaccatgtaattaaagttgtcttagctaaaataaaatacttcttcgcttattgtttgtttacctatcaaggatataatcatctggtttgttgtatttcaggtgaacttatttttatgtgtttgtttgacattttaagtgattgacacattagtattttagacttttctagcgagtacgagtaactcgtcgggtaaaattacccgtgtgggtactagtatgagtaagtttctatactcgtgaccttatatgggtaatccaactgataagattttttttgacgggcataggtataggatgatactacccgacgaatatatactcgttgccataaccaaacctttctctccacccgaccttcctctctgtcatcctatctccttgctcatcctcgctctctctggtgtcccctccctgctcaaactctctatcctttgtggtggctgtaagcatctgccctatctagtgttttggtttaacaaaaataaatatagactaaaagtttcatttgaggacatgagatttaggttaatccatgataaagatggagtgtattagattacatggagttatcactagtttatataaggtggatagcttaagacaaaggtatttatagggttttagatataaccagtcaagaggtgattagaaatcatattaaccaggttaatatgatagatagtcgtgctatcaagatgtactatcaagatggaacaaagtattttacttggtcgatctatagtgtctcatggatcactcaattgagacttgcaattttcaaagaaaaagtgtgacaataatgcttctttgaaagagagatgaattgtgagctatgtattgtccgactcatagggcatatttcccactggtctaactagatgatggccaaaaatataagtttctgtcttaaatagagttgattatgataaactctctgattttgatcggtggacagtcctccgatctattgtagtggaatacataaacttagaagttcctatgttagaatttttctttgttggaagactgttcgagaccttgggtggattattcgtcatacttattctggtggtagacttaaacttgaaagtttatatatggaaatgttgatttgttggtgcactatccaggcccatggattggattatctgggccacttggggtggattgtcggccatactttatatagtggacgacaaaacttggaagttagtgtgttggaaagtttcttcgctagcaaactatccgggactagagatggcattgggaaattttatgtcggaagttaactacccatccccatcctcgtccccatcaacttcaatgggggagaaatttccccatctctgtccccgtttgggattttttcccgtgggtctcctcctcggcttaaaatagcatgtattgagcccacttgtctttagaccattgcatgacatcacattataaaatagca

SEQ ID NO: 11063 - DNA, 961 bp, Zea mays
  misc_feature (6)..(6): n is a, c, g, or t
  misc_feature (933)..(933): n is a, c, g, or t
ccgggnccgggacgaattttttccccaaaaaaaaaagtcttgagtcccccctctccttccccttcccaacgctctcgctgcagaggaaaggcgaagatggcgatgaccgtcgaagtgcttgctgcactcgcgttcatgttttccacgagtattctactgcagatactgaaggcagcatgaaattgcgatgctattattgtttgtcgcttcttcaatgttggatttcattttatggtacaggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaagccttgctattccagcaattctgaggcacgctggcttaatcgagaccggggccatgttcatcgagttcacgtccttcttcatccttgtatgcacagtgctgtgcttccatagggcgactctggatgaagactggtaaatgcgcatttcaccgtcaccctgaaccctagcggttcttggctgcttctgtccatgctaagaaaaattcctgttggaagctaacatggatctgtacaaagaagcgtatttcgagcgtagccgtagctgatgtcttatgtagacacttgtgaagattatgtggtcatgtggcaatgcagatgttattaccttcactttgactttgtcgtcacatgttctatggtgaaggaaggaatcatccgtgtaaaccatggccagggcacgccctacttggctcctaattctatcgcaggctttggggttaacctattatgaatggaataataggatcttgatgaccgaaagaaaaaaaaaaaaaaaaaaaaaattaattaaactgaaaaanagataaaaaataaatataaaaggtctta

SEQ ID NO: 11064 - DNA, 1102 bp, Zea mays
  misc_feature (1052)..(1053): n is a, c, g, or t
  misc_feature (1055)..(1055): n is a, c, g, or t
  misc_feature (1058)..(1059): n is a, c, g, or t
  misc_feature (1064)..(1066): n is a, c, g, or t
cattgggaccctcgaggccggccggggtccctcgaggccggccgggacgggacgaatattatctcaaaaaaaaaaagtcttgagtcccccctctccttccccttcccaacgctctcgctgcagaggaaaggcgaagatggcgatgaccgtcgaagtgcttgctgcactcgcgttcatgttttccacgagtattctactgcagatactggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaagccttgctattccagcaattctgaggcacgctggcttaatcgagaccggggccatgttcatcgagttcacgtccttcttcatccttgtatgcacagtgctgtgcttccatagggcgactctggatgaagactggtaaatgcgcatttcaccgtcaccctgaaccctagcggttcttggctgcttctgtccatgctaagaaaaattcctgttggaagctaacatggatctgtacaaagaagcgtatttcgagcgtagccgtagctgatgtcttatgtagacacttgtgaagattatgtggtcatgtggcaatgcagatgttattaccttcactttgactttgtcgtcacatgttctatggtgaaggaaggaatcatccgtgtaaaccatggtcagggcacgccctacttggctcctaattctatcgcaggctttggggttaacctattatgaatggaataataggatcttgatgaccgaaagaaaagggagagctaattagtcacatggctcggtcgatgtattttttttcatatttgcattcatgaatctgtctaggatattacatattgtggtctgaatctttataaatcacttgttttgcggtctgaaaaaaaaaaaaaaaaaaaaaaaaaaaaaaaaaaaaaaggacaaacaatataaaaaaaccaaanntnacnnacccnnncaaaaaaaaaaaaaaaaaaaggggcggcccctttaa

SEQ ID NO: 11065 - DNA, 2228 bp, Zea mays
cccacgcgtccgatatgctggtgatgatggggctgatgatgaggattctgaagaggactccagtgacaatgactttggtaatatgtctgctagagattgggagcaaagtgatgatgatgaggtcgatgtaggagacgatgaaatggaggatttcaaagagaaggggcaagagatcaatgacaaagtggtgaataaagatgcacacaatttgaaaggagaatctaatgtgaaaccacaagtcaaggatggcggtattccttttgttattgatgcaccaaatgacctgaaagatctatcttctttgttagatggtcgttcagaagccgaaataattgagattattagtcgaatacgtgcttgcaattcaataaggcttgcagctgaaaaccgaaggaaaatgcaagttttctatggtgttcttctgcagtactttgcagttttagctacccaaagtccagtgaagttcagaataattgacatacttgttaagcctttaattgagatgagtggagaaactccatattttgctgccatctgtgcaagagagcgacttattcatacacgtacccgtctatgcgaagacattaaggttccagggaagagcagctggccaaatttgaagacattacttctgctgagattatggtctcttatttttccctgctccgacttccgccatgttgttacaactccattgcttctacttatgtgcgaatatctgatgcggtgccctatacaatctggtcgagatgttgctgttggttctttcttgagttcaatggtgcttgtggttactaaagaatctaaaaagttctgccctgaagcaattggtttcctgcaatctcttttggtaacatcacttaaaggaaaagtggaaactcatctgcacaatcagattaacgatcaatttatggagctcaagactttaaaactgtggctcagtatccatgaccatgtgcatgaggtgaatccagtgaatatcctagaaatagttggcatggatcctgacgccccttatttctcatctgatactggcagggctggtgtacttttatctgtggcagaatgtttaagaggttttgttattatacatgaagggctatcttctttcccggaaatcttccttccaatatcctctttgctgcaagaaattttggatagatctgagttgcctggatcgttacaagacattttccatgaagtcattgacttgatcaaaaagagaagtgatgaacactatgcttcaagggagcccctccgaatgcggaagaagaagcccgaaccaattaagcaattgaatccaaaatttgaagagaactacatcaagggtcttgattatgatcctgatcgagaaagggcacaaatgaagaagctgcggaagcgtgtcaagagtgagatgaagggggcgaagcgtgagctgcaaaaggataattatttcctgtctgctgtgaaggagaaagagaggaggaagcgagatgaagagagagctgagatgtatggaaaagccatggcgttccttcaagaacaggaaagtgctttcaaatctggacagctggggaaaggaaagggtaggaaaaggatgcggtgatactctattgcaggggggcagctcggccagtgtaaatatacgggattgtgtttgctcaccctcttcccgcggtactggagggtggatccagctgattactgtatcgtgagctgctcagagtttgtcgtgcctacaagagcagggtgggcctagtcttatggaacatctccacctgcttactcctaaagctttgcctataaaattgtaacgccacaaacactttacaaggcttctccttggtgaactaccacacctgggaaatgctttatttcttttgtaccgtggagtggcttgcatctatgttatatactggtgccatagtaattttcagaagcacagtgaagagtttttattattttcatttttgttgtactctgacatgtgagccctataagtatggcaattttggcacggttttgcagtagaaaaataaatactattactgttctatgctgggtgggaaaaaaaaaaaaaaaaaaaaaaaaaaaaaaaaaaaaaaaaaaaaaaaataaaaatataaaaaagaattaaaaaaaaaaaaaaaaaaaaactgtgggggggccccccatttttggacctccctaacccggaatttatttcggacccggtccctgaagggttcccacttttccttttaggg

SEQ ID NO: 11066 - DNA, 1503 bp, Zea mays
acctcgagccggccgggacactcctccccgtcgccggccctgctccccctcagcacccgcgagatcttcagctaccgatctctccggtcgcgtttgcatccgcattcctcagatccagattcgaaccccagccccgcttcgagatccagctagctctcatccggcggagcgagcatcgggaggctcggcaagagagaagatgaagcggaagacgcggaacaagatcatcgtatggacgctggccctggctgcagtggcgattctggtgggcggcacgattgcgctggtgctcacggcggggacgtggaaggccaagataaagaagtcgcaggagaagatctgtaacaaggggtgggagtgctcggggagcaagtactgctgcaacgacaccatcaccgactttttcaaggtgtaccagttcgagaacctcttcgccaagcgcaacacccccgtcgcgcacgccgtcgggttctgggactaccaggccttcatcaccgccgcggccctcttcgagccccaggggttctgcaccaccggcggcaagcagatgcagatgatggagctctgcgccttcctcgggcacgtcggcgccaagacttcatgtgggtacggcgtggcgaccggcgggccgacggcgtgggggctgtgctacaaccacgagatgagccccgaccagacctactgcgacaagacctacacccagtacccctgcgtcgagggcgccgagtactacggccgaggcgcgattcctgtctactggaactacaactacggcgctgccggtgacgggatcaaggcggatctgctccaccacccagagtacctggagcagaacgcgacgctggcattcatggcggcgatgtggcggtggatgacgccgatcaagaagagccagccgtcggcgcacgacgccttcgtgggcaactggaagccgaccaagaacgacacgctcagcaaacgcctgcctgggttcggcgccaccatgaacatactctacggcgagtcgatctgcggcaagggatacgtcgacgccatgaacgttataatctcgcactaccagtattaccttgacctcatgggcgtcggccgtgagcactctggcgacaaccgtgattgcgccgagcaggcaccgttcaacccctccagcccgacggatgaccagaagcagcagcaatcaggaagctaagacggacggactcattgcgccattgccactgatcaagcttccacagcgctagattgagctacagattcttcaggatgcgtgaagctgcatgcatcgtgttgatgttgttttgaatagactgtatgtactgtctatgtgaattgcgagatttgtggttatttactaccatgttgtccatagataagtctgttttggtttctttggttctgtcagatacgttatacttatacacatgtttaaagagaactgaacataccaggaccctttttccgcttgaaaaaaaaaaaaaaaaaactcgagggggggcccggtacccc

SEQ ID NO: 11067 - DNA, 1630 bp, Zea mays
gggtcgaccccgagttgccgcctgcccgggcgcgtctcccccctgacagcctcccgccgccgacacccacctctctccccgtcggcacatgtgtagttgccacttcgctttcccgttctctctcaccttacctcacactcctctccatcgattaatctcctcccccctcaacaaccgcgagatcttcagctaccgctctctccggtcgcgtttgcatccgcattcctcagatccagattcgagccccagccccgcttcgagatccagctagctctctatcaagcatccggcggagcgagcagcggggggctcggcgagagagaagatgaagcggaagacgcggaacaagatcatcgtatggacgctggccctggctgcagtggcgattctggtgggcggcacgattgcgctggtgctcacggcggggacgtggaaggccaagataaagaagtcgcaggagaagatctgtaacaaggggtgggagtgctcggggagcaagtactgctgcaacgacaccatcaccgacttcttcaaggtgtaccagttcgagaacctcttcgccaagcgcaacacccccgtcgcgcacgccgtcgggttctgggactaccaggccttcatcaccgccgcggccctcttcgagccccaggggttctgcaccaccggcggcaagcagatgcagatgatggagctctgcgccttcctcgggcacgtcggcgccaagacttcatgtgggtacggcgtggcgaccggcgggccgacggcgtgggggctgtgctacaaccacgagatgagccccgaccagacctactgcgacaagacctacacccagtacccctgcgtcgagggcgccgagtactacggccgaggcgcgattcctgtctactggaactacaactacggcgctgccggtgacgggatcaaggcggatctgctccaccacccagagtacctggagcagaacgcgacgctggcattcatggcggcgatgtggcggtggatgacgccgatcaagaagagccagccgtcggcgcacgacgccttcgtgggcaactggaagcccaccaagaacgacacgctcagcaaacgcctgcctgggttcggcgccaccatgaacatactctacggcgagtcgatctgcggcaagggatacgtcgacgccatgaacgttataatctcgcactaccagtattaccttgacctcatgggcgtcggccgtgagcactctggcgacaaccgtgattgcgccgagcaggcaccgttcaacccctccagcccgacggatgaccagaagcagcagcaatcaggaagctaagacggactcattgcgccattgccactgatcaagcttccacagcgctagattgagctacagattcttcaggatgcgtgaagctgcatgcatcgtgttgatgttgttttgaatagactgtatgtactgtctatgtgaattgcgagatttgtggttatttactaccatgttgtccatagatagtctgttttggtttctttggttctgtcagatacgttatacacatgtttaaagagaactgaacataccaggaccctttttccgcttgaaaaaaaaaaaaaaaaaaaaaaaaaaaaaaaaaaaaaaaaaaaaaaaaaaaaa

SEQ ID NO: 11068 - DNA, 2347 bp, Zea mays
  misc_feature (1988)..(1988): n is a, c, g, or t
ttttagtaccataactttgatgataataatatatattatagtagtacaaataatctatgattttttaaaatttcgaaaacttatgaaaaaatgtcaaataactgaattatagtataaggggaagctcgatagggtaaatgtttggagtcgtcgatatggggggagaattttttgcgtgatatagtaaaatataatagaaattatggataggagaaaaatctggtgagaatggttggaaatagttcttatgggcataaaaaactatgcatacttgttcaataaaaaaatgacgtaaaggaacgttccgggcgtatgcagatcacatgcgcctcaccccaccttcactcattttcagcgtaagcaaagtgcagaaaaaggaacacagaatattattccacacgcggcccaacctccggtttctgaacctgggtgtagtgtaaagtttcagtgttccactctgccggaaaccagcaaccagagccccctgttttcctctcccgccgcgtccgtccactccttccacgctgccgccaactgcatcggctaccggcctgctgccgggcatatataagtcccctccccttcccgccggacctgcgcagtgcaaagcgtcaacgcaaacagaccaagatccagaagcaagaaagtgtttatagcctagccggtgcgcgcgcgagagggatagccgattatcatcaagctctgagctagcagagaagatgagcgcatcgtcgtccatgaccaagaaggcgtcgtcgttcgtggtggcggcgagcatgagcgcggtggaggcgctcaaggaccaggcggggctgtgccggtgggactacgcgctccgctccctctacaaccgcgcggccgccgccaataaggtcgtcgccggccgcgccgtcccgttgtcgttgtcgtcgtcccaaaccgcgggtggcagtggcagcgccgcggccgccggtagggccgccaggcccaggcgatcggaggaggagaagatgcacaaggcgtaccacctcgtctgctggggccctaactaattgttaggggcattctcttattaattactcctttatacacgctgtccgattcctccacttcttgttcgtacacatacagagatgtatctgcaaattttgtatgtgtaatccgtcctctggtggtttatgccacgagaattgcttattattgttgggtgataaacaaatggaaatgagaaattttgtgatgtgattaaaaaaaaaaaaaaaactctcccattctcgctaatctcagaccgaccgtcttacgcgcgttagcactggttagtggagcagctgaactggactctaggagtgaggaatcatatgaaaattaatactatctttattgtcgaatatttatcatccgctaatttatttttgaaccaaaccatgacaaataaaaaagaatgaatggagtatttcttttttttatgtggtttgtgcctgaggtgccaaagacatgatgatgggtacagcgctgatgaatgatgaacagagcagggttaaacaaaccgtttttaaactaaaaaccggtcttcacaaaaaaggtaaaccttcccggtctcatgggctgcattgagcggtaggctctctgtcgggcaatgggcttggccattgtgaagaccgagtgaccgactgatttatttatttttccttaaacttttaaaattgatttatttatttttccttcgacttttaaaattagacatcttacccatcagcactcaaaagtcaaaaccatgtagattctctccgtgccaacaattaaaagtcttttttcaaggtcatttcatcatgttttagttttcaaggtgattccatcctcttttagttgaaaaaactggtgaatatttgctaaggtttttcaaccacgaaaaatatgtttgaaaactttagagtttattttgaataaacttagatatagattaggacaaaaaatacaaataatatatttatagcttatcatattgtctnaaaaagattttggtcttagaaaaggtaaagtatttagaaaaatctagaatttttttaacattataatagatgacaaagaaacaaatttgggtttttttcaacaaaaagatgatatgcggccattaggaatgcattcaacaccaaataattttgtttgcattctagcttattgcatccattttttcccaaacattttatatttagacattagttaaaatgttttgaaaaaaatccaaaactttttggatattttcgcgtttttctcgagctaataattttggaatcttctaaagatattttcaccagttctaaatttgtgttcattttttgtcgcggtccatttctaggatttttcatag

SEQ ID NO: 11069 - DNA, 1931 bp, Zea mays
cattgggtacctcgagaaggattctatactattgcttgagtgtcgccttgttcaacttctcgaccaaggcagagagagctttcatccggcagccgctgagcctgagatccctgcaccgcctcccgcccgcccgccggaatggagttcgccttagtcgagagtgaatcgttctctccttcctgccccacgcttatcatgccagcgctgtcgattggcaacgtggggcagctcgccgtcgaccttctcatatcctcgtcgagggcgaggcgggtggcctacctcgacgagccctccgtgctgccctgcgccggtaacgacgccttcggccctgacgccgtcggcgacctcgcactcgctctcgaagcttatgaatctacatctcataagctgggtttcattcagcaaaggtctccagttactacaggaatgatggtttcatttgcaaaaaatgttgctgatttcataagcagcatcgggaagaaccatattgtcattatatcaagtttagattctggaaagaggagagtgattgatgcatccagtgacatgcaggtgtattacctttcaagttgcaatgaagatggttctgatccagaatatgagaaattggggtggaaaaagcttgaggattacgatccatctcagaaacgttggaattatcttgctagcctggttaagggtggtggtctttcagaagatatggatgatgatactgatgagatgacaataaatgattactatgcaagcttgccatttgcagcactattctctgcctgcaaggctaaaggcttgaaagtttcttgtgtcctgtgctactgctcggaaggcgacaacatgccagaatctttccagttagctgaagcaatatgcaaacttctaggtcatggccctgagaaattccatggaaatgggtcaaatgggtggatcgttcccttgtcatggaaatcagtttatggaccaccacctgatatgtctatcttttagtgttgaattatgatcaggtgaagttgccatcacggaaaatgctgagtagaatcgaggatgttgaactcttaatttagacagtgtaccagaagtatccaggagggtgagttgcagacgtttgtagtcagttggtaaaggattactaaacactcaaggatggaacttctgcaggcaccatgatacttaacccttaaatgcatgaatcagaatatttttgtaactggtactgtggctactaagagtcagatctttgtcaactcaggtctgctaggtgcttacgcatgttgcttaccatcataccatgtgccgtttccattctaaccatggaattccaagcttctcgtctgccgttttggcagttttgcccatttggtttggttgattttgatgtggtggaagaatctttgctagtgcgtacccctttatgaaaagttgctactgaatggtggaactgttcggtgaggcaattccgtcggcgatgcctggttgtctgttcattttagttgcctacccgaaggtacggtatggaatcgttacgcttttaagcccagtacgtatgacatgtgactagaaggggagttctcgccttctcggtgccctgttacatggctcatggctggttgctactatttcaagaggtggccattcggcctctgtcggcagctgggcaaagctgtctagcgcatcaacgccctaaaggatatatgccttattttaagcgcaggaaccttttcccaatcacaagcggaaatcgtatgttttctgatgcttaatccatgcactccatttgaaattatgggaacttttttttagattcattgttttattatgtacttgcatagatacataatatattctagatataaaataaaaatattgtatctagaaaaatcaaaacgtgtcttatgaaaaaaaaaaaaaaaaagggcggccgccaccgcggtgga

SEQ ID NO: 11070 - DNA, 1040 bp, Zea mays
accgcgtatcactcctatgggcgattgggactctcgaggccggccgggataaaaccctactaaccgcgtctcctctccagcgcccgccgtcgccgccgccctcctcttggtcccgccgtccgtcgaggtcatcatggtgagggtcagtgtgctcaacgatgcgctcaagtccatgtacaatgcagagaagaggggcaagaggcaggtcatgatcaggccgtcgtccaaggtgatcatcaagttcctgacggtcatgcagcgtcatggatacattggcgagttcgagtacgtggatgaccacagagctgggaagattgtggtggaactgaacggcagactaaacaaatgcggtgtaattagcccccggtttgatgttggggtaaaggaaatcgaaggctggactgcgaggctgcttccgtctcgccagtttggctatatcgtgcttacaacctctgcgggaattatggatcacgaggaggcccgacgcaagaacgtcggaggcaaagtccttggtttcttttattaattaaagggtcgtccgagtttcttctattaaatggtgggtcgaccgagtttttgtttttgtttttggtctgaattgaatagagtgtttgcttcgttaagactggaatgtgttatgtgcctttgttaagactggatcactggaatgtgggaatctttatgagtgattcggcatgtaaaaaaaaaaaaaaaaaaaaagacagaaaaactctgtacaatgtaaaggtgtgatgcatgaaattaagaacagaatctgaacatcttgtctagtctggaaccattctgcttaaaacaaacatggggattccagatcaatttcctctgaaccagaaaatccatgccggctgacctatcatccatataagatatggatcaggtattcaggtgtatttgtatctgacagattgatctacatcatctagtgagaggttcaagctgcacctccattacaccagtagcgctagattctgaattcctggctgcaccatcaggatgcaaaagatcaactgaatcctcct

SEQ ID NO: 11071 - DNA, 810 bp, Zea mays
aaagtttggcttgggctgtgtcacaaattatacctgtctattgtaaaaaaatgtacactgtacaatgtaaaggtgtgatgcatgaaattaagaacagaatctgaacatcttgtctagtctggaaccattctgcttaaaacaaacatggggattccagatcaatttcctctgaaccagaaaatccatgccggctgacctatcatccatataagatatggatcaggtattcaggtgtatttgtatctgacagattgatctacatcatctagtgagaggttcaagctgcacctccattacaccagtagcgctagattctgaattcctggctgcaccatcaggatgcaaaagatcaactgaatcctcctcctcggtgttgcctaatacccagtgccctctggcacttctgtcaccgatccttcttttgacttccttatattccaagcacagcacaacaacgataactgaaagcacccacagcattaaggcccaagtgagctcctctacattctcactgtcatacctatggcctaaatgcttcattcctgtgaaaagcgccacgattcctacaataactgccgacctccctgtgataacatgcaggtactcccacatgattcgattgtgagatggaacctcaccggtcgcgggcgtactgggacgaaatttggcatttagtggctgcagaactgccaataacagggccagcacaccaaacttaacatgcactgagctgacaaagaagccacggagctcagccgcagcgaaaaggacgccaagaaacattatagcaattcctgaatactgcagata

SEQ ID NO: 11072 - DNA, 811 bp, Zea mays
attgggtacctcgaggccggccgggcagaaaaccctactaaccgcgtctcctctccagcgcccgccgtcgccgccgccctcctcttggtcccgccgtccgtcgaggtcatcatggtgagggtcagtgtgctcaacgatgcgctcaagtccatgtacaatgcagagaagaggggcaagaggcaggtcatgatcaggccgtcgtccaaggtgatcatcaagttcctgacggtcatgcagcgtcatggatacattggcgagttcgagtacgtggatgaccacagagctgggaagattgtggtggaactgaacggcagactaaacaaatgtggtgtaattagcccccggtttgatgttggggtaaaggaaatcgaaggctggactgccaggctgcttccgtctcgccagtttggctatatcgtgcttacaacttctgcgggaattatggatcacgaggaggcccgacgcaagaacgtcggaggcaaagtccttggtttcttttattaaagggtcgtccgagtttcttctactaaatggtgggtcaaccgagtttttgtttttgtttttggtctgaattgaatagagtgtttgcttgttaagactggaatgtgttatgtgcctttgttaagactggaatgtgggaatctttgagtgattcggcatgtaactaactggaggccacgagacagtttgacgcaaggcctatgacccccttggaggagagtggcgatcataacaaagtcagaccagattcccacattcttctttactcgtcatctgctaatctcttacctaagcacaacattttccggcc

SEQ ID NO: 11073 - DNA, 1692 bp, Zea mays
gattgatgcaacttttcacagcttcattccaaatgaataatcgagtaaatcaagcattaggaaaaccttttttttttttttttagcgtttgtcagagcagcgcctgactcttttttttcttcttctaataagcacattcagatccagataagaacatcacatctctcagtcatctacattgcagctttcaccaaaggtgagtgtgttttgacatattgtgccatgtgctgatgtgcatgtgtttaacaaaattagggggggaaagggatggcattgcaccatatattatcaggattcaatcagaaaggtaaggaaccggcagccttgtgtaaaacctggtatgcattccactgtatcatccactcatcttccatgttaggcaattatcatgtatcaaagtcagctggaatggaaatatctggcaaacaaaattgtgagccaaatttataacaggttaaaaagcagcggcataggagtcccagtttggtatgttggctgttgcttcattgaccattttcacaagtgtcaccacactttgagctacaccatgtggtggtaacggcaaatttctaggtggaggtttgtccgtgtatgatctcttgtcaaatctccattcaccaattttgccataagtcagcttacccgtcatgtcataatcacacccataagtataatgaataataaaagaatcaccaacttccaagtcccaaggtggctgaatcataaagtccttgcgtaagatgttgcccactccatggagagcagatgccacggcataggcatacatttcaagaacccagccaaaagatttatctgcgtcaggatcttttttcattgctaatgaaacattcatccaagtcggtgcaatccttccaagagactccttctcaataatgacaggagagtttcctataggatcgatcttagtgattgaccccttgtcttcagggaagaacttacgcaacacattctcatattttttaggctcaatgtaaaagaaaggaaaagctgctgcctgaccatctctcgacaagtttgggataggcttgacaattatgtgatctggctctgccatcaaaatatagtcttcctttatgtctgctttctggagccactgaacaaatgcccatggcctattgagaacgatgtatccctgatccccatcggggagtgggtcggcgacgaatgtggggatctcatcgacgaactcgtcgggtttcccggagtgcaggatcctggtgaacccgcccatctcgtcgccgcccggcgcccggcgcgcctccttgaaccagtggtacatgacgcggcactgccacgtgttgtacgcggaccctgacgcggtcaccgcggtgtggaacgccctccgcctggcagaccccgcggcgccgaagcggcgggaggcggtggcggtggggaaggaggaagggaggggctggagggaggagtggaaggagatgagcacgttgtaggtgaggaacgccgcggagagagccacgaggaccagcgtcagcgtgccgccgccgcggccgcacggcgcggccatggcggggcgcgcgggcgaagggacgggcgctcttgattgagggagaaggcggcggaagtgacactgaaacggcccagtcctgactcccgagtgtgcagtgtttggcagtttttttttcgattaggatgttctaggtaatggtctcgtgc

SEQ ID NO: 11074 - DNA, 1938 bp, Zea mays
  misc_feature (1866)..(1866): n is a, c, g, or t
aagggagcgacgttttataaccacgaataaattttaatattagcaatccaccgtgttcagctgatgatgaataattacatctctagttggcctgatatgggattgtagccggacgccgccttcatatagcggccgtcaggaaccccagcaagcaacccagccgcccattgccggcattgctcgcagcgctagcttcttgcgctcatcagtcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcgtcccgcccgcggaaccccgtcgccgacatcatccgctacaactcgacggacgtggccttcgcgccgtacggcgagtactggcgcacggcgcggaaggtggtcaacacgcacctgctcagcgccaagatggtcttctccaagcggcgggagcgggaaggaggaaggtgcgcctggtggtggcccggatccgcgacgccgccgaggcgtccccggggacggcgctcgacatgacggagctgctgggcggctacgccagcgacttcgtgtgccgcgccgtgctcggcgagtcccaccggaagcagggccggaacaagctgttccgggagctgacggagaccagcgccgccctcctgggcgggttcaacgtggaggactacttcccgaagctggcggacgtggacctgttcctccggatcatctgcgccaaggccaagggcgtcagcaagcggtgggacagcctcttcaacgagctgctgtccgagtacgcgctctccggcggcaagcagggcgaccacaactctgaagacttcgtgcacctcttgctgtcgctgcagaaagactacggtctcaccacggataacatcaagggcatacttgtggtaatatatgctactacgtactagctgtcatgtctgtctgtctgtctctcttctcagtgtctttggttttacagaacatgttcgaagcagccatcgagacatcattcctggtgctggagtactccatgagcgagctgatgaacaaccgccacgtcctggccaagctccagaaggaggtgaggacggcgacgcccgacggccgcatggtgatggaggaggacctgagccggatgccatacctgaaggccaccatcaaggagtccatgcgcatccacccgccggcgccgttcctcctgccgcacttctccacccacgactgcgagatcaacggctacaccatccccgccggcacgcgcgtcatcgtcaacgcgtgggcgctcgccagggacccgacgtgctgggacaaggccgaggagttcttcccggagcgcttcctggaacaaggccgcgacgccgaggtcgacatgtacggcaaggacatccggttcgtgccgttcggggcggggcgcaggatctgcgcgggggccacgttcgccatcgccaccgtcgagatcatgctcgcgaacctcatctaccatttcgactgggagatgcccgccgagatggagcgcaccggggccaaggtggacatgtccgaccagttcgggatgacgcttcgncggacgcagaaactttaccttgttcctagaaatcccaaatgagtgtcgtcgtcgtcgtacaaatggcatgca

SEQ ID NO: 11075 - DNA, 3714 bp, Zea mays
  misc_feature (5)..(5): n is a, c, g, or t
gaaanttatatgtaaattagatagaattctacataaaaattttgttgtggcacaccctatgtaaaaatcctaggtccgccactgactccgactcccaagacaggccgcacatggccacaggaactcgatgatgcctacacccaaacacccaacacacaaagaggaagaccacggtacgctgtcgttgccaagtctcaacatactccacgcgaggctgctccgattcttcgccatccagtcttgatgcttcgcccccttcagtttttgcccaacctcccaaacaatcgagtccacgaagaagggagtttaattttgcctcatgttatcattgccgagccataacatcatcttacgtagcagcttcgactttacgatacacgacccaatctccacccacatactgggcgccgagaaataaaagcatcaaccaaaggcaacgtcgtggctgagaccaacttcagcccagcagagactggagggagcgacgttttataaccacgaataaattttaatattagcaatccaccgtgttcagctgatgatgaataattacatctctagttggcctgatatgggattgtagccggacgcgccttcatatcattgggtacctcgaggccggccgggaacccagccgcccattgccggcattgctcgcagcgctagcttcttgcgctcatcagtcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcgtcccgcccgcggaaccccgtcgccgacatcatccgctacaactcgacggacgtggccttcgcgccgtacggcgagtactggcgcacggcgcggaaggtggtcaacacgcacctgctcagcgccaagatggtcttctccaagcggcgggagcggggaggaggaggtgcgcctggtggtggcccggatccgcgacgccgccgaggcgtccccggggacggcgctcgacatgacggagctgctgggcggctacgccagcgacttcgtgtgccgcgccgtgctcggcgagtcccaccggaagcagggccggaacaagctgttccgggagctgacggagaccagcgccgccctcctgggcgggttcaacgtggaggactacttcccgaagctggcggacgtggacctgttcctccggatcatctgcgccaaggccaagggcgtcagcaagcggtgggacagcctcttcaacgagctgctgtccgagtacgcgctctccggcggcaagcagggcgaccacaactctgaagacttcgtgcacctcttgctgtcgctgcagaaagactacggtctcaccacggataacatcaagggcatacttgtggtaatatatgctactactagctgtcatgtctgtctgtctgtctctcttctctcttctcagtgtctttggttttacagaacatgttcgaagcagccatcgagacatcattcctggtgctggagtactccatgagcgagctgatgaacaaccgccacgtcctggccaagctccagaaggaggtgaggacggcgacgcccgacggccgcatggtgatggaggaggacctgagccggatgccatacctgaaggccaccatcaaggagtccatgcgcatccacccgccggcgccgttcctcctgccgcacttctccacccacgactgcgagatcaacggctacaccatccccgccggcacgcgcgtcatcgtcaacgcgtgggcgctcgccagggacccgacgtgctgggacaaggccgaggagttcttcccggagcgcttcctggaacaaggccgcgacgccgaggtcgacatgtacggcaaggacatccggttcgtgccgttcggggcggggcgcaggatctgcgcgggggccacgttcgccatcgccaccgtcgagatcatgctcgcgaacctcatctaccatttcgactgggagatgcccgccgagatggagcgcaccggggccaaggtggacatgtccgaccagttcgggatgacgcttcgccggacgcagaaactttaccttgttcctagaattcccaaatgagtgtcgtcgtcgtcgtacaaatggcatgcatcttattgtaagttttggagtttgttgttgcacacgcaacgatggaccgcctgtgatatctttaataaatgtaaccgcagataataatgaaataaaaagaacgcatggctattgtattattattcccatgagttagatggaatcagtagatgtgttacttactagtctttggcttgcttatgggggctccttaatcaaattatgttaggttcaattgtagatttctaaaactcttatttttggctatgcgaggaagctgttgtgacctgacggttgtgagatagttgaaagttgtgtggcaacatagcgggacggatgccgtccgagactctcggatgagccaattcatacatagcgccctatacgagaggtgtgtatggcggtgtcagcacataaaacaataggtgatgcgccatcgtcctcgtcctccatgaggatgggccctcctagtttcaaacatcaaagtggaggttggagagtgctgagaaacatgatactccgtatgtggttgagcaacgtggatgttgggcgatgagaagcactaaagggtcgatgaggaagagatacgatagtttagggatgactaagtcatgtcaccgacctctagagtcggacacagagaggcgaaaggcaaatctagtcaccgctagaaggtgtcatcaggtagagggcctccgaataaaaataaaacgatttgatcctgtaaacaatggcaattggctaatattatgaaaatgttggatcacaagaatctgaaaatctaaggtaagagaagattctagactggaatatgtagattttcaagaatctattcagttcatgtagccctttagttgagattctagattttttgactgtgaatctagcttagaaaagcgaactaaacataccctcactagatgttgcttgttgttctggtagctgagatccgtagtaatgtatctggagataaggacgttagatctgagatggatggtcacgatttaatatgtgcagcaaaggctcatgtactcctcatattccccataaataaatggcagatgttttgatgtattactcttccgcttccttgaatgtcggttcattatggttgattttttagcgaaaggtcaccaagggagatataatagttttctactcataccaagattaagcaagtgcaaaacaccgaatacaaagtggagagacgaggattataaaactaataaaacaataacatggtgtagatataggttcaacctactatctagagctagtgtgagcactaggttctagatttgtgccaccactaatgacaagc

SEQ ID NO: 11076 - DNA, 2073 bp, Zea mays
  misc_feature (2064)..(2064): n is a, c, g, or t
ccacgcgtccgagcagagactggagggagcgacgttttataaccacgaataaattttaatattagcaatccaccgtgttcagctgatgatgaataattacatctctagttggcctgatatgggcttggggcccctcgcggccggcccattgcgtccctcgcggcccgccggcgggaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcgtcccgcccgcggaaccccgtcgccgacatcatccgctacaactccacggacgtggccttcgcgccgtacggcgagtactggcgcacggcgcggaaggtggtcaacacgcacctgctcagcgccaagatggtcttctccaagcggcgggagcgggaggaggaggtgcgcctggtggtggcccggatccgcgacgccgccgaggcgtccccggggacggcgctcgacatgacggagctgctgggcggctacgccagcgacttcgtgtgccgcgccgtgctcggcgagtcccaccggaagcagggccggaacaagctgttccgggagctgacggagaccagcgccgccctcctgggcgggttcaacgtggaggactacttcccgaagctggcggacgtggacctgttcctccggatcatctgcgccaaggccaagggcgtcagcaagcggtgggacagcctcttcaacgagctgctgtccgagtacgcgctctccggcggcaagcagggcgaccacaactctgaagacttcgtgcacctcttgctgtcgctgcagaaagactacggtctcaccacggataacatcaagggcatacttgtgaacatgttcgaagcagccatcgagacatcattcctggtgctggagtactccatgagcgagctgatgaacaaccgccacgtcctggccaagctccagaaggaggtgaggacggcgacgcccgacggccgcatggtgatggaggaggacctgagccggatgccatacctgaaggccaccatcaaggagtccatgcgcatccacccgccggcgccgttcctcctgccgcacttctccacccacgactgcgagatcaacggctacaccatccccgccggcacgcgcgtcatcgtcaacgcgtgggcgctcgccagggacccgacgtgctgggacaaggccgaggagttcttcccggagcgcttcctggaacaaggccgcgacgccgaggtcgacatgtacggcaaggacatccggttcgtgccgttcggggctgggcgcaggatctgcgcgggggccacgttcgccatcgccaccgtcgagatcatgctcgcgaacctcatctaccatttcgactgggagatgcccgccgagatggagcgcaccggggccaaggtggacatgtccgatcagttcgggatgacgcttcgccggacgcagaaactttaccttgttcctagaattcccaaatgagtgtcgtcgtcgtcgtacaaatggcatgcatcttattgtaagttttggagtttgttgttgcacacgcaacgatggaccgcctgtgatatctttaataaatgtaaccgcagataataatgaaataaaaagaacgcatggctattgtattattataaaaaaaaaaaaaaaaaaaaaaaaaaaaaaaaaaaacgaaaaactccgcgggggggngccggtacc

SEQ ID NO: 11077 - DNA, 2930 bp, Zea mays
  misc_feature (102)..(102): n is a, c, g, or t
tatttgatgcaggctgtcaattggtcagcctactgacgacgacgacattgacagcagcttttgggtggttaattaattattagtcatctccgctactctttnggctcctaattttgaatcgtgctcgtgttggtctataaagtccatcgtgcttgtgttggtctataaagtccgacggtccgacccatattatcagcactactcacggtcaccttgaaatgataagcgtcttctcttctccgtccacaccaacagaagaagagaacttccgtgaaaattcttccttggaagcaatgcaaggagagccacaggctcacaggcgctttatagctgatcgcacgcacacgcatcggctcactgtttgtctgctaattatactcccatcaatcctacccatcgtaacaaccaccatcacacttgcagcagatctgggtgatgaatcctgtgcacgcaaacgcaggtttactacctgcagacgtgcaccatgcatgatgcgcaccggaggccgattggttggtcccctgcgcaaagaaggcgcaggcacgtccctccctccctcctttccacgagccgcttttccccgcgtcgccccgccggccggccattccagctccctttcgctttcgctgagcgagcctgcgctttgccgtctcggccggcacatacaatacagctacagctacagctacgaactgcaccgccccggcccagtcccttccccttttgctttggtgaaatcatttcctccctgccccgcctatagggacactagtctttataggcggatcatgtggcctgctgctacagagtgcgtgcatgggagccagccacttccaacatgattctgggattattttttgtaccagccttgcagccttgccatcgcatcaactgtccaagagaagacgagagtgtggcagcctttctcgcggcactctttttgttcctcccactttctttcttctctctctcccactcgctagctccctccatccacattgccaccaccagatcagctgagatctcactttcggatcagctcagtcactggctttaaatagagaggcagccgagctggacgtcttcttgtaggttcttcttggcacttggcaacgacgacattcaccactgtcgacgacctttcgtgaccatcccagtcccattcttgccttgtgttcggttcaggactcgagacacacatgagcggggtactcgggcagaggccgtcgcggccgtggccgccgggggaccccgcgtccacgccgccgtcggagcccgccacagccgccgcggacgcgggcgcgaggggcgaggcgtccgcgctcagggacctgggcacgtccatggacgccatctccttcgggttcgcggccacggccatcctcatctcgctcttcctcctcatggccatcttcgagcacctcatcaagccccgggccttcccgccggactcccccgacgacggcggcaggcggccgcacgctgaccgcctgctgcacggccgcctctcgcctgggaagcttcggagcccgcacatggtaagactaagccagccaagcttggcaatcaaccaccgtccacggccctgtttttgtcgcgtacgtgacgccgtgaaatgcattgcatttgcggtgcatgttacttgctgggactggtagtctgggaggcagtgggtggagtcttggcgcgtgctctggctgtttctgatgcgaaaatcttggcatgctttggctgttccaggtggaggcggtgctgcaggcggcggacctgtcggtgctgatgccggggcagcggtacccgacgtacctggcgcaaccggcgccgctgccgccgccgtgctccagggaaggcgtgcactactggccaccgcatgaccaccacaacgcgtacatgccgccctgatctggtcctccacggccaccacgagagcatgcatgtttccaccgtacgtacgacgacgcgctcgttcatcgcgcttactatagttttgaggggttgtatattcagttgttcaggtgatcgcgaatccgatatggacgtcctgtccttgctgcctgcgctctctctctctctctctctgtccttgtcagtgtgcactgtgccgcttcgctttcagatgccgaattcgccaaagtccaggcgcaaacgtccaggtttaccggcaataatcagggccgagaacatgcatgcagctagctgttcttcgatcgctaacaagcttaacagtggtagagcgataccggccatccaaatgatggcgccgagaatatgcagccgttccgtcgctgacagcttaacagtgtgttagaggtcatccgaattccaaacttagagcatcttttagagtctttttaaaactagttctctagatcatcatcatttattagagaaccatttatataaaaaccgctttctatatatatcttttcctggatactttagagagttatcctcgttatctatctttggctagctgacgaaaaaatatgtatgaaaaaaaaatatgatggctatatattcagacaaaaccgttgcgcagtgtccccagtactcccactctaaaatctttattcataaccattagaaaccattgggagattcccaaaagtgtctctcttatgatatgtgtatgtaggtgcagcgccagtcgctagcttgcttatgccttttgcatctagctagcatgtaaccaccgatggccactcttgtctgctcaagtttgtgccatgattgggacgtgtgcagagagagtgttcccacgcgaccacaagcacagagcgtgcattgccatgcatgtgctgatacagttcacaacgtaggaaggctcgatcgatactactggcaccataccatacctggcataccatgagttcattcataccataccatgagttcattcatgacccacacgagcacgcagtacccctgca

SEQ ID NO: 11078 - DNA, 753 bp, Zea mays
gtaggttcttcttggcacttggcaacgacgacattcaccactgtcgtcgacctttcgtgaccatcccagtcccattctcgccttgttagttcggttcaggactcgagacacatgagcggggtactcgggcagaggccgtcgcggccgtggccgccgggggaccccgcgtccacgccgccgtcggagcccgccacagccgccgcggacgcgggcgcgaggggcgaggcgtccgcgctcagggacctgggcacgtccatggacgccatctccttcgggttcgcggccacggccatcctcatctcgctcttcctcctcatggccatcttcgagcacctcatcaagccccgggccttcccgcccgactcccccgacgacggcggcaggcggccctgaccgcctgcacggccgcctctcgcctgggaagctccggaacccgcccatggtggaggcggtgctgcaggcggcggacctgtcggtgctgatgccggggcagcggtacccgacgtacctggcgcaaccggcgccgctgccgccgccgtgctccagggaaggcgtgcactactggccaccgcatgaccaccacaacgcgtacatgccgccctgatctggtcctccacggccaccacgagagcatgcgtgtttccaccgtacgtaacaatactgtttttatatataaatctagttaattttaaaatttattaactctcaagaaaaaacgagacacgtatttttttttgaaaaaaaaaaaaaaaa

SEQ ID NO: 11079 - DNA, 1900 bp, Zea mays
ggctaatgctgttctgccgtgcctcatgtgcactaaagccactgatgatctaccttcttctgagattgcattctaaagattgtaataccataatttcaaatagctgtccccaccccctccttgaaatattgatgtgtactttatatttctttttatttgacctcagttattattttataggttgttcaaaaaattggtgccttatgtgtgaacttgagcaatatgcttcaactttacgtgaaagtggtggacccttatctccaagtagaatcctttctaatctgaggaatattggatgtcgcttgggtggtggaactcaggaagatgcccatgagtttctaaggcatcttgtgatgtctatgcaagcagcttgcttggatgggctgggtggtgagaagcacgttgaaccaagtttgcaggaaacaacactgatacaacagatgtttggtggccgtcttaaatccaaggttaagtgcctcagatgctatcacgagtctgaaagatatgagaatataatggatcttactttggagattcatggctgggtagagtccttgcaagatgctttgacacagttcactgctcctgaagatttagatggtgataatatgtataaatgtggaaggtgttctgcctatgttaaagctaggaagcaactgagcgtgcatgaggtgccaaacattttaacagttgttcttaaaagatttcagtcaggaaaatatggcaagatcaacaaatgtgttactttccctgatatgttggacatggttcccttcgtgactgggtctggtgacaatccccctctttatttcttgtacgccgtggttgtacatgtcgatacagaaaatgcatcattctctgggcactatatatcatacgtcaaagatatgcagggtacatggttgagaattgatgattcagaggtccaggttgtatcagtgaatcaggttatgtcagaaggtgcatacatgcttttctacttgaggtcttttccccgaccaccaaggatatacatcgagaaggggctgccggttacatccgcaaagcggcacacgtcgaaatcttccaagggctctaaacacgatcgcaagcagacagagttactctttcctgcaaacgatcaggcatatggcgtctatgatttcagacccgatggcgaaggctatgcccaagatcagcatgcagagctgaggtccagagctttccatcacgccgacgatgcctttgcagactcggttagcgcggacttctcggaagcgacatcaagtgaatggtcgctgtttaccagctccgacgagtcctcgttcaccaccgagagcacaagggattcgttcagcgtcgtggactacggagacaacgccggcctggatccgatttcctccatattcgggccaagctatgctccggagcacggtgctcccggcagtttcgtctcgcgcacaaggttctcaccttccagtccacagacaaggtacttctcggagagcacaggctttgtctcggactcttccatgccggcccacccccacggcattgtacatagaggaaggtatccggatagtagggcgtgcgcctcttctgcggaaccgcttgcgtcggcggcgcatcagcggagcgggtatggccggtacccccttagtcgagatggttttgttcaaacatctggtttttgccaaatgtaatcggctcacatttcattagctgtagctggtgcatcggcagttgcggttcttagccactgccgttaatgctgcctcatgttcttttatttcagatgaggcttattgaatttttagctacatgtcgtttctaggggtagctcgattcgatgtagcgaaaaaaagttagattatgtctatatgcaggtgaaattttagagcatggtgacaagctctgtggc

SEQ ID NO: 11080 - DNA, 2378 bp, Zea mays
caggggtcctggacagagaaaaataaagccagcaagagttggtggttttatttatgacggcaatgaagttgatttagatgcttcaaaggatgcagacttctcgatggaaccatgctcaaaatcaaagaagaaatctttgaaaaagactgtaaaacccagggatgaagtggttgctgtaaatggacgaaacagcacagggaatgttaaagcatcattgtcctccaatgaacaaaacaaatctcttcctcttatcacggcaaaacagtatgcctgtcgtgctgcacatttgtcttcccttgtagtttcatggtctccagttgtgtcattaagtgatagaacttcttgtttattgaggcattggtgcattcttgctgttggctctaaatctggaaatatttctttttggaaactatataagccagaatattacacaatagatgctggagtggttaccagtgatccgatgctcatcggggtttggcatgctcatgaatcatgggtcaatgccataacttggcaagttctttctgcgggctcttcaaaatcctcgttgcttttagctactggatgctcagatggaagtgttaagatatggttagggaatattgaaggggtctaccaatgtgcaattggagaagaagtgccatttgtgttagttgctgaggttgccgctaatttatcagctccagtgtcgtcaatctcattgggcatacctgcccggtctcaacatgaggttagtttggcaattggaagagtatccgggttactagaaatatggatatggaatgcatctaccaacaaaattgagagttccagtgcatggcatgcacatgatcaagtggtgacaggtttacgatgggctatcgatggcaattgttttattcagctgcagtcaggacaattctacacgttgttggatatctcacgaaaaccaccttgaagaattttttttgcattcagaattttcagagctaagggagtcagaagatctatcaaaagtttctgatcgatgctatggtcttacgctatcacctggagaagagataattgctgtggtccgcagtttggatctgaaccttttgaaccagatgtatcaagtcaggacacaaaaggcggtggtcgagttcatttggatcggtggccaatttgttggtattccactggacgggagtatcgatatttgcagtccgcagtctgcggacttatcctcaagtaaccttatgtggtggggatccaacatcttgtggtcgctgaagaaatacgaaaatgtcgaaaagaggcttgtgttgtgggacgttgtagctgcgctgcaagagctgaagaaaaccgcgcccgcctttctggagactctagtgcacagttgggcctcagctttatttgcgggcgactcacagtgtgtttctatcactgcccagtcatcacgctcgatgcatgacatgatgccccatgtcagctcgcggaagctgcacttactgaacataatctgcagaaaagtgatgctcggcaatcatgcgcggcatggtcctggtgctggaaacaacagtaatgatggaacaactgatttctggagcactcttttggtagcgagtgaaacggagctgcgagagaggctggtgggtttcacctttgccgcggtcgtgaaacggacagcgtgtctgttcaacggcacctccaccgcaaattgctggttccctgtcggcgtcgcccagatggattcttgggtatccatgaactacgaaaaggtgcacggtcagctgcagtcgatcagatcgaagatcaaagagctaggaagcaggatcgacggatactccgacgtagaaagctgcccctactgctcttcgccggtccgtttcgagtcgcctgacgtggccatctgcggagaaaggcacacgctgtcgcggtgcaggacatccatgaccctgtgctccgtcgcgcagccagtgtggcactgctcgtgctgcgggggcacggtcgacaagctgctgccggagtcgttcttcaccatgcctttggacgccgtccgtgacgacaaaggatcgctcgatctgtcggcagcctccgccccgctttgccccttctgcggcgtcctgctgcagaggtcgatgccggcgttcctgctctccacctcgccggtatagtcttcggatgcccccaggtgttacatgcagtagcaatgcaatgggaatatcgtagtggagccaactaccaagtttgttgtagctgatgctgtatggctgcagagtggcagtgccgtcattggggctcgaaatgtttgtgataggttttgtgacttctttctgcttagcccctctaatatatctcgagatacctattttttaaaaaaaaaaaaaaaaaactcgaccgtactctgccactgc

SEQ ID NO: 11081 - DNA, 2458 bp, Zea mays
ttgtgaaaagtactggggttcttgtgctacaaaatctccttgctttaatataatatttagaattaatttcggtaatcaaaacaacaggacacaaaaggcggtggttgagttcatttggattggtggccaatttgttggtattccactagacaggagcattgatatttgcagttcacagtccacagacttatcctcaagtaatctcatgtggtggggatccaacattttgtggtcgctgaagaaatacgaaaatgtagaaaagaggcttgtgatatgggatgttgtagctgtgctgcaggagttgaagaaatccgcacctgcctttctggagactctagtgcatagttgggtctcagtgttactttcgggcgacccccagtgtgtttctatcgatgctccatcacgttcaatgcatgacatgatgccctatgtcagcacgcggaagctacacttactgaacataatgtgcagaaaagtaatggtcagcattcacacacatcatggtcctggtgctgaaaacggcaatgaggaaacaactgatttctggagcactcttttggtgaggagcgaaacagagctgcgagagaggctggttggcttcacctttgctgcagtcctgaaacggacagcgtatttgttcaatggtacctctactgaaaattgctggtttcctgttggggttgcccagatggattcttgggtaaccatgaattacgacggacaagtgcttgcccgcctgcagtctatcagatcaaagatcaaagatttaggaagcaggtgcatgcatttttccatctcgattgatcaatcatctgccatccagttccatctaactggttcctcaaagatcaaagatttaggaagcaggatcgacggatactctgacgtagaaagctgcccctactgctcttcgccggtccatttcgagtcgcctgacgtagccatctgtggggaaaggcacacactgccgcggtgcagggcgtccatgatcctgtgctccgttgtgcagcctttgtggcactgcgtgtgctgcggaggcacggtcaacaagctgttgccggagtcgttcttcaccatgcaggcgtccaccatgcatgatgaaggatcgctcgatctgtcagcagcctccgtcccactttgccccttctgtggcatcctcctgcagaggtcgatgccggcgttcctgctctccacctcgccggcatagaggctctctgtggatgctagtaggcatccaccaggtgtagcatgcagtagcaatgtagtactagtaaagtttgttctagtcgatgctgcctacactcagttactcttaccaagtatggctggcagagtgtcggttactggtcattttttaggtcccttttgaatgaatacgatgagttcttttgtttggtttcttttggaccctgacggtggcagattaccaggccaagttcagctatctcgaattgtctcattcgattggtgcggacatgcagttctggcagttccaattggttgttgcggacatgcagtcctgtcagttgactcagttccaagtgtacgtattttgcttcgaggctttcccagagcagagcacgtgtcgatggatgtagcggccggagaacgtgaacgaggcaaaacaacagcgaaaaccaatcccacctgcgccctcggcgacgacgtgctcgactgcttgtgcacatcctcgacctgggtcaccacgctctttctgtacgcgcacaaccttgtcgcgccatggcgatggatcacctggaaatctcgcttttatcgcaattcgcaagtcgtagggggatcaaaagcacgacgaaagtgggcctgtacaggttggcttcacggcccaatcaaggaagccggactgttagcattatctacagttttagccaggtctaaacaagagtattcagaagaggctaaccattttccattagtgccatattgcttgctctgcataggtgagcaaaggctctggcgttcttagtggccggcagctacaccgtttcagctcatacagctgcgtgacgagcgcagagcgaactattctttcgccttttactaaagaataccgtgcgcttgtcacataaagcagcatacacttatttttgaagggtgctgtcgtcctgtacggtgcccaacaaatttaattaaatttgttttatttttatccaaacttattctactgtaagtgtgctctcttgcagattgaaaaaaaatcagaatgaccaaatttatatcaatttctttaaaatttactacagttggctaaagttgggcacattattaaaaatcagggtgatccaaacgttcattgtaaacaacagttatttagcatctggctcataataaaataccaggaagcagagtaaaaaaaatagatattaagctagactcatcatataaatcaaagtaaaaatagatatttaaggctcatcgtaaaattagcattattaaggct

SEQ ID NO: 11082 - DNA, 1009 bp, Zea mays
  misc_feature (983)..(983): n is a, c, g, or t
attacccttctcagcacattgctattgtgtattgcaaaattttggaggctttggactaaaaaagcttcgttttttcgagcttgctcctcccccgaaaaaaaaatcggggcccaaaaagttcgcaattctgggggctcccgtggccgcaggtccgcccgaattagcgcgcctctcggagatgatcctgcgccggcaaaggcaatgaagatctctaatctggatgcacacttaatcttgtccagctcttgatcagttgatcttgtgctttgctgctcctgctcaagttaatttgttggccaatcaagttcagaggcgcagatgagtgaggagtacaatatggatgatgccctaaaagccaaaaatgttgctgagaccaagttccatgcccgtgacatcaggggtgctcggaagtacgcactcaaggcccagaatctctgcccgacacttgaaggcatattgcagatggtctcaacgcttgaagttcatcttgcagctgagtccaagattgatggagagagtgactggtatcggatattgtctctaggcgcctttgcagatgaagaggaggtgaagaagcaatacaggaagctagctctgctgctgcaccctgacaagaacaaatcagttggtgctgaggaggccttcaaactgatctctgaggcgtggagtgtgttgtcagatactagcaggaaggtggtttatgatgagaagagaagaaatcattctgttgtcaatgtaaccaatggtatctatacttatgataagaaggcaaacaagagggctcgaaagaatgccgctgctgcagctgctgccgccgccgctgctgcagccgcagctgagactaccactcatcctgttggggttgatacattctggacatcttgcaaccgctgccggatgcagtatgagtacctaagaatttatcttaatcataacctgctgtgcccaaattgccataatgcattcttggcagtggagactgngttcccatgcaacggaagcagttcat

SEQ ID NO: 11083 - DNA, 6200 bp, Zea mays
  misc_feature (1995)..(1995): n is a, c, g, or t
  misc_feature (5829)..(5829): n is a, c, g, or t
ctgcagttccataaccgcaagagcacatcattacacccctcaccatttttgaagtgtgataacgttctgttacagactctaggtgcctggagatcttcagggcaggctacccttatgttggtccatatcatctgctgtcttctgggtgcagcttcaggtcaaggctgtgggttttttttttgcaagttcataaggcaaatcctcatgttctttactttgcaagctcaaacaaatactccatatcacgtatgaaccagttgcaggaatcactctgtctgtgaattgctgttaatactggcagaagaaatgtcaaacagtgttagtacttgcccttagatattttgtgctagtgctgtttattttattattgtattccttttttcagataccagtacagaagaagaaaaaaaagtgctggtgagtgatgatgtagagaggaatgcttaaagaatagtaacaaggggagtgggtcccacacttgggaaaagggggttctcacacagccatatgtacacaaggtatcttctccggtggaggggggaaataggagtgagaggaacctttttatggctgatgctgtgattttaaccctaagcattattgcatgggaaattcctgatatgtccctggcatttggttgttctaacatcagcaccaggttacccctactgctgtgattttacacaatagcccctgataaagtgtcacgtacactcgtatataggactagtatatcacatatctgtacgcaagcaaattacctcctgagtgccttttgtatgtccgaagtgatgtgtcccgtggggcccaccaggaggacattagagccatttcccgtattgagtgccctttgtgctgggctcaaacctccagctaaaacacaaatcatggtctctaaataaattcggcaattatctttttttgcttttatacacgcgtatttttgtgaaacaaaggaaaaagttggaaatcccgagaaagcccctgagttagggattgaacccgttgtttggggctgcactgttaccagaattaatttgaggcgccgaataggggcaaagttcgaaacttttggagcaaacaaaaaacagagatggaataatttatttcctttttacaggacacacatgacctgacctactctttttctactcctactgctgctgcagcagctacattacccttctcagcacattgctattgtgtattgcaaaattttggaggctttgactaaaaaagcttcgttttttcgagcttgctcctcccccgaaaaaaaaatcggggcccaaaaagttcgcaattctgggggctcccgtggccgcaggtccgcccgaattagcgcgcctctcggagatgatcctgcgccggtgagttcccagtagatccctcccgctgtcagcttctggttgaggtgcgtctcgccgccggccgcggcctggcgcggcagatctggcgggtgcctagggtttgggtccggctcgccgggagtccccgattcgtggcctcctggaaccggtggcggcgctgggttagttccttgtcttcttgaggtcgtggatcacgcggatcgaggcgtttcttggctcgattcgtgctgggggttttgcgaggtgctcgtgaactggtttcaaggtgccttctaaggggcttggtttgtccatttcgctggggtttttttttttgacatgctattgcgggtgggttcaagatttgtggactcgcgtagaaagtttggatcttttgttccacttgctcttatgaaagacacgatttttgttgtgggtattgttggagttgcgtgatctgcttagcttagcagctgcaggcctgcgatggaatgctgagtaaggatgctcgggagtccgaatttagtgaagtgaatctcagtgccgcttagtggtttgatgggagtgcatgctctgtccgagctgaagttaatactgtgaaatgtcagttctctatgagatagaactatcgatgagtatggttttactnaagcgctcacttctagattattttggatctgaaatgattagttcaaacgtggtagcttacttttctgggacttcttcagtgcttgtttacatactgcttggtttctcacttcagtgctcttattcagtccttttgtaatatgtactgttgcatcacagagttctttcattttgatgttgttgttgagatttctaacctagttgtacttaactgcaggcaaaggcaatgaagatctctaatctggatgcacacttaatcttgtccagctcttgatcagttgatcttgtgctttgctgctcctgctcaagttaatttgttggccaatcaagttcagaggcgcagatgagtgaggagtacaatatggatgatgccctaaaagccaaaaatgttgctgagaccaagttccatgcccgtgacatcaggggtgctcggaagtacgcactcaaggcccagaatctctgcccgacacttgaaggcatattgcagatggtctcaacgcttgaagttcatcttgcagctgagtccaagattgatggagagagtgactggtatcggatattgtctctaggcgcctttgcagatgaagaggaggtgaagaagcaatacaggaagctagctctgctgctgcaccctgacaagaacaaatcagttggtgctgaggaggccttcaaactgatctctgaggcgtggagtgtgttgtcagatactagcaggaaggtggtttatgatgagaagagaagaaatcattctgttgtcaatgtaaccaatggtatctatacttatgataagaaggcaaacaagagggctcgaaagaatgccgctgctgcagctgctgccgccgccgctgctgcagccgcagctgagactaccactcatcctgttggggttgatacattctggacatcttgcaaccgctgccggatgcagtatgagtacctaagaatttatcttaatcataacctgctgtgcccaaattgccataatgcattcttggcagtggagactgggttcccatgcaacggaagcagttcatcattctcctggtcaaccaagcagcagccacagcagaaccacaattcaaccaagcattcatatggctcaacaagcaggacttctagcatccctgggacagggcatggggggtaccagcaagataatgcttatgattcctacaacaatcaaggcttccagtggaatcagtactccaagacaacacctgcagcggcgacccttgcggatggtacacatgccttggagaaacagagaaagaagcatgatgagagctacagctacaactattctgaaagcggcaacttatatgtccatgagaaagctgcttcaaggcgtggtcgcttctcaaagcggagaaggcataattacgatacttacactactgtggattttggtggcgacccccgcgttccagttgccgcaagcacagaaccaactgctgttttcactgatgtgggacgggtcaacggtacttcagcggaaaggtttagatctgcagtgagtggaagaagagcaaatgttcttggtgagattacccagattgatacacgaagtctacttcttgagaaagccaaggcaactgtccgcaaaaaattgcaggagttaaacattacatcatcttcacgatttgcagagagaagaggatctgaaggaaagctaaatccttgtggcaacaacataaaggtcaatggtgtcctctctgacaaacctggcaagggagtcaagctatgtagctcaagaagcatagaaatccaagtgcctgatactgatgacaagaatccagagcagcgccgtgtacctgtgtcaattgacgtcccagaccccgacttccatgatttcgataaagatcgaacagagaaggcatttgacagtgatcaagtgtgggctacatatgacagcgaagatggcatgcctcgcctatatgtaatggttcagaaagttctttcgatgaggcctttccggatccgcatgagctttctcaactcaaagtcaaatatcgaactggcacctataagctgggttgcctccggtttccagaagacatgtggcgatttcagggttgggagatatcaggtcagcgaaacggtcaacatattttcacacagagtgagctggactaaaggtccccgaggcgtcatcaggattgttccccagaaaggggatacatgggccttgtaccgcaactggtctcctgattggaatgagcttacacccgatgatgtgatatacaagtatgagatagtagaagtcgttgatgatttcaccgaggagcaagggctgaccgtcatcccgttgctgaaggttgccggattcaaagctgtcttccacagacacatggatcccaaggaggtcaggaggataccgaaggaagggctgttccagttctcacatcgagttccttctcgtcttctgaccggtgaagaaggcaacaacgccccgaaaggttgccatgagctggaccccgccgcaactccagtggaccttcttaaggttatcacggagctcaaggaagatgcggtgggcgcagactgctaaataggagaagggggcaactctgaacactgaagataggtagctggatgtctggacgatcagatcccacttggttaatgacacggtgcaagcacatgatggtatctaaagctctactacgtcatcttatttttggctgatgacttggacaatactgccagggcaagcagcctgcgtgacggagttctgacccttttaattcttaggcatttctaacatttgatttcatctctacacgaactgattaaatggccattgggaggagactgcacacggcatcatcggtgaggaggttagtcgacgggaggttgtttacttgtttgtgttgccgctctgtaatgtactgtaggaggcaagtctgagtcgagggacaagagctgcaaggcttggcttgcccgtgtaccccgcatttgtgtaccctgtttttttacttgtgatgttgtatttccttcggttttatagtaattcatcgccatgatgttgaacctgataaattgtagactctgaactctggtaaccatgtcggaaaatctagcggctttatctagtggatgcttctgtctttcaccctgcactgtttggttgggtgccatacttggaccaaatcttatacccaagaatgtgattctggtgtcatgtggattgtaccactgcgcagccatgcttgtgtatttatttggttgtgagttgctgctgcccctgcaaatatccaagtagatatgcactcacggcacggtatgatgtgattttctgctgcttggtaggtggtgtggtaaacgaaaatacgaagaaaactaaggccatctttgattgcaatagagttaataattaggtggctaaaacaatattagtgaaattagctggctaataataactagctaatttttagttgacttaggggatgtatgaatgcactagaactaatagttagttgactaaaaattgttgttagaattagctagctaacaaataactacctaactattactaatttaccaaaaatagctaatagctaaactattagatagtgtttggatgcctcaactgattttagtcactaactattagctctagtgcattcaaacacccccttagccggatagttaaagatataactaaggcctcgtttggcagagctccgctccgtaattctctagctctaagagctaattctctaacagagtaattccaaatgattctcgagtagaactgaatttatttgacgaaaactgtttgacaaattatgcgtgaagtgattcctgaggggttggagtgtagggagcatgttgngagcagcgggaagcaggtttttttagctctcattctctagtacaaaatagagactagatttacttcttccacgatggagactagattcactttactttataaacagtgcagtctaaatcgagggagctgtggcggttcactgttgacatctgctagcgagggagcgttgtagcggatgccgttgcagccttagggagcttctgtagccaccacatcaaggggagggggctgtctggcggatgccgctgcggacagcctaacaatgttcgctgtctgctaagctttagggtgtgctcgtcgtccgattggcagacgagcttccgtcctctattgctggttcccccgccttcaatcttccagtgcactacggc

SEQ ID NO: 11084 - DNA, 3103 bp, Zea mays
ctaaaaaagcttcgttttttcgagcttgctcctgccccgaaataaaattcggggccccaaaaattcgcaattctgggggctggccccccgaattagcgcgcctcccggagatccggcgccggcccaggcagtgaagatttctaatctggatgtacttaactgcaggctaaggcaatgaagatttctaatctggatgcacacttaatcttgtccagttcttgatcttgggctttgctgcttcctctcaagttagtttgttggccaatcccggcccgggcccccccggggtgaggagtacaatatggatgtggccctaaaagccaaaaatgttgctgagaccaagttccatgcccgagacatcaggggtgctcggaagtatgcactcaaggcccagaatctctgcccaacacttgaaggcatattgcagatggtctcaacgcttgaagttcatcttgcagctgagtccaagattgatggagagagtgactggtataggatattgtgtctaggtgcctttgcagatgaagaggaggtgaggaagcaatataggaagctagctctgctgctgcacccagacaagaacaagtctgttggtgctgaggaggccttcaaactgatctctgaggcgtggagtgtgttgtcagatactagcaggaaggtagtttatgatgagaagcgaagaaatcattctgttgtcaatgtaaccaatggcatttatacctatgataagaaggcaaacaagagggctcgaaagaatgctgctgctgcagctgctgccgctgctgctgccgctgcagctgaggctactactcgtcctgttgggattgatacattttggacatcttgcaaccgctgccggatgcagtatgagtacttaaggatttatcttaatcataacctgttgtgcccaaattgccataatgcattcttggcagtggagactgggttcccttgcaatggaagcagctcatcattctcatggtcaaccaagcagcagccgcagcagaaccacaattcaaccaagcattcatatggctcaacaagcaggacttctagcatccctggtacagggaatggggggtaccagcaagataatacttatgattcttacaacaatcaaggcttccagtggaatcagtactccaagacaacaactgcagctgttactaatgcttatagtacacaggccttggagaaacagagaaggaagcatgacgagagctacagctacaactattctgaaagcggcaacacatatgttcatgagaaagctgcttcaaggcgcggtcgcttctcaaagcggagaaggcataactatgatgcttataccactgtggattatggtggcgataacaaagaaacagttgctgcaactgcaagcacagaaccatctgctgtttttactgatgtgggacgggtcaatggtacttcagtggaaaggtttaaatctgcagtgagtggaagaagagcaaatattctgggtgagattacccagattgatacacgaaatttacttcttgagaaagccaaggcaactgtctgtgaaaaattgcatgaattaaacatcacaccatcttcacgagctgcagatagaagaggatctgaaggaaagctgtatccttgtgacaacaacataaaggtcaacggtgtcctctctgacaaacctggcaagggagtcaagctatgcaactcaagaagcatggaaatccaagtgcctgctaccgatgacaaaaatccagagcaacgccgtgtgcctgtgtccatcgatgtcccagaccctgacttccatgatttcgataaagaccgaacggagaaggcttttgatactgatcaagtatgggctacctatgactgcgaggacggcatgccccgcctatatgtaatggttcagaaagttctttcaacgaggcccttccggatccgcatgagctttctcaactcgaagtcaaatatcgaactggcgcctataaactgggtcgcctctggtttccaaaagacatgtggtgacttcagggttgggagatatcaggtgagcgaaacggtgaacatattttcacatagagtgaggtggactaaaggtccccgtggcatcatcaggatcgttccccagaaaggggacacgtgggccttgtaccgtaactggtcccccgactggaacgagctgacgcctgatgacgtgatatacaagtacgagatagtggaagtcgctgatgatttcactgaggagcgagggctgactgtcatcccgttgctgaaggttgccggattcaaagccgtcttccacagacacgtggatcccgaggaggtgaggaggataccaaaggaagagctgttccggttctcgcaccgggttccttctcgtctcctgacgggcgaagagggcagcaatgccccgaaaggctgccatgagctggaccctgctgccactccagtggaccttctcaaggttatcacggagcacaaggaagacgcggtggcgcagagtcctaaataggagtgagcgactccgataacagcgaagataaggtagctggatgtctgagtgaccagatccccacttggttaatgacagcgtgccagcacatgatggtgtctaaagctctactacgccatcttattttcggctgatggcttggacaacacttccagggcaagcagcctgtgtgtgtgtgtgacggacttctgaccttgttaattcttaggcattcctaacatttgattctatcactacacaagccaaccgccacgtagattaaatggccattgggaggaggccggccgcgcacggcaccgagatgagatgaggaggttagtcacggaggtagggagggtgaagatgttacttgtttgtgttgctcactctgtaatgtaggaggcaggctcgagccgagggaaagagctgcttggctttgcttgcccatgtaccccgcatttctgtacctgtttttttacttatgatgatgatgatgtatttccttcgtgtcttatagtagtagtaattcacggccaggtaattgtagactctggtaaccgtttcggaaaatctagtgctttatctggtggaaaaaaaaaaaaaaaaaaaaactcgagagtcttctagggg

SEQ ID NO: 11085 - DNA, 2505 bp, Zea mays
ggccgcttttttttttttttttttgggggcgaattgatatttctttcatttgaagaatttgtgcatgcacttaaccaactattatatcatctgaactctattgcgaactatgatgaacacgacaacgccgctttcacgcgtgtcactgttgaccggtggctctaagctctgtgagctcaaaggacatgagcatgacccagccaagttctacgaggtcaaaggccatgacacaaccgatcctcacctgcacaccacctttcttgacaccacgcaagaattgtgtcgccaccaccaacatgccttcaccttcctcgcgtggcccaatgccaagacctccggtcgtctcttcaaatgccaacgcagcgcccatcctcagctgcatacccacaaccaccaccaccagcagcagctgaggatgggcgacgcggccatcgccgccgtgcatttgcatgagtctgaggaggagcacatcttccggagccggttcccgcccgtggccgtaccagacgacgtcaccgtgccggagttcgtgctggcggacgccgaggcctacgcggacaagacggcgctcgtggaggccgcgccgggtggccggtcctacacctacggcgagctggtccgggacgtggcgcggttcgccagggcgctgcggtccatcggcgtccgcaggggccacgtcgtggtggtcgcgctcccgaacctggcggtgtaccccgtggtgagcctcgggatcatgtccgccggagcggtcttctccggcgtgaacccgcgcgccgtcgccgccgagatcaagaagcaggtggaggactccgaggccaggctcgtggtcgccgacgcggtggcctacgacaaggtgaaggacgctggcgtgccggtgatcggcatcggggacgtggcgcggcttcccggcgccataggctgggacgagctcctcgccatggcggaccgcgcgggcgcgccggtggtggcgctggagccggcgcagcagtccgacctgtgcgcgctcccctactcttctggtacgacgggggtgtccaagggcgtgatgctgagccaccggaacctggtgtccagcctctgctcctccatgttcgccgtcgggcaggagctggtcgggcaggtggtcaccctgggcctgatgcccttcttccacatctacggcatcaccggcatctgctgcgccacgctgcggcacaagggcacggtggtggtgatggaccgcttcgacctgcgcgcgttcctgggcgcgctgctgacgcaccgcgtcatgttcgcgcccgtcgtgccgccggtcatgctggccatggtgaagagccccgtggccgacgagttcgacctgtccggcctggccctcaggtccgtcatgacggccgccgcgccgctcgcgccggacctcctggcggcgttcgagcgcaagttcccgggcgtgcaggtggaggaggcgtacgggctcacggagcacagctgcatcacgctgacgcacgccagcggcggcggcgaggacgtggggtcggcggtgcaggtcgccaagaagaagtcggtcggcttcatcctgcccaacctggaggtgaagttcgtggaccccgacacggggcggtcgctgcccaagaacacgccgggggagatctgcgtgcggagccaggccgtgatgcagggctactacaggaggaaggaggagacggagcgcaccatcgacgccgcggggtggctccacacgggcgacgtcgggtacatcgacgacgacggcgacgtgttcatcgtggaccgcatcaaggagctcatcaagtacaagggcttccaggtcgcccctgccgagctggaggccatcctgctgtctcacccgtccgtcgaggacgccgccgtcttcgggctgccggacgaggaggccggcgaggtcccggcgtcgtgcgtggtgcggcgacgtggcgcgccggagagcgaggcggacatgatggcgtacgtggcggggcgcgttgcgtcgtacaagaagctccggctgctgcgcttcgtggacgccatccccaagtcggtgtccggcaagatcctgcggaggcagctcagggacgagttcgtcaagaagacggcagcagcgtaataatgcacatcatcctgtgggtggctgcttgcttataccagtgcaagatcctgcattcgccacttgatgaagacaataatacaattagggtacagtcagatgttccaagctactgatacaattgttgtttctgcaaacagtactcccaactagtgcatatacattggcattgtggacccaaaaaaaaaactgctgttcctgaataacttgagcttcccccagttccctcccatcttgggtagattctgaattcacctgatgaacataaactagctagaggggttaagcttgttttttggcgggagagggtttctttttccccctgccggatgcaacgtcgtccatgctttggccctggcgccggtagcggccgccggacgcgacgaagccggggcacggccggtacgcct

SEQ ID NO: 11086 - DNA, 1770 bp, Zea mays
gcgtgcccagtgtctgacaacgcgccccaaccccaaccccaacccagcggtcccagtcccccctccgttctctctgcactctgcagctgccggtgccggccatggcgcgcgccccgagctcgtggacgccgtccctcgccatggtgctcctcgtcgtggccgccgcggccgtggtcgcgtcgtcggaggcggccagggtgcccgccgccgtcggcaactggacgggggaggagctgcgcggggccgcggcgaggcggggcggccggcgctcccggcgccgcgcgttcgagaacggcctcggccggacgccgcagatggggtggaatagctggaaccacttcggctgcgggatcaacgagaacctcatcaagcagacagctgatgcgctggtcaacaccggtctggcgaagctgggctacgagtatgtcaacatagatgattgctgggcggagtctgacagggactaccagggaagcttcgttgcaaacagacaaaccttcccctctggcatcaaggcgctcgcggactacgtgcacgccaaggggctcaagcttggcatctacagcgatgctgggacacggacgtgcagccagaaaatgccagggtcacttgaccacgaggagcaggacgtgaagacattctcgtcctggggtatcgattatctgaaatacgacaactgcaacgacgccggcaggagcgtcatggagaggtatacgaagatgagcaacgctatgaagacgtatgggaagggcatcttcttctcgctgtgcgaatgggggaggcaaaaccctgctacctgggcaggcggcatggggaacagctggagaacgaccgatgatatcgccgacaactggggcagcatgacgtctcgtgcagaccagaacgacaggtgggcttcctacgccggacctggcgggtggaacgatcctgacatgcttgaggtgggcaacggcggcatgtccgaggcggagtaccgctctcacttcagcatctgggcgctcgccaaggctccgcttctgatcgggtgcgacgtgcgggcgatgagccagcagacgatgggcatactcagcaactcggaagtcatcgccgtgaaccaagatagccaaggtgcgcagggaaagaaagtgcagtccagcaatggcttggaggtttgggctgggccgctcagcaacaacaggaaggccgtggttctctggaaccggcagggataccaggcaaccatcaccgcacagtggtcgagcatcgggctcgcttcttccactgctgtcactgctcgcgatctatgggcgcactcgtcgttctcggctcaaggccagctatcagcttcggtgccacctcacgactgcaagatgtatgtcttgacgccgaactagctcagaagacaagagcggattgttccatggcgcgtgggatgcaaccattcggtcaggattcagggaagaagagtatgcagtgcaggcaaggatttcaagagaaggaaattcgatatcatttggttatacaggatatgagtgcgaatggaggaataatttatactaatactatggaagtgtatctaaggcgccgtcaaaatgccggtgcctgtgttactggatgtttgtaacgagagttgcagcaataaaattggcttgcccaccaccaaaaataaaaacatgtggacggatttcagagaacaagagaatatagaaaatgtgcgttctctgtgaagtgatgttactaatgttatatcccatgaattcttaataaggtcatcggcactcatgctactct

SEQ ID NO: 11087 - DNA, 1002 bp, Zea mays
gtggaactgtggaagcgttgagcttttttcttctttgtcttgctgcgcaagaagaagggaaacgagaggcgggcggcgatggcgaagaggctgctcccgtcgctgaaccgggtgctggtggagaagctggtgcagcccaagaagaccgccggcggcatcctcgtcccggaaacatccaagcagctcccacctcctgcattcgtgaagaacgactgaaccagccgccactcgcccgtccgactccggctccggccagctgcctctgtccctccgccgagctgcccgtccgccttcgtccctccggcccaggcgagcagaactccgcccccacccgccccgagccgagcagcagccagcagagccgcatcgccgccggggaacgctgagttgccggtccgccgccctgagaagatttccgtcccagcagcatagccgcagcgccgctgcccgtcgcctcaaggcaagtccgagcgccctgtcacaggccccagattaggttgatgtctttcctgagactgttgcctcaaaggctaccccaacttatcaggcaggtggagcaagatgttgagactgtaatccacgttctccagccgggtccaataggaattgtggagcacaaattcacagacgcggagatcttagaggccagggctacagtgaaaagagcagtggataattggcgaagaaattggacccttgagagaaatgttagcagataaatggaaaaaatatacccctggtgtcttctatcaacagtaattgaaataaatagggtgccatggctggatgcagttgttgccattagttagatttgagcacgatctgcttatcgggagttatgttaactgttctaaatgatcagtctgtttctctttgtttcatggtttgaaacgttcatatttagagaatgcagtaattcgactccgattcgaaaaaaaaaaaaaaaattgccttgtcggcagccggctgtcatatccaatgtgatctttcttttgatgcttc

SEQ ID NO: 11088 - DNA, 857 bp, Zea mays
actccttagggcgattggccgcccacgaactaaactctactccgtaacctttccgtctctaaccttcccgtctcctgctgccacctcccgcatccgtgaagaacgactgaaccagccgccacccgcccgtccgactccggctccggccacctgcctccgtccctccgccgagctgcccgtctgccttcgtccctccggcctaggcgagcagatctccacccccacccgccccgagccgagcagcagccagcagagccgcatcgccgccggggaacgctgagttgccggcccgtcgccctgagaagatctccatcccagcagcatagccgcagcgccgcctccccaaggcaaggcccgagcgccctacgccctgccacaggccccagattaggttgatgtctttcatgagactattgcctcaaaggctaccccaacttatcaggcaggtggagcaagatgttgagactgtaatccacgttctccagccaggtccaataggaattgtggagcacaaattcacagacacggagatcttagaggccagggctacagtgaaaagagcagtggataattggcgaagaaattggacccttgagaaaaatgttggcagataaatggaaataatataccccttgtgtcttctatcaacagtacttgaaataaataggatgctatggctggatgcagctgttgccattagttagatttgagcacgatctgcttatcgggagttatgttaactgttctaaatgatcagtctgcctctctttgtttcatggtttgaaacgttcatatttagagaatttctttttgttcaaaaaaaaaaaaaaaaaaggccgaaaaaaaaaaaaaaaagt

SEQ ID NO: 11089 - DNA, 795 bp, Zea mays
gcacgagaccattacctagaacagccttcaccagtcgaatggacggcgcggatatcccctcccactccgccgccgatggcgaccggcctccggagaacgcggatgacggcggcgtgggggacgagcatgccgccgcgccccctccggagcggtgcgaggcgttggcttccgcgatcgcgggggtgctggccggcgcgctgcgggagcacgaggagcgggcggccgccaccgcccggagccaggacgaggtcgccgctgccatcgaccgcctcaacggagagctagacaggctattagagaatgcacccacaatggtaataatgcatcattcagcgaggatttccagcatccgcaagaggatttcagcaatgaacatgctgctcaagtccatacagcgacgcatagatagcatggatagaattatttctactgaccattcatctcctgtacagaaagccggtaatgaagttggaacaaggttctagcagaattctggtggtgtccatcaattgcgcaccatttctgttttggtagagctgccatccagcaatcacacggtgctgtgcatagaagtgagacgtcataatgtcgattttttccccagagacgtgtcatcaaaatatttcaatcctttttgtagcatattggagtggggaaagtcttttgtactggatggtcaatgttgcagacaacgaatcgtgctttcagctttggcggttacccttgtattcaaacatgaaattgtcttcagaaatcatattatcatattgccactggttgagcgggttttgatac

SEQ ID NO: 11090 - DNA, 662 bp, Zea mays
ggattgggtctaccctcgcccgcccggacaactcgcagatcgagtccaagcattcaccggaggatcccaaatcacactctccagtaaccgcccgcttctccagccgcatctctagccgagtctatctcctcctcctcctccgccgccgcaactatcctaatggctcgcttcgccgtggtcgccgccatcgtcgccctcctcgccgtcgtcgcggcggcgcaggccccgaccacagctcccaaggccgcgcccaggatggccccgctgccgcctccccctgcgcggtccccggccacagccccggcgccggccgccaagccgccggccgccaagccgccgaccgccgcggcgccgtcaccgctggcctctcctccggccccgcccaccgagggccccgccgcctctgcgccgtccgcgaaggctccgacctcgtccgtctccaccaccccggccggcgcccccaccgtcgcgccctccggcagcgccgccgcctcgcgcgcctccgccctcggcttcgtcgccgtcgccggcgcggtcgcagccgccgtcatgttctagacgcctccccggggcgtcgtggtgggcggcgctgtttatactaccgtgttttacttttgtgtgtgtgtgtgtgtgtgtgtgtgggtcgtgggtgaatctttctt

SEQ ID NO: 11091 - DNA, 1726 bp, Zea mays
ggagtaccgtgcagcagtgtttaggttgtacatgcctttagattgtagcctttatgttttagtctaggaaaactaaacaggcccaaagacggagagaatttttaatcccttcggatcccccctgcatatgtccggtgtcccgatcctattgcctttctcaacgccttctcttggttcctgcccgttaccgttaggccagattcgacgaggttttataaagtttaccgttaggccagtggcgacgaggttttatacagttgacgctaataatggtactatattaatataaattttatagaactagattatagttttatgaagataaaaatcttctataccgttaggcacttaggccagtggcgacgaggttttaaaatacagatgtgctgaggctggacttcctactcgtaaagcgtgaataaacaattcaaaccgacctgtcgtccggctgtggcgcgtgggcgtggccaaaggaaacccagccagccaccccggtaatctagccacgaaagacgccgaccaccccgattccccgcgtccgttccgcatccgacggcaaaggtggcaccacctgcacgcggaaactagtcgttactcgttagtcaggcactggcaccgtcctccagcggtcccccaccccacgtcaccacccgcgacgcggtgccgctgctgcaagcgtcaaaccggacggcgccgctcaacgactcgttcgccgccttcgctggatgtcagcccggtccaacgttacgtgaccccacgcgtcagggagcctccaacgtcacagcgggtcgtgaaccgacctgagagagagccggggcggaagggtcgccgagaggtcatggcccgcggaagggtcgccgagaggccatggcccatgggccatgaccccgttgcccgctataaataccattgggtcccccgcggccgcccggcacaactcgcagatcgagtccaagcattcaccggagaatcccaaatcacactctccagtaaccgcccgcttctccagccgcatctctagccgagtctatctcctcctcctcctccgccgccgcaactatcctaatggctcgcttcgccgtggtcgccgccatcgtcgccctcctcgccgtcgtcgcggcggcgcaggccccggccgccaccccgaccacagctcccaaggccgcgcccaggatggccccgctgccgccaccccctgtgcggtccccggccaccgccccggcgccggccgccaagccgccgaccgccgcggcgccgtccccgctggcctctcctccggccccgcccaccgagggccccgccgcctctgcgccgtccgcgaaggccccgacctcgtccgtctccaccaccccggccggcgcccccaccgtcgcgccttccggcagcggcgccgcctcgcgcgcctccgccctcggcttcgtcgccgtcgccggcgcggtcgcagccgccgtcatgttctagacgcctccccgcggcgtcgggcggtgctgtttatactatcgtgttttacttttgtgcgtgtgtgtgtgggtgggtcgtgggtgattctttcttagatactgagagagcagaggttatgtgagagattctagtgggggtagcgatgggctgttacatatgaatatcatgattcatgatccagaggattattaatggaattctttcatttgtttctagtaaaaaaaaaaaaaaaaaacccgccaaaaaaaaaaaaaaaaaagcggcc

SEQ ID NO: 11092 - DNA, 882 bp, Zea mays
gaattcacaactcgcagatcgagtccaagcattcacctgagaatcccaaatcacactctccagtaaccgtccgcttctccagccgcatctctagccgagtctatctcctcctccgccgccgcaactatcctaatggctcgcttcgccgtggtcgccgccatcgtcgccctcctcgccgtcgtcgcggcggcgcaggccccgaccacagctcccaaggccgcgcccaggatggccccgctgccgccaccccctgtgcggtccccggccaccgccccggcgccggccgccaagccgccgaccgccgcggcgccgtccccgctggcctctcctccggccccgcccaccgagggccccgccgcctctgcgccgtccgcgaaggccccgacctcgtccgtctccaccaccccggccggcgcccccaccgtcgcgccctccggcagcgccgccgcctcgcgcgcctccgccctcggcttcgtcgccgtcgccggcgcggtcgcagccgccgtcatgttctagacgcctccccggggcgtcgtggtgggcggtgctgtttatactatcgtgttttacttttgtgtgtgtgtgtgtgtgtgtgtgtgtgtgggggtcgtgggtgattctttcttagatactgagagagcagaggttatgtgagagattctagtgggtgtagtagcgatgggctgttacatatgaatatcatgattcatgatccagatgattattaatggaattctttcatttgtttctagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 11093 - DNA, 2070 bp, Zea mays
cattggctctctctctaccacacataattgaagggtttgccgttcggaggacggtgatccctgtctgtttctgtctctctctagagatccgataccgccgccagcccgccgctgtgcctcatcgccggcgacggcgcagaacaacccagccgatcagccgtcctcacatcgaagtctccatacacaagtggcatcgcccccctatttcgcccgttgcattgaactactgcagagtggagatccgtccatccatgacccacccagcaggccctggatcgatctgtcattctcttggtaattaacccacgcttgctcggaggaacgctgcagggcacaagaaatgcagagggatgccggctccggcgaccggacgccgggcaccccgagcccgacgcacggtggccggctcaggcaccggaagcgctccaacgaggtccccagcgacgtgaacacgactaatggcgccaacctgctcttgaacgaccagaacaagtacaagtcgatgctagttcgtacctactcctcactgtggatgatggccggggtcgtgttcttgatatatatgggccatctctacatctgggccatggtggtggtcgtccaaatcttcatggcaaaggagctcttcaaccttctccgcaaggccaatgaggaccggcagctcccagggttcaggatgctcaactggcattttttctttactgcgatgctgtttacctacgggcgcttccttagccatcagcttgttaacacgatgacttcagataagttgttgtacaagctggtgagcaggctcatcaagtaccagatgtttatttgctactttctttacatagcaggttttgtttggtttattatcacactaaagaaaaagacatacaagtaccagttcagtcaatatgcatggactcacatgatccttctcatggtatttgcccagtcatctttcactgtggcaaacatttttgatggaatattctggttcatcctcccagcttcgttaattgctatcaatgatgttgctgcatatttctttgggttcttctttgggaaaacaccactgatcaagctctctccaaagaaaacatgggaaggctttataggtgcatcagtgacaacattgctttctgcatttgtggttgctaatttcatgggccatttccagtggttaacatgcccaagaaaggatctatcaactggatggctttattgtgacccaggtcccatgtttacaccagaaggttatgatctaccgggatggataccacaatggtttccatggcgagaaattgcaattatgcccgttcaatggcatgcattagctcttggcttgtttgcttcaataatagcaccatttggtggcttttttgcaagtggattcaagagggcattcaaatttaaggattttggggacagcatacctggtcatggtggatttacagataggatggactgccaaatggtcatggctgtttttgcgtacatctattaccaatcatttgtaatggtacaggacttatctgttgagacaatcctggagcagatactacgtaatctcacctttgaggagcagcgtgagctatatggacagctaggcaagttacttgtgagagcgaactgaagctaacagtggccgtggaagcacctaatccaaaaggataatgcgcaatgctttttcaggccttgcttttttgttaatcttcttgtacagccctagcacccctaaggatgaaacgaagaaccacaacgctgacagggatcgcatcgctgtatgacgttttggagcatacagctcctcccgtctttttcagagatttgtgtcacctttttgatttgcttctggtgctacgcttgttgccgcatcaaaaccagctaacgctgttttgtcgtgtcaatggtttatttgacaatgtgtaggagatttccacctgtgagtctcttcgctagtactagtagccggtgatgcatccatgttttttgttactgtatctactacctctgttcacaaaatatatgaggttgttgactgttttttttgtaaaaatttaataattcatattattcaaaaga

SEQ ID NO: 11094 - DNA, 2075 bp, Zea mays
caccaatttctcagtacaccatgctaacggcctcgccgtcgtctcaggtgaagccgcaacaatggggtacatgcggggtcagcgtggcatcgacgccggcgcttcttccgccaccggccgccggacggcttgtcgccgtcgagaccaggaggaggacgaggacggttgcctccgccgcgcttggtcctgtggccaccgagccccgcgtaaggtctcccgtgccacagcccccgccactgtccagcgacgaggagacggtgctccggctcggcaactacgtcccggtcttcgtcatgctcccacttgaagtggtgaccaccgagaacgacctggaggacgcggggaagctgcgggcgcagctgcggcggctgcggggggccggcgtcgacggcgtgatggtggacgtgtggtggggcgccgtggagggcgccgggccggcgctgtacgagtggcgcgcgtaccgggacctgttccgggtcgtgcagggcgaggggctcaagctgcaggccatcatgtcgttccacgcgtgcggcggcaacgtcggcgacgacgccgtcagcatcccgctcccgcggtgggtgcgggaggtcggcgaggccgaccccgacgtgttctacacgagctccagcggggcgcggaaccaggagtacctctccattggcgtcgacgacgagccgctgttccatggcaggactgccatccagttgtatgccgatttcatgaagagcttcagggagaacatggcggacttcctggactccggcctgatcgtggacatcgaagtcgggcttggccctgcgggggagctgaggtacccgtcgtatccggagacgcaggggtgggtgttccccggcatcggacagttccagtgttacgacaagtactggaggcggatttcaaggcggcggcgaccggaggccgggcacccagactgggagctgcccgacgacgccggggagatcaacgacacgccggaggacactgggttcttcacggcggagcgagggacctacctcaccgagcaggggaggttcttcctgacatggtactcccgcaagctgatccagcacggagacagggtcctggatgaagccaacaaggccttcctggggtgcaaggtcaagctcgccgcaaaagtgtccgggatacactggtggtacaggcacccgagccacgccgcggagctgacctcggggtactacaacctcggcggccgggacgggtacgcgccgatcgcgcgcatgctggcgcggcacgacggagccgtcctcaacttcacctgcgcggagatgcggaactcggagcaggccgaggaggccctgagcgccccggagcagctcgtccagcaggtgctgagcgccgggtggagggagggggtcgaggtggcttgcgagaacgcgctgagccggtacgaccgccgcgggtacaaccagatgctgctcaacgcgcggcccaacggcgtgggtctctccggcgccgcgcggcgcagggtcgcggcggtgacgttcctccggctctcggacgagctcctggcgagcaacaacttccggatcttccggacattcgtccggaaaatgcacgccgacctggattactgccctgatgcggaccggtacggtcggcccctcaagcccctagagcggtccgcgccggagatgcccatggagcggctgctggaagccaccgcgccggcgccggcgttcccgtttgatccggagaccgacatgagcgtcggcggcgggctcgcagaggctgtcgactgggtgctcgacaagatcgcgtggctatttggataggatcagaatcagatcacactcaggcgatcagcatttccgttggacacgaaccattgatccgcaacaggaatggcatggccagtgatacatgcagttgcgctagcagcaccatgtcatgacaccgacattgtacctgtacacgcttctgcttcgtcctccttttagcggaaggctatttatgatatactgatgaaatttacagcatcttgggtaagatgttttagatgttgtttgaattttcacgtattcatgttaatgtacgtgtattaggggtggttt

SEQ ID NO: 11095 - DNA, 5096 bp, Zea mays
gaccggactgagctgctataattagaaagttcagggtccactgcgcaaaaaggttctaagactaggaatcccactgacaggattgcaggttggtttccaagttttacagggacttaaatgcgaaagggtccgtccgaaggggtatctaggatgtcatatcgtcagattagaatctaacgatcaggattatacccgtgctatgcgaatcggaggtgcactattggacgcacgatctcccatctacggtcgagaatccatcagcccgaagagtttttctacttctaatctgtaccgcccaatacaggatccacgtcgccaagcacgcatcggcacacacccatctccatcgcagatcacagatgcgacagccagcagccttcttctacctcacaaccccaccagacagctgcacgggactggtggccatgcagaccacgacggcggcatcgacgagaaacagccatcgaggccgagtgtcagcaacagtctaggggagacgctagacgaggcagccgtcgcggaagagcggctcgcatatccgagccaaggggttatgtaaacgagtgggccatgtgttgggtcgtagggtgaagggtatttgagtctgcattctgtatgaactggttatcaaagaaatagacaataccagaaagccttcgtgcttccacccgtcttctcaacttctctatctctttccccttcctcacgccattccccgccttcttcttccatgtcgctaacatccggccgcgttttaggtcgtcctgaatccattctctgttgtgtcgcgacgcccacgatcgcggtgatggagcaccaagacgccgccatccgcaagctactcgacgaaatgcgactcatggaggcgcgtctgtgcgagcgcatcagcggacgctgcgacgacgtcgagcgccacctggacgagtgctgtgaagagccctgtgatgagacgcctagcttcgacaggggtcccatcttcaatgaggaaccctgtttccaccgccgcctcctcaattcggatccgagctctccctgcgactgggtcgacctgctctcggtcgtccgtgcagtggccccgagctcccgggatttgcttcctccaccgggcatccgtgccgtgccgagcagctacgtcacgagcgggtatccgcgggaggacagagaacttgtccagcccctgcgacgagtcgagtcggctacacgcgtcgagtcaagcgttactagggcctccagcactgagctagacagggagttcatcgtcgcctccgccttcatcacagcatcatccacctccggcaccagcgccctcgaggcaggcgcgcgcgtggacacggctagcgaaccggagtttccgcctcgtgccaccctcggtgcccaccctgactacgaacttcgccatgtcgaaccggtgggtcttctcgaaggggcggtagtccggccacttctcgaagagcttgagcgccagcacagcacggcccagcgggtcatcgttgcgcggggacaattggtcctccaccgtcagtaccagctggactcgtccccgctcgactcctgcatcgtcttcgttcctgaaagaccggccgaccgggagatggtcgaggcatcggccgtcatggtggtgtgggcgtacgacaccgcgtgcgaccgcgtcggcgtggaggaggtgaagcatgcgtgcgaggtcggatgcagcggcggcgagatgtgccttttcacggacctcctcggtgacttgctctgccgcattcaccgctcgccgaactctctcatgctggtcgcggagacaacaatcggcaccaacagcacggagatcgccggaattgtccgcagctgcgctaagaccgctgtctctgttggcaccacccagcaggccaaagaagaccccatttacaccaaggttggctccatccttggcctccgcgtctcgaccaacatgtgtttgatgaattgcttcaaactcatacaaagttgtttcagctgggatgcagtgccacatcgacagccttggccaccacctcatatgcaggttgagtttgggtgtggcagtgctgatttatgtccaattccatggccgtctttcaccacagttggtaccaatgaggagataattgacatcacatctgatgatgacaaggttgataatgtggttgatcagctgattgatgaacagatcgcagcagtagtctttgtgccagcgtgtatggaagctacgcctaataatgggataaatacaagcaaaaccgtggagacctttgctgctcatcagtctcctgagtatgatagtggattgaaagataaggatcagagaatatcatttgaagatgagatatctgagggtgggcaagctgaacaaagtactccacaacaggaattgtgggctatgccaccagatactagtgaccgtgaaactgttgagaggacaaccagaagtattgaggtggagcatttctctcaggttgagtcaaagcataaaatgaactctatgtccgtggaagcttctgagcatgtcactatcactcagattgagaagaagccggttcaacaagttgagataactcaggagttagattcactgccgatatgttctagggagcattctaatgaggcacttgaaggggagagaacagtgcaggctgggttggaacaagagtgtgaggtgctggggatattgtcaacgatcacctcggatatttttgcaatagggctcagtccaaatcagtataccgtgtatttttatcggaatttgatggcctgcatgatgttgatccgtcgcagattcttgctgtcatttggacgtagttgggatgcggtgacgtacaagcaaccatggccaccacccgtgcatgttgtgatactaggagatggcttgtccgtcaggcttacaccttggcaaccacttgatactgatatctacagctttcctgtgaacagaccagaatcatctgcaggtcgccttggtagtgcaacagaatcaacgagtgtgcctatgattcccaaggaaacagtgtctcgacaatcctcttgatgatgcaaaggtgcctttatgaacagatgatgcaatacaaatctgaagagggctgtactcgggtagtgaaatgcctcccaccggctgacgcaagtttacttgtttggctgttaatcagatgacatatccattgattgcattgatgtatgcggtccaagtgatgaattttctcaaggacaaagatgagtcaccttgagaggatgttttgctgctccagaaggacccatttgatggcaacaggcattagaaacccaacgtgacacttgccatctccttgaggaaagatccaggagtcattgctgcgtgcactgccccaaccaacgaagtaccaacatatgtggaggactacactagtagctcaaaatctgcaactgctggctagtggctatcaccgatgctcccggcatgacaactaaaatttcttaccatcagcggcttgggggcaagccacatttcaagcggtggggaatgtcagcagcagtctaggggagacgctagcggcgatgtcccagcaaggagcagctcgcatatccgagccaaggggttatgtaaacgagtgggccatgtgttgggtcgtagggtgaagggtatttgagtctgtattctgtatgaactcgttatcaaagaaatagacaataccagaaagccttcgtgctcccacccgtcttttcaacttctctatcttcctcacgccattccccgccttcttcttccacgtcgctaactccgagctccccatcggtcactgctgggcgaaaaagtaggcacaggcaatgcataactcgagagaggcattattaccggagatcaaagcagtagggaagctctccatccgcgcgacggctccacatcacgaacacccctaggaggaagttcccagctccaatgacttcgatctccaaaggttagaccgcactcacgcctggcgtgcctaggcgacccgcaatagccacacgccgagaggaacccactcacgatggtgaggatcgcataccacacaccgagagccaaaacgacatcgacagtgaactttgacggtagcggcacttagcggacccgatggccaagtaccaaacacaggaggggcgagcgtcacagagggaggggatggtatgcacaggagcttcaggtgtacccccacgaggtctactgtagcctgcaggtgatgaggagacggagtaggggcgcggcggagggagcacgccatgggcaaccgggagggcctgcgttgagctaacaacccagggaaggaccgacttataaatccacctggggacgacgttcatgggttggttggagtacaggaccgaatctcccagagtcttccgtcgtttttgttagcgcctaatgtggagaagagatctagagaggagagccgaccacgcgaggaagacggagacgacccgatagatgggccccacacggtcagcgtgagtgcggcaccgcgaccacacggcttggagagactgcacgatgggacccgcctggcggtgaaggtggcaaagttgggctggcgctcaggaatttggcccgcgacatgaatgaaaactgaaagggggggggagagaaatgggttgtgaaggaaggatcgacccatcacgcaaggaagtctccttatctttttcttttctgttttcctttccacttgatttcataatttgtattccaaaatttgttatgagtttttcccatttattttaaatatgaaatttcaaatactggtctaaattagtttctttatttgtatatttattttctctatatgttatagtattttccttctcttctcaaattatagaatttcctttagaattccaattcaaatttgggtaccaacatgtttctttttacattatttttatattgtcacaaaatgcacacaaagcaaaacctcatcatgatgcatattccattttagtatcttttattttaactaatcacccttaattataggtatgctcttgttatacacaacataaggagatttactatatcctcatcgtatacattttttggtattacaagtgattccttctggtaccttgtctcacatctccattgagccaacctt

SEQ ID NO: 11096 - DNA, 4129 bp, Zea mays
  misc_feature (399)..(399): n is a, c, g, or t
tcatctactcatgtcgttgatctccgttcactctacctccactaccctcctcgctccgccgctgttccgccgacgactccaccactccgtccctaaacttagcgtatatgtcacccctgtagaagtctctggtcctccacacgagcactagcgacacgagcgcaccgcccaccgtggcggccgtgatgatgaggaacgacgtccggaagcactgcacgccgatgcaagccttgtccccagcggcgggcagcatcccgccgtgctgcctggtgtcagcagcagtctaggggagacgctagacgaggcagccgtcgcggaagagcggcgatgtcccagcaaggagcagctcgcatatccgagccaaggggttatgtaaacgagtgggccatgtgttgggtngtagggtgaagggtatttgagtctgtattctgtatgaactggtgatcaaagaaatagaataccagaaaagccttcgtgctcccaccgtcttcccaacttctctaactctttccccttcctcacgccattccctgccttctccttccacgtcgctaacatttggtatcagaactactcgcatcctggaatattgcacccatggaggcggcaatacagcagattctcgacgcgatggcgcacatggagctccgcttgaccgatgcgttggctggctgtggtggcgagcacaggatggaggactcggtctcagggctgccatcttccaactccgccacctcctccgtcgccgcgccgatgtacgacgacgatgtgttcagctcttcggcagccccacccacaggcttccatggagagcctattttcgacgaggagcccgacaactccatcaccgagtccgtcgacgtctcgtgccacgaccatctcttcctcctcgacaccgcctgggaccgctcgcaccagcacaacgccagcatcccaggacagcgccagcatctcggtcgcggcccccgcctgcagcgcccgaccgctacagcacctgaccgtcgaccccgtcagcgccgtccatggcagcaacgactctgagctgtcccacagcgaggtcgacagggtccctgcgaccgccgcgctctccaacccgcgcgagaaggtccacgacgggctcgtcggcgtgacggagttgtcccgcgaagtccgactcctccgcttctccttgccgtcactgaaccaggcgctcaacacatccatcggcaagcacgtcctcgactgcgccatcatcgacggtaagtcgtgcttgcgggcacacacgttgaggagcgtcgcggacgaggttggacacacgacctcagggatggtccagacgaaacacatcaacaaccaggagaagttggacgggatggtcattgtcgagcacaacaccttcggtctcttctctagggagttcgcgcacaggctccacctcatcggcccccgcgaagtcagagccacatccctggttcgagccccagagcagagcagcctccccgatctccacccctctgtgatagtccgcatgaagcagatggcgcgcaagtcgatgggcggcaaggcgccgcggaagcagctggcaacgaagggggcgcgcaagtcggagacgaggacgcgcggcgtgaagaaggcgcaccagctccgcccgggcaccgccgcgctgtgcgagatccgtcagtacaagaagagcacggggctgctaatccgcaagctcttgttccagcgcctcgtcggccacgacgccacatggttcctgctcgacatcgccttctacagccacaacaggttccaggaggactccaccagcatcagcgggatccccatgtccaacaccaggagcgcagaggagaaggaggttctcgccacctcgcccaacaggtgtttgacgaattgcttcaaactcatacaaagttgttttagctgggatgcagtgccatatcaacagccttggccaccacctcatatgcaggtggagtttgggtgtggcagtgctgatttatgtccaattccatggccgtttttcaccacaattggtaccaatgaggagataattgacatcacatctgatgatgacaaggttgataatgtggttgatcagctgattgatgaacagatcgcagcagtagtctttgtgccagcgtgtatggaagctacgcctaataatgggataaatacaagcaaaaccgtggagacctttgctgctcatcagtctcctgagtatgatagtggattgaaagataaggatcagagaatatcatttgaagatgagatatctgagggtgggcaagctgaacaaaagtactccacaacaggaattgtgggctatgccaccagatactagtgaccgtgaaactgttgagagggacaaccagaaagtattgaggtggagcatttctctcaggttgagtcaaagcataaaatgaactctatgtccgtggaagcttctgagcatgtcactatcactcagattgagaagaagccggttcaacaagttgagataactcaggagttagattcactgccgatatgttctagggagcattctgatgaggcacttgaaggggagagaacagtgcaggctgggttggaacaagagtgtgaggtgctggggatattgtcaacgatcacctcggatatttttgcaatagggctcagtccaaatcagtataccgtgtatttttatcggaatttgatggcctgcatgatgttgatccgtcgcagattcttgctgtcatttggacgtagttgggatgcggtgacgtacaagcaaccatggccaccacccgtgcatgttgtgatactaggagatggcttgtccgtcaggcttacaccttggcaaccacttgatactgatatctacagctttcctgtgaacagaccagaatcatctgcaggtgtcttttgtattgcaacagaatcaacgcagtgtgcctatgattcccaaggaaacagtgtctcgacaatcctcttgatgatgcacagatgcctttatgaacagatgatgcaatacaaatctgaagagggctgtactcgggtagtgaaatgcctcccaccggctgacgcaagtttacttgtctgggctgttaatcagatgacagatccattgattgcattgatgtatgcggtccaagtgatgatttttctcaaggacaaagaggagtcacctcgagaggatgttttgctgctccagaaggacccatttgatggcaacaggcatcagaaacccaacgtgacacttgccatctccttgaggaaagatccaggagtcattgctgcgtgcactgccccaaccaacgaagtaccaacatatgtggaggactacactagtagctcaaaatctgcaactgctggctagtggctatcaccgatgctcccggcatgacaactaaaatttcttaccatcagtggcttgggggcaagccacatttcaagcggtggggaatgtcagcagcagtctaggggagacgctagacgaggcagccgtcgcggaagagcggcgatgtcccagcaaggagcagctcgcatatccgagccaaggggttatgtaaacgagtggcccatgtgttgggccgcagggtgaagggtatttgagtctgtattccgtatgaactggtgatcaaaagaaatagaataccagaaaagccttcgtgctcccaccgtctttccaacttctctaactctttccccttcctcacgccattctctgccttctccttccacgtcgctaacatttggtatcagactactcacatcctggaatattgcacccatggaggcggcaatacagcagattctcgacgcgatggcgcatatggagctccgcttgaccgatgcgttggctgcccgtggtggcgagcacaggatggaggacgcggtctcagagctgccatcttccaactccgccacctcctccgtcaccgcgccggtgtacgacgacgacgtgttcagctcttcggcagccccacccacaggcttccatggagagcctattttcgacgaggagcccgacaactccatcaccgagtccgtcgacgtctcgtgccacgaccatctcttcctcctggacaccgcctgggaccgctcgcaccagcacaacgccagcatcccaggacagcgccagcatctcggtcgcagcgcgcggctgcag

SEQ ID NO: 11097 - DNA, 1005 bp, Zea mays
  misc_feature (862)..(862): n is a, c, g, or t
  misc_feature (883)..(883): n is a, c, g, or t
  misc_feature (890)..(890): n is a, c, g, or t
  misc_feature (908)..(908): n is a, c, g, or t
  misc_feature (943)..(943): n is a, c, g, or t
attgggtccctcgaggccggccgggagaaccttctatctccttccatttgtgcatatacaaaccctcttcaaaagccggcagaatcacacacccgcctccaccgcgcctgcccacgataacccagaggcctcgagaagggctggaagcaccgagagcgctccagagatgtcgtcggatgagttgcgattggagctggacgagctgcggcggctggagggcctcgccaagcgcccccgcgtccagaccctcctcgccaacgagatccgcaacattgaagctaagatggcgaaggcaactgaaccgtcaccggagccactagcggcggcttccgcgcccacggcggcggcgcgttctgatttgagctacgccacgttgggctcgttcagctgggaacaggacaacgagaagatcaggatatatattccccttgagggagtcgaacaagggaaggtggaggctactttcaagccaacatcggtagatgtaaagtttcatgatgtcaaaggcaagaattatcggtgtgccataccaaagctgaacaaggaaactgtccctgataaatgtaaggttgtggtgaagccaacaaaggttattgttacccttttcaaggcttctaaaggcaactggttagacttgcacttcaaggaagacaagttcaagccaagcatggacaaggaaaaggatccgatgtcaggaattatggacttaatgaagaacatgtatgaggacggcgacgaggatatgaaacgcacaatagccaaagcttggtctgatgccaagtctgggaagacgaccgattcgttgagcggattacgttgagctggcatatcggcctacggacttatgttactgatggttcanacggtctttacagtgtcttgntgggtgntagactgttaatggctgnttatcttacatttgtagtgaagctggacgtgcgangaatatttgaatttctctctttggaacccaagaaaataaaaaccattagtcttaagacgttt

SEQ ID NO: 11098 - DNA, 1115 bp, Zea mays
aacgagccagctcgagctcggtcgagccgaggggtcgatatccacccctagctgcctggtgcccacgataacccagagacctcgagaacggctggaagaaccgagagcgctccggaaatgtcggcgggtgagctgcggttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagtttcatgatgtcaaaggcaagaattaccggtgtgctataccaaagctgaacaaggaaattgttcctgagaaatgtaaggttgtggtgaaaccaaccagggttgttgttactcttttcaagggttctaaaggcaactggttagacttgcacttcaaggaagacaagttcaagccaaacatggacaaggaaaaagatccgatgtcaggaattatggacttaatgaagaacatgtacgaggagggcgacgaggatatgaagcgcacaatagccaaagcttggtctgatgccaggtctgggaagacgactgattcgatgagcggattacgttgagctggtataatcagttgatgggcttaagttttctgcgctagcccctgcagccgaagtgtttctgatggttcaaatagcgttgcagtgccttgttggtgttagtccttgtttatcttacatttgtgagtgaagttggacgtgccaaacatatttaaatatatcctcttgaacgggggaaagatcatatcaagtccaagaggttttgtgcttttgtggaattaccacggcgtttctgtttgctacgaaacgatggtagtaacagcttgagccttgccagaaatttcctgtttgtgacgctgtttttaaaattatgtttcatatcaaaaaaaaaaaaaaaa

SEQ ID NO: 11099 - DNA, 1054 bp, Zea mays
gcacgaggccgatctgaaaacattggtactaccaccacggtccacggctctagaaccttctatctccttccatttgtgcatatacaaaccctctccctcggggcccgccatcacacacccgcctccaccgcgcctgcccacgataacccagaggcctcgagaagggctggaagcaccgagagcgctccagagatgtcgtcggatgagttgcgattggagctggacgagctgcggcggctggagggcctcgccaagcgcccccgcgtccagaccctcctcgccaacgagatccgcaacattgaagctaagatggcgaaggcaactgaaccgtcaccggagccactagcggcggcttccgcgcccgcggcggcggcgcgttctgatttgagctacgccacgttgggctcgttcagctgggaacaggacaacgagaagatcaggatatatattccccttgagggagtcgaacaagggaaggtggaggctactttcaagccaacatcagtagatgtaaagtttcatgatgtcaaaggcaagaattatcggtgtgccataccaaagctgaacaaggaaactgttcctgataaatgtaaggttgtggtgaagccaacaaaggttattgttacccttttcaaggcttctaaaggcaactggttagacttgcacttcaaggaagacaagttcaagccaagcatggacaaggaaaaggatccgatgtcaggaattatggacttaatgaagaacatgtatgaggacggcgacgaggatatgaaacgcacaatagccaaagcttggtctgatgccaggtctgggaagacgaccgattcgttgagcggattacgttgagctggcatatcggcctacggacttatgttactgatggttcaaacggtctttacagtgtcttgttggtgttagactgttaatgcttgtttatcttacatttgtagtgaagctggacgtgcgaggaatattgaattctcttcttgaaaccaaagaaataaaaaccataagtctaagacgtttaaaaaaaaaaaaaaaaaaaaaaaaaaaa

SEQ ID NO: 11100 - DNA, 701 bp, Zea mays
tcgctttcctcaaaaacctcgggcttcccctggcttccatgcagcagtccccccttcgtgtcgcactcacacagtcgcactccataaggcaaggaggaaaacagagagacgaccaccgctccgcgccggccggccattccatccggcaatggcctccgccgccggtgctgcgttcgccgccatcaccctcctcatcctcgtacccctcaccgccgcctcggactccgaccacaagtaccaagcagcggagcctgtgacgctctgggtgaacaaggttggtccgtacaacaatccgcaggagacatacaactactacagcctcccattttgccatgcgtcagaaaaccatgtgcataagtggggaggactcggcgaggtccttggtgggaatgagctcattgacagccagatctgggaagacgactgattcgatgagcggattacgttgagctggtataatcagttgatgggcttaagttttctctagcccctgcagccgaagtgtttctgatggttcaaatagcgttgcagtgccttgttggtgttagtccttgtttatcttacatttgtgagtgaagttggacgtgccaaacatatttaaatatatcctcttgaacgggggaaagatcatatcaagtccaagaggttttgtgcttttgtggaattaaaaaaaaaaaaaaaaaataaaaaaaaaaaaaaaa

SEQ ID NO: 11101 - DNA, 2595 bp, Zea mays
tgtgtatatctgagatatatatttatacatatttgatattgctttctttagactgtgttcactgtttgcagattggagttgtatagggatgggtaagctgctggagatagtgttaagcttagtcaactttagaaaagtttgactgatttgaaacctaagtttgtgatattttggggatggaggttgtaacagttaacaaccatttgtgcacaaacgcacaatcctaaagcctagataggatcagtgtgtcatgacatctgtctgaataatgcaaagtttgttaccagaggctgattaactcctggtcagactgaagtgtgttttcattgacagttcaagccaaacatggacaaggaaaaagatccgatgtcaggaattatggacttaatgaaggtaaataaatatttttcccatatggattattcaagaagttaattgacccgatgtctgtgacttcgttacatgcacttaatgaagaacatgtacgaggagggcgacgaggatatgaagcgcacaatagccaaagcttggtctgatgccaggtctgggaagacgactgattcgatgagcggattacgttgagctggtataatcagttgatgggcttaagttttctgcgctagcccctgcagccgaagtgtttctgatggttcaaatagcgttgcagtgccttgttggtgttagtccttgtttatcttacatttgtgagtgaagttggacgtgccaaacatatttaaatatatcctcttgaacgggggaaagatcatatcaagtccaagaggttttgtgcttttgtggaattaccacggcgtttctgtttgctacgaaacgatggtagtaacagcttgagccttgccagaaatttcctgtttgtgacgctgtttttaaaattatgtttcatatcagttgcgcaccgaagagtgaaaccaagacaggtgagaggacatatttaaaaataatcattttaagcaattactacacccctctggatatttgttttgaaaaaggtcctgaggacatataaaaaataatcatttttaaacaattacttcagccctctggatatttattttaaaaaatgtcctccttgcatgattgaatcaatggttcggttgcacttgtttgtctgtttgcagcagcagtttatccatagtttaccaaaaacactgttcgacattaattaattatccgataagaccgattaacctgtctgacctgataaaccggcatcacatgtgtagaaattgaaccacttgttttttggcaaataaagcacattgaggtctcattttttgttcttttgttggccaaaatgttatcataagtccaataacaacattcatcggtttacatacattacatgccattgtgtatcgtagttcacaaataactttgaagatataatacactcgctagtgaagatcattcacacgggtgtgtattccactgatcttgtgctatattatactcctctaatgagagcaacataatacattgctcatgtatcaattgttccttgtacaattgcactccgtccaagcatgtccggtccacatagaagagcactacacgagtctaccaacatttggtagtactcatgctcctcccgttattacacacctcattggttgttttgtcacttcaccaactagatagttcacatagggaagaaggggtgaagacgaaccttatctttcgtcgctagaatcgagggtccaatacgcttgttgtaggccttggtgtcccaaccttgtaaacgtggtcttacgctcctcatgtacgtcgtgatcttggtcttgtgtagcgtattagttacgaaaatatggttagatatcaatcactaatttattgagaaccaaatttaatggtacctataaaatgtatcggatgaatcaaacccatcaccactaccaccaacaccacaaccaccaccatcatcagaagcgtcgctggactgctatcggcaaactcttggtatattggacttttatcaccactatcgcttcatcatcgcttgccactactttctttcctttctttatcctttttggtaacacgaactataccatttgcttaccaacatgagtgtctcccacattcttcttagtccactcaaccaaattttcccttgaagtgcctttaaccacattgctggaaggtaatggggtgttactctcggtgtcctcatctagcatcagattcgcgtttgagcaacccattttcatccactaacggaccatattgtttgtcatataagaacaactccatcaattcgcgatgcaaggtgttggttgaaacgtgtagcaccgccttcccttccattatttcttgcaatacttgcacttgaatctggaatatatgttgtcatcgtgtttcaaaccagatccatacaacctgacatcgctgaaaatagcaataacatgaactgttgttacaagtattattacaccctatttggatgtagatattggagcacaaaattagaaattggacatgaaattgagattcggaattagagcctataaacagaaactctttttcccaataaagagcttcatcagtctgtattgcgtgaaattagaccgtacaatttcg

SEQ ID NO: 11102 - DNA, 1754 bp, Zea mays
ggccggccgggaaaaaaattgggtacctcgaccccggccgggctactctcactagaacagaaccctaaacccgcatcccgaacattgacgccggcgatctccgccgccaccgccatgttcgggaccccatccatcactcccgctttcgggaacccctccagcaccccggtttttggcacgccatccgccacccccgcatttggcgcgacgtcgtccaccccggccttcggcaccctctcgtcgacgcctgccttcggcaccccttcgtcgactcccgctttcggtaccccgtcgtctacgccagcgttcgggaccgcttccacgacccctgcgttcggggcatcgtcgtcgacgccagcgttcgggaccacttccacgaccccgccgttcggctcgctgaatttcgggacgccctcgtcgacctcagcattcggcacgccgtcttcggcgccggcgttcggcgcactcaatttcggaacaccctcgtcgacctcggcattcggcacgccctcttcggcgccggcgtttggcgcgactccttcgccctcgccctttgggttccagcagcaggcgacgccgtccccatctccgttcggcttgctaggaggtggcggcgcgcaaatcaccacccagatggcccccgttgcgccgctgccgctctccccgtccgaccgcgacatccaggccattgtggatgcgtacaaagaggaccccggtaatccacgttatgctttcaggcatttgttgttcagcgtgacagaaccttcccaaagggtgaagccagttgctgcctcagatattatgtgggcagaagcaatggggaaacttgaatgcatggatagtgcagacagggagaggctgtggcctcagcttgtgcagggttttaaagacctttcccatcggcttaagcttcaagatgaagtccttgtttcggacactgatagattgagcatgactcactctaatgttaaaaagctgcaaaggcatttccaagctgacacgtatccttggatccagcgattgaagcaacaagagctggctattcagagacgtcttttaaggtttgttagaatagtggaggcattggagaatcggggctaccgctgtcctttaacaaaggaggaagctgacttgtatgaaagattggttgctatattaaagcggctaaaaggacataacgctgatctttctaagagggtcaatacacttgtttcgacgtcgcgtcttctggctagcagtggtggtgctggtggttccgtttatattcccagttctgcaaaagttgatgagcggagtgttacagagcttcttgaggccttacaacaacaaacagaggcagttgccaagctaggtaatgtgttgaagagggatatcagggacatggagatcatccagtcagaaggtacggatatggctgaagacaatgtggggagaagggcacagaaaatataagattgaagcacggtctttgtcgtaggctcgtagctaagtaataagcgggtgatggaagggatccatcgtcgctagaaggatctgagcctccaacttatttggagtaatgggccagggaaatgatatccctgtgtaactgctgcaggcaagcttgattctgcattctttgggaagctaaccatggtcaattagtagtggtatgtgtagattgtatgttgaactgaggcagtattcttagaactcagttttctcctcgtgccaactaaaaaaaaaaaaatgcggccttgctaaaaaaagcggcc

SEQ ID NO: 11103 - DNA, 2522 bp, Zea mays
gcgcatacttccctatagaagtaactcagctctgcaaatatgctccaaagctcatccttaaaatagcatcaaaacatcacgggcatcagcctctccataataatatggtagtcatggattttcaaaccgatcaatttaccggtcttcagattgactgcccgtttcagatttgccgcataccgatctggaaatttcagattcttcaaccacttaaatatttctttcctttcatccggcttgaggcagtaatcagctcgcggcctactttcatgccctttatcgcttactttcaactcgagcatcggcctcttacaaatttcagccatgtcttttcttgccttcatattatctttcgttttatcagtcacatcgaaacatgtgcttatgatgctttcagcaacgttacgctcttggtgcatcaagtctatgttgtgcggcatgatcaaggcttttgcatacggaagctcccatattgatgaaatatgggtccagttatggtcctccccgtagccttggaacctatcattttctccttgcttcagacaagcatgccatgccattatctgcggtgcagtttgcctctttggtggcccatttctgattttggctccacctctgaatgcagtaagcgaattcctgaaatcatgcttgaatggagtccaacgtcgatgagcatcaaagaatgacactttcccaccatgcttcaatctgaatgcatccgtatcattcatacatatgggacagcacaaccgaccatggacacaccatccagaccaatctccatacgccagcagatcatgcactgaccacaaataagcagcgcgcatggtaaactccttttcagtatggctgtcataagccttcacacctctccacaattgtttcagctcttcaattaaagggcgaacaaacatattcagctttggccctggatgctcggggcctgggatgactagtgcaaggaacatgaactcttctttattgaccaactcaggaggaagattatatggcacaatgaagacaggccaacacgagtaagggcttgcactggtattgaaaggtgtgaatccgtccgtcgatagaccaagccgtacactcctagggtcgtttgcaaattcgggatcaaactcgtcaaatgccttccacgcatcaccgtccgacggatggaccattatgtctggatcagtgacgagacgtacaccattctttggccacgtcatatgcagagctatttccttgttgaggaacaaccttgaaagccgaggaatgatgggcaaccgacgaagttgcttagctgcgaccttcgtaactaccaattcaccctcatcatttgtcacctcgacatatctagaagcttcacaatgcttacaacggtccagcttgtcatcctcctcaaagaatagcatgcaactgttgggacacacgtcgatcttctcatatgtcatcccaagaccagccaacatcttctttgcgaagtacatattctttggcaacttatgattctccgggagaacctcgcccatcagttggacgatgtcgttgtaagcactgtttgaaatgttgtgcttcgactttatcgccattagtcttgtgagagtcccaagaactgacatctgagtgtgctcgtgcagtctctcttctcccgcggcgagtagccggaagaattcctgagcatcgcgtggaagctgccccggctcctcagcgttcatttcaacctccctaccaagatcatgcaacatgtcgtccatcctatcatgatcgtcatcaagctccacctccgcgtcaacgtgtctaatagactctccatgccggtaccatacaaggtagttcggcataaacccacttttgcaaaggtgtttctccatttcttccttcttctgaggccacttgttctcgcagcgattgcaaggacacttcactagacgaccagttgcatctttgaaagcgtgctcaagaaaagcctttgttacacccatccattcattcgaatgtgccccatcctttctccacccgtcatacatcaccctccgatcaccgtccatttcaaaggctaaacaaaagacaaagaacatcaacgatcgtccgtggcttaggtgaactccctattaggtaaaggccctaaacccacccaagagtgtaggccgatgcttgtgatttgtgacgtgtagcctacgattgccgcgaaatttcggcagcataaccccgctgctctccaagcacacgcctgaacatggtgtgttggagaacaactgggttacacaaccgaaattccgcgtcaatcgtaaggcacatgtcacaaatcacaagcatcggcctacactctcaggctgtccaaaatacgtggacaattccggagcggcgaacctcacaagccaatgtgacgttcgccgttcccgaacgggtgacgcatacggttcgctacggttaacgattaaaactgaaccctaaacattaaaaaatatctcgtagattaaacaaaagacatcaccctccgatcaccctccaaacggggactaataact

SEQ ID NO: 11104 - DNA, 2449 bp, Zea mays
tcggtccgcccttttttttttttttttggccaataatttttctacattccataaaaagctttacaaatatatatatataaacaatatatgtatgtatacattaggggaaaaaaatgagatgtagctgttaagttgtactatctggcgaacaatcgaaaaatgagctcaacccctccagagtttagacaaggatggagccagctgagtcagtgtatgcattttccgggcacccgccacgagaaaccctgcgcgttgccagcggcggcgcgcgctctgtaggtcttccagtcctgtagcacgttcttgaggtcgaagagcttgttgtccagccccacgcagcagttggcgtgcatggtggccaccctgcccaggtcgtcgccgtgctggcagaagcccccgaagacggccgtgtccaggaactgcacccgggcgccggcgtacccttccttgacgatcctgtcgaagacgtactgctcgtggtggcccgggaaccgcgcgcgcgacgcctgccagtggcggtagaagcccaccgtggcgggcgaggagcggacgtagaggaggccgccgttggggtagttgttgggcgagtcggcgtcgccgacgaagaagtcggccgacatgacgacctgcgcggcgcggggcaggcgcgggaacgggctccggaaccacaggatgtccacgtccgtgaagaggaagctgtagcccagctccagcacgctctgctggaaccggttccggcgccacatcatctccaggtagtcgccctccatgtacttctgctcggcggcgaagtccatgccgtcgacgcggaacaggtagcagaaggggtgcacggcgttgcaccgctccagggccctgccgtccatggccacgaccagcaggtgccgcggcaggcccgcggtgtcctcgccctggcggaagctctccaggaacaggtccaggaacgaccctggcgctgcccacgcctcgttgatcgccgtcatcagcaccgtcttgtccgccgtcgccgctcgccggagcaggtccgccagatcctgggacgctggtggtgggctcttcttctgctgcttcggctgcggtctatggtgggaggtggcctggtgggtggtggggaacatcagatttacctcggaacgctaatgaataatcggagacaagatgagtaaattgtgaggcaagagcagccgcgctgattgatcgatgctagttcacttgttattattcgatctctgagcaactgtaagttaattaatgagaagaactaactagaaaattgtgcacaataagtaaaatttgcgcttaaagtatgcgctcttctgacatgcaccactgtaccgtccttcagcgggccctgcgagggtcggtatgaacattatttggaaattatgtgttattaaaaaaaacaactttatttgaaacaacgcagtgaccaggcgatcgaagtacagaatgtaataaacagccagaaaaactattaataacctaatttcgggaaaaaaacctactagacaacaacgaaattctacaagcgacgggtaatcaccccaaccgctgagttttgttgaacaaatcataatggcaaccggacagtagaagccaaatatcaacgacttacctcgtgggtagttgacgtggcaggcatcacaatccgccgctgctcctcctccttgctctgaccattctcctccgctgtggcgtcgccgcctctgtggtcgccgtcgctgctcgcagccacacgttcttccccgccctctcccgtggcggcctcctgccgagcggcggccgtgtcgccggtctcctgctcccgccgcggcgtcggcggcggcggcgatcccgacctgggcgcggcggcagcggcgctgccgaggtcgcggcagagggaggtgtagagcaggaagaaggcggtggcgagcgcggcgccgagcaggagcgacgtggccgacttcatggccccccgccgggcgcctccgcctccgcctactcctagtcctagcgaacggaggagctgcagcgggccggcttgctgcggttgcggcctattcatcatcatcatcatccggtggccggcggctctgtatttatagcattccgtgtaagaaagaggaattgatcggtctactacctacgccgtgtcatgtgcgcgaggggtgagcggccatgtgcgagcgagcgagcatggaaggtggcgcggcgcgaaggagggccggggccgggccacgagcccacgaatgattgattgatcgaggtcgaggagcgaagggaaccgcagaggcggacaaggaagctcgctcgctggtgctgagatggatcgctagcttgggttggtttggaggtccgcgtctacctgagctgaggatgcgtgtgcgaatcaatggtccgctgctcgcccgcgcaacgggagtccccagggagggggagttcgctgagggcttgttatcaaaggtaatga

SEQ ID NO: 11105 - DNA, 1676 bp, Zea mays
aaacccgcatcccgaacattgacgccggcggatctccggccgccaccgccatgttcgggaccccatcccatcactcccgctttcgggaacccctccagcaccccggtttttggcacgccatccgccacccccgcatttggcgcgacgtcgtccaccccggccttcggcaccctctcgtcgacgcctgccttcggcaccccttcgtcgactcccactttcggtaccccgtcgtctacgccagcgttcgggaccgcttccacgacccctgcgttcggggcatcgtcgtcgacgccagcgttcgggaccacttccacgaccccgccgttcggctcgctgaatttcgggacgccctcgtcgacctcagcattcggcacgccgtcttcggcgccggcgttcggcgcactcaatttcggaacaccctcgtcgacctcggcattcggcacgccctcttcggcgccggcgtttggcgcgactccttcgccctcgccctttgggttccagcagcaggcgacgccgtccccatctccgttcggcttgctaggaggtggcggcgcgcaaatcaccacccagatggcccccgttgcgccgctgccgctctccccgtccgaccgcgacatccaggccattgtggatgcgtacaaagaggaccccggtaatccacgttatgctttcaggcatttgttgttcagcgtgacagaaccttcccaaagggtgaagccagttgctgcctcagatattatgtgggcagaagcaatggggaaacttgaatgcatggatagtgcagacagggagaggctgtggcctcagcttgtgcagggttttaaagacctttcccatcggcttaagcttcaagatgaagtccttgtttccgacactgatagattgagcatgactcactctaatgttaaaaagctgcaaaggcatttccaagctgacacgtatccttggatccagcgattgaagcaacaagagctggctattcagagacgtcttttaaggtttgttagaatagtggaggcattggagaatcggggctaccgctgtcctttaacaaaggaggaagctgacttgtatgaaagattggttgctatattaaagcggctaaaaggacataacgctgatctttctaagagggtcaatacacttgtttcgacgtcgcgtcttctggctagcagtggtggtgctggtggttccgtttatattcccagttctgcaaaagttgatgagcggagtgttacagagcttcttgaggccttacaacaacaaacagaggcagttgccaagctaggtaatgtgttgaagagggatatcagggacatggagatcatccagtcagaaggcacggatatggctgaagacaatgtggggagaagggcacagaaaatataagattgaagcaaggtctttgtcgtagctaagtaataagcgggtgatggaaggaatccatcgtcgctagaaggatctgagcctccaacttatttggagtaatgggccagggaaatgatatccctgtgtaactgctgcaggcaagcttgattctgcattctttgggaagctaaccatggtcaattagtagtggtatgtgtagattgtatgttgaactgaggcagtattcttagaactcagctttctcctcgtgccaaaaaaattaacagtgctgttttcttgctcacaac

SEQ ID NO: 11106 - DNA, 1810 bp, Zea mays
ttttttttttttttttgtaataataatttttttacattccataaaaagctttacaaatatatatatataaacaatatatgtatgtatacattagggggaaaaatgagatgtagctgttaagttgtactatctggcgaacaatcgaaaaatgagctcaacccctccagagtctagagtcagtgtatgcattttccgggcacccgccacgagaaaccctgcgcgttgccggcggcggcgcgtgctctgtaggtcttccagtcctgcagcacgttcttgaggtcgaagagcttgttgtccagccccacgcagcagttggcgtgcatggtggccaccctgcccaggtcgtcgccgtgctggcagaaacccccgaagacggccgtgtccaggaactgcacccgggcgccggccgtacccttccttgacgatcttgtcgaagacgtactgctcgtggtggcccgggaacctcgcgcgcgacgcctgccagtggcggtagaagcccaccgtggcgggcgaggagcggacgtagaggaggccgccgttggggtagttgttgggcgagtcggcgtcgccgacgaagaagtcggccgacatgacgacctgcgcggcgcggggcaggcgcgggaacgggctccggaaccacaggatgtccacgtccgtgaagaggaagctgtagcccagctccagcacgctctgctggaaccggttccggcgccacatcatctccaggtagtcgccctccatgtacttctgctcggcggcgaagtccatgccgtcgacgcggaacaggtagcagaaggggtgcacggcgttgcaccgctccagggccctgccgtccatggccacgaccagcaggtgccgcggcaggcccgcggtgtcctcgccctggcggaagctctccaggaacaggtccaggaacgaccctggcgctgcccacgcctcgttgatcgccgtcatcagcaccgtcttgtccgccgtcgccgctcgccggagcaggtccgccagatcctgggacgctgctggtgggctcctcttcttcttctgttgcttcggctgcggtctatggtgggaggtggcctcgtgggttgttgacgtggcaggcatcacaatccgccgctgctcctcctccttgctctgaccattctcctccgctgtggcggcggtggcgccgccgcctctgcggccgccgtcgctgctcgcagccacacgttcttccccgccctctcccgtggcggcctcctgccgagcggcggccgtgtcgccggtctcctgctcccgccgcggcgtcggcggcggcgacgatcccgacctgggcgcggcggcagcggcgctgccgaggtcgcggcagagggaggtgtagagcaggaagaaggcggtggcgagcgcggcgccgagcaggagcgacgtggccgacttcatggccccccgccggccgcctccgcctccgcctgcgcctagtcctagcgaacggaggagctgcagcgggccggcttgctgcggttgcggcctattcatcatcatcatcatctggtggccggcggctctgtatttatagcattccgggtaggaagggggatgtgtccggccgccccccgccgccgtgtcatgtgcgcgaggggtgagcggccatgtgcgagcgagcatggaaggtggcgcggcgcgaaggagggccggggccgggccactagcccacgaatgattgattgatcgaggtcgaggagcgaaggtaaccgcggaggcggagaaggaggctcgctcgctggtgctgactgctgagatagatcggtcccggccggcctcgaggtacccaatg

SEQ ID NO: 11107 - DNA, 1753 bp, Zea mays
cccgccgggtacctccgagccgcccgggaaaaaaaaatctcatcgactctctcctgagtcctgactcctgacatctccgatcgtcaccgtccccgtccccggcgccgtccctctcgctcttgtcctcggtgccgcacctcctacatctctgtctcaccgctttagcacggccaccacgcccgcctgcgctagatcccatctgaagccggcggccatcatacccgtgagcgctagctgggctgcatctctcacctccacagccagcaagcgagcgtggttagcgccgcagtggtttcaccgaccttagatcgggccgtaagctcgaggactgaccttaatttcttgagcttaaggtctcagtgggtttaatcccgtagtgtatgaggttgacctttaaaggccttacggcccccttgtttcgcacgctacagatatcgagctgttgacatctgcgggtgcatctgcggacagccttgacgaggctgccgacgatgtcgtctctcaactcgctcttcaaccgctccaccttcggcacaaaatgcaaaacatgtttaaatcttgtcatttcaagaatcaagctgctgcgcaacaggagggagttacaactaataaatatgcgcaaagaaatggttcaatatcttcagactggccaggaatcaatcgcgaggattcgagtggagcacattattcgggagcaaaatatattggctgcctatgagatcgttgagcttttctgtgaatttgttctggcaagagtccctattgttgaggtccaaaaggaatgccccttagaactgcgtgaagccattgctagtataatctttgcatcaggaaggtgttcagacttgcctgagctaatgcatctccgtaatttgtttaccaccaagtatggaaaggagtttgttgctggtgctatggaattgcgccccgacagcagtgtcaaccgcacaataattgaaaagctctcggtgaaggctccatcaggtgattcaaagctaaaagtcttgaaagctattgcccaagagtacaatattgaatgggattcatctaatactgaagcagaattcaacaagaaatatgaagatctactggacggctcgggatcttcggtccaccagatccagacacctatcattgagggctcagtgagctcaccagttgtttctgctccaagagataagacgccagcattgaattcacctgtcattgatgccgaaaaacaccaagttcgcgaatctccgacttcaccagctggaggtgcaagagctggtgttgtcactaagggcaatgtggtaaccatgggccatcactcccccgctgaggagatgccctccaccagcccaagttcatcagacgcgctggagaaagcccgagctgctattgcagctgccacccgcgcatctgctgctgctcgcgccgcagctgaacttgcaaaagttaaaattacaaatcaatgacacctccagttcgggcaaggcgtgtcaggaagtttaatctggcaactgatcaccaggacagactgaaatgtatttcattgaataaattgttactgtatattccctttgtgagcacttggcacatcatataaggagcgtggctcctcgcctttcttcgaatgtactcaaagagaactatctggaatgcataatgttgcatttactgttcactagttagttattgtatcattacggtttttttacaatacaaaccaatctaaattgcagtggttagagacgaaaaaaaaaaagcggcc

SEQ ID NO: 11108 - DNA, 2855 bp, Zea mays
  misc_feature (1876)..(1876): n is a, c, g, or t
  misc_feature (2221)..(2221): n is a, c, g, or t
  misc_feature (2618)..(2618): n is a, c, g, or t
cattgggtacctcgaggccggccgggccgcttctgcaatccagttctttgctttgcccttcctccgcccccttcctccccccgcgctgcctgccgtaggtacgggaagggaaaaaagtcggcgccaaatctccgcatccattcgcacgccgcgattcttgtgcgcgatccgccgcgcgatgatgatcccgtggggcggcgtggggtgttgcctcagcgctgcggcgctgtatctcctcgggaggagcagcggaagggatgcggaggtgctgcggtcggtggcgagggctggcagcatgaaggatttagctgctatcttggacactgcaagtaaagtcctaccacttgtagttgccgtctctgggagagttggttcagacacaccacttatatgccaacaaagcggcatgagaggtgtgatcgttgaggaaacggcagaacaacacttcttgaagcacaacgatgctggatcctggattcaagattctgcagttatgctttctgttagcaaagaggttccatggtatctggatgatggaactggacgtgtatatatggttggtgctcgttctgcagctggtttaattttaactgttgccagtgaggtttttgaggagtcagggaggacacttgtacgtggaactctagattatttacaagggttgaagatgctgggagtaaaacgaactgaaagggttcttccaactggaatctcattgacagttgttggtgaggctattaaagatgatgttggaactattagaattcagcgaccgcataaaggacccttctatgtatcaccaaaaagcatcgatcaacttattatgaatcttggaaaatgggccaagttataccgccttgcttcaatgggctttgcaacatttggtgccttccttcttgcaaagcgtgcaatacaacattttctagaaagaaagcgccggcatgaactgcaaaaaagggttcttaatgcagcagcacaaaggcaagctagagaagctgaagggagcattggttcatcggacacagagcctaacagtaaaaaagaccaattagtgttggacatatgtgtcatatgccttgagcaagagtacaatgctgtttttgtgccgtgcggtcacatgtgttgctgtatggcatgctcttcacatttgacaaactgcccgctttgccggagaagaattgaccaagctgtcagaacattccgccattgacggtgataccacgtgcactgcttttgaaaccagttggctattggaagtgctggctcctgtcaaccaacgatatgaactgcaaaactgggtcgtagcagcttcttcatggagtttgcttttcgaacagaacagcgagtgatgcaagttgcaagctcatgattggcagttaagaaagataccctactgagatagtgccaatgggtgctcttgcatgtaatgtactactactacaactgtgtacaggacacttgtgtaaatgcacataggttagcagcttgcttcttgactaacacctaatgggcatttatgttgtgctaaccgaatgacaaaattagctcgtttagttgtgataatcgttttttctagtgagtggggaatgatacggatatctccgttcttttgtgctcacaggatcataagaaacagaaaagatttgtaacatgttctatattttactgctcattttgtaacctgaatgtgaggacaacatgttggcgcaaaaaaaaaaaaaaaagtccttaaacacgctccgctttaatttacagtcgtgcaataagatgtgacactgaccgagtattccactgaacgaaagtagggttggacaaaatgtttgtggttcatcggttggtggtcggctcaattgaattttttcatgagctaaacganctattacatttcagcaaaacgaaactatatgcatatcatttatataataattgatgaacatattatatatgtgtggtgtctatggtctatgagttaaactagtgattaatgaactgtgtcaatatattaaattagtctatgtgattataactgtggattaaactgatgaatatatgtgtgattgatgagttatattaatttgatgttacattgatgtagtatgtaaaactatgaatatactattgttaaattagttttaaattaactagaaattgattagtatatacatttatttttttctctcacccgtgagttaaatgaaccagctcgtaaacgaaccgagcngaattgactatatggctcgttagcttaacgagtcgagccgagctggctcgatatcccgtcctaaacaaaagtatgaagcggatgttgtttcccttgctagctaactatgcccctggtgtagcaagttgcaaccctacgatttatatcagattcttagattgagtattaggggatgtttggtttctagggactaattttttgtccctacattttattccattttagttccaaaattgccaaacatagaaactaaaactctattttagtttctatatttggcaatttatagactaaaatggaataaaatgatgggactaaacatccctagaaatcaaacaccccttagtcaaagattaattgatgtctaaaccttaagttgtttaaaaagagagggagngcaatttttctattttaaatgcatatttattattaaacatatttagattattttttggaaattatttatatgtctaatcgatcttcctgaactatcatgaaagttggatttacctcccctatcactaacgtattgacacgtagaacggttaacgtggcactaaaatctctactacttattaaggctataagagtagtctgtcatttctgttctgccaccattctgtgttctatcatc

SEQ ID NO: 11109 - DNA, 4306 bp, Zea mays
aggtaagtaatcgctgtttgctcagctccaattcactgtctcgtatccattttagtgattgcctgctgcctgcgtctccaaaacagcgaagccctcggcaacgcctccaattcttcgaaaccgtttctatgatgttttataatggcaattgtctctccgcccgccggaaccaccaccgttccagaatcccagcgacggccgctggctaagcacgagaccattacctagaacatcctaatcgaaaaattaagccgcccccttctcctcccactcccgcgcctccctcctttcacacccatctcgatcctcccaacccaaaccctagcggacgcaccgctgccatggccgaatccggcgagtcgtccccgaactcagccgcggccacggacgacacgcaccacgagatgccggaggccggagcggctgcggcggcggtgcatgcgcagccgcgcccgccgccgccgccatccaaggtgcggctgatggtcagctacgggggccgcatccagccgcggccgaacgacaaccagctcgcgtacgtcaacggcgagaccaagatcctgtcgctcgagaggccgctctgcttcccggacttcgccgcgcgcctcgccgcgcttgtggggaacgccgcggacgtccgcgtcaagtaccagctgcccggggaggacctggacgcgctcgtctccgtcaccaacgacgaggatctggagcacctcgtccacgagtacgaccgcctccacgtccatcgccacgccacggcctcctccgccggctccagccgcggcggatccgcgcccaggctcagggtcttcctcttccccgtccagtcgcccccgcctccgccgcagccggccgggatcctcgagcctaaggttgagcagcgccaatggttcgtcgatgcgctcaacaccgtcctgctgccctcgtccaagcaggacccgccgcccgtgcccccgcagcagcagaagcaggagcaggagtcggtcttcgcgcagcagtcgccaccgccgcaggccaagcacgaggcggtgttcgtccagcagtccccgcctcagccgcagacggtggtgcagatgcagatgccgccgccgcagcacgtggtgctcgcggcggcgagccccgactacctgttcggcctcgacaatggcttcgtccatccccccgcggtgaaggtcaaggacccggcgggcgatcctcctgcggtcagggagagcgtgcccgtggagttaccagccaaaaacgaggaccgccatcccattcccaaccccgcgggcgacaacgtggctgtctcccctgcggagtaccagcgccagatcccggggctcgagaagctgcaggtcgccgacaacgccgcccaccaaccacctcctcctgcgccagcgcctgcgccggcaccttccctcgccccgactcccgtccccgccgcgctcccgagaaacggcagcgacgactccctgacccgtggctaccctctcgcgacccccaccccgaactccagcgcggagtactaccttccaaagttcccggagaagccccccgtgccgccgccgccgcagtcatccgctccgcccccaccgacctatctgcaggtgcagggcaggtacacatccgtggcccctggctccggcgcagaccgtggccccgtgttcttcatcccggcgccccacggctacttcgccgccacggcctcgccaggtgcgacctcctaccccgccgtgtacgccgtcgcgccacccagtaccgccgccaacggctccgccgcgtcgcccgcggcgtcgaatgccacggcctactcccccgcccccacgcaggtcgcgtacgacagcaacggccgcgccatctactacaccagcatgctcccccagtacccgtcggctgtcaatggcatgtcctcggcgggcgccgttctcgggacagagcccgtgaatccggtggccgtgaagccgaccgtgtcgtgaccaccccagcttacacctcgcctcatcacaaacaccaatggatcaaaattttctttcatcctcaccagtggtcaatggactgtctagagttgtttttttgtgcctgttggtgttctgggttcatgatatgatgacgatgcaagtatgagtagttgtttgttgtgcttagctgtacatacagagcctgtggctgtggacataatgtataagtattatattgtattggcctgcctgttgtagagttgagtggagttgggagttgtttaacaatcttgtgctacaatcttgtgctagtaaaatttgttaattctttgggttgctgtatctcgattaactatagaaattcaatttggcatgtgatatctcggtgctcaatgctcttgcactccactctttgatgagcgtgttacgttatttctctgcccccttgtaggcaaaactactgctagtagtgtggttctgcgctgatcacgggacatcagcgtggtgcatttatgcatctactggtacgtatgtgggtggggtgttgaacagatgagtcaggttgtggcgatgcggttcttgtccgtgatgtctgtttaaatgttgtttggcgatggtgtgtgtgatgaagccgctgtgtcaggttgtcagcgatgtgtactgctgccgtcaatcgttcttgaactgcattttgatatcagcgatgtgtattctgctgccggcaatcgttcttgaagtgcatttcgatgcggtttttttaatctggaaatcgattacatttccatgcgtgatgtgatgtgtgacaccgacacggcgacacacccctgctactgtcactttactcttgtgtgagcactgggaggctgggagccatggtcgttgaaaacgaaggccatctccagtccctcttctgccccatgtaacgacagctgagctgaccaccgacaggtgcgtcttgttcccgcccgcgcccaattgtcacctccaccgcgttcccgccgcgcttgcttgctttgtgctttggcctttggctggcacagaaagaactgtgcgtgctaccctccctaaaagacgacatggagtctgcgtgcaatgcctgtgcatcgcaaagaggatctttcatccattggatgcccatcgactcgtccgtacccaagccccgcaaccccttttggtctcagccgcatggcgcttttgaccaaagccaaagccctgacgatgtgtttggtcgcccctatcccagaccccagtcgccctttttcccgcggatgattgaccaaaagacctgttggtgacgccatgggatccctggcccgggccgtgacctctagcacgactgcacgagcacaggttcgcttcaccgtctgttgccactgcagcagtgcagctgccgacctggtagagtagtggctgccggtgcccgctgtatctacctgcacctgcatgcgcgcccggcaaggaaggcagcagcagccacatggaagtgggcatgggccgcatggctccccattccccgcccgtccgtcacgctgatcacttgttcagcctgcacgtgctggcgtagtttgcaggcccagttagtgccaggccagttagatccgcctaggcgggcccgtgaagaaactgggccggaaagtgaccgtcggcaggtcgcacgcacccaactttaccccgcctgcaagccgatgccgacgccgccagcagcggcagcgcccacaagaatggaatcgggcgcgggcccgttgcgcagcccactggtggtcgggggctcatctgcacccacggcagagtacaacaggaagggagagagaaggaaagcacgagttgccttgccgtgcttctcgctgccagaccgccccgatgtgcggctctctcctctccctctctctggcggtggcgcccaccggtcgcggtcgcggtcgctgtcgccgaagccacgagaaggccgaagaagacgtccacgagtctctctcttattctaaaacttggagcctcgaattctgtcaacttgaacccgttgataatactgcgcttcttccacccagggaagaaaaccagcacctgatctgtactgcacgttcttggtcagccctggcgactcatgccgaccctggggaatctagctccacttgcacttttgcatggctgcaggctcgcggacgtaatttcagctgcaaattatttcaaaaaaacacatattaaacaatatatctaagtaaacattaatataatgatatatatatatatatatatatatatatatatatatatatatatataatgtgactacctagcattcgacgggactaaaatgaaagaggttggttccacacttctatcaatcgaatgtttcaataaaaattacg

SEQ ID NO: 11110 - DNA, 4990 bp, Zea mays
ggatcacatagggattagatatgattaagaggaaaataaactaatttctttctcaatccctttaatctcttcgtgatcctggtcactaaatcagcgcttaccttaaaatagtttttttagtgacaatatagttgaatgggtcgagatgatctaaatgaaaagaaatagagaaaaaagcggaaaagcacgggagcacggacccaccgcagcaacacacagatagacgcggacggacacctcaatcccaactgtccccacacgcctcccgagtcccgacgcaggggaggccacggcaaaaacctaaacgcagtcaagacaccccctccgccgaagccgccacgcttccagaatcccagcgacgacggccgttccctagcactaatcctttctgtatcccccaaacccacccgcctccgccgccgctactcgcaggccaggcattccccacctacccttaacacgcccccaccccagcgcccggccccgcctttttccgatcccaaatcctcccatccccagacggccagacctagcgcccgcgccgccgccatggccgaaaccggcgagtcgtccccgaaccccgccgcagccccggaggacacgcaccacgaggggtcggaggtgcctgctgctgctgtggcggcggtgcatgcgcagccgcagctgcagccccagccgcgcccgccgccgcagccatccaaggtgcgtctgatggtcagctacgggggccgcatccagccgcggccgcacgacaaccagctcgcgtacgtcaacggcgagaccaagatcctgtcgctcgagaggccggtcctcttcgccgacttcgccgcgcgcctcaccacgctcgtggggaacgcccgggacgtctgcgtcaagtaccagctgcccggggaggacctggacgcgctcatctccgtcaccaacgacgaggatctggagcacctcgtcgtcgagtacgaccgcgcccacaacaacggccccgccgccggttccggctccggccgcggcggagccacgcccaggctcagggtcttcctcttccccgtccagccgccgcctcccccgccgccggccgggctcctcgagcccaaggcggaccagcgcctctatatcgtcgaggcgctcaacaccgtctcgctgccctcctccaagctggacccgccgcccgtgccctcgcaccagtcgtccccgccgcagcagcagaagcgggagtcggtgttcgcgcaacagtcgtcgtcgccgccgccgccaccgccgcaggccaagcacgaggcggtgttcgtccagcaggctccgcctcagccgcagacggcgtttcagatgccgccgccgccgcagccgtcgcacgtggtgctcacggcggccggccccgactacctgttcggcctcgacaacggcttcgttcctcccccggcggtgaaggtcaaggacccggcgggcgatcctccgacggtcagggagaatgtgcccgtggaaatacctgccaaaaacgacgaccgccatcccaaccccgcgggcgaccacgtggctgtctcccctgtcgtctctcctgcggagtaccagcgccagatccaggagctcgagaagctgcaggtcgccgacaacgccacccaccaaccaccacctcctgcgacggctccggcacctacccacggccccgtccccgccgccctcccgaggaacggcagcgacgactcccttgcccgcgcctaccctcccgtgaccgccaccccaacctccaacgctgagtactacattccaaagttcccggagaagccgcccgtgccgccgctgtcatccgctccgcctccgacgacctacgtgcaggtgcagggcaggtacgcatccgtcgctcctggctccggcgcagaccatgcccccgtgttcttcatcccggcgccccacggctactttgcggccgccgcctccccaggcgcgacctcctaccccgccgtgtacgccgtcgcgccacccagtgccaccgccaacggctccgccccgtcagccgtggtgtcgaacgccacggcctacgcccccgcccccacacaggtcgcgtacgacagcaatggccgcgccatctactacaccagcatgctcccccagtacccctcggctgtcaatggcatgtcggcaccgggcggcgtgctcgggacagagcccgcgaagcaggtggccgtgaagccgaccgtctcgtgagcacaccaaccaccagcctacaacacctcgcctcacagcacagcccctcatcgccaatgaatggatcaaaggagttttcccatctttctttcatcctcacccgcccgcccgccacccactcgtcaatatgcgttcgttaatactgtgtcggttggattcgtcaacatgcgttcgttaatactgtgtcagttggattcgttatcgtctctagtatgcacctaagtatatgttttcccttataattgcctagagttttcattggttgtctagagttttcttttggcttggcgttcttggttccgtgatatgatgatgatgcaactattagttctttggtgtgcttagatgtagataagagtctggacatgatggataagcactatatatatattagcctattggagagttgagttggacaaatcttgagggtgtcatcacacttctgctagtagcatttgttaattctttggtttgctgtatggatgaattccagaaatccaatggccatgtgatctcgatgagcgtgttatttcctggcccccttgtctgatcacgggagatcagcgtgctgcttttatgtgtagtatgagcatcataaatgcgtagcaattaccttacctgtccattgaaaacgaaggccatctccattatccagttggcaaccgacaggtcctgttccctcgccgcccgttgtcacctgtaaagacggcgctgcgtgcgtagaaaaaaaaaaggcctgggagggatgcccttgcatcgcagagaggatctttcgacggccatcgaggtatcatcatgcctgggatgcccttgcgcgtcggtgtctgaaagcgcaagcatgtcgagcctggagcggatgattccatggaccttttacccatgcaggaggtgacctgtgtgtgattatactaccccgctcgctggttgtatgttacatgttccttgacgatgattgcaagcaaacgttctgaaaaatctttggtgagcgttgcccgaagatggcttcgtcccgtaatcggctatagcgcacaccgaaatgcttacattctgaatcgtgacagaaacatcaaaggcataaatgatctcagcttgcagcgggcgctcgctgagtgccagtccagttagtcgcgtctcgatgggcccgtgagtgaaactgggccagaaagcggacccacctccactccgccgccgacgccgacttgagtagcgcccacaaggaaggaatcggtcgcgcagcccaccggcgggcggggccagggctcacatccatgtccacccgcgaccgcgaaacaaggagtgcggctcgttctgcctcaggcgccgccgccgtagccgaagcagcgactgcaccccgtcgatcctgatcctcatcctgcgcctggccattccattcatgtaaagtgcagtgcagcaacacctttgttttgttgcgtacaacaaagggtcaccacacaagacaacaacgttcccagttcaatggttccagcttgctggttaatactacttctcttagcacgttcaaaattaaccaaaggaaatattccaatctttgcataaaagatacaaactctatttgtatcaaattttggtcgagccgtaacggttaagaacataattttagggatattgttcttactcctacgtgtacgcaagggctcttcttcatcctgaagcaaacactgccgaaggtgctctgattaactgtattgcatgattgtcttaaggacacgacaaaagtcatgccgaagatcactggttgacgaagaaacaatcagctgactaacacatagcttcggcataagtatatatgttttaggaacgtttcttattacatacgaagctaaccttcggctgaagcattaaataaagacgcttcgtccatgcgcaaacaacaagtacgaaaagcaatgacttcgagcacgagttgaaaaggaaatcactaaatgacagatccgcaaagtcaaagatagagaaaatacaatattgaccttgtatcgtttgtaaacagtgtatgaaagccttggtgggcattattggaaatctgtatagagacggttcgtctcccataataaatagatgaacaataccctacctaaagtaccttttacaagggccataaatttgtagtgcttagcctttgaaaacctttgtgcatcctattgttcaggagtcgaaggtatatttgtaaattcgtataatgtaatgagagacatagacatattgagaatgctaagcaaatagaggtaagttctcatgtattatttaaattgtctctttctatcgcatttcacttatgttatgcatgcgtatccgaagaccttcgcccttcgcgctcataccccgaaagagtattaacctcaggacgaaggtcttcatttcttaacacgtgttgtcgtgattttcaacacctttaggggattgagatcaagtacccaacataatatctctctgattttctagagagatagaaccatttttcatcgataaaaccatatcaaataggcgcttaaaccttggattatctagcaagctaataggatcaagcgttgttaataggattgagtagagtggtgttggatggagaagaagaagaagaagggtagaacacggcacaaggacaaagaagagacatttggcgactgggataaggtattcggttcttcgttattcactttagtgttcagaagtcacatataatgtagtgctaagactcctattacatggcccaagtaggcccatggtatttcgtattgggattcttttcccacctcggcttgttcacttagctcccgcc

SEQ ID NO: 11111 - DNA, 821 bp, Zea mays
ttcgcacgagacctttattgtgtttaaacactagaacatcctaatcgaaaaatacctaaagatttagcctgaatagaagtgcatggaaaacaactattcatgtgtctgaatcttaatcgtggtttctattggtttttaactctagcctaccctaacttgcttgagataaaagactttgttgttgttgttatagacttatagtgttaacttttcatgttgtatccatgttattttcataaacctgtcgtagatgtcactgggcttgcatgtagagatttttgttatgtttgttttcttgttgcagggaggatgggagaatgatgaaactgttgaagaggcagcagctcgagaagctatagaagaagctggagttcgaggtgatatagtgcattttctggggctctatgacttcaaaagcaagacgcatcaagatgcgtgctgccctgagggtatgtgcagagctgcagtgtttgcgctgcatgtaaaggaagagctggcctcatggcctgagcagagcacccgacagaggacctggctcacggtccctgaagctgcatcaagttgccgataccagtggatgcaagaggccttgctgacaggcttctctgactggcacgacaagtggagcagaggcggcggcggcacaaactgtgacccggcctaactgctgacaggcccatctgcagtcgtccaatttgttcatctcctctctttccctaggcccccaaccttgcagaatgcaataatacagtgtacttgtcttaaaaaaaaaaaaaaaattgacatgttatcttagtcgtagtgggacgaggtacatctca

SEQ ID NO: 11112 - DNA, 1210 bp, Zea mays
  misc_feature (1104)..(1104): n is a, c, g, or t
  misc_feature (1130)..(1130): n is a, c, g, or t
  misc_feature (1157)..(1157): n is a, c, g, or t
  misc_feature (1159)..(1159): n is a, c, g, or t
ggaccctcgaggccggccgggagactataggcagtaaaaaagcgcggtgggtacccgcagggaaaaaagaagggcgccctcaccggcgaactcccacctcctatcgccccctcacctctcctttctctctctagccccgcacaaatctctcctcccctcttgccctcgccgcattgcccgccgacgacccccccggcccccgccggatagagaggaggaggagcggcgcggctgcgggagagccgggcggcggcggcggagcgggcttcatgtgcgacctagtggcccgcacgggccggcatcagcagcggtacgaggatggccgtcggctagtggccggatgcataccatttaggtatagagctaacaatgatgaaacctctggtgacaaaactaagaaactcgtggaagttctcatgataaattcccaaagcggacctggtcttttgtttccaaagggaggatgggagaatgatgaaactgttgaagaggcagcagctcgagaagctatagaagaagctggagttcgaggtgatatagtgcattttctggggctctatgacttcaaaagcaagacgcatcaagatgcgtgctgccctgagggtatgtgcagagctgcagtgtttgcgctgcatgtaaaggaagagctggcctcatggcctgagcagagcacccgacagaggacctggctcacggtccctgaagctgcatcaagttgccgataccagtggatgcaagaggccttgctgacaggcttctctgactggcacgacaagtggagcagaggcggcggcggcacaaactgtgacccggcctaactgctgacaggcccatctgcagtcgtccaatttgttcatctcctctctttccctaggcccccaaccttgcagaatgcaataatacagtgtacttgtcttgatgctgggttggtcattgacatgttatcttagttgtagtgggacgaggtacatctcatcaagacgagaattctcacaacttttaagtgtcaattctcgtgccctattatttctcggtttcatccgctgtcgtcgcggtgctgcaggctgcaggcacgcgccgcacgcattgtaactccgctcctgnttctggagatgcatatgctatatgtntgaactggtataactttgaaatcaatncngcgctgcgccccttgtgctaacaaaagacttcctcaaaaaaaaaagcggcc

SEQ ID NO: 11113 - DNA, 3523 bp, Zea mays
  misc_feature (488)..(488): n is a, c, g, or t
cagcctgcttcgtcgcgagcaactgctgtgaccgaggccgcgcttgcgctacccacaccacctccaatggtggccctccctgctcccctgcgccagttccgctgcctcacacttgccgagatggccaagcgccattgccaagggtcgtgttacaactgcgaggaatcatacgtttagggccaccaatactagtgtctggtctattgctttcagcttccagagggcactcgtctacatgacgtgttttcacgtggggctgctcaagccgttctggagaccctctgacaacaccgctcgtgtcggccgtacaggacaaccgtctcctgctcgttctagagtgtgcaatgtgcgcccaactacgccggggcgcttgacatgttctcgtccagtggcgtggcttgcccagtgacgacaccatttgggagccgcttcaacaattgaaggacctctaccccaacatttagcttgaggacgagctgttcaaagtngcagggggagatgttatgaccggcgtcacctataggtgcgagggccacgatagtggctaggccacacgagtagttagggatgaaatacccatgattttttttcttagatgttttgcattgtttccataaaaaatgggaccatgattaattcttgctaggaggttttcataaaaaaagatcccttgcttagggatcaagtgagtcaattatcttgtctggcctcaagggccgtcttccacttttctctcactcgcatgctccctgtgcatgaccatggcttctgtgcgtcggggtacacactccggccaccgatctcctacccgtttaacctactggctgatcttagagcgtaggcatgggggcacgacatggaagaaattctctactggccatccacacaggtcacatctctcatttacctggtgcctatgacacttgttctccctcgtctgtatcaacatatctgtcattcaagcttatcaagtgccagtcatacattctagtggaagaaacatgagatgcacattgtgtagttttctcagtggttcatgacactgatgttgaactagttactttgattggatttattgtttgttgcttagtctggtgtgtccttcgactgccacaagtgggaactttttttgtccaatcttaagattgtaattgacattctagtctgaatgttggatagcacaatcgagattgacatctgttcctgctcgttgctcctgtaacacttctgtgcttacatagtggaagacccatgaaatcaatgattatcttttctagaaggctcttatatctcgatgaacacatgtggtggcaataaagatagccttaactttttctctctccccttgttcttagtgctgcatcatgatgaaacagtgtccaatgcttggccttgatgatggcaatagaatgcttatacggtgctagcttttgtctgtcattcaatttcgtaaagtgtctattgcaacacaagttgcccccccccccggtccagctatcttgtcgtcaagctatagaagaagctggagttcgaggtgatatagtgcattttctggggctctatgacttcaaaagcaagacgcatcaagatgcgtgctgccctgagggtatgtgcagagctgcagtgtttgcgctgcatgtaaaggaagagctggcctcatggcctgagcagagcacccgacagaggacctggctcacggtccctgaagctgcatcaagttgccgataccagtggatgcaagaggccttgctgacaggcttctctgactggcacgacaagtggagcagaggcggcggcggcacaaactgtgacccggcctaactgctgacaggcccatctgcagtcgtccaatttgttcatctcctctctttccctaggcccccaaccttgcagaatgcaataatacagtgtacttgtcttgatgctgggttggtcattgacatgttatcttagttgtagtgggacgaggtacatctcatcaagacgagaattctcacaacttttaagtgtcaattctcgtgccctattatttctcggtttcatccgctgtcgtcgcggtgctgcagcctgcaggcacgcgccgcacgcattttgtaactccgctcctgattctggagatgcatatgctatatgtatgaactggtataactttgaaatcaaaagttgccactgttgactcgaaaaaaaaggccggccgcgcgcccggtggacctcgcaatctgtttgtctaaggctggctggggaggcagccgggttatcaaaccccatttttagtctcggtattcagaagtttctgtctgttaaactttatgaagggaaagagctcatatgttcttgagagctaatcatgagatcaatcactgtgacgggcacgggcccaacccaacccatattattgaaccataaaagcacaggtttaatcattgctctttgggcgtgtgggttgaagcgtacgcgctagccaactgtgccaccacccgcttgtgttccgttcttcaatagtccttttctatacgaaaaatgttctatccggtaggagcaactcgaaagcttcaatccaaacaggcacgaactggttataatgaaacataatgttttgcatcaggaaaatctaaagacaaacggatgcttagagggtgtttagtttctagtgactaatttttagtccctccattgtattctattttagtccctaattttgtttttttatttgttaatttagaaactaaaataaaataaagtggaaggactaaaaataagactattttcccttttaggaaaaaaacaccttatagatgaggatacgcagttctgttttttctctcactaccggacacaattgctttctgattcgtccataattctctcgctaccagtaatatatgaacagctcctgggcgtatcaccgtttttcatttttcgagtgacttgtagttcaatctgaattatctgagaaaattaaattaaacgaactaaatctaatagttatagcaaacacttttataattgtaccaaaatcgaacatgtacgcctacatagtgtataacacaccacaaaaagtttggtgggaaaaggaaaaaatgaaaatatattttgccgagtgtcaagaaagacactcggcaaaatatagatgtgccgagtgtttgcaaggtgacactcgacaaagcagctattttgccgattgtcaacgcctgtcgctcggcaaagttaacgaccgtcaactatagacgactattgatgaccctttgccgagcgtcgtgttttgccgagagtttgacactcggcaaagccccctttaccgaatgtctttctatgtatagtgtctcgctgtcggtaaacgaggctgttgccgagagtcttatttcgccgagagtgacactcggcaaagtacgttttgccgagtgcccgataaaatgtactcggcgccgagcacttagcaaagagccagattccggtagtgtctctacataatttgttacctatgatttctacttaaattgctaaacaaaaatagattttatca

SEQ ID NO: 11114 - DNA, 2424 bp, Zea mays
gcacgagctcacggcgaactcccacctcctgtcgcccctcacctctcctttctctctctagccccggacaaatctctcctcccctctcgccctcgccgcattgcccgccgacgaccccccggcccccgccggatagagaggaggaggagcggcgccggctgcgggagagccgggcggcggcggcggagcgggcgtccggcgcgccccgtccgtggcccgcacgggccggcaccagcagcggtacgaggatggccgtcggctagtggccggatgcataccatttaggtatagagctaacaatgatgaaacctctggtgacaaaactaagaaagtcgtggaagttctcatgataaattcccagagcggacctggtcttttgtttccaaagggaggatgggaaaatgatgaaactgttgaagaggcagcagctcgagaagctatagaagaagccggagttcgaggtgatatagtgcattttctggggtcgtatgacttcaaaagcaagacacatcaagatgcgtgctgccctgagggtatgtgcagggctgcagtgtttgcgctgcatgtaaaggaagagctgaactcatggcctgagcagagcacccggcagaggacctggctcacggttcctgaagctgcatccaggtgccggtaccagtggatggaagaggccttgctcacaggcttctctgactggcacgacaagtggagcataggtgacggcggtggcggcggtgccaactgtgtgacccggcctaactgctgatgaacccatctgcagtcgtccaatttgtccatcctcccccatttcccctaggctccgacattgcgtaacgcaataaatacagtgtacttctctcgatgctgggttggtcattgacccttggatggttatcttagttattagtgggacgaggtatatagtatttatatctgatgaagacgagaattctcacaacttttaagtgtcgattctcgtgcctgtttatttctcggtttcaggtcaaaaaaaaaaaaaaaaacaggcacgcaccctgcgcactttgtaactctgctcctgattctggagatgcacatcctgtgtatgaactgaactggtataacttgaaaataactgttaagtcaaccaggcaaaaaaaaaaaaaaaaagaagtggcgcatgatcttaaacatctataaatctacttgcttggctatggcaagaacatcagttcaaaaggggaaaaagaaaacatgctgcctaatttgtgtgtatgaagtcctaaaccctagtaataaataaaactaacaacaatatgcttttgcggcaaaagaaaggaccaaccgtgcaagattgttataaaatatacacatatattgtagtgagaactgagaagatacgtgcagtgtgttttgacattagtagtgcacgcacgcatatgatccccatgcaccgaaagaaacgacaaggcaaaaagagagaaaatgcatggttccaacttccaaccaagagctagctagtcaaagctagctagaatcggatgcaattcagaatcccgaacaatgagaagggtggctgcgctttctgaaaagagaacgtagatgacaaatatatagaacgatggtgcttattactccagcgagtccaagcagttttaattgagatgcagctcgatcacgtacgtcgtctacaatggcgtgtggaactgtgaacgcatggacaccagtgcagatctagacgcattttataactagtactaatgctgctccttttttgcattcagtggaagaatatgttccgctccgctcctatttaatttgcttccacacgcaataaagatcgatcgagagttcgagaccattgtacgtactagagggatgcaaataaccatgattttattagtgggactatggttttaattctatttattttcactagcttctaaaacattatattcatcaatgtcgtacttctagttataaacaacttcacaaattataatcaaccatgcagtatatctattctttgacaaagttcatccagattcaaaatgcatgggacgtttagctaattaaaaaaaaggggtcaaaaaggcaaaaaattgctattttagcccttctaatatgggtatctgtgtctatgatttgtgggatcatctgtgtttatgatttgtgggcctcgtgataaaataaagaagtacacaactgatagtgacaaaatagcaaattccccggtcaaaagggacactactagatccatcggaggggttcataccacgccaggcgcccaagccaaatggccgatagccgcggcccacggcccagtggcagtgtccctgtccctcaggccctcacgatgagctaaccacagccctagtcgaacaagtccaacgcctcccccaagccgcaggaacgccgccacccgccgccgactgcaggcatgca

SEQ ID NO: 11115 - DNA, 994 bp, Zea mays
cggacgcgcgccctcacggcgaactccccacctcctatcgcccccctctctctagcgccgcacaaatctctcctcccccgctcgccctcgctgcattgggcgccgccaagcccccgccggatagagaggacgagaagcggcgtggctgcgggaggagcgggcggcatgtgcgacctggtggcccgcacgggccggcaccagcagcggtacgaggatggccgtcggctagtggccggatgcataccatttaggtatagagctaacaatgatgaaatctctggtgacaaaactaagaaagtcgtggaagttctcatgataaattcccaaagcggacctggtcttttgtttccaaagggaggatgggaaaatgatgaaactgttgaagaggcagcagctcgagaagctatagaagaagccggagttcgaggtgatatagtgcattttctggggtcgtatgacttcaaaagcaagacacatcaagatgcgtgctgccctgagggtatgtgcagggctgcagtgtttgcgctgcatgtaaaggaagagctgaactcatggcctgagcagagcacccggcagaggacctggctcacggttcctgaagctgcatccaggtgccggtaccagtggatggaagaggccttgctcacaggcttctctgactggcacgacaagtggagcataggtgacggcggtggcggcggtgccaactgtgtgacccggcctaactgctgatgaacccatctgcagtcgtccaatttgtccatcctcccccatttcccctaggctccgacattgcgtaacgcaataaatacagtgtacttctctcgatgctgggttggtcattgacccttggatggttatctttagtattagtgggacgaggtatatagtatttatatctgatgaagacgagaattctcacacttttaagtgtcgttctccggcctggttatttctcggtttccgggcagctgcagcctgccaggaggccccc

SEQ ID NO: 11116 - DNA, 2232 bp, Zea mays
gccccgccccgccatggaggacttcgcgcgcgcggtggaggacggactcaagctctcgaagaggctcgtgctcccgggaggggtgccgccgccgcgcccgccggcggggatggagcgcaccgtgtcggccgcctcggcgtcgggtcccgacccgcggctgctccctaccgcgccgatggcctacgcgctcgtcaccgacccggccgccgtcgacacccccgacgtgcccagctaccagccctacgtctacggcgacctcgacccgcccgcgctcatcccgctgcagatgaaggaggtcgacctggccgtcgactgcgcgctcgacgccgcgcacgtcaccctgcgcgcgcgctggtggctgcactgcatcacgcgaagccgcgactccgacgtgcgcctcgtcgtgcccttgggcgagcaggcgctgaggttactgttggaagaagatcatataatacccaagtaatcgaagtagaagaccacactttggagaaacatgcaaaaattgagagtggtggccttttgcagccacatctgtttttcttgacaatacctcaggttgagggaggagcagatatttgtgctacatttcaatggtctcagaagttactttatgatagcgggcgtttctctggtgacatacctttccgttttccatactttgtgaatccattaccaaaagtgttcatgaagaaggaaaaaattcagttgactgtgcacagtggtttcagtaaagagattttgctgcaaggaacaagccacccgttgaaggaaaagagtaggcaaggagataaattgtttttccatcatgaagccattgttgagaattggtcgatcaaagatttcaatttttcatacaatgtttactcgggtgatttgtctggtggtgtgcttgtgcaaccagcaacattatgtgactatgatgatagagatatgttctgcatttttcttctacctggaagtggcaacagaaaggccttacaattggagtttgctatgaaagatttgggtgacctacatcacttcctggggatgcaagttcaacggcgagatggcggcctctttctctcgcaacgtcaatatatgctggatattctggatcgggctggtatggcagattgcaagccttgttctacgcctgtcgacacaaacccaaaggtttctgcaactactgatttgtcttcacatgcatgatcctcgcgagcctcaccttgctgctttgaagcgcattcttcgttatgttcgtggcactctgcatttgggtcttcaatgactgtgtctcgctccagtgctgaagccgagtaccgggccgtcgccaacactgttgctgaatccacctggctgcgccagcttctggccgagcttcgtcacccgttacgtcgtgccacgttggtctattgtgacaacatcagtgcagtctatatgtcttcaaacccggtccagcatcagcgcaccaagcacattgagattgatttgcactttgttcgggatcgggtggctctcggcgatgtccgcgttctccatgtgcctactacctcccagtatgcagacatcttcaccaaggggcttccctctacagtcttcacagagttcagatccagcctgaacgtctgcggtaccgacgatcagactgcgggggcgtgttagctgatatatcagacttgtgtctcctaccatataggcgcaggataccctaccatacatgtgcaggcatccttgcctttctagctacagccgcatataggaagatatggattcaatcctcccatttaggggcagtgattgtttccttccattccaggagatctcagggtactgtttctataaacctgagatctcccacctctctgtccctctatatatatgtgcgcctgtactactctattcatcaatcaatatagacagcaattatcttgctatcactcatgaaggacatcttttagtatttaggatcgatgctacagagagacaacgatattgataaagatgttactggagaatcaaagcagggtggctaaagtgacgtcaagcatttgccgttctatatgataagagggtaccacataagctaaaatgcaagttttataggacgacggttatacgtattatgttgtatggtgcaaaatgttggcctataaaaagatgacatttcatagacaagtgttgcaaaaatgtgtatgttgcgttgggattatgggcataccagaagagattgagtttggaatgatgata

SEQ ID NO: 11117 - DNA, 4021 bp, Zea mays
atcattctactttggatcctttctctctgtccatgtcatactataattttatatacagaaatatgggatataattttacaggtagaaatatgagattacaccttatagatagggtagtaggctaaatgaaaatgtaaaaattggatatgccatatttgagtaattcgggataaacgaaaatgacctggatataatatagcctaaattgtttcgttccattttcatttttgttatcccgtttcgtatcgttttcacatttgtccgaaaatacgaatttgagcggggtaaatatgaaaatcggtatcgaacagaacgagatgttttctcgaccgtttacgtccctgcacgtatgttatagctaatctaattgaaacaagtgcagatcgtttgtgtttttccgataccaaagccaacattgagcgtggatacccgaccaactgattcgctgttctggtacaactaacaacttgttcgcacaagattaaaccagtgatcattgcacagcctgaaccaatgcagtgattcagttgcacggagggagcggcgtgccgcacaggcacttgttgtgcgcgtagcactctgccccgtgcatggacatgaaccttcccgccgggagctcgccgcagagctcgttatagctgacatcgaagtgctccagcctcacgtccatcagcgacttggccactctgcccctgaccctgttgtggctcaggtccaggaacctgaggtggtgcgggaacctgacctccgtcaggtcgaactcgagctggttccacgacaggtcgatcttgaccgccggcttcgtgatgccgaacaggaacgacgaggggtcaccggtgagctggttgtgcgagaggtcgatggtgtcgacgtcgccgtcgccgtagtcgccgggtatctcccccgtgagccggttgttggacaggatcaggaacctggagctcccgtgcagcagctccggcgggatggcgccgctcagcatgttgccgctgaggtccaggtaccggaggccggggagtgcggccagggacgacgggatgggcccggccagcttgctgttggcgatgacgagcgtcctcaggttgacggcagcagcgaggaggcagcccgggatgggcccggagatggaggtgccgtcgatgtcgaggtcgaggaggcgcgtgaggttggcgaaggaggccgggacggggcccgccaggcccggcacagagtccacctggaggatctcgagtgccgcgaggtcgccgagcgccggcgggactcgcgccgagacgtcgggcagggcgtagagggccagccccgtcacacggcccgccgcgttgcagaacactgccgggtcccacgcgcagcagttagtggacggcagccatgaggagagctgcgccgggtcgccgagctgcgccttcacccgcagcagcgcggcgcggtccgcggggtcgcagtccgtggcgtaggtgggggcggtgtaacaggccgagaagagaagcagcagcagagagagcaggccgagcgacatggagcagcagatcagcgatgggctcgacgacattgccgtgatcgcctttgctctggccgccaccgcacaatctgtggtgcgcttcatatatagcactagcacatattacttcttattaggaggtaatataagaaaatatatttatgagaaaatgagaaaaaaatatcgatcaaataacctgacgtgcatgaacatgcatgctgcatggatctgagaattttattggttgcaaaatgtacctagcatgaacatgcatgctgcatgatcaaatgtacctagcatgaacatgcatgctgcacgttgtacctttgcgaccctttttacctagcatgagcatgcacgttgcacgttgcaacctgtacaagaagaatatgagaattttattcgttgcacgatgccataagaaatacaaatacatcctccaaataatgttcgatcaaaggggaggagtaaaagaatcaagagagctaaagaactaccaaagcctcgcaaaggaaagaatgcgaagaaattgatgacggagacaactttattgatttatttgctgttttttttggaactatctgttggctgacattgctcaacaacacgtgagactaatatgtgctaggcactgctgtttgaaccaaatcttcatagccaactctgaattttagctctgttggcagcttggcactgtattaactgaattttagttgtacagatccattttcttgaatgtgcaaacaacatttcagagttgctagctccaaatgagccaacggaacacatgcaacatgatagaaaggcggcgacgttgctccctgcaacaggaagacagagagcacctatgtccatcgcctgggtaaaaagggtcgggcggggtttcttgaaaaagtagtaagaatactgcagagagtatgagagagcaattttgcaatttgtgtatcatccgttggatcacatatcaatggctcacgttcgatttgtcatttgtgcgccggggcatccttgtgcatctcatacgatacaagtatttcccatatctcgtatgtaaagctttttagttgaatggctttatgtcatactcggttctaatttataatttatttaactttttttacacaagttcaatcggtttgtcttattaaaaaatcatagttagtgttatttttttactataatatcgtttagcatataatttagcataaaataagaccagtcgatcaaatttgataaaaaagtcaaaaatcgggactataacataggacagaggaagtatataaacttggatttatgtagaacgtgaattataaattgagtattttttatatcccaaagggtagaatgtgaagccaaggaggcgctatgaccaactgaccgtgaaggatcggagcagctggcatgcatggggcgtgattcgcataccggccaatgaaaattgctcaagccgtgcctggctccacagagatgcctgagcacgctcctcaagtacaggaaagttagaggtcggttaggtcaccgaacatctcgatcaggatcagttgcagagtgtctaggcgctgtgtttctagtcttcgcagtaagaatcaaatgattgtcgaaactggtcgacaccgagtatacaagtagtatgggtgaggtccagggtttataatcctgctcgagaacaccgagaaggcgataaaccggtccggtttcacgttcccaccgagttttccggccgatttttttttaaaatcatttaaaattcaaagaaatataaaaatagagaaaaatatgataaaaatatatgtttttctaagtaatcctatgcatgccatgtttaatttttacttttttaaataacaataattaaaaacatatctagtgcatatgagcctttggtgcatatatagtatacatgaactaacaaatttcacaaaaaaaatctgaaaaaaccatacatattatctccattttacttcaattatatacaaaatttaaagttaaaatttattatactttacttgtaataaaaagatatttttttgacaagtttaaattagaaaaacggctaaaatgttctttttattatggctaaatataacgaatttgaaattttgtatataatagaagtacaatagaaagaacatgtatgcattttttcagatttttatgaactttattagttcatgtgcaccaaaggtgaatgtgcacgagatatgtttccttagtatttttagtaaaaacaatgaatttcgtaaaaaaatgtggttcctctgtcggttttaccggtttcttgaccattttttaatttcccgtctggtttataaattaaaatttatttatgccgagaaaaatgagttttatcgagaaacactgaaaaacgatagattttattggtttctcggtcgattttaccagacagggaaacaaaatttattcttttattttgaaatttgaaaccagtcgatatttggcaaacgagaaaccaccaaatcctgttttcaacaacaaacgggaaatagggatgtaatggtttta

SEQ ID NO: 11118 - DNA, 3640 bp, Zea mays
gatcggagaagaacacgacagagtttgttaccggcaaagggacccacgtccaacgatccatgagcacgcgatgcactcaaaggctacgggcgggtcccactggttggtcttagccggatcatgggtgcgcgatgcatcggcgaccgcttcctttcgtgtggggaggctgggtccgcggacgaagaagtggaggtgggccgggtagcggcccacacgggcgaggggaaggaaaacagaattgggctatggaggaaggttttggcccggccccctgtttccttattttttattgatttctgttttaaattttcaactttaaattcaaatctcgaatttcaaattgtatttgggtggaaaactagaatctagataaatgcacaatcaaataaatactcaacatgatgcatatttctatttatatatttttatagtaattgtttaatccttttggttaaataacatgcttcgaaatatgccatacaacaattttcagttttgaagaaatattaatttaaacctatagtcaaatgaaaggtttatccaagatttattaattgtttgttgtaataggagatatatatattctccaattacaaggtgcttttgacttaaccttatttagagaaggttttctagtcatacaattcatcaattattaattgtagacatccctgctttatttctttgagaaaataaaacctaatttcctagggttaaatataataattttttagatcactatttatccaaaaaaatcattgttatagatattttaattattgtttttgaagaaatatttataaattccaaaataaaattttggatgttacgttggtgcactggcctgggccacgcaccttgctaaaaccggcctgggccgatttctttgttccccgcacaatataatcacgagcataggctggcctcactcgtctctaaacaggccggttctcttcaaacatcgtaattctgaccccaaattggatccccttcatttatatttgatgttttaatccgacttttgacttccagattattttttgctgtcaacaatcctagctccagctgtcatttatccaaaggtttatggtggcagatcttaacggctggcatacgtgcagaatttctcctttctttacagttacacccctcccctccccctcgtgtcggggagtgtgcagtgcacatctgatgtgtataaataatcacacgcacctatgcccccgccacctcccgcgttcctccactccacggctcccccaccccactcatcacactctcccaccgcacctcgccgccgcggggcaccgcgccataaagtgcgttcccggctgcacggacgtcgaggagcagctcgcaagtgtttcttggtgcgtcgatcggcaagatgatcaccggcacggacttctaccacgtcatgacggccatggtgccgttgtacgttgccatgatcctggcgtacggatccgtcaggtggtggcgcatcttcacgccggaccagtgctcggggatcaaccgcttcgtggcgctcttcgccgtgccgctgctgtccttccacttcatctccaccaacaacccctacaccatgaacatccggttcatcgccgccgacacgctgcagaagctgatcgtcctggcgctgctcactgcatggagctacctctcccgccggggctgcctcgagtggaccatcacgctcttctccctgtcgacgctgcccaacacgctggtgatgggcatcccgctgctcaagggcatgtacggcgacttctccggcagcctcatggtgcagatcgtggtgctccagtgcatcatctggtacacgctgatgctgttcatgttcgagtaccgcggcgccaggatcctcatcaccgagcagttccccgacacggcgggcgccatcgcctccatcgtggtggaccccgacgtggtgtcgctggacgggcgcaacgacgccatcgagacggaggccgaggtgaaggaggacggcaagatacacgtcaccgtgcggcgctccaacgcgtcgcgctcggacatctactcccggcggtccatggggttctccagcaccacgccgcggcccagcaacctgaccaacgccgagatctactcgctgcagtcgtcgaggaaccccacgccgcggggctccagcttcaaccacaccgacttctactccatggtcggccgcagctccaacttcgccgccggggacgcgttcggcctgcgcacgggcgccacgcccaggccgtccaactacgaggaggacccgcagggcaaggcgaacaagtacggccagtacccggcgcccaacccggccatggcggcgcagcccgccaagggcctcaagaaggcggccaatgggcaggccaagggcgaggacggcaaggacctacacatgttcgtgtggagctccagcgcgtcgcccgtgtccgacgtgttcggcaatggcgccgccgagtacaacgacgcggccgccgtcaaggaggtccgcatggccgtcgcctccccgcgcaaaggtagcttctcctcgtttttggcttttgagctccttccttcctgctttggctgcgctgcatgctctcacacacacctgttctgttcttgttggacgttttagttgcggcggacgggaggaaggagcggggcgaggacttcgcggagcgggacgacttcagcttcgggaacaggggcgcggcggagagggacgcggaagccggcgacgagaaggcggcggcggcggcggcggctgcgcaggggaatgcaggcgccgtggcggcgcccgcggcgatgccaccgacgagcgtgatgacgcggctgatcctcatcatggtgtggcgcaaactcatccgtaaccccaacacctactccagcctcatcggcctcatctggtcgctcgtctgcttcaggtaaccagcggcaccggcgcggcgtgcttgaaattagtagtgggcgttgcatctttcgctaacctgtttcgtttctggacacgaacgcatacgcaggtggaacttcgagatgccggcgatcatcctcaagtccatctcgatcctctccgacgccgggctcggcatggccatgttcagcctcggtccgtggatctcaaaaccctctctgctgcctcctctgtctggagtcgcatcgccacgccacctatggaacagttaacccccttgtactgacaccgcgcgtgacgtcgccttcctccgtgcagggctgttcatggcgctgcagccacgcataatcgcgtgcgggaacaaggtggccacgttcgccatggccgtgcggttcctgaccggcccggccgtcatggccgccgcctcctttgccgtcggcctccgcggcacgctcctccacgtcgccatcgtccaggtaaaaactctccgaaccgaaccgaaccaaaccaaccaaccgcacaaacaaacccactggcaggcacgcacgccactgacaagggccgcaccgccttttgagaaagagatgaaaaaaaatatatccaagcacaagcagcggtcaagtggccggccgggcatgccgatcgatatgccccctgtgccggtaaagcgcggcacagcctcctttcgcttttggactttgcacgcacaacacaaattcgcccttttttttgttgcccccccccccc

SEQ ID NO: 11119 - DNA, 1283 bp, Zea mays
  misc_feature (77)..(77): n is a, c, g, or t
  misc_feature (80)..(81): n is a, c, g, or t
  misc_feature (92)..(93): n is a, c, g, or t
  misc_feature (97)..(98): n is a, c, g, or t
  misc_feature (109)..(109): n is a, c, g, or t
  misc_feature (120)..(121): n is a, c, g, or t
ttaacatcgtcggccccgccgccaagggaggcggaggagcggcgggggacgaggagaagggcgcatgcggcggcggnggnntaggacactcnncgcnnccgcaggccgncgccgtgccgnncaagaggaaggacctgcacatgctcgtctggagctccagcgcctcgcccgtgtccgagcgcgccgccgtgcacgtcttcggcgccggcggcgctgaccatgccgacgtcctcgccaaaggagcccaggcctacgacgagtacgggcgcgacgactacagcagcaggacgaagaacgggagcggcggcgcggacaagggcgggccgacgctgtcgaagctggggtccaactcgacggcgcagctgtaccccaaggacgacggcaaggggagggcggcggcggtggcgatgccgccggcgagcgtgatgacgcggctcatcctcatcatggtgtggaggaagctgatccggaaccccaacacctactccagcctcatcggcgtcgtctggtccctggtctcctacaggtggggcatcgagatgccagcgatcatcgcccggtcgattttcgatcctgtcggacgcgggtctcgggatggccatgtttcagcctaggcctgttcatggcgctgcagccgaggatcatcgcgtgcgggaacaagctggcggccatcgcgatgggcgtccggttcgtcgcaggccccgcggtcatggccgccgcctccatcgccgtcggtttgcgcggcgtcctcctccacatcgccatcgtccaggctgctctgcctcaggggatcgtgccgttcgtgttcgccaaggagtatggcgttcatcccgacatcctgagcacagccgtgatcttcgggatgctcatcgctctgcccatcaccctggtctactacatcttgctggggctctgagcctgagcctctctcgctcgcttcttcttcttcagcgtgcggaaggcgccatgctactactgaaggcattagcgtctccgatgctgtggtgtatcggccccacatggaaatttctgacgagcattagcacttactattagcttagctagggaaacgaaagatagctccgacgacagcgatctattcagtgattcagtgagtgaggcattgcgatctgtcaaacatgctgacctgcggtcgaagaatcgatatatatatatcttatcttgcttcatgctgtctgaagataaacattatatatcttgtttcctttggagaaatattagcaattttagcaaaaaaaaaaaaaaaaaaaactcgagcccgg

SEQ ID NO: 11120 - DNA, 4522 bp, Zea mays
cttttgggtattactatttgtgttgtttcctctttatttgggatgctgcttgagatggaggatcatgtctattcaccgtttttcgatcctagctatccagtcaaaaccttcccacacgcgcgcacacggtgaccgatcgagcctaaagatctaacggtaagtcggtaactactgccttgtatgtccaacactttaccacggaagcgaccatatcgccttgtcggtgtggcgtcgtgcaatttgcaacgacactgcagcagcccaacaggagcctactgcgtgcaattctttgaccagttgcggagtctctttatccatgtcaaggccatccttgatcagcgtgcatgcatttgcgccatggcccatggctacctcgagcttgcacgcatttatctagtctagaagctagctagggctcaggttgtactacctacagtacgttgccgtagccacacaaggatacgacagtgtttgcacgtcgcggcctgcagctagctacctgcaactgtgtacgccgcccctcggattctctacgtccatcgtcgtaccaccatgctctagctgattaacagctaaattaagtggcgagtcgtctgcgattatcttattaaggacctcctatatataactatctcttcgccggccgggcccgcacttcgtttctgatagtttgcgtcagctaccagcagatctttgtagaaaaccaaaggaacagaacaggctagcgtggcctaagctgcagctgtcagcgtcgccgccgccgccgccgccgcgatgatcaccgggcgggacatctacgacgtcctggcggcgatcgtgccgctgtacgtggccatgttcctggcgtacgggtcggtgcggtggtgggccatcttcaccccggaccagtgctccggcatcaaccgcttcgtggccgtcttcgccgtgccgctgctctccttccacttcatctccagctgcgacccctacgcgatgcagtaccggttcctggcggccgactcgctccagaagctggtcatcctggcggcgctggccgtttggcacaacgtgctctcccgctaccgcaggggcgcggcggcgtcgtcgctggactggaccatcacgctcttctcgctgtccacgctgcccaacacgctggtgatgggcatcccgctgctccgcgccatgtacggcgacttctcgggcaacctcatggtgcagatcgtggtgctgcagagcgtcatctggtacacgctcatgctcttcctcttcgagtaccgcggcgccaaggcgctcatctccgagcagttcccgcccgacgtcggcgccagcatcgcctccttcagggtcgactccgacgtcgtctccctcaacggccgcgaggcgctgcaggcggacgccgaggtcggcagcgacggccgcgtccacgtcgtcatccgccgctccgcctccgcgtccaccacgggcggcggccacggcgccgcgcgctccggcgccgggttccgcccctacggcccgtcctcggccatgaccccgcgcgcctccaacctcaccggcgtcgagatctactcgctgcagacctcgcgggagcccacgccccgcggctccagcttcaaccagtccgacttctacgccatgttcaacgggagcaagatggccagcccgctggcgcagcccggcgccgcacgcgcgccggggctcgacgagcaggtggccaacaagttcgcgtctgggaagggtggcgacgccgcggcgtaccccgcgcccaaccccggcatgatgccaccgccacggtacgtcggtctactgtccccaagttttttcgttttttgttcgctagtgctcgcttccttgaaatttgtcttatatatgctaataatgatgataaacttggctctcttagtctctttacatttggcaacgatgtttactccaggaagaaggagctgggcggctccaactccaactccaacaaggagctgcacatgttcgtatggagctccagcgcgtcgcccgtgtcggaggccaacctccgcaacgccgtcaaccacgccgcctccaccgacttcgccgccgcgccaccaccgtcgatgccggtcgacggcgccaccccaaaaggtgatagaccataccaacattttcttcctctgtcaccacaacattctcgttagcgctgaaactgatatacgagttgtctgtccctgcgtgtcatgcatgcatcaggcgtgagtgggactgtcacgccggccaagaaagccggaccccgcggccaacggcggggacctggagatcgaggacggcctcaagagccccgcgacggggctggccgccaagttccccgtgtcgggctcgccgtacgtggccccgcgcaagaagggcgccgacgcgccggggctggaggaggccgcgcacccgatgccgccggcgagcgtgatgacgcgcctcatcctcatcatggtgtggaggaagctgatcaggaaccccaacacctactccagcctcatcggcctcgtctggtccctcgtctcgttcaggtatacatgcatgcatgaattctaaaagcactgccattcaataatgccagcagcaattaagattcagcgaatccaaacggagagccttgtcaattgactgggtccgaaattacaagctaaaatctagattactagtacaggttgcttgcaaccctctctaggattagcatttgcatgtgagagcacatgagagtgtacgttcgtctcggatctggcacatgcagggacgatgcaggtcgtatgcgtgaggcgctggagctttgccagccgaccatatcagccgcggctgccgtgtttgtctccaccgtccatgcatatgcatccatggaccaaaatgcacgatgcgtcgtgtcctgagacagtacaatcatatgcgctcgtcgtcgtcgttgatcgttgtactattttactactcgagatgcttgacaaggcatggcatggcacatctagctagaggggagctgaaaaacagcaggcatttctaggagagagggtggcacatatactatataaatatacaccagcatgcatctgcaatgcattgattcttttatcatgcgaattgctaactatactactactactggttaacatggttggattaacaatttttccctctatgaaatctcaggtttaacatccagatgccctcgattataaagggatcgatatctatattatccgacgcagggctaggcatggccatgttcagcttaggtacgccgttggcattttgatgcttgtttagagacgtacgtacgttctttacttgagccgagaaattctgacgggtgcaacgtctgacccaggtctgttcatggctctgcaaccgaagctcatctcctgcggtaagagggtggcgacgttcgccatggccgtgaggtttttgaccggcccggccgtgatcgccgccacctccatcgccattgggctccggggagtgctcctgcacgtcgccatcgttcaggttggcatcgacaccgtacacatcgtgctctactaattttcaagcctttctaatgagggggaaaaagtgacggtcgtactgattaatgtaaatgttggaacgtacgtgtgtgtgattgatcaacaggctgcacttccacaaggcatcgtccccttcgtgtttgccaaggagtacaactgccatcctcaaatacttagcacagcgtaagcgattctatgctcaaactctgcaggatatcaatctcatgcttagctgttggtgtgtgaatttagctgcataaagttaacatcttgcgtgcttgcgacgtgaatttttcagggttatattcgggatgctgatcgcgcttccgatcacgatactctactacattcttcttggaatttagatttctgggtaggcagagccgctaggattctaggaatgtagcagcgaacgcatgcaaagtgaagcaaattggatatcctgaagaccatcggagcagagaaataggggaagctaataggaccctagacagaaatgcagatgagggtgaaaaaaaaaatccttgattctatatattttttttgcattttctgttaccgttttagattcaaagcaaagtttagagctttgagcatggaggattgaaccgttaaccgggcaacttggtactaaagattcctaccagttgattcctttgcccagagagacatgttctgcaaatttctgcctgatctgatctcatacaaattgggataaagtaatagaagtggttctcgaatcgcatggcaagatcgtcagaccgatccagcctgacagctttggggagcgagttggagcctgtaccttgcttcgattcagtccctggcgccatgcctgcgtgcacctttccagatacaccagtagtaactctggacctaaactctgaatctatatctgccgtggattatgcgtagcaagctactcataattttagtagtatctagttacagcattgttattaatctatctattgatgtgtggaggcattatgcagcttgcattgaagagtccaaggcgatgc

SEQ ID NO: 11121 - DNA, 2433 bp, Zea mays
  misc_feature (27)..(27): n is a, c, g, or t
  misc_feature (35)..(35): n is a, c, g, or t
cgcattcgcattcgcgctcacctccanaaccgagnaccaccaccgcgcaccttcacgactcggccggcgctccgtcactcatgatggccggccgcccgcaccctgcatttgttgatctgctgggctgctcccaagctctgaccgccttgcctcatctgtgtctccctccatccgtctcctccttggctggcgctgatgaggtgagcctgtcctgagccctacaaccactctcttcttcattgctccacactaccatctcatctctccgccattttacaccactcccttctcgttgcaacccaacaaattggcactgctcgtcgccgacccctcctccctccccgcgtcccccgacaagccatccgcggccatgatcaccgcgctggacctctaccacgtgctgacggcggtggtgccgctgtacgtggccatgacgctggcgtacggctccgtccgctggtggcgcatcttcacgccggaccagtgctccgggatcaaccgcttcgtggcgctcttcgccgtgccgctcctctccttccacttcatctccaccaacgaccccttcgccatgaacctgcgcttcctggccgccgacacgctgcagaaggtggccgtcctcgcgctgctggcgctggcctcccgcggcctctcctccccgcgcgcgctcgggctcgactggagcatcacgctcttctccctctccacgctccccaacacgctcgtcatgggcatcccgctgctgcgaggcatgtacggcgcgtcgtcggccggcacgctcatggtccaggtcgtcgtcctccagtgcatcatctggtacacgctcatgctcttcctcttcgagtaccgcgccgcgcgcgcgctcgtcctcgaccagttccccgacggcgccgccgcgtccatcgtctccttccgcgtcgactccgacgtcgtctcgctcgccaggggggacgtcgagctcgaggccgagcccgacggcgtcgccggcgccggcgccgtctcctcccgcggcggggacgccgggcgggtgcgcgtcaccgtgcgcaagtccaccagctcgcgctccgaggccgcgtgctcgcactcgcactcccagaccatgcagccccgtgtgtccaacctctccggcgtggagatctactcgctgcagtcgtcgcgcaaccccaccccgcgcgggtccagcttcaaccacgccgacttcttcaacatcgtcggcgccgccgccaagggaggcggaggagcggcgggggacgaggagaagggcgcatgcggcggcggcggcggaggacactcgccgcagccgcaggccgtcgccgtgccggccaagaggaaggacctgcacatgctcgtctggagctccagcgcctcgcccgtgtccgagcgcgccgccgtgcacgtcttcggcgccggcggcgctgaccatgccgacgtcctcgccaaaggagcccaggcctacgacgagtacgggcgcgacgactacagcagcaggacgaagaacgggagcggcggcgcggacaagggcgggccgacgctgtcgaagctggggtccaactcgacggcgcagctgtaccccaaggacgacggcaaggggagggcggcggcggtggcgatgccgccggcgagcgtgatgacgcggctcatcctcatcatggtgtggaggaagctgatccggaaccccaacacctactccagcctcatcggcgtcgtctggtccctggtctcctacaggtggggcatcgagatgccagcgatcatcgcccggtcgatttcgatcctgtcggacgcgggtctcgggatggccatgttcagcctaggcctgttcatggcgctgcagccgaggatcatcgcgtgcgggaacaagctggcggccatcgcgatgggcgtccggttcgtcgcaggccccgcggtcatggccgccgcctccatcgccgtcggtctgcgcggcgtcctcctccacatcgccatcgtccaggctgctctgcctcaggggatcgtgccgttcgtgttcgccaaggagtacggcgttcatcccgacatcctgagcacagccgtgatcttcgggatgctcatcgctctgcccatcaccctggtctactacatcttgctggggctgtgagcctctctcgctcgcttcttcagcgtgcggaaggcgccatgctgtggtgtatcggccccacatgaaatttctgatgagcattagcgattactattagcttaggtagggaaacgaaagatagctccgacgacagcgatctattcagtgattcagtgagtgaggcattgcgatctgtcaaacatgctgacctgcggtcgaagaatcgatatatatatatcttatcttgcttcatgctgtcttaagataaacattatatatcttgtttcctttggagaaatattagcaattttagcaaaaaaaaaaaaaaaaaaaaaaaaaag

SEQ ID NO: 11122 - DNA, 1332 bp, Zea mays
ctcctccttcccttccttctccctcccaccctcctcactagctctatctagctgagtgaactgaacagctcactggctcgtcttagctaagctcagctgtaaagctaaggttcggattagctagcgtggtggccggagagtgtagcgagcggcgttcagctcaccgggggctgcttggtgagtgagggagctagctagcgtcgtcagagctccacgatgattacggggacggacttctaccacgtcatgacggccgtggtgccgctgtacgtggcgatgatcctggcgtacgggtcggtgcggtggtggcgcatcttctcgccggaccagtgctccgggatcaaccgcttcgtggcgctcttcgcggtgccgctgctgtccttccacttcatctccaccaacaacccctacaccatgaacctgcgcttcatcgccgccgacacgctgcagaagctcatggtgctggccatgctcaccgcgtggagccacctcagccgccggggcagcctggagtggaccatcacgctcttctccctctccacgctgcccaacacgctcgtcatgggcatccccctgctcaagggcatgtacggcgacttctccggcagcctcatggtgcagatcgtcgtgctccagtgcatcatctggtacacgctcatgctcttcatgttcgagtaccgcggcgcgcggatgctcatcaccgagcagttcccggacaacgccggggccatcgcctccatcgtcgtcgacccggacgtggtctccctcgacggccgcagggacgccatcgagacggaggccgaggtcaaggaggacggcaggatacacgtcaccgtgcgccgctccaacgcctcgcgctccgacatctactcccgccgctccatgggcttctccagcaccacgccgcggcccagcaacctgaccaacgccgagatctactcgctgcagtcgtcgcgcaacccgaccccgcggggctccagcttcaaccacaacgacttctactccatggtcggccgcagctccaacttcggcgcggccgacgcgttcggcatccgcaccggcgccacgccgcgcccgtccaactacgaggacgacgcgtccaagcccaagtaccctctccccgtggtgaatgcgacgtccggggcggcggcggcggcggcggctcactaccccgcgccgaacccggccgtggccgcggcgcccaagggcgccaggaaggcggcgacgaacgggcaggccaagggcgaggacctccacatgttcgtctggagctccagcgcgtcgcccgtgtcggacgtcttcggcggtggcgccccggactacaacgacgcc

SEQ ID NO: 11123 - DNA, 9121 bp, Zea mays
  misc_feature (1414)..(1414): n is a, c, g, or t
  misc_feature (1677)..(1677): n is a, c, g, or t
ttgttggctctcgtgcttgtgtgaggagtactacaaattgagtttgtatccccttgacagcttggtcttcatccctttatataatctgacgatgtttcgtactagcaccgacgattaaatttgtgcattcacattttagccccggatgttgtgttcaatggccacaagagttacactagttcgggtgaaatgtccctactccagccttcgaaggctcgcactaccaacacctgattgctcgtagtaggggttacaagcgagcgagagaggatgaaatcccaagtatctgtgtgttgtgtctttcgtgaggttgacccttccttttatagactaaggaggggtgtttttagatgtcttctcccggatgggagcggaacataagataaaagatggaatttacctctattaaaaccttattgtacgttagtttctttccttgtgtgaggcgtgtgtcgtatctctgagattgccaggggaggacgcgatctgtgctggtggtgaaactccgggtgtcatcattactggtttctgtttgtatctctttttgttgaccttctatatttgtagcttgtccactggtttctcctttatctctgtttagggccatatgacttctagggacctaggcataggatttgtaggccatgagtggtggtggggagatcgatacatgttcgtgttgtagaccaccgactagcatagttaatatggcgtacgcaagctgacaacgtggctagtttcatgggtaccaaaatccactcgagaaggtttcgacctatttgtctgacccctttggcatgcctctgtctcgctcgtcccattatattgatgcgggggctcatcctacgagcatggcagattcttgattgacttgctgactcgtggtccccgaggattcgaaccccaacataaccaagggagcgagtggacattgttccatgatgtttttagtgtgctacatcattcatatctttggacatgtagttcctctgatgtgtctgcttcgtcatccttgaattgactagggcgtgagggtggttgagtcctgaaggtgtccgaagccattttgttaggtacgcttatgaaaggcatgcaaatcatttgccttggatttctccttctctttcatcatgtccagctttgtggacttttgtacatttggagtgtgactagtcatggcctatggagccctatttgtacctttgagggtgaagcaattggacggaggagtcatcagagtcttgtgtaccatacctatttttgccttttgcgtgtctcagttagtagcacatgtcgagcgatcaaagaatcataaatgcatttttcccttggcgactgtaccacatttgggtcatggggtcctatcagaggcgctcgattttagatcatcttatcttgggatggtcgaggtctnggtcatctgactgggatgacctgatcaagttttttttggtgattggggtcgaatctaacctggtctgggaactcttagctaggttcattatgatctgatccttcccagtcggagtaactaggtcgatgatcctagttgggagacttagatcaggatgatcgtcctttggtccttcctctagttggagtcaccaaacaagggtaccggatcatgtgaatctgtggaccctttgtgttgttcttatggtatcccaagaacgagtncatgtcacattggttgcacggttttatcagctagagtgggcataatactctgttagcctttatcgatgtggcattatagactggcgcgatgaagggttaacaacgtggagtccctaaatggtcgttaggaggtagagggagtagttgtccagcgagcaaccgtgtgtagatgctccgagcaggatcttcgatggcaaggtttgagagggtccatgcgtgtagagctgtggcactgcagatacaattctcagccatacgagaaaactttaagggcatgttcggttagggatggatcgaaggaactaaatcctttaatagtcaaaactgaatagaaaaagatttaattctactcaattcccttcgatcccatgtaactcaacaaactgtaatagagaaacataggaatattctgaactggagtatccaacaataatagaaaaatttaagggaaaaagagagatcgacgcggaagaacatgcacacatgatcatcacgcccacggcctcgatctcgtgggtgatgagacgagcgagcgtgtgcaacacgtttatctacgtttccaacttcacaaatagtatatatagaattcaactaataagttggttagaatctctcttaaatttaactggttatctctttcacatcacgtctttctttataattagataatctattgaattaatttagactattcacatttaaatgcaacatgtgctttcatgtttgaaagaaaaatgcacgtatgaccgtccagagatactacctgctatgcatatttttttatatgtataaaaagcaacaactaacggaaacgcatggagaaagtagaaacgtttgcccgacaaagaaaaggagcgcgggagggggacggagacacgaaactgagccacctagaaattcttttggcaaacaacatgggccttcatatctacgtgggctttttttaagtatctcagcctcgtataagtgttagcccttcggggctacgaaatgataacaggatgggccgttcggggtggcagcctaaaaaaaaaaactgcttgccggatcttctctgtttgcatttcctagagcttctttgtagttgtagttgtagggacgagaaaaatgtacagtctactttcaaagaagacgacgacgtacagttcaggtcttcaaggactacatacacgttcattggtatcactacactacaagcgtggtttttccacccctgaagtctgaactcaactcatcttgcattactcctgatcagcaacagtggcgcggctggaaagcgagcgggcggcgatacccaaggacgatcgggagaccgagttctccgatgcgaaggaagctcgccgcctggtcctggaaagaaaaagatgctcctccgttctatcaacatgtgcctgccgcgctagcagcgatcaccgacgatggatcatgatcgttgttagcaaatcatccgcgccgcttttggtgccgccggacgccttttcccaccctccccgccacgccaggaccacaggtccagaggcgcgcgacgagcaagtggtgtgtgtgcgtgtggtccgctgcggcgcgacgtcgaggccgagagcactccatcgtacacgtactgctggagtgctgggaccgccagaagtagaaccagaagcggatcgttcagagaagagaactcgtgcccgctgctgctctcaaggcgcgagcgctggtcccccctggttagcggcgaacaggacgaggtttgaccagtctagccccgtgataaacccaggccggtcacggtcacggacaggagcacatgtgaggtccgttgggaaccacaggtactggctgcattggttgattcattaagcaggtcgatccagacgagcaacgactgctcactgccaactaccatcgggagggacgactggccaagcggggaggcgcaccaacacaggtgtcgcgctcgcgcccatgggccgattccctggctgggcctccggcgcatcgtggtccggcccaccctccgctttcgcagatcacggatgcctacgggaacggcgggatccgtctcctctgtcttcgcgacatggtgtttctgatcgattcgagaggtgagcgtgtcgcggctcgcgggaagcccatgccgtggatctccctcccccctcgccgcagagaaactgtgcccggaaaggcatggtgggtggttgagtccaccgtggacggacgctttgcttcggtcgcatcgcatcgcatcgcatctcgcttgcatgctccatccagttggattctggcgttccctcgtgctacagcaccctaacatcaacctacgggctatgccctatgcctgctcgcctacgcctccactccgctcggatcttgtacagaacggagacgcggacacgagaggttagggaatgcgcaggctacagtttccctccgcttcgtcagccacctaaatagagaatccagctcagccctcccctccccatgcatgaagcttcggatttgttctaatcgagtttaaaggtcacattccgtttatccattgttatggcatagagaatccagctcagggcccccgattctctctcaaccgtttgtttatccaattgccatggtatagtggctcccatattggagcatgcgaccggtactgtgagagagggcactttacagcgtttcaccagtaagcttgccgtgctttgtattagctgggtaattagtaggaggggggttacaggtacttgcaaaacaaaatgataccagcacgcacgctttaatgcatcttttgcagcggcacgtatgcgcgagcggtggccacggaatttgtccaaagtttattctcccgcacagcaaagggacagggtgaaaggtagcacaattgagattttaatagacattatctgaataaagaaaagctgacacagggcagcttttttgtggggtatgttaaggggagggcacacttcgccattttgctgctcgtcctttcctttccttttcccttgcttgctaccgttagaccccaggcacagccgaaccgtgcatgtgcacgcattcatcacactaaaaggagttaggatctgtacgtaacagtcacacgccatatatatatataattgatgaatcactggaccagcgacgcgcggcacacgcaaggacaaggtcatgtactacaacctgtagaccgtagtgaaggtatctgtatgatgatgtcacactgacagcacgcgtattgcatcgtgtgtttgatcgtctgttatttctttattatctatacatgtagccatgattcaaagcataaataaggtttgtgcataccgaatcagttttcgcgtgcgaaacaatgaaacaacttctacgttctgcagatgaggtagtagctcagtatccgtcccgcctgccgcgcggtgagcccatgggtcttcatgctcacctttcgtcgagcacctcggttacatcagaatcgccaaccatgtcctcagatggtgcgctcccacgagcgcgcggaggacgcagcccaggcggcggcggttgagccagcgggtgagggcctctgctgctgccgtcctcgcgacggaggagtccgtcgttgccttgaccagtttgggccgcccatcggccatcaccgccgcagcaggatccgcgtcgtcgactcgagacgagtagacgacgaccctgtatgtactgtacagcggctctctagctggcgactgcatcttggagcacgagagctctcgccgtggcgagagtacaggagccgatcaggatcgtggcgcggggatgcgcgcgcgggccaacaaaccggcagcaggccaggaaaacagactttgctgctctcatctcatcttcatggtttcccgatccgcgctgctccccatcccctgccattttttaaacgaatccgctgctacggctagcgctgctcgctgtccaacgcgcggtttccgacgccgaattgtggggaatttgtcgcttttgtgctcgtgttttattcctcccgattgggtggggttgggtgactctggttcgccgcgtcattgtaaagaatttcccccgtgcggcctgcctacggcaggtcggcatgtgtgggtcgtctcagacattccgatggtaaagataacgaaacaagtaccagtccactcgattaggatctactggtatgatgatagatcgggtacctaacgtgttaacagtaattcagactttctgttacccgagcacgccatcttttcacggtcatttctcacgcatctcacttcactgccagtgccagaccgccactagcagagtattctcagtactaggcatgtttcagctcacgcacttgagaagctttcggttgacttgaaccttgccatccactggctgtggcctgtggcgcgaagaggaggatgagagatttggtcggctcatcacggatcgcgataccggcctgtgtgactgagctgacgtttcgggaatattcattcatagctacgccggcgggcagccttttgcctagccctcctcctagcagattcttcgtcgtccgtcggcactgatggccatttgtggtcatttctggcggacttttttttttccgagctctgttatgttacgggtggcacgagcacgacagttggcggaggaaaggcgacggaccgggggcccgacacgtcactgcattgcatagcccccattccgtccgggcagccgccatcgagcccaccaaacatatcccactccttcctttcctttcaggctttcactttgggagagtactacgaaaactgctccccaaaggaacaccgctcctggacctcacgtctaaaaggtgagaaaaaaagtgcgcattccagtttcacactccgtgaacgatggcaaagcaaccttactacctggcactggcaggcaacgagaagtaaccgactccaagccagtgtgtaccgaccactacaccctctattgtcagccgagttcgatcagtatatatatagctcagctgtcagctcacttaactacgaatttcagtttaacattgatacggccatacgggcatgtacatttgtattatactactacccgtatgttataatttagtatataattatattttactaagctgcatataatgcgatactaaggttgcgtttggttgagaagtggagtagaatgaatgcataaaacgtctcaattcctaattttttaatgtttggtttcaataaaagagaagcggagcaactgttggagtctgcatatgaaaatttactataaatagttagagtgctcacgctctaccaaaacgacatgatatgaacgctctcctggacacgacacgagcgctctcctactctctgcacttatatagctctctaaccaaacaaagaacggagcggctgcctgtctatcgtgctccaccctacaccgtaccaaatcacccttcacagcacagcgcgccgttccgctgtttagatgataaaaaaaagcgaggaatgactgaaggccgcgcgcccgggatggtccaaggagagcttggggctcgctgccacctcgcgcgccagcgcctaaataaatcactcccacgcacacccaccaccgcgccgagcacctcctccttcccttcattctctctcccaccctcctcactagctctatctagctgagtgaactgaacagctcactggctcgtcttagctaagctcagctgtaaagctaaggttcggagtagctagcgtggtggccggagagtgtagcgagcggcgttcagctcaccgggggctgctgggtgagtgagggagctagcgtcgtcgtgagagcgctccacgatgattacggggacggacttctaccacgtcatgacggccgtggtgccgctgtacgtggcgatgatcctggcctacgggtcggtgcggtggtggcgcatcttctcgccggaccagtgctccgggatcaaccgcttcgtggcgctcttcgcggtgccgctgctgtccttccacttcatctccaccaacaacccctacaccatgaacctgcgcttcatcgccgccgacacgctgcagaagctcatggtgctggccatgctcaccgcgtggagccacctcagccgccggggcagcctggagtggaccatcacgctcttctccctctccacgctgcccaacacgctcgtcatgggcatccccctgctcaagggcatgtacggcgacttctccggcagcctcatggtgcagatcgtcgtgctccagtgcatcatctggtacacgctcatgctcttcatgttcgagtaccgcggcgcgcggatgctcatcaccgagcagttcccggacaacgccggggccatcgcctccatcgtcgtcgacccggacgtggtctccctcgacggccgcagggacgccatcgagacggaggccgaggtcaaggaggacggcaggatacacgtcaccgtgcgccgctccaacgcctcgcgctccgacatctactcgcgccgctccatgggcttctccagcaccacgccgcgccccagcaacctgaccaacgccgagatctactcgctgcagtcgtcgcgcaacccgaccccgcggggctccagcttcaaccacaacgacttctactccatggtcggccgcagctccaacttcggcgcggccgacgcgttcggcatccgcaccggcgccacgccgcgcccgtccaactacgaggacgacgcgtccaagcccaagtaccctctccccgtggtgaatgcgacgtccggggcgggggcggctcactaccccgcgccgaacccggccgtggccgcggcgcccaagggcgccaggaaggcggcgacgaacgggcaggccaagggcgaggacctccacatgttcgtctggagctccagcgcgtcgcccgtgtcggacgtcttcggcggtggcgccccggactacaacgaggccgcggccgccaagtccccccgcaaaagtagcaatctttcccgccgcttgctcgctccgcccttgggggagtgtttctcgggctaatttgtattctttctttccttggataaacaagtggatggaggcaaggacagggacgactacgtggagcgcgacgagttcagcttcgggaacaggggcgcgatggacagggacgcggaggcgggggacgggaaagccgcggcggcgggcggggaccccagcacggtggccgcgccgacggcgatgccgccgacgagcgtcatgacccggctgatcctgatcatggtgtggcgcaagctcatccgcaacccaaacacctactccagcctcatcggcgtcatctggtcgctcgtctgcttcaggtccgtactactagcagctacccagctaccaaccgatacggcggcatgcatgcatgcaccggccggcggagtagagtagcggtagcgggtgatctagctctggcgatgcgaggcagctagccgattgatagcttcgctgttggatctgctggtgtgtgtcctgcaggtcgactc

SEQ ID NO: 11124 - DNA, 690 bp, Zea mays
gcacgaggcgttgctgtcgggcaacaagtcgcttatctgttttattatctagttcggctgtttgttcaactagcacataccaatttctgaagaattatgaagatcttgccattttcattttggctggcgaagcattttgtggatttgaagctagtgagttccgccagaagttgaagactgtctgtttgaactacatggtgtcctttcaccggcaaaatgtatatgcacttaagatggtactggaaaatgaatcttggacaataatgtccgctgaagcttcagaaataattagtttagcaggtctaactggtgatggtgctgcactgtgctctcctaccagtagaagtcctaagttgccaataaattgttaccatgggacaactacatccaactcaggaaaggaaaagctcggatttgcttcttggcttgtgattgaaaatccattttcttttaagctagaaaatggctctgccgaatccccaaagtccaatatgctttgttgactcatcagctagcaataatcatggcaatggaaacaattcatctttagatgaagagaatgaagaccttctagcggatttcattgatgaagatagtcagttgcctagtaggacaccaaaagcgaaaattgtaaaagggcattctttacattggaaagatggagacatttcatcacagacaggctcatca

SEQ ID NO: 11125 - DNA, 1024 bp, Zea mays
gcacgagaccattacctagaacatcctaatcaaaaacacacctccgaagtcggaacctccctgccccaacacaatggcctcctccctcgccgcgcgccgcctcctctcccgcgcagccgccgtgcatggggtggagcgagtcggccatggtcgcgggggcgagggacgttggcgtgtcccctgccatcgtgggcgcatttccaaggaaggaggccgcccttgtggagtttttcatggatgactgcctccaacaactgatggatcgaattgatgctggagaaggagagcagttgaagaacttgatactgagtgagagactctcaaaacttgttcggatgaggctggaaatgcaggcaccttatatatctaagtggcctcaagcactgagtattcagtctcaaccagcaaacgtctcaacaagcttgaagcagcgagctatcctggtggatgagatatggcatgctgctggagattctgggtcagatattgattggtatgtgaaacgtacagtgcttggtggtatctactcaacctcagaggtgtatatgttgacagacaattctccagagttccgtgatacttggacgtttgtgaaccgcagaataaaggatgctcttgatcttcagaaaaccttccaagaggccgcatacctcgctgaagccgtgggagcaggcatgagcggtaccgtgcagggtgttctcaacagggtcttccagaaccgtagtggatgaactttctttttctcaaacacgtagtgtggatggactaattccgtcttttgcacgctgcacaggataaagcacattttcccgttgaccaactggcgtatgtttataataaagcaaatggtgatgtggttgagatgcatcacgttagggtaggaagtgacgatgtgtatgctggtggtgttgttgagcttcagatttttcaaatgaatgctttcgtcgcggagccagtcctcacgcatgcgtgcacacacgtggggcttattataatttgatgccagctgcatgcattacttgcc

SEQ ID NO: 11126 - DNA, 1197 bp, Zea mays
agaaattcccaccgtccgtccgtccgtccgtcccgttcctcttctcgcaggttggacccgtcagtcacacctccgaagtccgaacctccctgccccaacacaatggcctcctccctcgccgcgcgccgcctcctctcccgcgcagccgccgtgcgccgtttccccgtccccttcgcctccgccccagcccccgcgatggctccccgcagtttctccgccgacgcgggaccgcctccgccgctcccgccaccgccgctgcagcccgtcgtcgagccgcccacgtcggagggcgcgggtgcctcgtcctcctccaccaccgctggtgccggaggggcccacaggtcgtcgccgggagccgcggcgggggcgcggcgccagggtggtgcgggctacgaggaggagcaggagaaggtcctccgcgcgtcgctgctccacgtgccgcgcatggggtggagcgagtcggccatggtcgcgggggcgagggacgttggcgtgtcccctgccatcgtgggcgcatttccaaggaaggaggccgcccttgtggagtttttcatggatgactgcctccaacaactgatggatcgaattgatgctggagaaggagagcagttgaagaacttgatactgagtgagagactctcaaaacttgttcggatgaggctggaaatgcaggcaccttatatatctaagtggcctcaagcactgagtatccagtctcaaccagcaaacgtctcaacaagcttgaagcagcgagctatcctggtggatgagatatggcatgctgctggagattctgggtcagatattgattggtatgtgaaacgtccagtgcttggtggtatttactcaacctcaaaggggtatatgttgacagacaattttccagagttccgtgatacttggacgtttgtgaaccccaaaataaaggatgctttcgtttttcagaaaaccttccaaaaggccgcatccctcccttaaaccgtgggagcaggcatggggggccccgtgcagggtgttttcaacagggttttccagaaccgtagcggatgaactttttttttttcaaacccgtaatggaggggctaattccgttttttgcaagctgcccaggataatgccccttttcccgttggccaactggggtatgtttttaataaaacaaatggtgatgtggttgaaatgcctcccgttagggtt

SEQ ID NO: 11127 - DNA, 1664 bp, Zea mays
ttttttttttttttttcagccattgttaactgtaaccacttttctcagcaattgctagtagtacctggtactcgttcctcaacaatggagtagctagtatactggcacctccagtttacggtatttgacagtaaccccacacaaagtactgttcccaaaaggtgaggttactacatgctacagctaatgtactcctgtctcctcaaggcagctccatacagcaaaagcaggttagctgtctaggaatacatctccacgcagcaacttggatcagcgttcctttcgctgctgtggcagtgtttgccacacaaaagggccgtacctgtatatacacaaaacacattgtggtcgtatctgggaagaccaagttcggcctcagggagacgatccttcactgggaacgaccgtatgcgatcctcctgcggagccgctcctgtctctgaacagactcccattggcgagcttccaagaaggcagaatagctcaagctggttgcctcagggactagttgactctgcatcctgtactccctcagcagactcctttggtattcgcatgcgaagtagtcagtgtttcctagcgattcagcaatgattctgttttcatacagagtttgccccagacgagcgaacaaacagttgctcgagattctgcccattggtgaaggaatgcggcctggctgcctttgatcaactacatgagatggcgcagtcatgggcacaggaactatgtaatctcgtggaacaaactgtagcccggaccatggctgaacaagtgaaagaggacgacatggccttgtgtcgcctccaatggatgagattggtccagcccttctcccattctgtttcttcgagcttccaattctgaacttgaatgtggaacaggtacctagcgggaaaggtttgtcacaatttggaccagctcctttcttctggtgataaccgggatagtctgccttttggaaactaactttctcgaccaacacaagagaaaactcagctgctagatgcttaagaccccacttttcgtaccactttcctctcttgtgactaacatggatttcaccataaggccgaagtaggcggcgtgcattacagaaaaattccctcaccagcttcttgtgcgagttgatcatgtgcacctcatgttcttttcctttgaagccagaatgaggaaagttatagataatccgatcaaaccgtctgtttttcaggtcaatctgcaacttcattgtcttcacgtcaatgccatgcaaaacagtagctcccaaacttttcagggctgttatattagacttcgctctgcagaatttgttgcccagtgcctcgtaggtgtcgagcgacgtggcgacgaggttggccccggagccaaaccctgtggccagcgccagtgagaacgaaaaatccccgtcgccgacgagcagtatgctctgcgtagaagagtattgccctagccacttctcttcctcctcgtcagcttccggtgccccctccactacccgcattcccaacaccccttcctctgcaggccccgctccctccctcgatccgccgccgttcgccgccggcgccgagtcgtgccctaccgctggtgaagtggtgaggctgccccgaacgccatgaactcttgtgggtagagtggtagactggtagtggacgatgcac

SEQ ID NO: 11128 - DNA, 950 bp, Zea mays
tgcagaaaccggcttcttccattattcaagacttttccagcacaggtaataacgttagttctttaataatatcatgttgaaatgtcagttgctatcttgtgatgttgactgctgcaatgtgattgtgcaggatttaatcgacatggacagggaagatgaacgatcaggaagaatggatgaaattcaccacggacttcattctgcttattgccagttcgctgacactgtagatgtgcccttggataaaattgaaatcgttggtggggatgaggagcaaggctctagctcgggtcagtccagtgttaaagaaacgtgcgaggatcccaagaagcacctggctcaccctacactaaaagggctccctgttaaccgcctccggcatgccgtggggtcggttactttcctgatcagattgcagaaaagaggtttatcagaacagaaaatcggataattagttagccgccaaccccctttgcttgttggctatataaatgtacagaggcatacatgcatatacgatcgttcccttagaagagagaagggctaatgtagaagtctgtgggagaacatcatcatgagtgttgaggtgcaattttgttttgtcgcatggatgagtttgttggttctgcgggttatctggcagattcagctacccaaaccttagccttgcacgttgatgaaattaatgctcatggttttgttgtaagagattaatgtggccaaagtgatctagatgtataatgtcctcctctccattggtttgtgtttgagcctcgcaactttagcaggtctgttagtcttcatgcgccaatcatattgaggtattgagaattatactaattggtttgtctgacaagctgtaagcatgttagtccatgctgtcgagcagcaggtgtggaggttcttaacatgtagcattgagctggtatctgcatatctgcaggcatgca

SEQ ID NO: 11129 - DNA, 2946 bp, Zea mays
  misc_feature (1)..(1): n is a, c, g, or t
nattcggctcccggttctgttcgcaccgcctccgcccccctccctccctagtccctccctccctctccccttccggactctctgctctcctctgctgcggccatccattaatctcctctcctcgccatcgctgcactcactctacgcttccctcctcaagccgagggcttctccgggaaggaatcgccgcgccgggttcctgcaacgccccgccctttgcgcacccggagcaactgagtcgtggctatcgaggatgatgccgcgtttcagataacagagactgtgagagtgcacgacacacttgacatgcagagatgaagatcagtgcgcttctcacctccgcgggcatcaacattggcctctgggttctattcctggcactctactccgttctcagaaagcagccggccaatgtcagggtctactttggccgcaggatcgctgaggaacacgatcggctccgaggggcatttatcttggagaggtttgtcccatccactggatggatagtcaaagccctgcagtgtactgaggaagagatcctggctgctgctgggttggatgctgttgttttcaatagaattctagtattcagcatacgcatcttctcccttgccgcagttctgtgtgttttcgggattcttccgctcaattattttggacaggatatacaccatgttcgaattccttcagaatcactagatatatttacaattggcaatgtagaagtgaaatcaagatggctctgggtccattgtgtaaccctgtacataatttctgcagtagcttgcattcttctatacattgagtacaagcacattgccaggttgaagctccttcatcttacaagcgcaacaccaaaaccaaaccattttacagttcttgttcgtggaataccaaaggcagataaagaatcatgcagtgatgttgttgataatttcttcacaaagtatcactcatctagttatctcttccatcaagtagtttacaaagtcgggaaagttcagaagataatgaagttcagaagataatgactggcgcaaagaaggcatataagaagttcaaccatttcacagatgaaactgtcgatcaaggttgcaggacagttacctaccgctgttgtctgtgtggagcttcttcaaattctttcaagttgttgaccactgagtgtgagcagaacaaggggaaagcggccaataaatccatcttggacttagacgatgaggaatgcacacctgcttttgtatttttcaaaactcggtatgcagcacttattgcgtcagaaatacttcaaacatctaaccctatgaaatgggttgctaatcttgctccagaaccagaagacgtgtattggtccaatctttggctaccctataagcaactttgggctcgccgtattgctacactcctaggctctatctttttcatgttcatatttctgataccggtgacatttatacaaggactatctcagctagagcagttgcagcagaggcttcctttcctaagaggaatattgaagaagaaatactacatgactcagctagtaactgggtaccttcccagtgtcatactgcaaatcttcctgtacattgttgctccaattatgatgctgttttctacattggagggccctacatctcacagtgaaaggaagagaagtgcttgctgtaaagtgctgtactttacagtttggaacatattctttgctaatgtattatctggtactgtcattagtcaattgaatgtgttatcaagcccaaaggacatacctgtccagcttgctaaagctgtacctggacaggccactttcttcatcacctatgtcctgacctcaggatgggctagtttgtcatctgaagttatgcaactctttggtctgatatggaactttataatcaaatacgttctgagaatgagagaagatacagaattcgttccctcgtttccttaccacacagaagtaccaaaagttctgttgtttggactattgggcttcacattttctgtgctggctcctctgatcttaccttttctgctggtgtacttttgtcttggttatgttgtataccgcaatcagttgctcaatgtgtatcgaacaaggtatgacacaggtggtttgtattggccaattgcatacaacacagtcatattctcacttgtgctcacccagatcatctgccttggtgtatttggccttaaagaatcgccggtagctgcaggcttcactgtacctcttatcatcccgaccggccgcccgggcaggtactgcagaaaccggcttcttccattattcaagacttttccagcacaggatttaatcgacatggacagggaagatgaacgatcaggaagaatggatgaaattcaccacggacttcattctgcttattgccagttcgctgacactgtagatgtgcccttggataaaattgaaatcgttggtggggatgaggagcaaggctctagctcgggtcagtccagtgttaaagaaacgtgcgaggatcccaagaagcacctggctcaccctacactaaaaggactccctgttaaccgcctccggcatgccgtgaggtcggttactttcctgatcagattgcagaaaagaggtttatcagaacagaaaatcggataattagttagccgccaaccccctttgcttgttggctatataaatgtacctcggccgcgaccacgctacatgcatatacgatcgttcccttagaagagagaagggctaatgtagaagtctatgggagaacatcatcatgagtgttgaggtgcaattttgttttgtcgcatggatgagtttgttggttctgcgggttatctggcagattcagctacccaaaccttagccttgcacgttgatgaaattaatgctcatggttttgttgtaagagattaatgtggccaaagtgatctagatgtataatgtcctcctct

SEQ ID NO: 11130 - DNA, 1778 bp, Zea mays
  misc_feature (1774)..(1774): n is a, c, g, or t
tgaccggattaacaataacagtcgcttgtttctcaagcaagcaagcacgatctcggcaaatcccacggacagaggacctttcgagagatctcccaaaatcatgtgtaaacccaggaaaaagtagcaagaactcggtacacgcacacggaacgcaaccagcgggcagcctagcgcaagagataaacgaaccccgcgtccgcgtgcatcacgactgacgtgtagcgcacccgagccacgagggcgtgcgcgtttctcccaaattccccagcccaagctaaaaaacagagcagacgccagacgccagacgccccagacgccagacgccagacgggcgccgcgagtcagagcccttctagaaggtcgcctcgctacccggttcccctatataaacgccgttcccatctcgctaaccgactagcagttgttccccttttccctccccacgccgaacgcacccgatcgcaaacaaagcgagcagcagaaacatgcgagacatgccggttgtccgccgccaggaacccaccgtcgtcaggacggaggacgacgtggtttccggcggtgaggactcggacggcgagttcgagttcccctccgtgagccgggagtccgcggcgggcgttggcggcgccgcgtctgccgacgagctcttcgcgggcggccacgcccgggcgttctacccggtgtttggccgagtgctggacgaggccgcagcgccggcaccgagggcgccactagggcggctgttccagctggagcaggcgcggacctcgtccgtcgcgtccacgtcctcctcctcctcatcatcatcggcgtcgacggcggcgggcacgggcgcggacctcgacggcgtcggcgcgtcgccggacagctactgcgtctggacgcccgggtcgtcgccggcgtcctcgccctcgcggccgccgcggaagagcgggtccacgggctccatcgcgcggtggcgccgcatcggtgagctcgtcgtcggccgcagccgcagcgacggcaaggacaagttcctcttcctctcggcgccgccgtccccggccagggacagggagcacgcccccgcctccaaggccaaggccaagctgccgcccaaaggaagcaaagccgccgcaaccgagctagacacggtctccgcgggccgccggttgtcatatggcggcggcggcgccaaggcctccaccggcggccggcgcacgttcctgccgtaccggcaggacctcgtggggctgttcgccagcgtgcacgggctcagcaggagcccacacccgttgtgagccggtgagccacgaccacgacgcgccgtggaggacccgttccaaacagtgagacttcaggtttgaaatcgggatttgaaatttcagacatttgacttggagatctcctgcgagccgagtcaaaaagacaaggtgtgaagtcagagaaagcaggggaaatgtgagccttcctttcaggattcggctcggaatcgtgctctgcagtcggtggctaaccacctgccatgcgatttgtgtaggcgggtacacatatactacgacaaattggacaagaagtttacatgtgattgttcgtatatgttggtatatatgtagctgtgtacatactgtacattgtatagtattgcaatttaggtatacaggagtaggtgtttgcgaggaattcagaattcctcgtttgcattctacagtttcgtttatctgcgtgttgtcgcatctctaatgtctaatctaactaattgcttttctgcctaaaaaaaaacaaaaaaaaaaanaaaa

SEQ ID NO: 11131 - DNA, 4493 bp, Zea mays
tattcatttattattttttttcgaaaaagtaatcttgtcattttagcagtggtagggcagcgcatttgtcatcaatcgcaatcgtgacaaatccatttatcacacggcagacggcacggcagttcatccctcatcagccgcccggaaagccacgcactccacttttctgcaccatcattccgtctaccgcccccgctgacctgagccctacccaaaagccaagcgtaaattcacgtgtagatgccggcgctacggccacccgatccctccgcgtgaatgaactcctcccgacctgccccgccccgggcgggcgaccagaacacatccgacaccaaaactaggcgcccgcttcgacgcaccataacgcactccacccaccgccacctactcgctacactctccatggctgccagataacggctggtgcttaaactactccggccgagctggccgtgctaatgccgctgcggctgcgtgcggtggcacagcgcggcctgcccctgtcgcgatgacacgccgcccggcctcctccgcgccttcggcggccccgctcctcctcctcctcctgcttcttctgctgctgcactgccagtgccaccgcgccggcgcggcgacggacgcggagcggcgggcgctgctggacttcaaggcggcggtgacggcggacccggggggcgtgctggcgtcgtggacgcccacgggggacccctgcggcttcgtcggggtcacctgcgacgcgtccacgggcgccgtgaagcggctgcgcgtccacggcgccggggctggccggcgcgctcccgccctccctcgcgcgcctccccgcgctcgagtccgtctcgctctccggcaacgccctcacgggcggcgtcccgccgagcctccgcttgctggcgcccacgctccgcaagctcaacctcagccggaacgcgctggccggccgagatcccgccgttcctcggcgccttcccgtggctccgcctgctcgacctctcccacaaccgcttcgccggcgggatccccgccgcgctcttcgacccctgcccccgcctccgctacgtctcgctcgcgcacaaccacctcaccggccccgtcccgcccgccatcgccaactgctcgcgcctcgccggcttcgacttctcctacaaccgcctctccggcgagttcccggaccgggcctgcgcgccgccggagatgagctacatctccgtccgcggcaacgcgctctccggggacatagccgccaagctcgcctcctgcggcagcattgacctcttcgacgtcgggagcaacagcttcaccggagctgcgccctttgcgctccttgcctcggtaaacatcacctacttcaatgtctcctccaacgcctttgacggtgaaatccccagcattgcgacttgcggcaccagattctcgtacctggacgcgtccggcaaccgcctcacggggccggtgccggagagcgtggtgaactgccgcggcctcagggttctggatttgggggcgaatgctcttgctggagctgtaccgcctgtgattgggacactgcggtcgctctccgttctccggctcgcgggcaaccctcgcatttccggttccattccggctgagcttggagggattgagatgctcgtcacgctcgacctcgcgggccttgctctcacaggagagattccagggtcactcagccagtgccagttcctgcttgaactgtaagtattagttggctgcttgcactactctgcaattcgcttctgtgtatgtatgtactgactagtagctaaatcacgtcaacacaggaatctgtccggcaacaagctgcaaggagtcatcccaggcacactcaacaacataacctacctcaagatgcttgatctccacgggaaccagctccaagggggcattcccgtcacgcttgggcagctcacaaaccttgttctcctagacctctcggagaaccagctgactgggccaatccctcaagagcttgggaacctctctaacctgacacacttcaacgtgtccttcaacaacctatctggcatgatccctccccggcctcccgtgccgggttttgatttcaccgcatacatggataacccgttactatgtggctctccactgcccaataactgtgggactgggactgggatgaagcaccggaaacgattgcgtgtgcctgtcataatcgccattgttgctgcagccctgatacttgttggaatatgcattgtttgcgcgttaaacatcaaggcttacacacgtaagggcacagacggggacgggaaggaagaggaagaggttcttgtgtccgagagcacccctccagctgcctctccaggctcgaatgcaatcatcgggaaactggtgcttttcagcaagagcttgccttcaaggtatgaagactgggaaactgggaccaaggcgctacttgataaagactgtctcatcggtggtgggtcgattggtacggtgtacaaggccacttttgagaacggcctgtccattgctgtgaagaaactggagacagtagggagggtgagaggccaggatgagttcgagcatcagatgagccagcttggtaacctcagccaccccaacctggtcgcttttcagggctactactggtcatcctcgatgcagttgcttctgtcagaattcatggccaacgggagcttgtacgaccacctccacggctaccgtcctcctcctcgcgctctctctgagagcagcagcagcagcagaggtggtggaggtgaactgttctgggaacggaggttcaacattgcgctcggagcagcccgtgcactcgcttaccttcaccatgattgctggccacagatcctgcacctcaacatcaagtcctccaacatcatgttagatgggagatacgaagctagactctctgactacgggttggggaagctgctgccgatactaggaagcattgagctgagcagaactcacaccgcaatcgggtacattgcgccggagctggcatctccgacactgggatatagcgacaagagtgacgtgtttagctttggggtggttttgcttgagatcgtgacggggaggaaacctgtagacagccctgggataggagctacagctgtggttctccgtgactacgtgagagggatattggaggacggaactgcgtcggactgcttcgatcgaagcctgagggggtttgtcgaagctgagctggttcaagtgctcaaactgggcctggtgtgcacttccaacacaccgtcaagccgacctagcatggcagaagtggtacagttcttggagtccgttagggttagctcttgaccttctgctgtcggatcggaacatagcagcagaattaggatgttaacatggaaaggattttctgattttttcaacagatgaaggtcacattctctttttttttaaatttttttggttctttactgtggcgcagcttcatttgtaaattgtatttagatttgttactgaataagtcattgttttggtcgaattactacatccatgtctatgattttgtcctttcggtcttcggtctatgtaaggctctttctatgttgtccgaagaccattttgcttcatggtgtgggcttaaagatgagttggtacagtctaattgtatatctagtttgcaggcatagcaaaggaccaggagtttcagtttccccgggcgccatcagagaagagcttggaggtggccagcgacgaggaccagctgaacaaggacagtcagtccatggaagcccattgagaccgaggtgtgcgtacaagctctgtccgttgaggaaaagtatcacatcggtgcagcatattcagacaaaaattcataccacatcgctacgggaacgggggtccattgcatctgcagtccgctgagacaacaggcaagccacggatgcttcttctcattggcaggcgcaggttgttttttagtattgtattattgccattgtatgatgctgacaccacaaccgctcccgctaaacgctaatgacagtgggttttcccagctcttgctctgtctgatgtttcaggggctcatgaaggagctcttcaccatcgcgtgttctttagctgcacggctccggcctccggggctgctgcacatggacgtgccaaacggtgcagaatgcacgtgaggccataatggagagaggaagcatggcaaggtagaaagcctagccgtcgggcgtcgggtgactggtgttgtaccgtcgtctcgtgaaaatattggtcctttttttttaaaatggaacggtatgcaggagaggagacgcactgcaactttctttgtacagcagattcgaaagaaatgtcctgctgctggtccatattatcattcattcatgtggtatggaagcacttggtattgaacgtgtgaacttttgttgcaccgtctgaaagaccatcagactatctccagcggctcacccattcttatacttgtatttaaactttactttacaaacaatacaatttat

SEQ ID NO: 11132 - DNA, 4850 bp, Zea mays
cgcgggctctaaatacttttttctccggtcccaatctatttctaatatttttgaactttttatatactttcaatgttttaaataaactttttccgattttcttagtaaaaagttgaaaccatcctaaaataaaaactatttctaaccatggtagagagctaatttaagcggctttaagatttgaagaagaaattgccttattttagagttcattcaagaaggaaaaaatggagtcctagttgagggaaaacaccacagattccacagccttcgcctgttcgccacctttcctccaaaatttgacccacacgcggcgacgccccggcccccctgcggccacatcctccgcggccgcggcgtcgcccgaggcctgcaaaaccctaaccactcaggttctgccggccaccgccaccaccaccaccagtccaccaccatgctgacagccactcccctaccccatcagctcctggccaccttcctcctcgtcctggcgtcggcgacccaacctgcagtccctgcctccaccgaccgcgcagcgcttctcgccttccgcgcgtccctgtcgccgccctcccgcgccgcgctatcctcgtggagcggcccgctctcgccatcctggctcggcgtgtcgctccaccccgccacggcgccagccccttcggtcaccactccctccgttgccgaactctcgctccggggcctcaacctcacgggcgtgatccccgcggcgccgctcgcgctcctccgacgtctccggacgctcgacctctccgccaacgcgctttcgggagagcttccctgctccctcccgcgctcgctcctcgcgctcgacctctcccgcaacgcgctctcgggggctgtccccacctgcctgccgtcctcgctccccgcgctccgcaccctcaacctctccgccaacttcctccgcctcccgctctccccgcgtctctccttccccgcgcgcctcgctgcccttgatctctcccgcaacgccatctccggcgccgtcccgccgcggatcgtcgccgaccccgacaactccgctctcctcctcctcgacctctcccacaaccgcttctccggcgagatccccgccggtatcgcagccgtacggagcctgcaggggctttttctcgcggacaaccagctttccggggacattcctccggggatagggaacctgacctatttgcaggtgctggatttgtcgaataaccgattgtccggttcagtgcctgccggacttgcaggctgcttccagcttctgtacctgcagcttgggggtaaccagctctctggggcactccgtccggagctcgacgcactagctagtctcaaggttctagatttgtcgaataacaagatatctggggagattcccctgccgctggctgggtgcaggtctttggaggtggtggacttgtcaggaaatgagatctccggtgagctcagcagtgctgtagcgaaatggctgagcttgaagttcttatcactggctggtaaccagctctccggccacctacctgactggatgttctcgttccccctgctccagtggcttgatttgtctagtaataagtttgtgggtttcatcccagatggggggttcaatgtcagtgaagtgcttaacggtggaggtggtcaggggactccatcagagagtgtgcttccaccccaattgtttgtgtcagcttctgtggacacggtgtcatggcagttggatttggggtatgatgttcaggcaactactggtatagacctgtctgggaatgagctctgtggggagataccagaagggttggttgacatgaaggggttggagtatttgaacctctcctgtaattacttggctgggcagatccctgcggggcttgggggcatggggaggttgcatacgcttgacttctcacataatgggctgtcaggggaggtgcctcctggaattgcagccatgacagtgcttgaggtgcttaacctctcctacaatagcctgtctgggcctttgccaacaacgaagttcccaggagcattagctggaaacccaggaatttgcagtgggaaagggtgctctgagaatgcaaggactccagaagggaaaatggaaggtagcaatcaccgcggttggcttggtggctggcatggagagaatggatgggtatctcttggtgcattttgtatcagcacaatgactagcttctatgtatcattagcaaccttactatgctcctctaatgcaagaaacttcgtgtttcggcctgtgagggttgaatattaacaagaggggagattgcaaaatcaggttgttttgaagttcgagcgactctggtctgcagctgattaacaagaaatatgagcatatgagatggatatcttcagccaagaggaagtgctgtctcttttaatgatcaatcaagctctcttgattgtttcctaatattcttgatcttgggatgtgtagatctagttctaatattcctactgttatagaatgcaatcacctgctggtgcttggttgtagccctggcgtgtttggaggattggacaccaaggatgcacataatttgaagcgctggtactgtgaaccacttcagatgtaaatattttctttggtttttagttctgatctagtttaaaactggacatgtatttagtgttgttgagctacctttcgatgttatattatgtcaatttgctggaagatcatttgataacaattgtctaaaaaaatggattagtcgtgtagattgtgaagttcgttatgtttcttcttagtgctatgtatatcatctttctgtctgaacttagtttgggggtaaaaggctttgttattatgtgactgaaactgcaaatgtgcttgactatttcttggtgctgctcctgtaacacctatagttttataggtcaatggtaatagctgcctgaagcagcatccagcaggccggcaactgtttttggtactgtaatactttggaacagaggcgcaaagtttgtgattgcagaatgatcaacaaatgtatttattgcaaagtgtgagacaaggcaacatacatatctctgttttgtgcattaccaaactaacccaggctgtaattgcagattgataattcctatagccgtagcttcttcagctggataaggtggagaataagcatcagtggcttttcaaagggttcggcacttgtgcagaatcagactcatgcaggaatccggttctaacttttccactaaaacctttttcctttctgaacttgctgcagtacctaccactacttgtaatgttggatcagtttcacagttaaccacagaatttcattgcttttaatcaaacgtgaaatggtcacacagaaaaaccaacatccttcagaaccgctcgttttatcttgttctttagattacttcaaatgtgagcgctttgagatggtcacctaaggtgtgtttggttgatgtactaaggtgtgtttggttggatgtacaaagagtgatggaagggggcaacaacagtttctatagtgtttggatgagtcacgtgaggacgagataaacattagagtaattttttatggcggcgtgatcccaaaaaatcgagggaacggtgttattcctgccttatcctattttgatctcaaaccaaacacatcctaaactgtcttggatctagataaggtgacctggacgcaaacgacgactgctgatggttggtctcctgtcaggaactggctcgtctggcctagacaaaagaactggctcgtctggcctagacaaaactttcatgtggccgttggccgttgacgttaagaggaattgagatcaccgccggcgccaggtctatcatctgatctgcatgctcatcctcatcacgcgagtccatttcagtggggcccccggtgtcgtgccctgtgattgccattgattcggccttctgcatatgctcgcatacggcattacaaaacactccacacaaatcttgaagtgcaagctatagacgaaaaatcactaagacattataattctaccattgaaaaatcactaagacattacaattctaccattaaaccgccatccatgttttacaaaaatctccatagcaaccatctctaaagagtgataaacatcgtttatttcctgatgagttttttctttctgcatcagtctcaaatttgaacgagcaggttctcctaaaaatgacatgcataatggacaatatttatttattgttaaaaacaacattttattttttgtgtgcgtttccgttgcaagatcctattatgtgattaagggcttgtttaaagcacccatttttttaaaaaaatggtttatagaaactagactggtttcaaacatactagtttatatttgagtttattgaaactagattctcagtttcttaaaaaccaagaagttattctcccctatataaaaccagtttttgtttgtttaattacatcgtgcccttgttggtttaatggaatttacatctattgacattgctttttaaaatagaggaagattatgctagtaattgtgtatcaaaaaactagaaactggttttttagaaactaagttctaaaatccccacctattttttttcttccataaaccagttttttagaaactgaggatagaaagtggtttttaaaaaactaaaaactagtgtgcttccaaacagactctaatactagcaagcctatctattttaagagcactaaaaataatcctttaaataactcgggcaatatagcaatcgaaaaaagttgttggatattctcattctgataacagaagctgcacttcacaattcctttccacctttttgctagaatatcttaggtgagagtccctcccttgcctag

SEQ ID NO: 11133 - DNA, 2875 bp, Zea mays
gtccctgcgacgcgtccacgggcgccgtgcagcgcctgcgcatccacggcgcggggctggcgggcacgctcgcgccctccctcgcgcgccttcccgcgctcgagtccgtctcgctcttcggcaacgccctcgcgggcggcgtcccgcccggcttccgcgcgctcgcgcccacgctccgcaagctcaacctcagccggaacgcgctcgccggcgagatcccgccgttcctcggcgccttcccgtggctccgcctgctcgacctctcctacaaccacttcgccggcgggatccccgccgggctcttcgacccctgcctccgcctccgctacgtctcgctcgcgcacaacgacctgacgggccccgtcccgcccggcattgccaactgctcgcgcctcgccggcttcgacttctcctacaaccgcctctccggcgagctcccggaccgggtctgcgcgccgccggagatgaactacatctccgtccggagcaacgcgctctctgggcaaatatccaacaagctcgcctcctgcggcggcattgacctcttcgacgtcggcagcaacaacttctccggagctgcgccctttgcgctccttggctcggtaaacatcacctacttcaatgtctcctccaacgcctttgaaggcgaaatccccagcattgcgacctgcggcaccaaattctcacgcttggacgcgtccggcaaccggctcacggggccggtgccggagagcgtcgtgaattgccgcggcctgaggtttttggatttgggggcgaatgctcttggtggagctgtacctcctgtgattgggactctgcggtcgctctccttcctccggctcgcgggcaatcctggcatttccggttcgattccacctgagcttggagggatcgagatgcttgtcacactcgacctcgcgggccttgctctcacaggagagattccagggtccctcagccagtgccgattcttgcttgaactgtaagtgtttgttcagtactcgcactgctgcaattttcgcttatggtacaatgtttccatgtactgactagtagccaaattacaacgacgcaggaatctgtccggcaacaaactgcaaggagctatcccagacacactcaacaacataaccggcctcaaggtgcttgatctccacaggaaccagcttgatgggggcattccagtcacacttgggcagctcacaaaccttgttctgctagacctctcggagaatcaactgactggggcaatacctccacagcttgggaacctctctaacctgacacatttcaacatgtccttcaataacctatctggcatgattcctcctgagccagtcttgcagaaatttgattacactgcctacatgggcaaccagtttctatgtggctctccattgcccaataactgtgggaccgggatgaagcaccgcaaacgagtgggtgtgcctgtcataatcgccattgttgctgcagccctcatacttattggaatatgcattgtttgtgctttaaacatcaaggcttatacgcgtaagagcacagatgaggacatgaaggaagaggaagaggttcttgtgtctgagagtactcctccaattgcatctccaggctcaaatgccatcatcggaaaattggtgcttttcagcaagagcttgccatcaaggtacgaagattgggaaactggaactaaggcgctacttgataaagactgtctcattggcggtggatcaatcggtacggtgtacaaggccacttttgaaaacggcatgtccattgctgtgaagaaactggagacactagggggcgtgagaggccaggatgagtttgagcatgagatgagccagcttggtaacctcagccaccccaatctggttgcttttcagggttactactggtcatcctcgatgcagttgcttctgtcggaatttgtggccagcgggagcttgtatgaccacctccacggtagccatcctcacgctttctctgagagcagcagcagaggtgctggaggtgaactgtcttgggaacagaggttcaacgtcgcacttggagcggcccgtgcacttgcttaccttcaccatgattgccggccacagatcctgcacctcaacatcaagtcatccaacattatgttagatgggaaatacgaagctaagctatctgactatggattggggaagctgttgccgattctaggaagcattgaattgagtagaattcacaccgcaattgggtacattgctccggagctgtcatctccaactttgagatataacgacaagagtgatgtatttagctttggggtggttttgcttgagaccgtgacagggcggaaaccggtggacagccctggggtagctacagctgtggttctgcgtgattatgtaagagaggtattggaggatggaactgcatcggactgctttgatcgaagcctgaggggaattgttgaagctgaattggttcaagtgctcaaattaggtctggtatgcacttccaatacaccatcaagccggcctagcatggcagaagtggtacagttcttggagtcggttagaattagttcttgatcttctgctgtcagaacatagtcgcagaataggatgttaacaggaaaagtgttttctgatttttttttcaacagatgaaggtcacattctttttttattctttactgtggcgcagcttcatttgtaaattgtatttagatttattgctgaataagtgattgttttggtcaagttaccaaatccatgtctatggttttatccttttggttttcggtctatgtaaggccctttctaagttgaacctatgtaaaaaactgcaaatgcaagagcagttgctgggatctgaaccccccttttttttt

SEQ ID NO: 11134 - DNA, 1374 bp, Zea mays
gtagttcttgcatgtgcattgtctgctcaaagtttgactcagcatctaatacttgtagttgggttggttgtgatgtatgtcttcattggtgccacacagattgtggtctacgccactctctgattcgaaaggggcaaagtgcttcaagggcatatggaactactgagatgcagtttcactgttctgcctgtggatatccatcggagatgtttggttttgtgaaggaagtatttcgaacatgtgcacaacaatggaggatagacatgctggttagagagttacagtatgtagaaagaattttttctgcaagtgaagatgtaaggggcaagagggtccgggacttcgtgaagcagatgctaattaagtcagaaaacaaggcctatcatgctgaagttgtcagatgtgtcattgcattcttttctgatgatggtgctaaccttggcagtgatccatcagtaccactgaaaggcattccatgcagcatttctgaagctgttgatgggattcctagttcaagtcggaaggcatggataccatttaccttagagggacttccagttttagacaaaacaactcttcctaccacaagcacagggagcccatctgtgcctagaaaatctggtgaagctgagtttcagacaattgataataagcctgccactgatgaactggatagcttgatcaggttaaagcaggctgaagcatatatgtaccaggaacgtgcaaatgatgcacggaatgaggttgacaatctgagacacattgttatggtaaaaaatgcacgaattgaggaagattatggcacccatatcgctgatcttgacataaatgagttacaagagcggcgcaagcgaaggattgaagaactccaagtaattgaaaggacacaccatgaatttctcagcatgaaaactaggatggtagctagcattggggagttattgtcaaaaatggaggcactgaaacaaaaccgaagcacatgaactgaggttactattgcagaaatcgaagttgctcaacttgtttaaggaagcctgcacatattgttcttacaggaatgcgcaaagcatcgacatgtgaggggtaaccgaatgtctcactggggatgagccaccccagggccccccacgagtagccgaaggaggagaggtgcagacggacgacgaccatgatggtcagaatgtaacataggtagatatagaggatgtttggtttccatgaccaaagtttagttcatgtaatattaaatatttgaatatcaattataactaataaatgtagacttaattatatttaataaatttgtctcgtctttatctgtataattagttttataactaaattatatttaatatatgcaattattattcaagc

SEQ ID NO: 11135 - DNA, 1283 bp, Zea mays
aatgctggttagagagttacagtatgtagaaagaattttttctgcaagtgaagatgtaaggggcaagagggtccgggacttcgtgaagcagatgctaattaagtcagaaaacaaggcctatcatgctgaagttgtcagatgtgtcattgcattcttttctgatgatggtgctaaccttggcagtgatccatcagtaccactgaaaggcattccatgcagcatttctgaagctgttgatgggattcctagttcaagtcggaaggcatggataccatttaccttagagggacttccagttttagacaaaacaactcttcctaccacaagcacagggagcccatctgtgcctagaaaatctggtgaagctgagtttcagacaattgataataagcctgccactgatgaactggatagcttgatcaggttaaagcaggctgaagcatatatgtaccaggaacgtgcaaatgatgcacggaatgaggttgacaatctgagacacattgttatggtaaaaaatgcacgaattgaggaagattatggcacccatatcgctgatcttgacataaatgagttacaagagcggcgcaagcgaaggattgaagaactccaagtaattgaaaggacacaccatgaatttctcagcatgaaaactaggatggtagctagcattggggagttattgtcaaaaatggaggcactgaaacaaaaccgaagcacatgaactgaggttactattgcagaaatcgaagttgctcaacttgtttaaggaagcctgcacatattgttgtaagtttctttttcttttattattatttctgcttgttctaggactagctttctgtaatattattctttttcactactgctgtgatagagattccttcacttttggatcatttcaatcacataggcagaatgatgagatgtaaactctagatcttcctgtatataatctcaataattatctacatgcacatgtggtgcttcctgatgtgatgttcttgattcctatgacctgactgaactgcacagggccgccactacatttatcagtgatctgaaccgcacagagctactggtgcattctttttctgtgtgatatgaactgcaagttgcatacaacacgcaactagtcaagtgctgatttttcttttttttatctccttgcacatatttttgttgcgtctcaatttctgcatgaacataaacattatgtcgctacccactcatgtatttggtggaatttgtcgtacacatttcgaagcctttttaaaatgtaagca

SEQ ID NO: 11136 - DNA, 1667 bp, Zea mays
atctccaagaatagcgggggggacggctataaatcggaaaatctgcccctcaagtttgccaactttaggataggccgtgcaaatccatttcttgccttgccggcacagctctgcatagctcctcccaagctttaggattaggatttggatttggatttggatttggatcgggtgtgtttcctgcgtaaccatgagcgagatcatgaagctaaagcgtgggatcagcaccaaaccaggagaccacctcgtccaaaatggccaacaacatccatgtcacgaatgggaggagcaacagcgctactggccctcgccgcgggcgccgccggcgagcccgacggagtcgcccaggaccccaggcgggagccagaagaaggcggttctgggcaaggtgaagagcaaggccaagaaatggatgcacatgctgcatcacaagaagaaacccgcgccgccggaggagatgatgtggacccccagggccgggcctggacccagcgcggcacaagacagcatgcccagggaggagcgacacgccgccgagcaccgtggcactggcactcccaggaaaccgcagcaacacgcgccttcctgttcctcgagcgatccagagcgggcgtccgaggtgttcctggaagcgtcaccgaggcagaactcgccggtcccgagccccaccgcgcacaggcagcagcagcagccgcagccgtacttcaaggtcagcagcaggttcgagtcggagatgaaggaggccaacgagatgctgatggagtccaagaagctccgcgtcaacacgaccaagcccaagaccaagaccgtgacgttcgcgccgccggccgtggagcgcgagcagccgggcccgggcggcgagaggagcggctggaagaaagactgcaggagggagctgcccggagcagcggcgtcccaggcgctccgcgacgcgttcgctgcggtccgccagacggtgctcgagatggtcgccaggatccaggaggcggtggcgctcgttgacggacggcggcacgtggtagagaggctcgtgtcggtcggcaggtacctggtgatgaagctggagcctgggcaggacgacacgttgctctcggaagcgatcactgacgccgtcctcgacctgttcgacgcgtggagcgagagcgtcgagaggcctttggtgcgacgggcgaaggagatctcttcttggttcctgcaggaaggaagagaagacacacctcctcctgttccgccgtctacgcgtccttgtgcggccgaagatgcagatgtgttttattccttagagaattgacagagcagcttgaagcaagagatcgagacattatgaaactacgtcggtagagttcatttacctaacgatgtcaggaagctgaaggcaaaggtctccacggctttgtacctgagatttgagtgagagaaagcaataggcaatcttgatgaagtttctcttcagtaaagaccatgtattcacgatgcatgtaactaggagccaaacacaatgtgtatatcgtaaaagaatagacctagtgctgaaggctgtggggtggataaaccgaggcaaaagcattttctcccgtaaatatggagaggcggctctcaccactacgtcagacccgttcaatgtgtatatcatagacatgttgaaatagaaatccccaatggcagag

SEQ ID NO: 11137 - DNA, 1319 bp, Zea mays
ctcatccgtacccgagcactgcacagcacagcacagcacagcacaccacctttagtatatagctgtattgcgcacctccgggccggccgtgaactcccccggccgtcctgctcgccggcttctggctggcccctgcatccgcccagtgtgtgtgacctcagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgagttcgaccggctgagcgcgctcggcccggtggccaccctcgccggctcgcagtacacgctgaacctcacctacgacatgggcaccgtccgcgtgaagtccatgtggtccgaccccaagatcagcagcagcgtgtactccacccgccccgtcgcggtgtacgaggtcggcaaggttctcctgccgatgcagatcttcaagagcgaccccccgctggcgcctgcccccgctccggcaccggatgccaaggcatccgacgtcgctcccagcccggcgtcggggaaatcatcagcgagtgcgaaggcgaaggagaaggcgggagagaagagctcgtcgtgccgagccggtgtcgtcgcccattacttggcgatcgctgtctccggcggcctggtgctcttgtggtgaggatcgacgagttcgtcctcaccgtgtgtccgtgtcgaaggagcaagtacggggttcagcttagggccccccgtgtttaatttatatatgggtgtttatggattcattcttttggacatatggtaggccatttgtgtttaggactgagctgttgttgagtgtttgcgtcatatgcttctactaggtgtatgcccgtgcgttgctacgggaccaacatgtattgctaagatacattaagataagaaaacactataataaaatatattgatatacaaaaaaaaaaaaaaaaaacacgagggcggccc

SEQ ID NO: 11138 - DNA, 976 bp, Zea mays
ttttttttttttttttcttaacaaagtaaaccctagagggaacggttatatatatatactccttgtattgctggccaccgaaaacaaaaccgtgctcctgttgcgagatggcaccgtcgctatattgcataaatcctcaaactaagccgtgaggtggttctatcgcaacactgggatgtttgctctgtcctaggctagttgtttgcattacagactgccctacaaagaacgcattcaattatgtatcctaaacttatttgaaactgaaagatgttgcaataatgtatcctcccacacggaaactatatgtaggaaacaacgaacagaaaatagtgagctctcagctgatgatgacgcacatgcaaatctacaaatggcagcaaattaactttattgttcagaatcataacttatccattgtctctgtttagctaatcgcccaaccgagctgatggcgatggcatcaacggtgagggactcggaaggtctatcggcggcactccatccattaggctgcaggccgcggcaagtagatcgacacgtccagcgtggccacacaccgagaagagctccaccatgcgcatgcgactcatcggcgccggcagaagcttgccgatgtcgccgtccacgacgtggcacaggcaggtgaccgtgtccaacgtgaacatggagccgaagccgtcgcagcaggtggcgtcgggcgcgtacacggtggagttattggtgaggaagcccgcgcacggcatcatccgcgccagccatggccggcactcccttggctgcggcggcagctgtggaatgccgccgtcaccgtcaccgttacctggatctgcgatggccctggcaaggcctcctcccactctgctcgccgctgatggttgcaggataagggcggccatggcgaccagcagtgtggtgcgcttgttgcctagcgccatcctcaactatagacgcgcgcggcgtgtgttgagaattt

SEQ ID NO: 11139 - DNA, 1260 bp, Zea mays
ctcatcccatccgtacccgtgcactgcacagcacagcacagcacaccacctttaggatatagcaatagcacactcggcccccctcctcttcaactcccccggccgtcctgctcgccggcttctggctggcccctgcatccgcccagtgtgtgtgtgacctcggctcagggaatcgattcattcatccaagtgaaggcaaccagactccaggatggagttcaaagccggcgttttcaccgtggcaatgctagccatcgtcgtgctctccacaccagcagccgcgcagaagcccaagagccctcccgctccgccatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgagttcgaccggctgagcgcgctcggcccggtggccaccctcgccggctcgcagtacacgctgaacctcacctacgacatgggcaccgtccgcgtgaagtccatgtggtccgaccccaagatcagcagcagcgtgtactccacccgccccgtcgcggtgtacgaggtcggcaaggttctcctgccgatgcagatcttcaagagcgaccccccgctggcgcctgcccccgctccggcaccggatgccaaggcatccgacgtcgctcccagcccggcgtcggggaaatcgtcagcgagtgcgaaggcgaaggagaaggcgggagagaagagctcgtcgtgccgagccggtggtgccggtgtcgtcgcccattacttggcgatcgctgtctccggcggcctggtgctcttgtggtgaggatcgacgagttcgtcctcaccgtgtgtccgtgtcgaaggagcaagtacggggttcagcttagggccccccgtgtttaatttatatatgggtgtttatggattcattcttttggacatatggtaggccatttgtgtttaggactgagctgttgttgagtgtttgcgtcatatgcttctatgattactactactgattcgtgtgcagaaagtatttcatacttgccggcc

SEQ ID NO: 11140 - DNA, 2377 bp, Zea mays
cgggttttcaatacttgcatccttttcgctgcatttgtttagcgggagttcttcgaacaagcagcgctgccgctgcttgcgcgaatcttttgagtgaagctccccgtcacatcagtcctcttcttccccggtcgtcgtcctatgcttgtccctgtctcggcaattctgggatactaaagaggaatcggtgaaggtccggtcttcgattccccgagatttgcatctgaatcttcttcttcttctcttttgcctccatggagtctcttgctgcgtgccactccatcgagcgagtcggggggagggaaaaggcgagagcgtagaaagtccggtcggagaagcggaagttcgcgttgctttgctgatccaatgggggagaccaacgagctaccgccgccacccgtggccgcgccgccgcccatgatgccgatgcagtccatgatggtcggcgcaggcgccatccacccgccccacgagcagttccaccatctcaactactgcgtccactcaaatccatcctgggttcaggtggcagcacttgcattccttcactatcttgtgatgttgggttctaccgtcatgcttgcaacagctattgttcctgcgatgggtggtaacgctggtgacaaggctcgagttattcaatcgttcctctttatgagtggcataaacacactgctgcaaacacttattggaacgagacttccaacagttatgaatgcctcttttgcatttgttgtcccagtgctgtcaatagcaaaagagattgaatcaaataacttcctgaatgatcatgagagatttaaacacacaatgagaacagcacaaggagctctgattgtggcatccatcctcaacatgattcttgggttcagcacgatatggggggcatatgccaaaaagttcagtccggtgataatgacccctgttgtttgtgttgttggtcttggactattccaacttggctttccccaggttgggaaatgtgtggagattgggcttccaatgctaattcttgcggtggttgtgcaacagtatgtgccaaattacttcagttatatccatcaacgggtcaccttcttgtttgagaggtattcgttgcttctttgtatcggcatcgtgtgggcctttgcagctatccttactgctgcgggtgcatatgaccatgcttcacctaagacacaacagcactgccgcactgataagtctttcctcatgtcatcggcaccatggattaaaattccattaccattcgaatggggtcctccaatcttcactgctggtcattcatttggaatgatgggtgctgtacttgttgcagccttcgagtcaactggagcacactttgctactgctcgtctagcgggtgctacaccacctccagcttatgtccttagtcggagcgttggcttgcagggtattggaatgttcttggaggggatctttagtgttccagcaggttcatctgtatcagttgaaaacattggcctccttgggctgacaaaagttggaagtaggagggtgatccagatatcaactgggtttatgatattcttctccatatttgggaaatttggggccttctttgcatcgatcccactgccgatctttgcagcaatttactgcatcttgttcggcattgtagctgctgtgggagtctcgttcatgcagtttgccaacaagaactcgatgaggaacatctatatcatcggactctcgttgttccttggcatctcggtccctcaatacttcaacggatacacttcttcagctggcggccacggacctgcccggacaaatgctggatggttcaacgacattataaacaccgtgtttgcttccgggccgacggtggcgctaattgtcgcttctgtcctggacaacacgctggagttcaggggctacgaggccgaccgggggctctcgtggttccagccgttcctgcgccgccataagggatactcggaccccagaaacgaggagttctacagcttcccaatcagcgtctatgacgtcatcccagaccgatttcggcgctgactccaaatgaccgctgttaccccgcagctgtgcatgtaaatccccgtgagtcttgttagtcttactcctgtgacttgtagcggctggttctagggggatatgggtaaaagaatgcttagggcaattgcttggtttgactcttttcgggataagaaacgggttacatgataatgtagagctctgtgccggatacattggttttgggaagggttacagaagaatactagcaccttacatgttgatgggcatttagttgaaggcattggctatttgtttttttgcccaatatatggctgttggagcttgatctgctgactgggaaaagggggcagtactttgg

SEQ ID NO: 11141 - DNA, 2683 bp, Zea mays
tgtcatgaggaacctcctggtgatctcaacattttccaattgagaggcataactgctagtaagggcacattctaccaccatagcatggaagaacgagtggctactttgctatacatgttctcaaatacggaagagatggagccatattttatgtcggtgtttcttttgctccataatttctttgacattactagataatgactttaattatttaattctcgtatagtgagtttaatgaggaaaattggacacatattcatcaacctacaagcaaacagttagatacggtgcgatgatatgagcgacgaggaagacctaattttgttgattggtttctggatcatgtaaaagtctttgtatccatcagtttgatgtcatttaatcttttagcgatatagtatttgttatttaactccatatcatttgcagtgcacaaagacacctaacatacataaggacttagagacatctatcttatgggacaatgacttatagaagctatggttaatacaatatcaatggctttcgtttttcttgtgcccaatttgaagcttctcgtccctcatgcagccacatgtgatacttgagttgtaactaggtcaatcgatgcacacggtagagaaactaattagtatgatgtcatttaaaacattcttgagtttaattttacaagaaacaaaagtctaaaagtagtattcttactttgtgatttgttcgatacttgtaatgggattagacaaaattatggaatgcgtgactgaagtcaagtacaatgaactatttcgaggtcatgataattttattcttgcacacgagtgcgagcggatgtactgtatgtcataccgaagctagaagtatggtgggtatttaacaaagtaaaccctagagggaacggttatatatatatactccttgtattgctggccaccgaaaacaaaaccgtgctcctgttgcgagatggcaccgtcgctatattgcataaatcctcaaactaagccgtgaggtggttctatcgcaacactgggatgtttgctctgtcctaggctagttgtttgcattacagactgccctacaaagaacgcattcaattatgtatcctaaacttatttgaaactgaaagatgttgcaataatgtatcctcccacacggaaactatatgtaggaaacaacgaacagaaaatagtgagctctcagctgatgatgacgcacatgcaaatctacaaatggcagcaaattaactttattgttcagaatcataacttatccattgtctctgtttagctaatcgcccaacctgctgaaaataaggaaaagaaaaaaaagatgtgcatagtgaacagattataactgaatacagattatacgtcaccaatttggtaaaagtgatgaaaataaggcaaaagtgatgaaaataataaaaaaacgcataccgagctgatggcgatggcatcaacggtgagggactcggaaggtctatcggcggcactccatccactgttcagttcaataataatccatatatattcttcatcagatcaatcatcggtgaagttttttgttttttgtttccggccgtacgtacaaacatgtgtacatatatagctttccgatcatcagatctcaagaggcagcagctagctattacgtacttgtggtctatcggcggcactccatccattaggctgcaggccgcggcaagtagatcgacacgtccagcgtggccacacaccgagaagagctccaccatgcgcatgcgactcatcggcgccggcagaagcttgccgatgtcgccgtccacgacgtggcacaggcaggtgaccgtgtccaacgtgaacatggagccgaagccgtcgcagcaggtggcgtcgggcgcgtacacggtggagttattggtgaggaagcccgcgcacggcatcatccgcgccagccatggccggcactcccttggctgcggcggcagctgtggaatgccgccgtcaccgtcaccgttacctggatctgcgatggccctggcaaggcctcctcccactctgctcgccgctgatggttgcaggataagggcggccatggcgaccagcagtgtggtgcgcttgttgcctagcgccatcctcaactatagacgcgcgcggcgtgtgttgagaattttttcgagcaccggtttttatatatatatatataaccactttagtcaactgcatgcctatggtgtggtggatcacaaatcttttgatggcacaggcctccattattcacggaaacttggtgtttagaaacaggacaaattccaataaacttttaacatatactggcgctccacttcttcatggctccatgttaacacgatagattggggatgaaggaaggaagaagagaatgcttggagaggaagaagtacagaagccagtggctttgcgccgtgacagctgggctgcacacacacgctacgccacaccggctcatgggccacggttacaggacatagtcgctgttgtggatcagacgattgggcgcccttgcacgcgagctacgacgaagggcttcaggtagacgcaggtgtaacattccccctgttgcgccgcagcttgccccccaagccggcgcaaaaggaaacgcctgatgcagggagtcctcatcttcctaggtcgccattgaggccggccacttggaccacttgatcaaagct

SEQ ID NO: 11142 - DNA, 3233 bp, Zea mays
  misc_feature (1506)..(1506): n is a, c, g, or t
  misc_feature (1796)..(1796): n is a, c, g, or t
agacggcgaagacggtggctgctcctggtgcgcgagttgcttcaaatttggtaggtccggcgacgcatgcctggcagctcgtggaatccaggaaatcgaagcgacggcgcctgaagttggaacgacagtggaaacagctccctcggcacctggttggtagatgcttcaactgcctttcccaagaccacttcgtctcccattgtgctgagaagacgaggtgcttccgttgccgtgagctggggcatcggtcctttgactgcccactgattaaagagtcggtctggcataggatttctcctactgcggactcagggagcagtggaattccttctcggcctgtggctcttcaacctgaggctcgagtttcggtctggaataggatctctgtggtgaaagctaagccgaagaaactggtgtggagacggaaggcccatcaacaccacctgcaggtggcaggtgctgttcctgctactccttgcaaagcagcccttatggcgggaaatgtctggggccccgggtctcgttcgctgggtggtggttcaagggattctttgcgcgctgatgatggcaatgccgttctgggtgagggctccggtgttggggctggccggcctcgtcggcgtcgaccgcgcaaacgtcggcgtccgactagaaggcctggaagcccaacgtcgggcaactccctggaaggcgatatgcggcaagatcgggacattattgatccacaggcccccaccagtgctatctcaccctgcattatgggttggagcaacaagctatcggcttctgaagatgatctcaggactgcggtggtgttaaccattatcagcgaccttgtgattcctccggtggagattgctgcgcttctggctccaagattgaatatcaatgaaacttcactggtcatccgcaggatctctgcaagtagtctgctactgattcttcctgatctggccaaggcagacctcctagtcagtcgttggcctctcatcagaactgcctctttttctgttatctgtaagcgttgggcaaggtttcttggcgcctcgggagtcgccttgccattcttggttgatctggagattggaggcatccctgttcatgcctgggaaactagtacggtggaacatattcttagcccctatgcttggattcatcaggtgcatcaggagaccttggcactgcaagatttgtcctgctttcgatgctctgcttggtgtactgatccgtctactattcctgcttcacgtgacttgtggattgttgagtctgttcaggttgttgagggcattgttggagaaactatggctctgagctacccaatcactattagtttttccgttgccttccgaccgaacgattccaattcacagtctggtcttcctatagattctgtgaatgatggtgatcaaaagtaatggccactatggacatgccaatcagggattgtctcaggggcatggtgcatttgggggtgggagatctggcccattcctgagggatggntgtaattcatccttgggacgcatagccagagactgttcagggacttgcgagccaccagtcaccaaccaggggacaacttgctagatatcgtgcattgttgacacttctgaattacataaaattgctgacccacttctggattgtcttcttgctgattgggagactcgtcattcgtccatgtttcatcaatcgtccaggattttcattgatccctgctgtttggatatgacagtggacctaggaggttttgagccacaatcttcgaactggttacggatttctacagccantcgggattggaatgggctgcaattatgcccacctataaattatttgaagccatttctgactccatgtagggaccttgggtatctaagagtaaatctaagtggattttctttgccatcgaaaaaatcttctatcaacgacatcgaaaaaccactgctggaaataatattgctacaattaatgatgatgataatgcggaggctcatgctttgagattgggcttggatgttgatgtggcagcggttactccgtctgacccccccctcggacgtggaaggagctgctgatactccgtctgagaccatctctagatttcacgggccattattattagagcacattggaacagcgaggagggctgatgcagactcaactgctccactcaggcctgaggtggtagcctctgatgacagttccaggcagaattttggggattcatgtgagtcctcattggatccattatcttctatggaatctagaagaagatcattcatggctaagataacaatggcaccttcacagctccttgctgctcctgtcctccccaagcggtcaaggggtgccacaaaacatggtactgcgctacgacggagccgacgggttgcaggggcaggggtggaatttaacatgcaggatctggagaacagagccacaaaacaagtaatgcggactctgaaagtcatcacagagaatgcaagcatcaaccagcaagctgttaaggattatgagaatctttttcagcatcccttaactcaaagtcatgttgaagcgttagcggctctctttggatgggagactccggggaatctcttcccgtagtgtgtctatttttctttctgggttgtaatttataattgttgtaatggatcctagcaaaattatatgttggaatgtgagagggttaaattcagctgatcgtcaaaattcagtccgggatctagttctgtcctctaaagctgatgtggtctgtctccaggaaactaaaatgactgtcatttctacaagaaccattcttgcagccttgggttcggatttttgccagttctcctttctaccatcttgtggtgctagtggtgttgtgctggttgcttggaagcgacatctgggagtgactgggttgtctaggattgacagatacagcatttcaatccaattctgcaatgcgcataatcgctgttggtggttaacttgtgtttatggtcctcaaagtaacagtgataagatgttgtttcttcaagaactgagagacgtcagggctgcttgcactggaccctggttgattgctggtgacttcaatctcatctacagggcttcagataaaaataattcaaatattaacagagctatgatggggagatttaggaagttggttgaggacttgagtctcaatgaggttccactttttgggcgcaaatacacgtggtcaaatcagcaagaca

SEQ ID NO: 11143 - DNA, 1581 bp, Zea mays
gggcgattgggttccccgccgcgggccggcctcctatccaccaccaccagtgcctccaccgaatcttcaacaggcaaagccaatcaataatcaccagccacatccacatcaatccattccctttcctctcccgctccacttccatgggcaaggttcggtccttcttctcccgctcccgcagcggcaagcgcggcagcgcccggagggcaggctcgtcctcgccgcactcctccgcggcgagcgcgccgccgtccccgtccccactcccactcccgaggaggtcgccgtcgtcgtcgtcgtcgaccagggacgagacggagcgcgtgttccgcaagttcgacgcgaacggcgacgggcagatctcgcggtccgagctggcggcgctgttcgagggcgtgggccacgccgtgaccgacgacgaggtgtcgcgcatgatggaggaggcggacgcggacggcgacggctgcatcagcctgcccgagttcgccgcgctcatggagtccgcgtccgccgacgccgccgccgtggaggaggacctgcgccacgccttcatggtcttcgacgccgacggcaacggcctcatcacgcccgccgagctcgcgcgcgtcctgcgcggcctcggggagtccgccaccgtcgcccagtgccgccgcatgatccagggcgtcgaccgcaacggcgacggcctcgtctccttcgacgagttcaagctcatgatggccgcgggcggcggcggcggattcggcaggatcggtgcctaggaacaaggatcctgtgcctgtcctgctctgcctctgctttgctccgctcccacaaattggatttctttcattttatgtatgtacatatactacactggaatcacacggacagcgccacgtaaaaaagacccctttttcatttggtttatgtgtactatacaatgcaaatctgcatccattgtactgctatggatgttcaatggaattgtttcggctttcatcaattgcagtctgctagtagttcggagtttgcgtctcattgttatttggggttctcttaatttggcacaagtgcgttcataccacaaacacaaggggctgacaacgatgctgatcgttggtagctaaaactcaggcaaaccaagtttttttttttgtctctgtttggtttcttgccgaaatttgctaatacctcgtatttagcttgttagtaaatattttttgtcaaaaatttggttgctaaatctttgatttggaagtcaacctagcaggcccaacattcccatgtgtgttggatttgggaagcctaacgctaagatagatttctagtctgaccagcacaagcgccctaccaaacagccttgaaagacagtcttctccttgcctcctttttttatactcggttcagttcagacgaccaaaaatataatccatatagacaaaaaagcttggattaaaacatcgtagaaatagtagaagccggctgttttagtagaagccggctgtttagattgttataactgcagtttataggtacaaaaacattgtataagtagttaaagctggtatgaattaaagccaagcgaacatgattatagcg

SEQ ID NO: 11144 - DNA, 970 bp, Zea mays
gcggctcgggccctcgacccagggccccctccctcctcatcaaccagcagcacctccatcgaatcttgtaggcaaagccaataatcaatcaccagcgacatcaattccttgcccggccgcgcgtcgaggaaccgcgccgcacagttccagttccatgggcaaggtgcgctccttcttctgccgcgcccgcagcggcaagcgcggcggctcccggccaggctcgtcgtcctcgtctctctcgtccccgtgcccgtccgcgaggagggcgtcgccgccggccggggacgagacggagcgcgtcttccgcaagttcgacgcgaacggcgacggccagatctcgcggtccgagctggcggcgctgttcgagagcgtgggccacgcggccaccgacgacgaggtgtcgcgcatgatggaggaggccgacgcggacggcgacggctacatcagcctgcccgagttcgcggcgctcatggactcggcgtccggcgacgccgacgccgtcgaggaggacctgcgccacgccttctcggtcttcgacgccgacggcaacggcctcatcacgcccgccgagctcgcgcgcgtcctgcgcggcctcggcgagtccgcctccgtcgcccagtgccgccgcatgatccagggcgtcgaccgcaacggcgacggactcgtgtccttcgacgagttcaagctcatgatggccggcggattcggcaggatcggtgcctaggaacaaggattctgccctgctccgctccccacaaaaaaattggattcatttcattctatgtacatatatgccctatagatcacactggaatcacggagatgtttcctaggtccagattatttgcacgcccagcggcagcacataaaaagcccccattttatttgctagtttggatgttcaaacggattgttttggcttcatcaattgcaatattgagtttgcgccggttccgtggttgcaaagtga

SEQ ID NO: 11145 - DNA, 778 bp, Zea mays
gaccgagctaggagaagcgcgaacgccgtgcatgcgcagacgttgaggtcgagggacacggtatctctgagcttcatcggagagcgacccgccaccgccacgcttggccgcaagccgagaagagtgccgggccgggagaccggacgattattgatccgtagcagattcgctaatggcggagacggcggacatggagcggatcttcaagcggttcgacaccaacggcgacggtaagatctcgctgtcggagctgacggaggcgctacggacgctggggtccacctctgccgacgaggtgcagcgcatgatggccgagatcgacaccgacggcgacggctgcatcgacttcaacgagttcatcaccttctgcaacgccaacccggggctcatgaaggacgtcgcaaaggtcttctgatccattacatcttcgtccaacctgcttatatatacacacacacgtaccattcagctccaacatatgatttcgatcggcttgcctgcctcgccgggcttaatgctgtccttcgccttcctataagcactaagctactattaggattttgttttatttaacttttttttgtctccaatctaatatatgtggacttccttttttattcattttttacctattttggttcgatcggataagtatttctatgtaattaattaattcattggagataagcgatccatctccttgtaattcgtaaacgaagtactgtatttcaaggggaatggtgtgcttatttttacaatcacaaaaaaaaaaaaaaaa

SEQ ID NO: 11146 - DNA, 821 bp, Zea mays
cactccttagggcgattgggttcctccaggccggccggggaccgagctaggagaagcgcgaacgcgtgcatgcgcagacgttgaggtcgagggacacggtatctctgagcttcatcggagagcgacccgccaccgccacgcttggccgcaagccgagaagagtgccgggccgggagaccggacgataattgatccgtagcagattcgctaatggcggagacggcggacatggagcggatcttcaagcggttcgacaccaacggcgacggtaagatctcgctgtcggagctgacggaggcgctacggacgctggggtccacctctgccgacgaggtgcagcgcatgatggccgagatcgacaccgacggcgacggctgcatcgacttcaacgagttcatcaccttctgcaacgccaacccggggctcatgaaggacgtcgcaaaggtcttctgatccattacatcttcgtccatacgatacaatcgatgatgaacctgcttatatacacacacatgtaccattcagctccaacatatgatttcgatcagcttgcctgcctcgcctggcttaatgctgtccttcgccttcctataagcactaagctattattaggattttgttttatttaacttttttttgtctccaatctaatatatgtggacgttcttttttattcattttccccctattttggttcgatcggataagtatttctatgtaattaattcattcattggagataagcgatccatctccttataattcgtaaacgaagtactgtatttcaagggaaaacgtgtgcttatttttctactcgattc

SEQ ID NO: 11147 - DNA, 2130 bp, Zea mays
  misc_feature (1192)..(1192): n is a, c, g, or t
gtttctatatgtttaattggtctatgcgaatataactatgagttaaatttgattaatatgtgtgtaaattgtaacttgtgaattgataagtgatgagttgtgttaatttgatgttacattgatgtggtctgtgaaactattagtataattattatttatattattaaattagtttgaaattaactagaaattgattattatatacatattgtttttttctgatctagatcgcgagctaaacgagtcagctcgagctcgtaaacgagtcaagctagccgagatgactctataactcattagcttaacgaagagtcgagccagcttattaacttaacgagccagctcgaactcggatgagccgagacgagttggcttgatatccggccttacttctaatcaactggccctcaaagctaattgatgtttgttcgactgagtgtataggtgtacatttagggcagatctgatagactggcccgaagcatagaaaaaaacacggcccagacacaacacgacccgaaataatttagtgtcgggccagcctggtccgatatattaggccgaggtcgcggcacatgtgcggggacaatcacggttcatttaaggtagacacaaaatgactcatatagagacaaaaaaagctcatatatattcattaaaatcgcacttcattacacactttcatgtactcgataaagaacacaaagttagagatgatgttagttagatgtttttttagctttgaattaaagtatgtgatgaaattttacttttttacaaacattagacgataaactgaacttatgaactctgtatgaatctggtatattctttttgcttctaacaaaaggatttttaacaagatagtcatcgcatagctctaataacttaatcgaaatattaaattttcttttagtcatatttatttgtcttatattttatttttttattaaatctattttaaattttaggctatgatgtgaacgttagaccagaaataaattttgggatttttataaaatttaggtcgtctaaaataaacctgacacatttaagtaaattatgtgctagaccatggacgattctttgggggtgtgggtgggggtgcagtgcagctggtgcatggcgacgaatggcagagaggcgacccaagtatttctcgccagcatgtcctctcctccatacctccacntatgcagcgcaggcagcagccgtccggtacagctaactaaattggggacctcgttgctatatatatgtctccatagggcgcccgcggcgacatgcatagaagagcacgaccgagctaggagaagcacgaacgcgtgcacgcgctgacgccgacgtcaaggtgtacggtaactcggagcgtcatcggagagagagacccgccaccgccacgcttgaccgtaatccgtggagagtgagtgcccggccgggctaccagctaagacacgacggtccatccagccatcggtggcccagcagattccacaatggcggcaacggcggacatggagcggatcttcaagcggttcgacaccaacggggacggcaagatctcgctgtcggagctgacggaggctctgcggactctggggtccacctccgccgacgaggtgcagcgcatgatggccgagatcgacaccgacggcgacggctgcatcgacttcaacgagttcatcaccttcagtaacgccaacccggggctcatgaaggacgtcgcaaaggtcttctgaaacatcacatcatcatcaataggataccatcgatgatcatgcccccaacgtgtcatttcatctggcctgcctcgccggtcttattgctgtcgttcacctccttataagtactactagtaggattttgttttgttttattttatattttcatggtcaccaatcaaatatatatgtggacttccatttatttattttttctgtgtttcctcgatcggataagtgtatacctgccagtccagctttaatttccatgtatttaatttttactggagatcgagaagcgattcgtatcctccaggcggaaccagatacagtgcggccatggaaaacaagtgcgtcttattttgtgtaaaatattagaggcgctataagacagctacctgaatttgag

SEQ ID NO: 11148 - DNA, 2121 bp, Zea mays
gcaccgaaccgaaggtgggccagtggaccgggcccaagactcactcaacccgctcgtcacgtcacgtcacgtcttcgcacggagaggctagcaacagcgagcaagacggccgccgagtcttccctaattccagattggaaaatgcccaaatgttactgcacgatcagttaatatctaatgacgatggtaaataaggttgtgatgacgtgtctcgctctcgagggattggagatcgatcttttttttacttctctaattccagatcggattcttgttggattgttattagatgtgtcatgtgtggccagtgtgggttgtaccgcggcgcctgtcgctagcttgcagcgattaggttcccgtccgtgccttcacatcagttcgtttccggcgtgccgtgcggcgacaccatgattgcgcaaggggggtgggggcactgctaaaattttggacaagctccatcggctgtactgtactccacggtttattattagggtttttttttcttcttgaacaaaagatcctccctctaatttcttcacgtggacgaaaggtcctgttggttcatgtgggtctaggcagcatttctcgtgttctctttgaaattgaattttagacttttttctgtcttataccaaagcatcataggtctaaaatccggtcctgtttgcgatcattctcgtgtaagctacggtgttgccgtgtatacgcgagaaagaggttcgattttttttatttcttcgcgtgagctatttatatatagagggagcgacagaaaacgataagaaacagaaaaaaaaaggaacgccccgacgatcgagcaaagggaatccgtcggcgtccggtcactgtgccggagtaaaccctgaatgctcacgtctactgtgtgtgtggagccgcgcgcagcgcagcctttgagttgtggcttgtacagtacgtctgaaatcagctgaagcataggtgccattaattaatttttcttttttttttttggcaagcatctcctcgcagtcatcacaccaatgcaatttcaattcaagtattcaaatcgtatgtacatggaggaatgaactcgaagggatggaagtatgtggcacgtgtaccaccaccaccaccacgtacgatggcatcaaggagaagtcacggaccgagagatggctggctggctgcaggcattaccagggagacgacagacgagacgtcgtcgtcgccatttgtgcattgcgtgccgacctgagagagatcgatcgacgacgagccgagccggccgggccggggagaacggaacgatgctcgcgcgtccgtccccgcccgccctccgtccgtcatcgcaggttgtgcagcgggttggaccccgtgggcgccagccgcttgtcgtcctcgaaccagtcgccggcggcggcctgccggagccgcctcctcgcgccgtcgtcggatgagctggcggcgctcccgctcccggcccgccgccggtgcctcgcgtggcgatacggccggtcgcggtcgcgcgccggccagaccgagacggcggcggccgcggctctctcgtgcgggtcggtcgtccaggactggcgagacgacgacgacggcgacgccagtgccggcacgccgagcagcagcgaggccgccctcagcgccagcgggacgagcgacagcagcagcgcgagcctcagccacctgccggcgctcatatctagactagacggaggacggggaggaggagatcggtcttggtgcctggccacgagcgtggacgacggcgcgggccggccggccgggtgacagctgacgcgacgcgacgcgaggcgaggcggtatagataacggtagcacttagcacaggcaggcctggctacgactctgctgcgactgcgagtgaagtgagagaggggaattgaggggcgcgaggcaaccgggcaaaaagcatgcaggagtggactacttgggcttctgtgcggctctgcctctctctctctctccccgaagaagaatggcgtggcgtttggccgcttggcgtgtggtggtggtggcgctgtaataatcggcaatgatgcgacgggacgacgcgagcagcgcaacgggaacaaggcgacgacgagagcgggggtgtgggggtgggggtggg

SEQ ID NO: 11149 - DNA, 3575 bp, Zea mays
gcttatatacgctggggagtatgaccttatatgcaattggctgggtaagcatacaatgacctgatatgctggggagtatgatcttatatgcatcaccagatccttcaatggttttgcagttaagataccgagtatacaattctgaatttgtttgtgtgtttgggcaggaaactcgagatgggtgcactcgatggaatggtctggccagaaagacttcgtatcctcctgtgactcaccgtttgtagtagacggtgcagaagctggagtcttgaagagccatggaccactgagcttcctcaaggttgccatccagcacttctttcactttaccctgtttccttcctaagttcttcccccccccccccccccccaaactaaagctgatgtttcatgctggcaaaattaagactggttccgctaaaccgtaggcgtacttgacaaaatgtgacaagacaacctagtaaatctgttcatcgctgcatgctcatgagaacctggctggctgtctagtgctttagaacccttccgtgcctcatcaacagcaagtgtacgtgtatgcgaagactagaacaaaactcacgtgagtttcctccatactgtgcaaatgcaggtccacaatgcggggcacatggttccgatggaccagccgaaagctgccctggagatgctgaggagattcacgcaagggaaactgaagcaggaaccgctccctgagacgatggccttgaaggcggcgatgtgactggcgtggacgtcgtgaagggaagaagggagtctcttaattactaggtggtccgaggtgtcgttcaagcgagcgtgtgtcgatcactgagctgctgaagcttgttgtttccattggctcatggatggatgctgttgataagaagttcaatgctggaaaccctgtctgtctgctgctcttgtaaagcatctcatgtatacaccccctggatccagaaagagaaataatatgtttttttccttagccaaagaagaaaaaaaaaaaaaaaaaaaaaaaaaaaaaatagtgtctgaattactgttggcgatttgctgtctgactgatccgcatgctcgctcactggctggagctcacatgcattgctggctagttttgagctggatatgtacactgctgaaaagtaaactaagttgagacttcttcggatggccacagatctctccctctctctcttattcaccacgaaaatgtttacatttagttctcatgactaaagtttagttcgtgtcatattaaatatttgaatatcataataatgaaatataactttaattatttaaagtagtatataattgttagaatggatgtaactaattcaacacaaaaagcttaacttattgacagaaggtcttttaatatgattcgaactcgagaacttcgtgtttgatactatgttagagtaagtctaatcgaaaagcttaagttgttggtataaaatagactttcctctttttcattccagcagtaatgacttttattaacgatgtaatgtcatgcacaaatatctttggtccaaaggaagagcactagccaatggccaccgcgctccaccatccaagatggccaagagtagagcagagagggaaagaaagaaggaaaataaaaggtagcatgcagctaactaaaaggaggtggagtgaactgtgaagcatatacctgtgacgagcatatccatggaagacgccgccggagcagatgcaccccagctactccgatccccgtgtctatctctctgtcctgtcgtcctccccaagatctcaccagctataaatcgagtgagtgcgaacgccggcctcactcttgatcggagcgagtagctaggcagcatgacgcatgagatgaacgggtccctgaatctctgtcagcatatatacacatacacggaggtagccgccgccgaattcgtcgtgctcccatgtccatccgattggtcgtcatcaaggctgtctagagctcaagcagcagcaggaggaggttcagtgctccgcatccatatcgtcgccgtcgtcgacgacaatgcgtcggccatgtcgggcgggcagccggagggagatgctgtggcgtcgccgccggcgccacgcgtggcgttgtcttttcctgctctggttctcgattcttccctggaacaatcggaaccgaagccggcgagcgagggcggcgtctgatcgatcctccgtatgtgcagtgcagggcaagttgaatcctttggcatgtactcctatcctaacgatgaatgtacacgatcgatgatatccatttatctaactcttccatcatccaaaaaataacacgcccggccgccgtcctgtgaacagaccacagtagacatgtgaattatatgataaacttaatattttaacatagatgcacatataatttggtgctaacctttaagtatattattgaagataagaatgaattttattttttcttattttcttcctactgaaaaagcatctgcatcaaatagtatccatatccaaattttatattaattaacttaaaaagatttagaacgaatttgagattaactttttacgaatcttaataagttcaatactaataacaagaatataaatttatacaacaaattctataacttatttgttcataataaaaaagaagaaaaaactaacatccgaataagtatctagatctatcccacaacagcgtaaaattttttataatgtaatgttactggtagtctaattggacggtttccgaaaacacaatctccccttaaccagccatatgtgcctcacccgggccaaccaacgaactccctcactctctgtcttgtttagttgaagagtgggggagaatagagtggctccattctaattttctaaatgtttgatttccaacaaataagagcggagcagctcctaaatcttcatatgaaaatttaccataaatagttggaacactcccgctaaaaaaacatctatatgcgagcattttcttcctctcctttcctttacactcatacgactctccaaccaaacaaagaatggagcgctatattatactaatctctactacttattaaggctacaagggtagcctgccgttctgccgttatgtaatctcaaccatctgttttatcattatgcttttcaaccgtccgatcccaccagtcgtccgatcctgtgacccaccctcacggctgtacccaatccctaacctcccaatgctcccaactgttaacacgccgacgcctcctctttctcccccgcagtccccgaccctccgcggctccgatccgccttcgccaccccccgcttcccactcgtgctaagcccgacgacgaggacgtcgatgaggcccgcgtgaagatggccttcgcggctccaatccacctccgtgtcgccctcgcaccccgcgaaccccgcccatgccaagcccgaggaggacgaggagggtagcgacaccaaggtggaagggacaagcagcgcccgcggttgctatgaaatcgccgagcagggagatagtcgccgcggtgcgtagtccggcttgggcgcggcgacgtggagtgttgcgggtccatctgccg

SEQ ID NO: 11150 - DNA, 2098 bp, Zea mays
cggacgcgtgggcgccccacgcgagctataaaaccggaggagaagcagctgccaagttaaatccaatacccccacgaacccactctctctccccacgatggcaaaaatggcgatggcgtcctcccgcctcccggctctcctctgcctcgccgccgtcgccgtcgccgtcgcggcggaggccgccgccgccgccggagaaggcggcctccgcctgccccgcgacgccacgttcccggcggcgcaggcggagcggctcatccgcgcgctcaacctcctgcctaaggagaaggaggcggggccggccgcgggcggcggcgacgggcccagcgtggcgcccggggagctcctagagcgtcgcgtccggctgcccggcgcgcccgccggcgtcggggacctcggccaccacgccggatacttccgcctgccgcacacgcacgacgccagaatgttctacttcttcttcgaatcgaggggcaagaagaaggaggacgaccccgtcgtgatctggctcaccggagggcccggctgcagcagcgagctggccgtcttctacgagaatgggcccttcaccattgccaacaacatgtcgcttgtctggaacaaattcggttgggacacgatctcaaatatcatatttgttgatcagccaaccggaactggctttagctacagctctgatgatcgtgatactcgtcatgatgagattggtgtcagcaatgacctatatgactttctccaggtgttctttaagaagcacccagaatttgcaaagaatgacttctttataactggagaatcttatgctgggcactacattccagcatttgcaagcagagttcaccaaggaaacaaagcaaacgagggcattcatataaacttgaagggatttgctatcggcaacggtctcactgatccagaaatccaatacaaagcctacacagactatgcgctggaaatgaatcttatcacaaaatccgactacgaaaggatcaataggttcattccaccatgtgaatttgcaattaagatgtgtggtactgacgggaaagcatcatgcatggcagcttatatggtctgcaacaacatttttaactccatcatgaagcttgtcgggacaaagaactactatgacgtgaggaaggaatgcgaggggaagctttgctatgacttctcaaacctggagaggttcttcggtgacaaagcggtcaaggaggcgcttggagtcggtgacatcgatttcgtctcttgcagcactacggtttatgaagcgatgctcacggactggatgaggaatctggaagtcggcatcccggcgctgcttgaggatgggattaacgtgcttatatacgctggggagtatgaccttatatgcaattggctgggaaactcgagatgggtgcactcgatggaatggtctggccagaaagacttcgtatcctcctgtgactcaccgtttgtagtagacggtgcagaagctggagtcttgaagagccatggaccactgagcttcctcaaggtccacaatgcggggcacatggttccgatggaccagccgaaagctgccctggagatgctgaggagattcacgcaagggaaactgaagcaggaaccgctccctgagacgatggccttgaaggcggcgatgtgactggcgtggacgtcgtgaagggaagaagggagtctcttaattactaggtggtccgaggtgtcgttcaagcgagcgtgtgtcgatcactgagctgctgaagcttgttgtttccattggctcatggatggatgctgttgataagaagttcaatgctggaaaccctgtctgtctgctgctcttgtaaagcatctcatgtatacaccccctggatccagaaagagaaataatatgtttttttccttagcaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaaaaaaaaaaaaaaaaaaagggggggcgcccttttaaaagaatcaaattttactcccccgggtttggcaaggtaaaattttttttttggggcccccaaatta

SEQ ID NO: 11151 - DNA, 1780 bp, Zea mays
  misc_feature (1628)..(1628): n is a, c, g, or t
cggacgcgtgggcggacgcgtgggcgacgctggccgccccgacgacgaccccgcctggttctgcctacgagtcggttgcgaccagagccatgagcaggtcgaccctgaggccctggacaggagcttctttatgcgggtcatggcggcgagaagccccaacgtgaggctacagaaggctatcagcaagaagaaccagagctcgatgctgaaatgcccgcactctgcgccgccgaagcaaccgagagctcggttcgcgaggctgagcgcagagactgagactgcggggaaggcaccggcggagcccaagccaagggtcgagcggatctgcgccatgcaagcgtccccaattcgcaccaagacagccagggtcgaatgtcccagcgagaggaagaaggcactgaccacgccgcggagcaaggccgtccggccgaggcaggagctgtttcacagtgtgaagcaccagaaggagccgttggccgctgcagccaggaaagggacggtcgtcaagtctctgttcatgagcacgacgccaaaaaaggagccggtccagacgccggcggcggacaagagcaagggggcggtatccaaggtctgttcgaagctgaggaagctgaacttggcgtgccgggaggtgccgagcaggtacatgtctcagcctcagccgaagattatgaagacggccaagaaggctgaagagaccacggtggccaagagcgagaagcgggggctggaatccaggaccaatgctaagaagaaaattttaggacgctcagtgaagcgtgctaatgctggacctgacggagagaaccgaaatggttgcagcactgctgcagacgagaactcgcttgcagaaactgctggctcccatcaggaaaggaaggtggtgctgcaggaattgagaatcgaggtggatgcatcgcgatatggcaattcagatgacaacaaggagaatgtgtccagtgctccgagtgaagaagcattggacaattcacattatggaagtgaaaacagactgttggagaacaatgagaatattcctctgaaggagaatgttgctctgaaggtggccaaattgcagaagaaagtgcatcaagagcaggcaggaaagctcaagaaaaccaccaatcctaggccattcaggctaaggactgatgaaagaggagtgcttaaagaagcaaaaccagagaaaaggcagccgttcgctgagaataactccatggcagtactcaaggacgcaaacagagaagtgacgcaaatggacaaacacacccatggcaagggacgagacaagccgccgacctgcggcaagaaacagaagaaacaaagcgcccagattgctgtaacggctcagcagctcggtgagcccaccaggccggccttcaacaacggcatccagcgcaaagctgtggaaccggagagagtttgtagggctgcatcgtcaacacgaacaaccaaaccagcaagaggccttccggcaccaccaccttcccggactgggaaggagatgaaggctcccgtgaagctgtcgagggtccaaacagcagccgcttgagctcgtgcagacccagggaggaaactgttgttttgtcgtctgtctgctccaacgacgagttctgtatttacggcgntcgaattcgttttctggatttcgttgacttgtgtacactgattctttctgcgaatcgtgtggtggaattcctctcctctgttaccggtaccaacacctaccaacaggattctttctgtaatatgttttggaatttaatcctttatgtaactt

SEQ ID NO: 11152 - DNA, 1526 bp, Zea mays
tcgtagtctgccctaacacttacattgtcatcagtcatcgcggcctcagctatctgaatcactcgtcccgctcggtacgtatagtagtagcatgggctgctgtggcgccgccatgtccgccaggccgcggggcatccacgaggagacgctgctgcgcgtcccgggcgcgtccgtgcacctcctggccggctcatccgacggcccggtcgagctcgcgcgcggggacctcgccgtcgtcaggctgaccaaggacgacgtggccttggccaccgcggtgcgcgtcggcagggacctgggctggccgctggcgcgggacgagcccgtcgtcaggctcgaccctctgcactacctcttcacgctgccggcggacaaggacgggacgttcctcaactacggcgtctccttcaacgccggcgccggcgccgacgcctccgcgctggcgtcgctcgacggcttgcttcgctccaacgcctgcttctccgcgccttcctccggggcggtggtcccgccgtccaagggctccagccgggcgcggccgcagccggggccggttgttgcgtcgggggacgggtactggaacgagttcgcgccgagggtggaaggctacaacggcgtgctggccaaggccatcgccgcgggcaccggccagctcgtgaagggcatcttcatgtgcagcgaggcctacgccagccaggtgcttctgtttctgtacgctgcccagtgcccctcccgtgctctgtggcaagtgacaagtccatccagtggagaatagctttgctgtgcgtcatgtctcacgtcccggaccattgttggttgcttgcaggttcagagaggagccgatctgtttcgcccacaggctgccggcagcgcacggagcagattcggcgacgccgctggtggcgccgacaggaacaccaagcctggagcagtcaacaagagtctcaagagggtcaggaagctgtcggagatgaccgagaagatgagccagtcgctgctcaacacggtcatctcggtgaccgggtccatggcggcgccgctgatccgctccaagcaagggagagcatttctcgccaccgtgcccggcgaggtcatcctggcatctcttgacgccatcaacaaagtaatggatgcggtagaggccgccgagaagaagtcgctcgctgcaacttcgaatgtcgtcgctggtgcagtgtccaggaggtacggcgagaacgcaggagaggcaacccaagaggcgttcgcgacggccggccacgccgtggggacggcgtggaacctcttcaagatccggaaggccgtcacgccgtcgtcctccatgcccgggaacatggtcaagagcgccatcaagaacaggaactgacgtcggcaccagacagtttgttcattgtgcccctcttcatgatcatatacccagaatgatcagacagttatgcaaaaaaaaaaaaaaaatctggatgataatgtacccataatggcgtgtaactatcgtgtgtgcaccatcgacattaacaaatacttgttccaac

SEQ ID NO: 11153 - DNA, 1382 bp, Zea mays
atctgaatcactcgtcccgctcggtacgtatagtagtagcatgggctgctgtggcgccgccatgtccgccaggccgcggggcatccacgaggagacgctgctgcgcgtcccgggcgcgtccgtgcacctcctggccggctcatccgacggcccggtcgagctcgcgcgcggggacctcgccgtcgtcaggctgaccaaggacgacgtggccttggccaccgcggtgcgcgtcggcagggacctgggctggccgctggcgcgggacgagcccgtcgtcaggctcgaccctctgcactacctcttcacgctgccggcggacaaggacgggacgttcctcaactacggcgtctccttcaacgccggcgccggcgccgacgcctccgcgctggcgtcgctcgacggcttgcttcgctccaacgcctgcttctccacgccttcctccggggcggtggtcccgccgtccaagggctccaggacgcggccgcagccggggccggttgctgcgtcgggggacgggtactggaacgagttcgcgccgagggtggaaggctacaacggcgtgcttgccaaggccatcgccgcgggcaccggccagctcgtgaagggcatcttcatgtgcagcgaggcctacgccagccaggttcagagaggagccgatctgtttcgcgcacaggctgccggcagcgcacggagcagattcggcgacgccgctggtggcgccgacaggaacaccaagcctggagcagtcaacaagagtctcaagagggtcaggaagctgtcggagatgaccgagaagatgagccagtcgctgctcaacacggtcatctcggtgaccgggtccatggcggcgccgctgatccgctccaagcaagggagagcatttctcgccaccgtgcccggcgaggtcatcctggcatctcttgacgccatcaacaaagtaatggatgcggtagaggccgccgagaagaagtcgctcgctgcaacttcgaatgtcgtcgctggtgcagtgtccaggaggtacggcgagaacgcaggagaggcaacccaagaggcgttcgcgacggccggccacgccgtggggacggcgtggaacctcttcaagatccggaaggccgtcacgccgtcgtcctccatgcccgggaacatggtcaagagcgccatcaagaacaggaactgacgtcggcaccagacagtttgttcattgtgcccctcttcatgatcatatacccagaatgatcagacagttatgcaatgcgctcctcttactctggatgataatgtacccataatggcgtgtaactatcgtgtgtgcaccatcgacattaacaaatacttgttccaacggcggccgctcgcgatctagaacctagcggacgcgtggg

SEQ ID NO: 11154 - DNA, 473 bp, Zea mays
ccaccccgccgcccgcgcggatcgtgtctgaccatgtcgtccagcaagcaggttgcggtggccaccgtcgctctagcgctgctcctccacgcttcacatcttgcagccggagccgaaggagaaacggtgacaccgttgagcacatgcgaaaccccgatctgcgtcccctgctggggcaagaaccaggtctgcatcgccgcttgcgttgcgttgcgctacaccggcggtttctgcaatggtgacacctgcgtatgcaccaagcagtgccttgcggaagcggaagcggaggcggaggctggtgggccgtccccgccgcccgtgcagccgccgccgctcgggaagcgtgggatgggaatgctcaagtgatggacgattacgtagcttgttggccgacagatggctgaggcatatgtcaaataaactctcattgttaaaacataatatattctactaggtaaaaaaaaaaaaaaaaa

SEQ ID NO: 11155 - DNA, 1034 bp, Zea mays
gttcactctattcccccgagcccggccgccccgcgctctatttgcactcctcccgtcccgccgccgccgcgccgtaccgccggcctctccaccgttcattctccaatggcgtcgactcacgcaatcagcaagaagcggaagttcgtggcggatggcgtgttcttcgcggagctgaatgagatgctgacccgcgagctcgcggaggatggctactccggcgtcgaggtccgcgtcacccccatgcgcaccgagatcatcatccgtgccacccgcactcagaacgttctcggcgagaagggccggaggatcagggagctgacttctgtggttcagaagcgcttcaacttcccggagggtggtgttgagctctacgcagagaaggtgaacaaccgtggcctctgcgccattgcccaggccgagtcgctccgctacaagcttcttggtggactagccgtgagaagggcatgttatggtgttctcaggtttgtcatggagagtggtgctaagggctgtgaggttattgtaagtggcaagctcagggctcagcgagctaagtctatgaagttcaaggatgggtacatgatttcttctggtcatcctgtcaacctatacattgattcagctgtgagacatgttctattgagacagggtgtgcttggtatcaaggttaagattatgctggactgggatccaaagggcaagcaagggccaaccatgcctttacctgatttggttacaattcacgtgcctaaggaagaggatgagttcttgaggcctcttgcagctgaaatccaagttgcctgaagtaaaaaagttccagtgaggcctacgcctatggttgtggtcctcctttttttgtgtaatgttcattattaacatgttgaaagtaaaaagagctttactttctatagttgcaagcagtggtaatcaatgtattctttctgcttctcactttaaaaaaaaatgtttataacttgctgctctgtattatcctgttattcacttgacttgcctggtagttacagtttatactt

SEQ ID NO: 11156 - DNA, 4476 bp, Zea mays
taatatttaatataataaaatagttataaataatatattaaatcatttaaatactaacatctattaataattacccctgagctttttgctttcctgctttctcttttttccatgtactcagcttcgcttttattctatatttcaagtctcacatttaagggatttagccgaacgacaaaacctgcaaacttggacccagatcacatggccagaatacacccacttccagttttacacgacacaaggttcaactcaacacatgaacaatgttgcaaatttacttcaatatattgacccccgtgtaacatctatattacacaccaacaccatcataccaatactccctccgtttcttgttgtttcaacaggattgcacccgccttcacctatgtctatctatgtggcactccatccgcaggacgagacaatttacgaacaaccgagcattcgtcaccgggccttctcggattccgaattcgcgggctgcgcaacaagggtgcgccagaggtaacgcccgcttgccatgtccaccatcgtccagaaccctgctttcacagccgatccaacctaggatttgtgcacaagaacaaaccttcagattctgaagtaactgttattcaagaaacctttgaaatttgcacgcaggggagacaagagacaatggaccgatgatccaatattaaaatcaagtaagcagcgcaacaagtgaccattgattgtgcaccgtgcaccagtatatctaactcgactcatgtttctacgcagcgggttttccaaatacattcagacgctagatccaaaagctctgtgcacgtaatatagaatggtggtcagtacctctgtgcacgtaatggggagtgggctgcgttggctggcgagccgcagattcgccattgctcaaatcagttgttacatcgagcaaatttaagcgtggtaattaggcaatactgcgcagaaaataaggacgaggctaccttatcatctatggaattgtctttgtgcagtgagaagtgataactcaagtgtcaggcagcgcccggaacccggctggcgccgccgggcctaccttggaatgcaggggcaggggcgccctgggggatcccgactcgtcggcgtcggcgtcggcgtcgaactggtccggctcggcgttgagccccctgacgaggaagaagcccgcgacggtggcggagaggaagatgaggatgacccgcagcgggcacatctcttgctgacttctccgggcccggggtccctcccccgaccgaggaatcgagcaatcgaccaatatggcgtggacggagggcaagcggttcagaaaagtcggcacctttgccttttattgcttgctccgagctgggggcggggggctctgggcgtctggtgatggggagaataggaagctatggtggattgcgggagtcgcctgcgttggtggtggggatttcttttgaccttctcggcttctcccgaggcggagcacgcaggcgctgagacgcccagcccacctaacgtctccctcccctccaataaactaatttgatgaatcgagcagaaaccgaaagggagggagaagggaaaaagaaacaagctacgaaatggcgaggcgaggggcggagcggaggtggacgagcagctcgatcaatccagggagggagggagggtttgcggtgtggaatcgcgtcgtccgcgaagaggagggatccgcggaggaagacgccgccgcctgcgctgcgcgttcccccgtatctattccccggccggctcgagaaaagctggcagaggctggcggggcccgaatgccagaagtggcagaggccacgtcaaaacacgctgggttgacggattccgtctatggggcccactgtcacatctagactgttatgttgcctctccgacagatcctctattcagtaaatgtttcaaatttcacaccgtaaacagtatcaaataatattatctatagttctgcgttatctattttactctatctacaggagacaatcttaaatcatatttaaatacagtaaagctaatagttagctgctaatattagctagatatgtttaaacaactcaactaatagtttaactattatattctcttagctcgaggcaactggatgtcgtcaactaatagtccaactaactattagttacactcttaagttactacacctttaaagtgggactttcatggtgcgtcatcccctctctccacgctcgcatccctgcacacgccaaaagcgaacagggtgctcgcctctaaccacggtatctcatattggtttgtgtttatataaaagatagacattataaatatatatgaactaataatttgaaaataaaaaataaaatcgtgtcgggtcggaccgtggcactattaaatgggtcgagtctcagatcggcttgctaggcatagcccagttcctgcttcctcaccgtccataatctcacgagcttgaaaaaaaggagagagaaaacttcgatgttgacatacttaagaacgtcagttcccttagaccggcgtaaacttaagtatggcgattgtgtgggtggaccgaagtacttacctataccactatacaatcaactagtttcaactttgcaaaacgcacccaatccaatcacccacacacccataacctttactaaatccaccaacaaattgcacccaggcttaacacaccatcaaaatcaatggtttagatcgttagataaccctctctcccttactcgtcaaatccaacagacaatattatttggatcgtccatccccctctctcgtgtctcggtcgcccccttcccctcactcgcactgttgtcgttgttgatccctcccctctatagaatcgtagagttagcacggagctatacgctagtctaacttaagtacatcggctgatcgatggaccaacatacttaaggttaagtacgtcaaagtaaatacgttggctaagtacgtcagtcgatccccccacgttcttaatgtaagtatatcggtctattagagtaagaatggtagttcctagtccacgttctttaatcattttcctgtagtgttgggtcgtgtttgaataactatataatttaagcaatatctacctatataatatatagaaatcttattaaggcatggataactaatagttagtcggctacaagttagctaggtaattccaacggtaactttttagctaacttagtgcgtttaaacatatccttaagaatcaatggacgttgcgttgtcaccaactttttatggacgggaataaaaatgttaaacactctgtgtgctccctactgctagttatatatggtacggcatgcattaattctcaccaactgtttatggacgttgcgttcgtatcgtacgtgtatgatcggatagatatgcccgacggcacagcagttgggtttgtttggttgggtagcagagcacatggagtcgccgccgctggatgagatgaagtggcacaacacgccacgcacgctgtgctcgtgcatgattggtcgtttgtgctctccatgtctactaactaaccaccggtcgttgacaactgatccattgcatatacatgctacgcccatacttaagtttgctaatatggcgttggctttgttagcagaaacggtaggaaaaataaagtagattaaccaaacaaatcacagagcgcgacatataagtttacgtgaaaaactcttcattacgaaagtaaaaaaccacgggcaccagaggcgaaacatttgtgtctataattttttggttcgtctgtgtctataatttatagattcaatagcatactaacgaagcattgcaaatccctccccgcggccgtggtggagacgtgtgagtggccgcagcaggataacatgaacagccggcccaccggcggagggcgacggcgatggagctgcacttgacaccacgctccactctgccttaacgcaatgctccaggctccagtggatgcattccactctggttctgggaatagtactctagtttagtttcacttcaaagcaggtcagtcagcaaaatctgctgcgcgaaagtcgccaagcacgagcatgacatggatggatggataggccctcctctcgtcacatactactcaaccaatggcaatggatgggcttccagataaatattaacacatatataaaactaaccagtgcacgttttcactagggcacaaacaaaacaagttgggcaggctgtgtggtcgctagtgcccagccagtggagactgacggctgaaccacttgcaggttaaacatgcatggccgccgcacccaccaaagacgatcaccaccaccgttgagacaatgtgtccaacatttcctctgcacttaggtgccgttcggttgtttgggattggtgggtcagaacgatttctaaccggattgtttctctaatttatataaattttgattagatagaacaattctaagtgcaatccggcacaaacgaacgacg

SEQ ID NO: 11157 - DNA, 1187 bp, Zea mays
  misc_feature (1171)..(1171): n is a, c, g, or t
gtctcacatttaagggatttaaccgaacgacaaaaactgccaaacttggacccagatcacatggccaaaatacacccacttccagttttacacgacacaaggttcaactcaacacttttttttttttttttcgttgcaaatttacttcaatatattgacccccgtgtaacatctgccgccatattacacaccaacaccatcataccaatatgtaacaagaagatacaacaggattgcaccagccttcacctatgtctatctatgtggcactccatccgcaggacgagacaatttacgaacaaccgagcattcgtcaccgggccttctcggattccgaattcgcaggctgtgcaacaagggtgcgccagaggtaacgcccgcttgccatgtccaccatcgtccagaaccctgctttcacagccgatccaaccttggaatgcaggggcaggggcgccctgggggatcccgactcgtcggcgtcggcgtcggcgtcgaactggtccggctcggcgttgagccccctgacgaggaaaaagcccgcgacggtggcggagaggaagatgaggatgacccgcagcgggcacatctcttgctgacttctccgggcccggggtccctcccccgaccgaggaatcgagcaatcgaccaatatggcgtggacggagggcaagcggttcagaaaagtcggcacctttgccttttattgcttgctccgagctgggggcggggggctctgggcgtctggcgacggggagaataggaagctatggtggattgcgggagtcgcctgcgttggtggtggggatttcttttgaccttctcggcttctcccgaggcggagcacgcaggcgctgagacgcccagcccacctaacgtctccctcccctccaataaactaatttgatgaatcgagcagaaaccgaaagggagggagaaggaaaaaagaaacaagctacgaaatggcgaggcgaggggcggagcggaggtggacgagcagctcgatcaatccagggagggagggagggtttgcggtgtggaatcgcgtcgtccgcgaggatagcaagaggaggaggagggatccgccccggaggaagacgccgccgcctgcgctgcgcgttccccttcctcttggtggtggagaaaagctggcagaggctggcggggccgctgncgcaatgtggccccgg

SEQ ID NO: 11158 - DNA, 1450 bp, Zea mays
cgaaagacttaatcgattaacattttctatgttgccttgttcttaactcatagcatttgagaacaagtccccaacagtagagtaccgtttgatcctctatatttagagtagaagacccttactgtctgtttggttggcttttctccgtagcctggctgcatgagccagaccgacgggaacctgcctgcagcgatgcgaccaatttactcgcgcctacagagtctggcctaggatactttgagtatcgtgtgagcctggctccatatctgcacgcaggcaaccaaacacacatctcacatgtgtagagcctggttaacaataaccaaacaccagctcatccttcgatgtcaactaatcacacggttagagacctggagccagccgagcgaccacgagctgaggctgaaagcagccacgctctgcggctgatgggctgcctgaacgctggagggcagtggcctttttttttgaaaacccgagcaaggcgctaggcgccagatgatttcgcagagagagagagaggtgttttttttcagggccgatgaaaaactgacatcataattaaagtagttttatgtttcaaataacttcctaaataatattgtctataatgtaagtatataattgataatggtaaagagtatgtttctataataatatttgagcgaattctaagttcttaatgtcagaaatttatccctctcgagcggggttgcgtgcgcgattccgtccttcaggttactctgaagtgggctggcccgctaaactcttcgctcggacggaaatacccgccgctacagcctactgctggacatctaagggcccacctgaaaaaacccttgcgccgctgagctgagtctccttcctttctcccgtcgcctccgcctccgccttcagtttagcctccaagcaggggcgccgcgcggggtattctgtccgtcgttgaggatagagagtcacttgcaccgggggagcggagatgaagccggttgtggggatcgtggtgtcgaacaagatgcagaagtcggtggtggttgcagtggaccgtctcttccacaacaaggtatacaaccgctacgtcaagcgcacctccaagttcatggcacacgacgatgacgactcctgcaacattggcgaccgggtctgtaattcttgctccttcgattcgtctccaccccttccccgttctgattttgtaaggctgtggaaattagcgatgctaacttctgtaagactggtgtcaattcgttattggatcctcctcctaactgggagctactgtgcgtctggagtttttggggtgtagtttaaccaatgatttcctcctaactgggagctactgtgcgtctggagtttttgggatgtagtttaaccaatgatttgaagtcgcctggtcgaacactggggcccgaccaggcgactagtcacgattaggcgacgaccagggcga

SEQ ID NO: 11159 - DNA, 2450 bp, Zea mays
taaaaaagatttaattcactttagtcctattcaatccatgtactgccgtgtacatgtccttaaaactaatcgatttgttttctcgttagagagtgggttgaaaggacaaagggtcaatatagcggtaacgcgtcatgtcagctttcgtctgaagccgccgtgcgggcgggcatatgcagagcaccagccgctcagcctgccgcgccgccgtaggaccctccagccagcctccacctgccaaccgtatattgtccacgccgacgctgtaggaaccttccgccgcctgcgcagcgcagccaacagaaacaacactttgtatgcagtaatgattgagcttaaggctaagtaagcgaagcctttgcgtccagcgtccgtataaaacgcaccacacctcaacgcaaaaacgccgtgactgtgagcacaagacccccccaccggccaccggccaccgccgcgagaagaaccgacaaccgagcatgaaggccgggcctccgcacgtggccatgctggccacaccggggatgggccacctgatcccgctggcggagctggccaagcgcctggcggcgcggcgcggggccacggccacgctcatcaccttcgcgtccgccgcgtcggccacgcagcgcgcgttcctcgcgtctctcccgccctccgtcgccgcgcgcgcgctcccgcccgtcgacctctccgacctgccccgcgacgccgccatcgagacgctgatgaccgcggagtgcgcgcgctcgctccccgcgatcgcggccgtgctcgcggagctgggcgagaccgcccgcctcgtcgcgttcgtcgtcgaccagttcgggatggagtccttcaacgccgccggcgtcagggcggcgcggtgcctcttcatgccaatgaacctccacgcgctctcgctcgtgctccacctccccgagctggccgcctccgtgcccggcgagttccgggacctggccgacccggtgcggctgcccggctgcgtgcccatcccggggcccgacatcatctcgccgctccaggaccggtccaacccgtcgtacgcggtgatggtgaacctcgccgtacgctgccgcgaagccgccgccgccatcctcgtcaactccttcgacgccgtcgagcctgaggccgccgaggcgctgcgccacccagcagagcccggctggccgcccgtgtaccctgtcggcccgctgatccttcagtccgagtccggcggcaccggcgccgatgtcgacggcacgcctccacgtgcggcgtgcctcgagtggctcgaccggcagccagccaggtcggtcgtctacgtctcgttcggctccggcggcgcgctgccgaaggagcagatgcacgagctggcgctcgggctggagcgcagcgggcagcggttcctgtgggtggtgcgcagccccagcgacgacgaaggcacgctcaacggcaactactacgacgcggagagcaagaaggacccgttcgcgtacctcccggagggcttcgtcgggaggaccaaggaggtgggtctgctggtgccctcgtgggcgccgcagacgcaggtgctggcccacggcgccaccggcgggttcctcacgcactgcgggtggaactccacgctcgagagcctggtgcacggcgtgcccatggtggcctggcccttgttcgccgagcagcggctcaacgcggtgatgctgtcggagggggcaggggctgcgatacggctgcccgagaccaaggacaaggagagcatcgcggcggtggtgagggagctggtggaaggggaagggaagggcgccatggtgcgggccaaggtggcccagctgcagaaggctgcggcagagggcctccgtgagggtggtgccgcaacgacggcacttgacgaggtgatggacaagtgggaggcggaagccaactagaaggtgcattcgcatgcatgcccgacaacacaatcctctccgccaaactctttaaatcatgagttgtcagtgtccatgttcttcaaactctttaattcgttaattatatgtatgcgtggcgtgcataaaggtccgggggcgtcgtgatgtttatttgggtcactggaatatgcctgtaaaatatgcgtcgtcgtagattactttgccggcagaataaaagtactgttcttcaccagaaaagaaaaacaatgatgacactaaaacattgcagaaataaacagtaaaaagaaaccaagggtgacgtatccacttgtacacacacatatttttttacacatgttcagtttcagctgatttctacgtggacactcttttggtcgaaatacccattttttcaaagaagccgttcggctgtttgtttgtgtctatgtgtgggggaccataattaggggtaccctcaaggctcctaattttcagctggtaacccctatcagcataaagctgcaaatgcgattaagtcagggatcagtccattcgagggac

SEQ ID NO: 11160 - DNA, 853 bp, Zea mays
gcacgagaccattacctagaacatcctaatcaaaagagtcccttccctttcccccggtccagtggcggacgccctagccgttatccaccctagagcctgagttcctttcctttcccccggtcgccgccgggcaagcgccgtccaacctgtgcgtcaccgcctccgccttcagtttcgcctccagcaggggcgccgcgtggggtattcggttcgtcgtcgaggagagagagtcacttctgccgagggagcagggatgaagccggtcgtggggatcgtggtgtcaaacaagatgcagaagtcggtggtggttgcggtggaccgcctcttccaccataagatgtacaaccgctatgtcaagcgcacctctaagttcatggcacacgacgaggctgactcctgcaacattggcgaccgggttaggctggacccttctaggcccttgagcagacataagcactgggttgttgctgaaattcttcgcagagctaaggtatatgttccaccagctgcaacagcgtccagccagtccagtgaacatgatagcaaatctcaaaaggctggtgttgctaccaaatgatccatatgcagttactcaagcaagatgcagctatggctttttttcttcttctgtatgtttgtttggaatgtggatgccatgtttagccatggaagaaaaaatagcacgcagccaccatcttcgcttaatttagtttgttctcctgtggtgtcctccctttaatggtagccatcgaggatataattaccatattcaacaagaccagtggatactatatcggcagttgtctttgtatttgcatgcatggttggcaggtgtctaaaaaaaaaaaaaaaa

SEQ ID NO: 11161 - DNA, 918 bp, Zea mays
gaaatacccgccgctacagcctactgctggacatctaagggcccacctgaaaaaacccttgcgccgctgagctgagtccccttcccttctctcgtcgcctccgcctccgccttcagtttagcctccaagcaggggcgccgcgcggggtattctgtccgtcgttgaggatagagagtcacttgcaccgggggagcggagatgaagccggttgtggggatcgtggtgtcgaacaagatgcagaagtcggtggtggttgcagtggaccgcctcttccacaacaaggtatacaaccgctacgtcaagcgcacctccaagttcatggcacacgacgatgacaacacctgcaacattggcgaccgggttaggctggatccttctaggcccttgagcagacacaagcactgggttgttgctgaaattctccgcagagctaaggtgtacgttccaccagctgcaacagcgtccagtgaacgtggtagcaaatctcaacaagctggtggtgctaccaaatgatccatctgaagttactcagaacaagatgcagtcacggcttgtttttctttcgctgtatgtttgtttccttgtggaatgtggttgccatgtttagcatgggagaaaaaatagcaagcagccagcatctttgcttaattactgttgttcttctgtggtgtccttcgtttaacggtactagccattaaggatgtagttaccagattcaacaagaccaatggattcatattgtattggttcacttccgatacccgcttgcatttgcatgtatggttggcagctgtctttgcaactcccctctgacactgaattgagcgggcggaaaacatcagagtgcataatacatgtcaaattgactggttgagtcgttattgtaaaataatgagaagtatcgaggggtccattctg

SEQ ID NO: 11162 - DNA, 974 bp, Zea mays
gcacgagaaaaacccttgcgccgctgagctgagtctccttcctttctccccttccgtcgcctccgcctccgccttcagtttagcctccaagcaggggcgccgcgcggggtattctgtccgtcgttgagggtagagagtcacttgcaccgggggagcggagatgaagccggttgtggggatcgtggtgtcgaacaagatgcagaagtcggtggtggttgcagtggaccgtctcttccacaacaaggtatacaaccgctacgtcaagcgcacctccaagttcatggcacacgacgatgacgactcctgcaacattggcgaccgggttaggctggatccttctaggcccttgagcagacacaagcactgggttgttgctgaaattctccgcagagctaaggtgtacgttccaccagctgcaacagcgtccagtgaacgtggtagcaaatctcaacaagctggtggtgctaccaaatgatccatctgaagttactcagaacaagatgcagtcacggcttgtttttctttcgctgtatgtttgtttccttgtggaatgtggttgccatgtttagcatgggagaaaaaatagcaagcagccagcatctttgcttaattactgttgttcttctgtggtgtccttcgtttaacggtactagccattaaggatgtagttaccagattcaacaagaccaatggattcatattgtattggttcacttccaaaaaaaaaaaacggcagagggcctccgtgagggtggtgccgcaacgacggcacttgacgaggtgatggacaagtgggaggcggaagccaactagaaggtgcattcgcatgcatgcccgacaacacaatcctctccgccaaactctttaaatcatgagttgtcagtgtccatgttcttcaaactctttaattcgttaattatatgtatgcgtggcgtgcataaaggttcgagggattcgtgatgtttatttgggtc

SEQ ID NO: 11163 - DNA, 852 bp, Zea mays
cattgggtacctcgaggccggccgggatctaggccccacctgaaaaaaccctcgcgccgctgagctgagtccccttcccttctcccgtcgcctccgcctccgcctccgcctccgccttcagtttagcctccaagcaggggcgccgcgcggggtattctgtccgtcgttgagggtagagagtcacttgcaccgggggagcggagatgaagccggttgtggggatcgtggtgtcgaacaagatgcagaagtcggtggtggttgcagtggaccgcctcttccacaacaaggtatacaaccgctacgtcaagcgcacctccaagttcatggcacacgacgatgacgactcctgcaacattggcgaccgggttaggctggatccttctaggcccttgagcagacataagcactgggttgttgctgaaattctccgcagagctaaggtgtacgttccaccagctgcaacagcgtccagtgaacgtggtagcaaatctcaacaagctggtgttgctaccaaatgatccatctgaagttactcagaacaagatgcagtcacggcttgtttttctttcgctgtatgtttgtttccttgtggaatgcggttgccatgtttagccatggaagaaaaatagcaagcagccagcatctttgcttaattactgttgttcttctgtggtgtccttcatttaacggtactagccattaaggatgtagttaccagattcaacaagaccaatggattttatattgtattggttcacttccgatacccacttgcatttgcagcggccgttggcagctgtctttgcaactcccctctgacactgaaacgagcgggcggaaaacatcagaatg

SEQ ID NO: 11164 - DNA, 1842 bp, Zea mays
gccgcccggcccaccgttccttttctccaccattgaaacactctctgaccctcactcgctccctgtcacacacactacactcgcaattcatccgcagtcacaagctcggctgctgctcccgctaacggttgaggcgttgctggtgcacacaggaagggaagggaagggagagctgcacacagctttgctctggctcttggctcccctgtccagctgtcctgtccgtccatcatggaggaaacgcccagcccgcagctctagccgccgtcaatctcgtctcgtatcggagtcgaaggaagtaagaggcgggatggcatgaagcgacctaccaagaatgagaggctgggcaacccccggcacaagtaggaggaagaacccgagcaaccgagccacagggaggaggaggagatgggcaactgcggcacacgggaggagaatgccgtcgtcgctgcgcacgcgcaagttcagcaactccacttgttacaacagccttccaagaacgccaatgcagataggaagcacacctgcatgtcatcagatataagtgacccttccacacctaggaaagttgaagatgccaagaacatttccatatacaacgatgtgattgccttcacattgtttgagctagagacaatcacaaagagcttccgtgttgattatgttcttggcgaaggaggatttgggaccgtttacaagggttacatagatgaaaatgtcagggttgggctgaagtcactgcctgttgcagtcaaggtgctcaacaaagatggacatcaagggcacagagaatggcttaccgaggttaactgcctggggcagttgaggcatccaaatttggtgaagttgatcggatattgctgcgaagatgaccatcggctgcttgtctacgagttcatgtttcgaggaagtctagaaaaccacttattccgaaagacagctacgccattgccctggggtactaggatgtcaatcgcgctgggagccgctaaagggctcgcttgcctccacaacgctcaaaggcccgtcatctacagagatttcaagacatcaaacattctgctggactccgattatactgccaaactgtctgactttggcctcgcaaaagatggccctgaaggtgatcagacgcatgtgtcgacacgggtgatgggaacctacggttatgctgcccctgaatatgtgatgaccggtcacttgactgctcggagtgacgtgtacagcttcggcgtggtcctgctggagctcctgacggggcgcaagtcgatcgacaagtcgcggcccagcagggagcagagcctggtggactgggcgctcccgaagctcaacgacaagaggaggctcctccagatcatcgacccgaggctggaggggcagtactcggccagagccgctcacaagtcctgcagcctcgcgttctactgcctgagccagaaccccaaggccaggccgctcatgagcgacgtcgtcgagaccctcgcgccgttgcagcagggcggcggcggcggcagcgacgcgtcctccggccttcctgactgcagaggccgccgcaggctgaccggcaacagcgtcgtccacttcagggccatccccaaccccaagtgcacgcctgttgtcccggcttgcagagtgcggtgatgttgctgcgcttcggttgaagctgctgggataggttcaggtgtgtactgtgaccatgggtggtggtgcgttttgatgatctgcatgttggattaatgtgggcttggcccaaattaatattcaataatagtcaatgctaatggcccacttttaaaaaaaaaaaaaaaaaaaaaaaaaaagggcggccgccaccgcggtgga

SEQ ID NO: 11165 - DNA, 4568 bp, Zea mays
  misc_feature (2219)..(2219): n is a, c, g, or t
agaggcgcttggcatgaagcgacctaccaagaatgagacgctgggctacccctggcacaagtagagcaagagccccagcaaccgagccacagtgaggaggactcgagggaagagatgggcaactgcggcacgcgggaggagaatgccgtcgtcgctgcgcacgcacaaggtaccctttcgagtttgcccctggtggatatcttcgcgggattccccactcgtcggcgcttgtttggatctcggccgcctaccctgccctgttcgaaatccaccaaaatttcatttttggcggattgtttctcaggcccccctgggttcttggttcttcggctcaccgcggattgctataattacacacactacttctgtctttctaccgcgacggcttccggtgttcattaatcagtgccgtggcgttttggttgcgaaactggattttttttgccgggggtgggggaaggggttacccccatgtcgttgtgattacggaaggatggtttcgattgaggtcgcatgccaaattccactccaaatgttaggttttaatacttcagtacgggggtttttgctgatcttttttggttcattccatccccctcttgagatgaatccggttctatttatcctcatttggtcatgtttttatcttcttgtgaagttgccatgcgtcgtgcgtctccttatctttttgatctttgtatctcgaagcctacttcattgtgcacattgagaaaatcgcaaggcacttgccgcacttttccccagcgtgcttcgctttctgtgccctcttctcctccccactattgactagagataaaaaaaaatcacgatcctccaagttaaaagtctgttgcagttgctacttgcgtttattaaaagcaatttgaggttttctaacttacgtgcaactgtgcagtagatctggtcccctgacctctctttctctctcttgaaattatgacctcctttttacccttgctgtaatcaattcgtgcatgtgtaactcttctttatttattttctgctttctacttaactccgttttcgaatatttgtatttatttttcaacttaaaatgcgacaactaaaaaatttaaaaatgacggagcgagtatttttttaggcgaaaggtcattttaatggatgccagcagtaggcaaatcattcatttccacttcttattttacctttataataatttccaaccagaacattgtatctcaacatgagtaaatgcttgtaattctacacgaatccttgcggtataaaacttttcataagtatgcccatgacctatactggtactttgatcttaatacgcgagatatccttgttagttgttacttcaattctgtagttaagtattatgcttcatatttccttcgttcttttgtttgggggttgaggacttacatttccttctcatacttccagttcaacagctccacttgttacaaaatcctgccaagaatgccattggagataggaagcacaaccgcacctcatcagatataagtgatccttccacacctaggaaagctgaagatgccaagaacatttccatatacaacgatgtgattgtcttcacattgtttgagctagagacaatcacaaagagcttccgtgccgattatgttctcggcgaaggaggatttgggaccgtttacaagggctacatagatgaaaatgtcagggtggggctgaagtcactgcctgttgcagtcaaggtgctcaacaaagatggacaccaagggcacagagaatggcttgtgagttgataagttgttcggttattttcatgctcactacgttttcattacatgcatggaaacatgaaaaattgtctactaatatggtgtgcttaaaaactatgcatgtcatattgacatggatacatgtaaatatcatcaggttcatgtcgctaacaagcatgctgacaaataaaatacacacattgaggattccatgtgtttcagtggcaatcattgttttgtttttaagggcgtctggattacttctcaccactttgttgcagtccttgagtcgttgagtcatgtatgatattgagtccttgagtcgtgctcgattacagatatgtgcagtccttgagtcgtgctgttattgacaaataacgtattttgtttgtcatgcttgaaatttttaaaatagcttacttgcatgaccggaataagaaacattactgagcaaagaaacttgangcatgaagatggaagtccttgagcaaatgtagatttattcgataggttaactaagtgtatgtaactacctgtaaaatgctattgggttatttttgcacatggtttgacagttatcatgcttgttactagcctacaaaattattattctatcttttgtatttatgtcagaccgaagttaactgcctggggcagttaaggcatccaaacttggtgaagttgatcggatattgctgcgaagatgaccatcggctgcttgtctacgagttcatgtttcgaggaagcctagaaaaccacctattccgaagtaatacttctactcctgtttgtcctggatgattgcttgcttggtgaactgttgattttgcttgattacaggtggtacctaactggcttttctgttctctgtatggacattttaggcaacttcccaactgaccatgaacatataagaaatgaactattttacaattacgcactaccacaccttcgtgttaatttcttctagatctgttgatttttgtcatgctcctttagttacacaggctactatagctgttacttttccctgctagcatgtatgatatgtaatgccagtgcactatttttcttgattcattcgcaatgaaattttattcagacgacgagggaaaattccgttgaccagacatcttgtttttcatgttctcagagacagctacaccattaccctggggtactaggatgtcaatcgcactgggagctgctaaagggcttgcttgcctccacaatgctcaaaggcctgtcatctacagagatttcaagacatcaaatattctactggactctgttgagtgttaaccacttcctcatgcttccttctcctttttcagttccattgctatcatccaatggtaatacatatatgtttgacatatttatcttcttgtttccgttgccacaggattatactgctaagctgtctgactttggcctggcaaaagctggccctgaaggtgatcagacccatgtatcaacacgggtgatgggaacctacggttatgctgcccctgaatatgtgatgaccggtactttcctcactgtttgtatatgcttggtgtctgcatttcttagaagatatcgtctaacagtttgggtatgaacttcatgtcgattttccagacactgaactattgtttgtactccatgagctgagatcacatattttgccacttcctatgctatgtctttcattatctgaatatagtaactttgtagcaatgtcttataaccaggaaaaaaacgtattattcttaatgcatgatctgatatcacatataccatcacacctacacttaatgatacctaatgtgcaggccacttgactgctagaagtgatgtctacagcttcggtgtggtccttctggagctcttgacagggcgcaagtcaatcctcaagtcgcggcccagcagggagcagagcctggttgactgggccctccccaagctgaacgacaagaggcggcttctccagatcatcgacccgagactggaggggcagtactcggccagagccgcccacaaagcctgcagccttgcgttctactgcctgagccagaaccccaaggccaggccactcatgagcgacgtcgtcgagaccctcgaaccgttgcagggcagcggtggaggcgatggacgcggccagccttctggccttcctgactataggggtcgccgcaggataaccgggaacagcgtccacttcagggccatcccgaaccccaagtgctcccctgccgtcccggccacggcttgccgagtgcggtgatgggtgctgtgtttcggttggagctgccggggtaggttccgttgtgtatattgcggccgtgggcagtggtgtgtgtgtgggtgcatgtgtgtgcttggcggcggcggggtttcggtttcttctcgggttttggcctgcgttttgatgtgtaaatttgatctgcgtgctgcattgctgctgctgcttttgtaaggccctctaattttcactgtggtcttatgtatccttcgactgagcgagccctgctgaaactggcgggttcgggattaaccctagaaatgaaatgaaaggctgaaccgagagcggttggatggctgatatggcatatgctgctgttgtgttgtgttgtatctgaggaatcaatcagtctgtatcgagtctcttggcaagttttctcttgtttggggcatcctggtatagtagggaagaacaatcgtgtgaccacatgatgcgcgatggtaaactgacaatgtttggaaatgtaattggtgatgtttttttttggatcaaaaagaaatacacacataccaagtatccgctctgca

SEQ ID NO: 11166 - DNA, 2019 bp, Zea mays
ccggccggggttccttttctcaccagtgaagcacactccgacctgaccctctctctgtaaccctcgcggaccccccggctccgcagaagctcggctgctgctccttcagtcagtctagcaacggttgaggcgttgctggtgctcctgccgcttaccctgccctgttcactgttctgttccgcgtatcccacaggaagggaaggggaggaagcagcagcagcacacagctttgctctcgctctcggctccccgtccaccaaaggaggaaacgcgcagcccgcagcgctagccgtcgtctatctcgtctcctagtccaaggaaggaaagaggcgcttggcatgaagcgacctaccaagaatgagacgctgggctacccctggcacaagtagagcaagagccccagcaaccgagccacagtgaggaggactcgagggaagagatgggcaactgcggcacgcgggaggagaatgccgtcgtcgctgcgcacgcacaagttcaacagctccacttgttacaaaatcctgccaagaatgccattggagataggaagcacaaccgcacctcatcagatataagtgatccttccacacctaggaaagctgaagatgccaagaacatttccatatacaacgatgtgattgtcttcacattgtttgagctagagacaatcacaaagagcttccgtgccgattatgttctcggcgaaggaggatttgggaccgtttacaagggctacatagatgaaaatgtcagggtggggctgaagtcactgcctgttgcagtcaaggtgctcaacaaagatggacaccaagggcacagagaatggcttaccgaagttaactgcctggggcagttaaggcatccaaacttggtgaagttgatcggatattgctgcgaagatgaccatcggctgcttgtctacgagttcatgtttcgaggaagcctagaaaaccacctattccgaaagacagctacaccattaccctggggtactaggatgtcaatcgcactgggagctgctaaagggcttgcttgcctccacaatgctcaaaggcctgtcatctacagagatttcaagacatcaaatattctactggactctgattatactgctaagctgtctgactttggcctggcaaaagctggccctgaaggtgatcagacccatgtatcaacacgggtgatgggaacctacggttatgctgcccctgaatatgtgatgaccggccacttgactgctagaagtgatgtctacagcttcggtgtggtccttctggagctcttgacagggcgcaagtcaatcgacaagtcgcggcccagcagggagcagagcctggttgactgggccctccccaagctgaacgacaagaggcggcttctccagatcatcgacccgagactggaggggcagtactcggccagagccgcccacaaagcctgcagccttgcgttctactgcctgagccagaaccccaaggccaggccactcatgagcgacgtcgtcgagaccctcgaaccgttgcagggcagcggtggaggcgacggacgcggccagccttctggccttcctgactataggggtcgccgcaggataaccgggaacagcgtccacttcagggccatcccgaaccccaagtgctcccccgccgtcccggccacggcttgccgagtgcggtgatgggtgctgtgtttcggttggagttgccggggtaggttccgttgtgtatattgcggccgtgggcggtggtgtgtgtgtgggtgcatgtgtgtgcttggcggcggcggggtttcggtttcttctcgggttttggccggcgttttgatgtgtaaatttgatctgcgtgctgcattgctgctgctgcttttgtaaggccctctaattttcactgtggtcttatgtatccttcgactgagcgagccctgctgaaactggcgggttcgggattaaccctagaaatgaaatgaaaggctgaaccgagagcgggttggatgattgatatggcaaaaaaaaaaaaaaaa

SEQ ID NO: 11167 - DNA, 6524 bp, Zea mays
  misc_feature (4235)..(4235): n is a, c, g, or t
aggggggcggcatgcatgcgtacagcaaaaaccatgacctcacctttttcctttcggcgtggttctttttaataaaaaatggtgcgcagaatggcttctagtacatgccagtgccacaggtgctaaaggaggtgttttttaaaatcaaagaaatcctttgggcgccgctcatcgcatttataatctatatatattgagaagtcagagggtggggatctgtttcagagacgtcgtaccactactccgtacagatcatagatgagtcatcgatcgtatataggtgcagtcatgccgtgcgtttgtgcggcggccgctgaaaggcaacaagaccaagatgcgttctacctcgtccgaccgaccagcagctgcagacatgtgtacacaggtcaaaagagatcgatctgtgttgttcttcgcctgcatgcatatgcacaatctcaccgtacgtacgtgttgcggccttgcatgccctgccactgcacaaggacaaggacaatcgtcctcgtcgacaggagacgccacagacctgaatcagaagacaggtcgcagccagctcaaacgacccggcatgcgtgcatgcctaggcatggctgccttcgagtttgcgcagttgggcacatgaacagggcaagagcaaccacccacgcggcgtggtggcgagaaacaagcaaggcagcagcagcaagcggaactgcgacacgaaagagagctctaggctctcgcaccgaccgatcgacgtcgtcgcgagccaagattccgcacaaaaaggccggcggccacggcacacgcacacgcttttggctgccgtgttgcggtgccccgttatcccgaagccgctgccggccggttgatctcctcctcccctccgcagctccgcttatataagccctccgtgcccgcgcctcaatggagacatgcaccacgcacgcgcggcaccacatctagtagagcctgcctaccgccccactgtcgtcgtcattaattcaccaggctagagctagctagctggctctaccgccgttccccgatcgagcgtccgtcatggagattgatgagatggagagcggtgtcgtcaatggaagcggcggcggcgggtcgttccggcgggcgaggtgctgggagctgctgtgctcggcggcgggcatgctctggggcaaggtcgtcgggttcgcccgcaagctgggcaggatcgcgagggacgacccccggcgggtggcgcactccatcaaggtcggcctggcgctcacgctcgtgtccgtgctctactacgtcaggccgctcttcaacaactggggggtgtccaccatgtgggccgtgctcaccgtcgtcgtcgtcatggagtacaccgtcggtacgtacgtacgtacgtcgtggtacggatcgttccgtcgcacgtatatacacacaagcagctaactagccgatcgatcgtgagcaggtcgttgtagatatattagtgtatatatacatgctgtgtacgtatatacgcacacgtatatagtagctgtgttgcgttacaagcagccattattcacagtttcacacagtagaactgtagaaacaataaatatatggtgacgagttcttggtgcgcgcggggtgtgttcatgtcatgtatgtgtgtggcaggtggcacgctgagcaaaggcctgaacagagcgtgcgggacgctggccgccggcttcatcgccgtcggggctcacaaggtggcctacctgtgcggcgacaaggccgagcccgtgctgctcgccgtcttcgtcttcttgctctgtacgtacacgattaatttattaatttgcgtcggccatgcacgtttattaccctcccgtgcctgtagaccatttttaccacgcacgtacgcatgttcgccatgcgcgaagctaagcaagagcggttggccagccgtgcacgtacgtacgtacggtggccgccgttgctttcttgacacacgagtcgtcgacagtcgtcgtcagtcgtcaccatgcactatgtattattgcagcgtcggcggcgacgttctcgcggttcatcccggaggtgaaggcgcggtacgactacggcgtgaccatcttcatcctcaccttcagcctggtggccgtgtccagctaccgcgtcgacgagctcatccgcctcgcccaccagcgcttctccaccatcgtcgtcggcgtcggcacatgcctctgcaccaccgtcttcgtcttcccggtctgggccggggaggacctccacaggctcgccatcggaaacctcaacaagctggccgagttctttgaaggtacctagctaccatgcactcgatcgaacaagtttcatacgtatatactagagtttaatttgggactaaaagctctccttacatgtttacgtacgtgcgcaggactcgagtctgaatgcttcagagagaacgccacgttcgagaatttggaagcaaaacccttcctccaagtgtacaagagcgtcctcaattccaaggccaccgaagactctttggtaattaataagctcacctcactttaatttgcaaaccatgcacatatgtgtgcaaatttatgcagagctagcgccaaatgaattatgtacaaaaagttatactacaacaatacgatccaataattaatggtatgtgttcccgaaaccgcagtgcaattttgccaagtgggagccctgccatggcaagttcaagttccggcacccatggagccagtaccagaagctcggcgctctctctcgccagtgcgcttcctcaatggaggctctcgcttcctacgtcatcaccctcacaagaaccgaggtacgtaactgctgctgcaggtccatccatctcgtgaccaatgcattacacacacagtagaaacacgcgcggtgcatgctcatcacctgcaggctttctttctccctgcccattattcacagtaccctgaagcgcggcccgagctacgctcggaggttcgaacagcgtgccgccagatgagcctgcactcggccaaggcgctccgcgagctctcggcggcgatgcggacgatggccgtgccgccgtccccggccaacgctcacatgtccgcggcagccaaagcggccaaggacctcagggacgagctagaggacgcggacctggcgcaggcgatgcacgtcgctgttgtcgcgtctctgctctcggacctggtgaccaaggcgaagcagatcacggaatctgtcggtacccttgcgcgacttgcccgcttcgtcaagaacaacgaccatgagaacaacgctgacgacaaggatattgcggctatcgatgctgtgagctgagaaagctagcagacggtcctgtggcggcaaaaatatatcctaattaaccgtgcatccagacgttcatagctatctaattcgcacatatcgaagatcggatggctctgaacgtctagatgcatggctgcacaagttaatatggatgcacaatatatatgcgttgccggcgatcttttcggtgggacttgactagtgatgttctatatttggcgtggtggggaatacatgtatcagaagcatttggtaaatgggataaaagtaagtcgatatcaattagtacaatgctagatgcgcatgcacagcaagtgactaattcttcgatttgtacaagtcgttaattacgatgctggtggtaaaacttcactgtcttccaccaattaacctctctcggcaggccaaaaaaaaaaattgatattcttcgagatacaaggaagaaaaacaaattacatctcaatgtgtagcagtgtgctaaagaaaacagtgagccaagtgtcattcttccaagctaggccggtgtgatgttaaagcaacagatatacgtgaaattaagttcccaaagcatatcaaatattcgtctcaaaaacagatctcatgacaactcacgtaaaggtcgtctcgccaacagcgtctcttttgcttatgcaaactttccaactataaatccttcttaagatctatcaactataaattcttttgcttatgctaactttccgtgtcaataaggaggcgcgatgtgccgtgttacaacttacaagtgtcgtcggtgcatttcattatcaacggtccgttatgggcacaacgacagtgtgacaagcatggaagttttgcacaaaggaagaaactcgttagtggaactttgcactgccaaccagtaaacaccaagttctacaggcaaggcagcatacaagactttccttttgagtatagaatttgcgaaagatagngcatatggcgtgcaaaattggctgtgataaagcaattacttgattcaactatgcacagtcaaccactaacgccaagtttgctcagtacgtgaacaaatagactggcctttttgaggataaactttcgaaaaggccagatacaatagatcaaagcaatagaaaatttccttcagcggtgtgttagttaacttctaagaacgaatacgtgtcaaattatgtgctggggctttggctttctaactcaaataagatcaaagaggtggaaccgtggaatgatcatagacaaagttgtgtactctatatgcaccatttactgccatgatttaaaatgttcgctgctaggttttattcaaagatgttagcatcattacttgaaggagtagtcctaaaaactccagccgtgagcagcctaaacattttggctttcatgtacaatttctagtttttgatatacaatgactaccctacccttcctctatttaaatggaagcagtgccaatagatataaattccacgaaatcaaggacatgatataattaaacgcacaaaaactggttttagctaagatagactagcttcttggttttaagaaactgataatctaatttctataaaattaggacaaaaaacaggtatgtttaaaactactctaatttttataaatcatttttttaaaactaggtgcttccaaaggccctaagttgccaatatatatacacccgtcttgggtccagcaactcagcatcatgcttgtgtttccttctataccttcatacccttggctccagtctacaagctaacatatagatgatgggtcttagactggactgttttcatctatagcaccagaagaaaaaatgcagaataagaaaaagaataaacaaaaactaaatgtagcaaagataaatgtgccagggtccctcaaccacacagacaatattgtaacatgagccacaggaaatctgaagattaaggaccgtagttaggatacataccaaataatagaaagaagacccaacttccttgatcgagagaattccaacttttcattgcatcataggttagtaaggaaatgaaagtacttctcgaatcaataatgtcttaatttatctcgtcaccgagtcttcagtttgagtatggttgcttcagctagtcacagcaagttaaactctatcccttttcacacctacagacagttttccgaacaaactatggggcatggcagaggaaaccgaaacaagtcacaatccttgctgtcccataagacttcagagtacaggcactggtaattatgtgtatacgcatacctcagattaaagatcattcaactacataactaacctatttggatagtgaaaaggagtataattacaatcaaagagtgcaacaaggcaggttccccatggaccctaggaattaccaagactctacaaaagttcatgctcctgacagtacacaggaactggatcacttaatatgtacatcctacgactatacatagttcaatgtgaactggtttgatcaccagccatatacagggtgttgaacttgaggaggcagcaggttcagatccatgcactgctgtttatcatagtcacgtgtaccaggaattgctcccgtcgctaatctgaggatttcgttaccagtcaggcagtgatgagcaaatgccagtcccccatccaccacatctgacaatttaggaagtaacggtatctttcttgctttgttaaccttcccatttcgtccagggtgacgatttctgttcagaactttgtcaagctctgagtattccataaacctctcagtcgccgcttcccatgacaaactgtaccgttgctctgaggtcagaggttgaggttccgtagccatggcttctttgacacgagcaacgaattcctctgaagttctatatgttaagcagttagggaatgacttaaaaaaatcgtttgatggatgatctgcacagactacaaatttccccattgcaagggcctcagctgttgctgtgcatagcacatcactaacacttggattgacgaaaaccttgtacccatggagtgaatcatctgcatggtcctttcccttgaaaaaattgatgttcaaatcaaatttcctagcagcgttctggacagcttcagagtcctcgccatttccatatacatctatcatgaatccttccaggtcgtttttgtgtttggataataaatcaatcagctctctatatcctttagcccacaccatcttaccaaggaaccctcgcgtaagcccacgcgtccgcggacgcgtgcg

SEQ ID NO: 11168 - DNA, 1838 bp, Zea mays
agactatatgcaccacgcacgcgcgggcaccacagctagtagagcctgcctacctccccactgtcgtcattaattcaccaggctagagctagctctaccgccgttccccgatcgagcgtccgtcatggagattgatgagatggagagtggtgtcgtcaatggaagcggcggcggcggcggcgggtcgttccggcgggcgaggtgctgggagctgctgtgctcggcggcgggcaaggtcgtcgggttcgcccgcaagctgggcaggatcgcgagggacgacccccggcgggtggcgcactccatcaaggtcggcctggcgctcacgctcgtgtccgtgctctactacgtcaggccgctcttcaacaactggggggtctccaccatgtgggccgtgctcaccgtcgtcgtcgtcatggagtacaccgtcggtggcacgctgagcaaaggcctgaacagagcgtgcgggacgctggccgccggcttcatcgccgtcggggctcacaaggtggcctacctgtgcggcgacaaggccgagcccgtgctgctcgccgtcttcgtcttcttgctctcgtcggcggcgacgttctcgcggttcatcccggaggtgaaggcgcggtacgactacggcgtgaccatcttcatcctcaccttcagcctggtggccgtgtccagctaccgcgtcgacgagctcatccgcctcgcccaccagcgcttctccaccatcgtcgtcggcgtcggcacatgcctctgcaccaccgtcttcgtcttcccggtctgggccggggaggacctccacaggctcgccatcggaaaccttaacaagctggccgagttctttgaaggactcgagtctgaatgcttcagagagaacgccacgttcgagaacttggaagcaaaacccttcctccaagtgtacaagagcgtcctcaattccaaggccaccgaagactctttgtgcaattttgccaagtgggagccctgccatggcaagttcaagttccggcacccatggagccagtaccagaagctcggcgctctctctcgccagtgcgcttcctcaatggaggctctcgcttcctacgtcatcaccctaacaagaaccgagtaccctgaagcgcggcccgagctacgctcggaggttcgaacagcgtgccgccagatgagcctgcactcggccaaggcgctccgcgagctctcggcggcgatgcggacgatggccgtgccgccgtccccggccaacgctcacatgtccgcggcagccaaagcggccaaggacctcagggtcgagctagaggacgcggacctggcgcaggcgatgcacgtcgctgttgtcgcgtctctgctctcggacctggtgaccaaggcgaagcagatcacggaatctgtcggtacccttgcgcgacttgcccgcttcgtcaagaacaacgaccatgagaacaacgctgacgacaaggatattgcggctatcgatgcagtgagctgagaaagcactagcagacggtcttgtggcggcaacaatatatcctaattaaccgtgcatccagacgttcatagctatctaattcgcacatatcgaaatcgaagatgggtacattttacatagggtacccttttacataaaaccacatcaggcgatatgcctgtatgcgaatcggatggctctgaacgtctagatgcatagttgcacagggtaatatgagtgcacaatatatatgtgttgccggcaatcttttcggtgggacttgactagtgatgaaatatttggcgtggtggggaatacatgtatcagaagcctttgctaaatgggataaaagtaagtcggaaaaaaaaaaaaaaaa

SEQ ID NO: 11169 - DNA, 1670 bp, Zea mays
gggtacctcgaggccggccgggccgggtcctcccactcctctcttgcccgcccgtccccggtccccgtcgtccctctccctagtccctcccctcgtccgtcgtccacctctgccactacgagctcgtccccgtcttgtttcgtctcctctcgtctcgtcacgcgagatatttctacgggacgggacccgcgttgcttccccgcctcgccgtcccgcgcgcgccagccgggcccggggaagccatgaactgcctccagaacctgctcaaggagcctccaatcgtggggtccaggtcgatgaggcggccctctccgctgaatctggcgatggtccgcggcggcagtcgccgatcaaacaccgtcaaaactttgcaggcccctggggcgtccacttccggtgccgagagcagcgccgtggagatgggcaccgagaagtccgaagtgtacagcactaacatgacgcaggctatgggagcagcgttgacatatagacatgaactcgggatgaactacaatttcatacgcccagacttgattgtaggatcctgcttacagagtccacttgatgttgataagcttcggaagattggtgtcaaaattgtattctgcttgcagcaagattcagatcttgaatattttggagtcgacatccgtgccattcaagattattctctacaattcaaagatattgtgcactgccgtgcggaaattagggattttgatgcttttgatttgcgattgaggcttcctgctgtggttagcaaattgcacaaacttatcaactgtaatggtggtgtaacatatatacattgtactgctggacttggaagagctcctgctgttgcattggcttatatgttctggattcttgggtacagtctcaatgaaggacatcggctgctacagagtaaaagggcttgctttccgaagttggaagccattaagttggcaactgctgacattctgacaggattatccaaaaacacaatcactttgaagtgggaagctgatggttcttcctctgttgaaatttctgggctcgacattggctggggtcagagaattcctttgacatatgatgaggagaaaggagcttggtttcttgagaaagagttgcctgaaggacggtatgaatacaaatacgtagtggatggcaaatggctatgcaacgagcatgagctgataacgaaaccgaatgctgacggccacgtgaacaactatgtccaggtctccagagacggcacgagcgatgaagagaaggagctaagggagcggttgactggtccggaccctgatctcacggaccaggagaggctgatgatcagagagtacttggaacagtacgcggatgccgccgagcgctaggaggtccaaagaatgatgatgactgacgaagagacgacggtccgaagccgacctgaccgcaccttcctttacggcgaggtcgggctttcccctctcttgtcaatcaaatactcgtagcttaaccgtgcaaaagggcacgttctgctcgcatacttggagaatgatgatgaaggagcaaaatgtacgtagctgtgcagaaataacaaaggtagtagcgtaaaactactgtactgaccataatgttactactatatgctccttcctggctatgaataataataataaataaaagagtaaataaacctc

SEQ ID NO: 11170 - DNA, 1601 bp, Zea mays
gcacgagaccattacctagaacatcctaatcgaaaagttccgtttcggtccgtcctccggtaacgcgctcgcctgctccgcttggctcatggattttcctccagggagcctccaatcgtggggtccaggtcgatgaggcggccctctccgctgaatctggcgatggtccgcggcggcagtcgccgatcaaacaccgtcaaaactttgcaggcccctggggcgtccacttccggtgccgagagcagcgccgtggagatgggcaccgagaagtccgaagtgtacagcactaacatgacgcaggctatgggagcagcgttgacatatagacatgaactcgggatgaactacaatttcatacgcccagacttgattgtaggatcctgcttacagagtccacttgatgttgataagcttcggaagattggtgtcaaaactgtattctgcttgcagcaagattcagatcttgaatattttggagtcgacatccgtgccattcaagattattctctacaattcaaagatattgtgcactgccgtgcggaaattagggattttgatgcttttgatttgcgattgaggcttcctgctgtggttagcaaattgcacaaacttatcaactgtaatggtggtgtaacatatatacattgtactgctggacttggaagagctcctgctgttgcattggcttatatgttctggattcttgggtacagtctcaatgaaggacatcggctgctacagagtaaaagggctttgctttccgaagttggaagccattaagttggcaactgctgacattcttgacaggattatccaaaaacacaatcactttgaagtgggaagctgatggttcttcctctgttgaaatttctgggctcgacattggctggggtcagagaattcctttgacatatgatgaggagaaaggagcttggtttcttgagaaagagttgcctgaaggacggtatgaatacaaatacgtagtggatggcaaatggctatgcaacgagcatgagctgataacgaaaccgaatgctgacggccacgtgaacaactatgttcaggtctccagagacggcacgagcgatgaagagaaggagcttagggagcggttgactggtcgggaccctgatctcacggaccaggagaggctgatgatcagagagtacttggaacagtacgcggatgccgccgagcgctaggagaagaatgatgatgactgaggaagagaagagacacaccatgagacgacggaccgaagccgacctgaccgcaccttcctttacggagaggtcgggcttcccctctcttgtcaatcaaatactcgtagcttaaccgtgcaaaagggcacgttctgctcgcatacttggagaatgatgatgaaggagcaaactgtacgtattgttgaacagcagctgtgcagaaataacaaaggtagtagcgtaaaactactgtactgaccataatgttactactgtatgctccttcttggctatgaataataataataataataaaagagtaaataaacctcaaaaaaaaaaatagaaaacaaaagaataaattacagaccagaacatgaaggaaaaccaagatttaaa

SEQ ID NO: 11171 - DNA, 2017 bp, Zea mays
gtcgactcctttaatcattgctaatgatcccgattctaaaatatcagttgatttttcggtaaaaataaaaataaaggaaataaaaaagggaaaaatatatccctgaatttttttcactgccgcgcgtggtcagcgttcctatcctgtcgactgatattttgaaacaggacacgctcacacgcatacgcgtctacgcgcgagacagcgaaccgtcgctctgcacttggatatttcaagccgccgcccttggattcttacaaatctcgccgagctcaatcccaagctgccatgcacccaattccatctccttccccagctccggcgtccgtggcacctaggccatggctctgtgctcgccggttcgtcctaagcgttgggcatgtgctcccctgcccctctgtccgccgacgactctcccttaccatctcctcgctggttcaagacgcccaaccttcttctccctgctcggatcccgctcgtggagctcccttcctctaccttggccgccgttgagctcacccagcggcccttcctctacctcccgcaagctcccagcgatgcgccccaggtccctgcgcacagccgccaccggccgagctcgcccccggcacttcgctcctccatagtcgcgccctggagctcgcccagcgttcttccacgctgatggtcggtggtctccttacagcgacaccgattcctgctcccgtggatgacggcggcaggagatgcttctcccccgcgctcgcccatggacgccagccgcgcccccttctcgtcgtggagcttgccgcgcccttccagttccctctgcccggccatggagctcgcccctggcttggattccagcgccccgctccctgtttgcccctgctcgcctggccactacgcagccccctcggcttctcctccccagcacgccacgcccagctccctgcgcgcgtccctctgttggccggagtaccctggcccgaccccgtgctgcgctggcccagccgtggtctccagctcgccggccgcgagtccctacccatggccgctgtgccgagttcttctccagcgtcgtgaagcccctgctcctcgctcgcctccatggtgttgccgtagaatttcctcgccgcgcccttgccaagctctggcgcgcgtagtcctgtttcaatgatggccgctcattccttctctggtgctcgccgatggcgcgcagtcgcgtcttctcattcgacctgctccggatccgaagctggtcgccctatgtgctcgactttgtcttatcgcagaaaccccaacgtcgtcgaccttgccgattgtcgtcattcgtcgtcgcgtcgtgcgtgcagcagccccagatctgtgcagctctgctcttgttgtcgacatcgctcgccgtggctcagcttgctagcttgtcgttgtttcgtcgtctcgtcttgatgtcagtccctacgtggcatctccgacatatattcacgccgacaaaagaatcccaagaagatatagagaagcaagtcaatcatcgccatttatacggagttctagttaatatggagagattccaagaattgcggatggaagagaaagtaaagctccgttctatactcatcaactgtttgatcgaagattttattcggaggctgtcgacgttctcgcaagctttgagtcggacttgctttggatgagaaatccctgatgttcgagagaggcctgtaagcgctctcttgggactcgaccaaatgactaaattggaaaaccatcatcgccctcgcggatatcgaatccattcggtcttggtaagccaatttattatttcggttaatcgaattggattaactagactcattagttgtaataattcttgtgtttagcagatgcgtcgtatttgtgttagatgcttgctaaaatatctcagcccctctggtaatgtaattgtgtgaaataaatgcgtgatatggtgcaccttaggtgtaaaatgcaggataaataaaatatttaatttagtgagaacttagaatagtaattctag

SEQ ID NO: 11172 - DNA, 1091 bp, Zea mays
atcaatctatcatacaacaacagttctttagacgcacgagaccattacctacaacatcccaaccgggagattagcgcccccgtcggccaaacagtaccggactggccgccgttcacagttcacgccccgcgtggtccctatttcccggcgagcactaggctaccgccgccgccgtcaggtgccggtgcccagaccttcgtcgtgcccatttcaccggcgacgagcacccactagcccctgcccgcaggtgttgggaactggggatagagatggatcaccaccacccgcagcagcagcagcagcagtacggcgatccttaccgtgggctcatgacgtccccgcagcccgaccaccacctccacgctcttcagtaccatcagccgcagccgcagcaacagccggcgcttatgtctccaccgcagccacagccagcactgatgtctccacagccgcagcagacactgatgtctccaccgcagccgcagcagcatcaccacgcctctcttgcctcccacttccacctcctacatttggttacaagattagccgatgctattggtacaggaacaagggaccaaaatttcgatgcactggttgaagaattgaccagccagtttgctaggtgccaacaattgttgaactccatatcgggaacaataagctcaaagtctactacggttgagggacaaaggcagagtttggacgaaacacggcagctgcttgatcaaagaaaggagttgattacaaagtacagaggctctgtcgaagagctccttaagggagatcaaagataaagaaagcatcataaggcttaatatttaaggatttattgtcgtcaatacttgaactctgttacttgaattcggtggtatgcatcaatagagccggaagatgttctggagtaaggacctggcagtgtgatacgggaatttgacatctgaatagatattctcccttgtccctctggtaaaaaaaactgttgtcacatttgccttcgctgtgacttggatgtatcatgtatatctttgaccattgatatcttggttaatcagacggtgcattacaaaaaaaaaaaaaaaaaacggcacgag

SEQ ID NO: 11173 - DNA, 1086 bp, Zea mays
aggcctcagatactatgattaacagatcactgagttgtacaacagcaagcacacagagcacatacaattttgtttagttcagaaaaggccaaacaagataaatcattacatacactcatctcttcatgaggaaccctagcagtattcccagaatagcaaccaccagtactaaaactaatgagaaaccaccatgccgcttgctgatgtctcgccttagaaaatccaattcttgtcgaaccgggtggcccggtccattgccggattccttctcctccatcagtttcgaaatcaaagcaaatggctcagtgattattttttctgattctttaggttcctttgtttcctcttgataactcaaactgccgagattaccatcctcaaatctttcgctttgagaggacgatggtgctacataaactaccttcaacttcacttcttccactacattgcctgaatctttggtaaacatgtctccagtgacctcctttggcacgacctccttggcgacggtggcgctctgcacaaggaacttgtccttgcattgcatgtccggtggcacgtcccgctgcgcttgcatcgtaacaacaacgtcagccttggaccggggcgccaccatgccgttgtttgggcgaacgcagtactttttcgggcttgtcgtcttcaccttgaacgcgacctgcttgtctgtcttgttcgtcagctgcagcgtgcaggagatctgcttatttaattcgaatgggaaccggagctcgacggggtcgatcccgagcagctccccggactcggtgctcatcctgggcaatcgaaacggacgcaacccggccgcggtggtgggagcggcgaggtgggggttcggaattgcgatgcttcccctcccctccactcccctgcctcctctccctcctctctctctctctctctcagtttttttctacgactatctatattcctgaggcggtggagcagagaaggaagcggaggggaaacggagggtcgaaatcggggggaaactcgggattttccccgccggccccgcggtgccccaccgtttcctcggaggcgggagaaggggtcagctgcagagca

SEQ ID NO: 11174 - DNA, 1228 bp, Zea mays
atacctccagacctcaagtcgcttgcaagctgataacagctggtgttagtaactatgacagattgactaaagtttataatatgaatcagaaaattacaataggcctcagatactatgattaacagatccctgagttgtacaacagcaagcacacagagcacatacaattttgtttagttcagaaaaggccaaacaagataaatcattacatacactcatctcttcatgaggaaccctagcagtattcccagaatagcaaccaccagtactaaaactaatgagaaaccaccatgccgcctgctgatgtctcgccttagaaaatccaattcttgtcgaaccttgttgttcagttcaatagcagaattcttctcctccatcagtttcgaaatcaaagcaaatggctcagtgattattttttctgattctttaggttcctttgtttcctcttgataactcaaactgccgagattaccatcctcaaatctttcgctttgagaggacgatggtgctacataaactaccttcaacttcacttcttccactacattgcctgaatctttggtaaacatgtctccagtgacctcctttggcacgacctccttggcgacagtggcgctctgcacaaggaacttggtccttgcattgcatgtccggtggcacgtcccgctgcgcttgcatcgtaacaacaacgtcagcccttggaccggggcgccaccatgccgttgtttgggcgaacgcagtactttttcgggcttgtcgtcttcaccttgaacgcgacctgcttgtctgtcttgttcgtcagctgcagcgtgcaggagatctgcttatttaattcgaatgggaaccggagctcgacggggtcgatcccgagcagctccccggactcggtgctcatcctgggcaatcgaaacggacgcaacccggccgcggtggtgggagcggcgaggtgggggttcggaattgcgatgcttcccctcccctccactcccctgcctcctcctctctctctctcttctctctctcagttttttttttctccgactatctatattcctgaggcggtggagcagagaaggaagcggggggaaaacggagggtcgaaatcggggggaaactcgggattttggaagggacgagaaggttgcccgcccgttttccttcggaggcgggagaaggggtcagcagctgcagagcaggacgccccgagcccggccggttgcccggccgg

SEQ ID NO: 11175 - DNA, 848 bp, Zea mays
gcacgagaccattacctagaacatcctaatcgtcgaccaggtcctccaccgcaagtgacagagaaccagagaaaccataagcccatagcaagctaaagcacaggagcgcaagagcccagcaggcgccaagaaaagcaccgcccggctggtccgcgccagcgcagtatggtgacggcgatcgcggtggcgtcggcggggctcgggatgctggcgggcgtcgcgatggccaacaggtcttcgccgccgtccgcgggcgccgcgctgtggaggcccggcgggggccccgcgctgcgctggggcggaggcggaggcgccccgcgctgcgaggcgtgcggggggtcgggcaaggaggactgccgcctctgcgcgcgctggtccgacgccggcgcccgcgggaagaagattagccgctccgggtgcggcgcgtgcgccggcacgcgccggacgccgtgccggtgctgcggcgggtccggtaccggccgacgcgcgcccgtgcggatcgccacgtccgcgcgcgccgcaccgacgactgccaggtgaggtgatgaccgcccgtcgcgccgacgccgacaccgatgccgatgccgagtctctcttcgcctctcctggacccgccggttctcccggatcatggatgaaggcggctctgtgcggcgcgcgggcgacctgctggcacaagggaatgacggcgcggagctcttgctctcttttttggacgaaaaaagatcagagattgagattgtagtagtatttgttagctagcgcgctggattgattagcaaaaattattgaaacgcgctatatttattttgcatagcaagatgagttacgcaacgcaaaaaaaaaaa

SEQ ID NO: 11176 - DNA, 1451 bp, Zea mays
cttcaggccccacccgctaaccacccgctaacggcgacgacgactgcttccccagtgggagacctgcaatcctcagccacctgcccctccccctcccccatctccgttcacctcttcccctcttccctaccttcctgtattcgcggcgtcgagtgccgccgcccttcgccggcgccgagcacggagcaacgcaccagtttcagtacctggattcgaactgagagtggattacgaagtcatggcaaggttatgttgcttcggcgccggttgctccgatttcacggggcaagggtcaatagcatccggtaaagggaaaggctgtcaagggcaagtcaagatctgctatggatataaccttgtaagagggatgacgaatcatccaatggaggactatcattttgccgaacttgttgatgtcaaaggaaacgagcttggtctttttgctatttatgatggtcatttaggggacaccgttcctatgtatttacagaagaatttatttacaaatattttgaatgaggaagagttttggacacacacagatagagcgattataaaagcgtatgaaaaaacagaccaagctattctgtcacatactccagatctgggacaaggtggctccactgctgtaaccgccattcttgtgaacggcaggaagttatgggtagctaatgttggcgattcaagagctgttcttttgaaaggtggtgagcccatacagatgtcgatagaccatgatccgaatgttgagcggagtgtaatcgaaaataggggtggttttgtttcaaatatgccaggagatgttccccgagtatgtggtcagttggctgtctccagagcttttggagacaggaatctaaaatcactattgagatcagagcctgatataaaaatcgaagacatagatcacactgccgagctacttgttcttgcgagtgacggtctttggaaggtgatgaacaatcaagaggttgtcgatttggccaaaaggtacaaggatccctatgctgctgccaagcaattaaccgtcgaagcacaaaaaagagatagtaaggatgatatatcatgcatcgttgttcggttcaaggcgtaagtcggtctcgaaggattttcatcgagagcaaaaaaacaagtgaattaggctgcctgacgatggtagtgataatctgatggttgaataatgactggggtgttggatgtaaatgatttgtctgctccaatgtaaagttcatatataagtatgctaggattatttggtttggcgatttcaaaggtacaggtgcgagggcccgagagctactaaatagctaccatctgtaaataatggttatattggatgttgaatttgtaagagtagactgagcaaaagacatctggatagttcctaaaagaacaaggtactctttatgttcgaaaaaaaaaaaaaaaatgtatgtacttcacttcctttt

SEQ ID NO: 11177 - DNA, 3167 bp, Zea mays
  misc_feature (2022)..(2022): n is a, c, g, or t
  misc_feature (2175)..(2175): n is a, c, g, or t
  misc_feature (2974)..(2974): n is a, c, g, or t
tgcagaacatgccgtgcgccattattcgcgccatctgccctgggttcgtttatttttatttatctacgggggagcgtagagactgtgttctagatgtcgtgcacatgcattctagactgtgttcgacttcgatagctgctcctgctcgtcgtcggtggctagcgtgttcgtcgcgtcggctgcgtggaaacgaaatttgccgtgatgtatagtcgactacggtggcccgggttcacattgcccctcctccggccttactaacaggcaatgcatgccaattggttgccaacacaaggacatcgtggcgctgtcgaacctgcgacctgctgcttgcttgcttttttatttataccacccccatggccgcttgggtagtttgtttgcacctgtggcctctctctctctctctctctctctctctctactccctctctcacacccgtcctgcagtcctcagcaaggaaggagatagggatcaccgccaactcgtttgtgcgtgcaactcggctcctgcttttccaagacccctgccgcagtctcacaatagaatcaccgccatttccgaatcccttccagagctcagctgccaagtgccggtcacagatgaagaggcaatccaagaggcccaccgccagccgtgactccccagaaacgggtacaggggagaagcagctggcgctcgcggagtccctaacggcgcggaagacggagcccgacgagctgggcggcggcggcggccggcgggctgggggagaagaagcggcgcctggcgccggagcaggtgcgcgcgctggagcgctgcttcgaggcggacaacaggctggacccggaccgcaaggcccgcgtcgcgcgcgacctcgcgctgcacccgcgccaggtcgccgtctggttccagaaccgccgcgcgcgctggaaggccaaggccctccaccgcgacttggcggcgctgcgcgcgcgccacgacgccctccgcgccgcctgcgacgcgctccgccaagacaaggacgccctcgccgccgagataagggagctgaggcagaagctggcagagcccgcggctgtgaagacggaggcgacgggcagtgacacggcggaggcgcgcccgacgacgacgacgacggccggcgcgccggcaccgcccgcggggggctgcaaggacggctcgtcggacagcgactcgagcgtggtcctcaacgacgacgtggacgcgtcgccgtactccggcgcggcgttcgagcagccgggcgccttcgccgggttcggtgcgccgttcttggccgcatcggcggcggcggcgccgccaccgacgggctgctcgtctccccccgtgttcgagaccaagtggcagcacgggccgacgacgtacgctttcgaatcgtacaagagctgctgcgccggatacggcttcacggaggaatggctcgcaacctcggacgtcgtcggcagcgacggcgcggccggcttcttctcggaggatcacgcctccagcctcaacttcagctggtgcgcgagtggcgcccaggactgggagtgagcgaggtttttggtctctgcacggttactgtaaaaccaatgttacggctgcattgtacattgggctcgtttccacaacaaaaaaaaaaaaatagctagtagctagtggacaacgcggcaaagcgagcggacatccatcgcacggcgggaaaagaggattagttatgtccaaacgggctacaagggatggctaagcagagcctcatcagacacgtcggtcttgcagtaccgcgccaatgtgatcaggttgagattcagccacgacaccacggagttgtcgagcccgacacactatgtcctctaaacaactttttttctaaacagcctttctgcgaatctggattcctagacaatttagctgtattaggaatatgaatatcacggagtttacgtggggagaaagataaatgagtttgcacgatttagggtttagaaagcgacaaattccttccgtcgcgtcgatttagtagattatgcatccacgttganatggacaatttttacatgagcgattctcacaaaaagcgaaccggaaagaggaacgtttgacggacgaagtcgattctgacgtatagaatgccagaagccgaaagaaatggtgcctatgtttggcaagggtattaaagcggccaaacaccttcnatcaattcataataacatgtatatcttcaagtcaaaagttcagcttctaagtagataaggccttgttccaaaccctataaaactaattgttagcggctaaaattagctaaaagatttagaatagatctgctaatgtaccaattaattgttagctatacttgaaaatagtcattagttgctagttgcctgaacctagctaaaaaccagctaataggtggttgatgaccaaattgttcctggccatttctatctattagcttatcggaaaaggcgacatgggtagtgaggacatttagcttatcacaacaatctattagcttcaggtttagaacccttagataatagttagccagccaattcggctaacaacttattagttggctaacgattagctctagggttttggacatggcctaagtaacagattatagtaaataagatagattacaacatggcacacatcacatgtttagcttctaagtcatatatcacaatataaggtaaccagttataagtttaaattatctaagtcacatatccatcacacaatcatagataacaaaaggcaaattaagtttggagcttgcaatggcttcatggttcaaatctatataggtaaacattcacctttgtgaaaaaaatagtgcaatcgacttcatataaagttcattacatgaaccatcaaatatccagagtcttaataatattacaaaaccattacataaatgttatgactcatgaagatagagtaattcaaagatctctttatgctccttatcctctaccatacgttgaagcnttgatttcgccacacaaggatgcaagttgttggcaagcaatcgaaccttagcaataaatattattttacctctattgtcatgtttggtctgctcattgccacacttgtatttacattattagctttacttgttagtgtgttagttgcctgagtagctagcttagtagtaatgtagttgtaactagcttagttg

SEQ ID NO: 11178 - DNA, 7166 bp, Zea mays
  misc_feature (3038)..(3038): n is a, c, g, or t
  misc_feature (5333)..(5333): n is a, c, g, or t
  misc_feature (6073)..(6073): n is a, c, g, or t
cttattcaaaattgaataaggaggggattttaacccctccaatcctcttcggattttagacttccaaactaacacttagaagaggaatttagcccattcaattctctcggtttttttggctcccaaactaccaatcaatggtttaatgatttttctttgccctaagcttgtctgctggaacgggaatgtgtcaagataggcttcttaacagctttgattctttggcagaaaactcgtattgttcaaaggaaaacgggagaccaggttcacttctaaaaacggaggaaccggcattggccccaaccggcaatgccagcacaacacatggatcctacaaaaatctcgggcacatggcatcgcggcgctgtccaaccggggggtgtgcccggcccggcgagccgcttgcttttattgtatttatatttatacgagccccatgggcgcttgcctcagtcgtttgcccctttggtccctctccctcccccgtccgccctgcactctccagctcaacaaggaagaagagggggccttcaccacaccactcgattcctctttagagcacgacttacgaagagtgcccaggccgtcgccgccgaccagcaaaagggctggaaagcccccctcttttgtgctgtgcgtgcaactcggctcctgccctgccatcttgctttccaagacccctgcgcccccagtcccataattagttaggattaggatcaccaccatttccaaatccttgcagagctgccgaagcgcggatcacagatgaagaggcaatccaagaggcccaccgccagccgcgaatccccagaaacaggtattgcgtccgtgatgtccgtgacagaataccaaatggagtatagtagttagtgaatagaaaagtacgtatgcgtgcttttgacatctgatcagtgttgcttctgcctgcattccattttttgcatttggttagcttgctgccacaaagctgcagaaagaacgggtctccccccttcattttggggaatcctccagtagctaaccgcacgcgcgaattgcaggggagaagcagaagctggcgttcgcggaggaagaggccccgccggcgcggaaggtggagcccgacgacgaggccgagatggacgaggacgaggacgagctgggcccgggcctgggcggcgggcgcgcggcgcggtcgccgtgcgggctcggggagaagaagcggcgcctggcgctggagcaggtgcgcgcgctggagcgctgcttcgagacggacaacaagctggacccggaccgcaaggcccgcatcgcgcgcgacctcgcgctgcagccgcgccaggtcgccgtctggttccagaaccgccgcgcccgctggaagaccaagacgctcgagcgcgacttcgcggcgctgcgcgcgcgccacgacgccctccgcgccgactgcgacgcgctccgccgcgacaaggacgccctcgccgccgaggtaattaaccgactgctcttgctctgtcatgtcatgtcatgtcaccgccggtcatggtcagcaaccgtctacgtactctccgcgtcttgtccggtgccacttccaacctgccgtcactcactgatgtcgttttggcgcgcgcgcgcgcccgctcggcgcttcttatcagataagggagctgaggcagaagctgctgcccaagccggaagccacggtgaagctggaggcgacgacgggcaatgacacggcggaggagcgccgccaggcgacggccggcgcgccgcccgcgggggcctgcaaggacggctcctcggacagcgactccagcgtggtcttcagcgacgtcgaggcgtcgccgtactccggcggcgcggggttcgagccgccggccttggccgggctcggcgcgccgttcctggacacgtcggtggcgccgacgggctgctcgtctccccccgttttcgtcgagaccaagtggcagcacgggccgacacagtacccgttcccattcgactcgtacaaggcctgcgccggctatggcttcacggaggaatggcccgcgagctcggacctcatcggcagcgacggcggcgcggcggggttcttctccgaggatcacgcctccagcctcaacttcaactggtgcccgagtggcatccagggctgggagtgaagaggggtttttgatctgcacggctagtgtaaaaaaaccgatgttacggtggcatttgtacatgcatggaactggagtctagtgacctggcctggcgagtgtggtgtggccaaagctagaggacatccagcgcaaaaggcgggaacaggagcagtagtagcctgtaacaataacggaataacttgagccagaaaaaaaaaaaaaaaagatgtaaatgtaaaaagaggctgtcgcaccactacggcactatcacttggatgcaacatgcaatgcagcaaatcggcgacgagagcgtctgaaggggaaactggtaagcaggctgcaatttacggtgccggatgagatacgtcaaacctctaatcaaaataaatgttctttgactcgtttacatttgaaattaacgtcttcagaaaaacaattttagtgttaaggtaaaaccgaagccgagcgacgaaggctatactacaagagccctgcggagcggtttgctttttccactttttttttcttcctttccttttcctaccacttcttcattctccttttaaaaaataaaaaaaaacggagggagggcttaaaaggggagcacggaagaaggtagaggggcaaaagctccgcctgttctaccactacatccgtccttgcaaaactcaacgaaagctcgatgaataggcttagggtgtgttggtaccctcctatattatataagttggattattatagtaaaaaagtagagagtaaaatatcactttgtgaccataaataaactaaaataagttaatattaggtagcttatttgtgatcataaagtgatattttactattctacctttacaccttaatccaacgtttgttcggttagctctcaatccatgtgaattgagtgacactgggtggatttanattccaaccaagtcaaatttcttcacaatttttcttaatctcatccaatccatatatgacgggattaatcgaacaatgtcttatataatgtaccattaatggcttttggtgaatggatgaccaaaagctcgatgaatcttgccaagttttcagcgggaacgatcttcatattcattttctggatgtatatggcggatagctagctctgacacgcttcataggcacctcatctacaaatgtgatgacaacaagcttcgtctgctattttgcacgatcaagttgctctggctaaatgtttgaatatttcagcgttaagtcctacacatgagactacaaaatgttcacttttacttggacagtggccaacaagtgagaagattatgaaaagatgatatagtcagccaagtcaaaacttcacatcagaattgaagacatacatggcttagtcggggtgataagataattacatgtcatacattagtgtttatgtagagcccaaaaaaaatccccttttgtagttataaatgatggagttttaagggctataaaaaaattaagggtttttaaggggatggttagagacaagttttttgtgtttatatatatatatatatatatatatatatatatatatatatatatatatatatatatatataacttgagttagggaagatttttgtgagcttctaagtaggcgatcgtaagaaatcaacattagatcagctaaatttagttagcagaatggtggccatgctcttcgctagtgcattgtatcgcggtattcacctaaaacaacggagatatttagttaatacaatcttcgtccaaaactataaaaacgttttgtttttataagcccgtagatttcactacttgtttatggaatggcatatcacaacttgggtgatttgaaaatgaagattagttaggaaaacaatcatggttggcaatccaggcctagagctagcggtgtgagtggagaggatccatggcatgtgaggcagcttggattccgaggctaccccggctggccaggatggcggcatgttccccttccaccgcgcacaaagcagaaccgcatccgcttttttttttaagaaaaaaaactcgagaaagatatgaacctccgaaccgtcgctaaaacatcgaaaatattgtacagcctgctttagaaaagatggccaattaaaagcaggctgcaaaggcgcctctaattcaggaaccgtgacgctctgtttccgtttatagaagccccgagtgcatttccaaattgcaagtggcagtcgccaaaccgaaaagtccagctttagtttagaaaaaagtgtccgccgatcgtgtcgatgcacctccctcaccctcaaagctagtttagggacacaaaaaccggaagaaattgggaagctaaaatccgctagtttgaaagcctaaaaatcacagatgattagatgagctaaaatcaattttttatttaatttttaataagaagtgtagattttagctcttctaatccactccgtttttgacactccaaaactaactagtcctcggagtcgccggcggcgccaatcagagcctgagaaagttttggcaaggtttggtacgcgtcgttgtcggctgtagggccgggcacgtacaacagtacaggcacaagcatcgcagacgagaaggcgtcgtcaacgtcggtcgagcgagtcacggttaacgctatttctttcacacggtgaagacgtcacgggaagtaagaggaaagggacagcaggtggctcgcggtcgcggcacaccaccacctcttggccatgtgggcacagttttatattggctcctgttggcgacccgcaacctggcagggtacgccgctgggggccgtagaaccagagctatctctgtctgtctggaactgccttcttcttgccacagatcatggacggtactaggcctgtagcggtgacatttgagggcagagcgctgtagctgcagttgcggaaactactgtgggcggccggggggtatatgcatgccacggcaagggggaaaaccatgcaagaggagagagagcgaccaagatgctcagcagatttgccgggagcgtgaacgaacgaacgaaggacgaacacatggagttattagctgtcgcgtaccccggacgcatcggccggttgatgtgccgtcaaggtcgcggggcccgtgtttttctccgcgagtcccgtgtgctggcgtttggcggggacgaacggaggaggagtctttgagaaagaattggagcgaaacgggacgacggcgagcgccgagttngcccacggcaacgggaccttcttcttcctggagcgttcgaagcagggtatcggaaactgagctagcgcgctcaggaacggccgaacatgtcggtgtccagatggattgctgcgctgtctcttgcgcggcgcagttgtcatgcgctgtacgctgctcttccagcgggaagaccgggctggtgacgcgtagagagggggggctgagctgttcgtcgcgcatctgtgtggcactctgctgtgaccgcaatgcaaccagagccagccaaggaccaccaccatgtcggctcagctgctctggtgccgacctggctccagcagccaacaacggctggcaagttccgaactagtagtcacaaagttggtcgcaacgcgcaagatagtgttctgaatgtacttcgggcgtgacatcttgtcgtccatggagtctacttttcgggacgctccctgcaattctatctccaaccaattcttggaaagtttaagcctcatctagttttatctaaccatcatcattatcatcatcataagacgtaccgtgccaaagtacctttaaggttcaagtttggattaagtcagtcaaacccatttaatttcgttcgccgttacaataaccaacacgaacatttatagcaccaaataagcacaatatttttttaacaatatattaggttggtagtctaacgttttatttgggacacctccagctccattaaattcggtagagcaggtcattaagtgctntaggaaaacgtgaaactggagatgtaagcctttagaaaatatttagataagtccttttatttattatttagattaaaaatatttttgaaactatttaaattgatattataaactacagctccacagtggaaaactgtaacctagagccattctaaacaccggctaagggttatttgctacaagtttttatatatatttaaactcttgtctgaatgcacatatgtccacctcaatccacatgtgtttaaagatgacattctcacaaactttattcaaacaagttgacatggtaatactatatgttgtttttcactgacgattagattgcttaacatctttcctaataaataatatcaaatatatgttttactattgttggttacaagtagtaaaaaaaacaacaaatcatagaaatgtgttagtgcacaataattaaacagttttaataaaatacatttttcttcacagtttcctattatgatagagttaagtctaattgatggaagtttatagatatattttgaccagcttcaaatctttttttttgtttctcatgtaccaatatatttgtagcattttcatactttttaaaaagtctatggaccttatgagcattatagtttttttggtttacgaaccatatgcgatgtttaaactattttaaattaaaattatgaaatagtgtttaaaaccatttatgaagacaagtgtgtcatttagtttctttttagagttaaagagattttttaaaaaaaattaaagctcatgaagggaaactagactatggaaataatctagaaagacaaaatgatggtttgattccttcgttcattatgacattattaggcctgcacaactagggatggaagtgggtaaggtacccaatggacatagaaggtcatacccttgcctactagagaaaaatgtcccatacccactacccaccacgggtactaggtagccatcgggtacccatacccactaagattataatagacatgatcatttgaatcgcaaaagtaagtacaaaatacaatatgctgaaactcctaacctcatcaatagtgaaagattttaaaataacatactatct

SEQ ID NO: 11179 - DNA, 1529 bp, Zea mays
agtcgtttccccctttggtccctctccctcccccgtccgccctgcactctccagctcaacaaggaagaagagggggccttcaccacaccactcgattcctctttagagcacgacttacgaagagtgcccaggccgtcgccgccgaccagcaaaagggctggaaagcccccctcttttgtgctgtgcgtgcaactcggctcctgccctgccatcttgctttccaagacccctgcgcccccagtcccataattagttaggattaggatcaccaccatttccaaatccttgcagagctgccgaagcgcggatcacagatgaagaggcaatccaagaggcccaccgccagccgcgaatccccagaaacaggggagaagcagaagctggcgttcgcggaggaagaggccccgccggcgcggaaggtggagcccgacgacgaggccgagatggacgaggacgaggacgagctgggcccgggcctgggcggcgggcgcgcggcgcggtcgccgtgcgggctcggggagaagaagcggcgcctggcgctggagcaggtgcgcgcgctggagcgctgcttcgagacggacaacaagctggacccggaccgcaaggcccgcatcgcgcgcgacctcgcgctgcagccccgccaggtcgccgtctggttccagaaccgccgcgcccgctggaagaccaagacgctcgagcgcgacttcgcggcgctgcgcgcgcgccacgacgcgctccgcgccgactgcgacgcgctccgccgcgacaaggacgccctcgccgccgagataagggagttgaggcagaagctgctgcccaagccggaagccacggtgaagctggaggcgacgacgggcaatgacacggcggaggagcgccgccaggcgacggccggcgcgccgcccgcgggggcctgcaaggacggctcctcggacagcgactccagcgtggtcttcagcgacgtcgaggcgtcgccgtactccggcggcgcggggttcgagccgccggccttggccgggctcggcgcgccgttcctggacacgtcggtggcgccgacgggctgctcgtctccccccgttttcgtcgagaccaagtggcagcacgggccgacacagtacccgttcccattcgactcgtacaaggcctgcgccggctatggcttcacggaggaatggcccgcgagctcggacctcatcggcagcgacggcggcgcggcggggttcttctccgaggatcacgcctccagcctcaacttcaactggtgcccgagtggcatccagggctgggagtgaagaggggtttttgatctgcacggctagtgtaaaaaaaccgatgttacggtggcatttgtacatgcatggaactggagtctagtgacctggcctggcgagtgtggtgtggccaaagctagaggacatccagcgcaaaaggcgggaacaggagcagtagtagcctgtaacaataacggaataacttgagccaggctagtaaaaaaagaggatgtaaatgcaaaaaaaaaaaaaaaaacc

SEQ ID NO: 11180 - DNA, 2149 bp, Zea mays
  misc_feature (34)..(35): n is a, c, g, or t
cattgggtacctcgaggccggccggggaaaaaanncattgggtacctcgaggccggccgggatcgaccccatcgcgttgccggatcgagctcagctctatctcgaaccttggttcgccgcacggcaccagaagcacggccgtgttctcatcccctccacacgtttccgcctcccgatccacgtccgccgttagccgcggccgacacagctcctcctcctcctcgcagctcttctccagctctcggaggcccgaggtttcatcgacccgcgctccttcatcctcgacacctcactccggcggcgcgggtccgcagtgctgcacatcgcgagccgcgcggcacagccgcacttgttgtccttcgtgcgtggggtgcggttcgacgcgggcggcgggatggcggcgagcgcgcgggacagcaccgatgcagcggagcgagttgtggatgaccacgacggctgggcgtcggacgccgagatggacgtggagatggatgtggtggaaggcgatgccgaccggagggacggcggcgcggatggtgatgatgagtacttgctgctcactaggataagggacacatcagcagctgaagcaagggcaggaaaggatatacaaggtataccatgggagaggatacacatagccaggcaagattaccgaaaagctaggttggaacagtataagaactatgaaaatttccctcaatcaggagagctcatggataagctatgcaagcaagtggagaagagcagcaagtattatgaatttcagcacaacactagatcagtgaagccatcaattctccattttcagcttaggaatttgttatgggcaacatcgaagcatgatgtctattttatgtcaaattccacagtaagccactggtcatcattgtctcacaaattatcagaggttcttgacttctctgggcatgttgctccagcggagaagtatcctggcagtttactagaaggtttctctggtgttcaagttagcacacttgctgtgaatgagggtttggtggtagctggcggttttcaaggagaactaattggcaaagatgtggaaggctgtagtgtaaaattctgtatgaggacaactttgagtgacaatgccataacaaatgccatagatatacacagatcgataagtggaagcctgcacattacagtatctaacaacgattgtggtgttcgtgaatatgatatggagagatatcagctcgtgaaccactaccgatataactggccggttaatcacacatccgtgagcccagataagaaacttttggctgtggttggagatgatcgagatgctcttcttgtggattcacgaaatggaaaggtaacctctaccctagttggccatctggactactcatttgctacggcatggcacccggacagccggacattcgcgaccgggaaccaggacaaaacctgccgcatctgggacacccgcaacttgtcgacctcacttgcagtactgcggggcaacatcggcgcgatccggtgcatccgctactcctccgacgggcggttcctggtgttctcggagcctgccgacttcgtccatgtgtacagtgtggctgcggactacaagaaacggcaggagatcgacttctttggtgaggtgtccgggatcacgctcagcccggacgatgagtccctgttcatcggagtgtgcgaccgcgtctatgccagcctgttgcagtacaggatgatccgcggattcgactatcttgactcatacgtgtgaagaactgagctttggtgactggtgttgtgctaggtgctggctgaaggttctgatgcgcggttcagggaatatatctgcctgctcttagttcatggcgaatgatggttcggtgggactcgacgccagcgaatctgccgtgtaaatagtttagaatttgaagcgtagtgtagtgctgtggaccaatgctgtctctgaacatacatatgatcagagtaatgtgtgtttgcgctgttagtttcagactccggaatacaaatagttttggaccaaattcctaaagcctgtttgtactgtggaacacatgaaagggctagtttgtattcacttcgatatatgtgttgttattattgcgttcccaaaaaaaaaaaaaaaaaaaaaaaaaaactcgagagt

SEQ ID NO: 11181 - DNA, 2018 bp, Zea mays
gcgggcaccagtcagcgacactggtgtgcaaatatcccgtccctgtccccgtcgtcacgtcttctagaaaacgccgttaccctatccccccccggtcgctatccaccccatcgcgttgccggatcgagcttggctctctcgaaccttgcttcgccgcacggcaccaaaagcacggccgcgctctcatccccctccacacgtttccgcctcccgatccatagccgccgtgagccgccgccgacatagctcctccctctcgcagctctccagctctcggaggcccgcggctcatcaacccgcgcttcttcattctcgacatctcacccggcggcgcggacgcgcagtgcacatcacgagccgcacggcacagccgctcttgttttccttcgtgggttgcggttcgacgcggccacgggatggcggcgagcgctcgggacagcgctgatgcggcggagcgagtcgtggatgaccacgacggctgggcgtcggacggcgagatgggcatggagatggatgtggaaggcgagttccacgaccgcgatgccgaccggagggatggcggcatggatggtgatgatgagtacttgctgctcactaggataagggacacatcagcagctgaagcaagggcaggaaaggatatacaaggtataccatgggagaggatacacatagccaggcaagattaccgaaaagctaggttggaacagtataagaactatgaaaatttccctcaatcaggagagctcatggataagttgtgcaagcaagtggagaagagcagcaagtattatgagtttcagcataacactagatcagtgaagccatcaattctccattttcagcttaggaatttgttatgggcaacctcgaggcatgatgtatattttatgtcaaattccacagtaacccattggtcatcattgtctcacaaattatcagaggttcttgacttctctgggcacattgctccggtggagaagcatcctggcagtttgctagaaggtttctctggggttcaagttagcacacttgctgtgaatgagggtttgttggtagctggtggttttcaaggagaactgattggcaaggatttggaaggatgtaatataaaattctgtgcaaggacaactttgagtgacaatgctataacaaatgccatagatatacacagatcgacaagtggaagcttgcgcattacggtatctaataacgattgcggtgttcgtgaatacgatatggagagatttcagctcttgaaccactaccgatataactggccagttaatcacacatctgtgagcccggataagaaacttttggctgtggttggagatgatcgggatgctcttcttgtggattcacggaatggaaaggtaacctctaccctagttggccatctggactactcatttgctacggcatggcacccggatagccggacctttgcgaccgggaaccaggacaaaacctgccgtatctgggacacccgcaacttgtcgacctcgcttgcggtattgcggggcaacatcggcgcgatccggtgcatacgctactcctctgatggacggttcctggtgttttcggagcctgcggactttgttcatgtgtacagcgtggctgcggactacaagaaacggcaggaaatcgacttcttcggtgaggtgtccgggatcaccctcagccctgatgacgagtccctgttcgttggagtgtgcgaccgtgtctatgccagcctgttgcagtacaggatgatccatgcattcgactatcttgattcatacgtgtgaaatggagctttggtgttgacgtgttgtgctcggtgctggctgaatgtcacttgttctcggtgacggttctggtgcgcggttcagggaatgtatctgcctgctcttctgcgctagttaatggcgaatgatgattcgttgggactaaaaaaaaaaaaaaaatgccatgtaaatagttcagcaattgaagcatagagctgtggaccaatactgtctgaacatatgagctga

SEQ ID NO: 11182 - DNA, 700 bp, Zea mays
aggtttcctttccaccaccgctactccgctaggttcagcagcggcaccagtcggctgagcggatctccggtgaggttgagggatcagggatggcgaacggcggcggctacgtgtgggcccttgcggcgggcttcaacgccgcgctcgccgccatctccgccaaattcatcgccactctgccgctcaaatatggcacggtgatacttttcaacgtgacaatgtgggggtgctacgtcaacagcctcaaagctttgtcgtccctccaggcaacagtcacaaacttcgccgccaacttcctctcgtctgggcttgcagggtatttcctgttcgaggagccgctgccttctaagtggtttgcaggtgccagcctcatcattcttggcgtcttcatcctcagcaagtccagcatcgaggagaaacagaacacggattaggtggaaaagttttgaccgctagtgttagctgtaacatatacgtactccgcataagctgagccatgggatgttttgtccgtccatgtagccgaatcagagcatgactgtcattcggctaatacaatgtagtgtagcaaacatgttgtgcgagttgtcacgccaggacatttgacatttcccacggtgctactggtacatcgagaatcatcgctgtaattgtatgtatgtggtgaattgatttcatttattttattatatttttattc

SEQ ID NO: 11183 - DNA, 2137 bp, Zea mays
ccggccgggatctgacgaagtttgcatgtgatgatctgacgatcggtttctttttcccccctcctcctcctcctcctccctccagcggctacaccctgctgcgcgacccgcggcacaacaagggcctggccttctcggaggcggagcgcgacgcgcactacctccggggcctgctgccgccggcgctggcgtcgcaggagctgcaggagaagaagctcatgcagaacctgcgccggtacgagcagccgctgcaccgctacatcgccatgatggacctgcaggagcgcaacgagaggctcttctacaagctcctcatcgacaacgtcgaggagctgctccccgtcgtctacacgcccaccgtcggcgaggcatgccagaagtacggcagcatctaccgccgcccgcaggggctgtacatcagcctcagagacaagggcaagatcctcgaggtgctcaagaactggcccgagaggagcatccaggtcatcgtcgtcaccgacggcgagcgcatcctcggcctcggtgatctcggttgccaggggatgggaattcccgttggcaagctctccctctacactgccctcggaggtgttcgaccgtcagcttgcctgcccatcacaattgatgtcggcaccaacaacgaggccttgctcaaggacgagttctacatcggcctccgccagaggcgtgccaccggcgaggagtaccatgaacttcttgaagagttcatgactgccgtcaagcaaaactacggcgagaaggtcctcacccagttcgaagacttcgccaaccacaacgcctttgacctgctcgagaagtacagggagagccatctcgtcttcaacgacgatatccagggaacagcctccgttgtcctcgctggcctcctggcggcgctcaaggtggtcggcgggacacttgcggaccacacttacctgttcctcggcgccggcgaggccggaaccggcattgctgagctcatcgctctcgagatgtcgaaacatactgggtctccgatcgaagagtgccgcccgaagatctggctgatggactccaagggcctgatcgtagcgtcacggaaggactcgctgcaggcgttcaagaagccatgggcgcacgagcacgagcccgtggcgaccctgctggaggccgtgcagtccctgaagccgacggtgctgatcggcacctcgggcaagggcggcaccttcaccaaggaggtggtggaggcgatggcgtcccagaacgagaagccggtcatcttcgcgctgtcgaacccgacctcgcactcggagtgcacggcggagcaggcctacacctggaccaagggccgcgcggtgttcgcgagcggcagccccttcgacagcgtggagctggacggcaaggtgctggtgccggggcagtccaacaacgcctacatcttcccggggttcggcctcggcgtcgtcatctccggcgccatccgcgtccgcgacgacatgctgctgggccgcctcggaggcgctggcggagcaggtcaccgaggagcacttcgccaaggggctcatcttcccgcccttcaccaacatccgcgccatctccgcgcgcatcgccgccaaggtggccgccaaggcctacgagctcggcctcgccagccgcctgccacgccctgacgatctcgtcaagtacgctgagagctgcatgtacacccccatctaccgcagctaccggtaaggaaaggaccatggccggggcggcggcctgagcaaaaggaaaggaaacgggtaaattatgagtcagtgagtgaataaagggtcgatgcgatatttgttgcagctagaggagtgagtttacacatactttcatttctatacactgtatttctgtgtaccgtatacggcataccatacaacactactacatactcgtcagtcatttcaatacagttaatgtacctggttagaacgctatcactctacatttacctagagccatctcaatgtcaaatttgtttttatataaattaaataaaattgcataatttataattaagcaaataaaatttcataatttattaattattaaataattaaaattacgtaacttgcataaaaataaaaaatattttataaataaacttacttaatgtaaacatctattg

SEQ ID NO: 11184 - DNA, 6425 bp, Zea mays
  misc_feature (816)..(816): n is a, c, g, or t
  misc_feature (2986)..(2986): n is a, c, g, or t
atccatgaacaatatccatctaaccaaatcaccccacacctataacctctactaaattcactaaacaacttacactcggacttaacacaccatcaaaacgaatgattcaaatcgctggataatcctatctcacttagtcaaatccaatagataatattatttagatcatccttctctctctcttacgaccctgccgcccccaacctcctcctctccctcccctcgtatccccgccacccctccccctcccctcattcgcctcgtcgccatcgtcgttgaccctcctctcttctggatcgtagcgttaacacgagctatatattagtctattttagcgttttggttgtttctttttctttgcccttccatgtctccataatcatgcaacatcgtaattcttgcacttcctcctttctttagctatctccagtagctcttctatttcatcacatatatcaaactccactctctgtctatattataaaaatatattttatatgactatatacacgatatgctgaacacaaccttaatattcgttctttccatgtgtataaactcatcgcaccgtttcatgtcgttgcctccacctccgtctcaaggttgctagatagtagtatacgtccaagtccaaatacaattggatatgctcacgcaaatgtcaaaacttagaccatgtttagatagactaaaaaagattgtagctgctacaaaaatctcagatagactaaaaaaacatggtacagaaatctcttagatagactaaaaaaagatggtagctgctataaaaatctctagacggtgcaaacagcttgntttatagcccgttcgaaactattcaactacccagatggtcaaaaaaagctattagccgctctcttaggctattgtagcttatggaaagtttagctgatctaaatgaagttttactcaaagaacctctaaacgcttatctttacaagtcgtgtctaaagaagtctattatattaaaaaaatagattgatgatattttttcccgaacagatcccgtggagaaaaatctgcatgaaaatatatatccgaaaagttatgtttaaaaaccgtactaaaagtttaaagtaaaaacattgcttcaagggatcaagtagtatataatttaagtagtctctactcactaccggaatcagcagctttatcgagtgtctaaaacactcgacaaagcttgaaaaacactcggcgaaggctttcctgggtgtaacaatcagtaaagaaagttcggtgaactgtacatcgataacaacttatttgtcgagtactttttatcggacactcgacaaagactttgccgagtgtcaacctataatcggtaaataaaagtccccgtcacggcgacggagcctgtgccgagtgcccacagagtggcacttggcaaaggctcactctttgccgagtgtccactctactacattaagaatcagtttccacgattgtatgatcctcgtgctccatacgtttaaatgtaaaatttttaaaattatgtacaaatgaggatttaaactatagttgttggcttttaaatctagattcacgtagaacacatatatttttatattttatacttcctatttataaatgaaaaccgcaacaatatactctcactagcaggcagatagtaaaacccagagttacgatgggaaataaaatttaggaaaataagtacggagcacgttggacggtgcgcgatagcgagcaatggtacgtgggcgcccgtgcgccaatccgccaaccagaaagaaggcgctactgtggtttggatctggcacgcagttttcctgtggatttatggcggtaatactaatacatacagcgtccgcggcacacctagtcatcaaaacagtcggcactccggcagtggtccggtgcgcgcgctcgcccctgcctgctgcgtgcgcaagcaagatggccaatggcagcggcagccactgctagtaagttacagtacgtgcaatatttcggtgcaaggcggcggcgttcgcgtaccataccaggcgcggaagccaggcccgctgctggaacaccaaactcatcagcaggcaggatcccggctcaccagccgaccggcaccgaggccgacgactgctccaccaccaccaagtcaccaacccattgggcattgggccttggtctgccttcctcgccgcgtcggcgggcagcttcccttccccaccggccaccaccagcaggcagcagcagcagcagctgcaggacacacaccacctttccacaagttccctttggctttcctccctcgccgcggcgtttaccatccgctcgcgtccccgacctttcctcgcttccacacgcggcgggccccagccgtggcaaacctgggctgggagggggagcgactaggactactacttttcagggcccctgcccctgcccgtggagactactcagcgtctggagcgctataaatccgcgtcaccgtccgttgcttcttcttccacatccgtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaaggtcccatcgattcggatccattcccatgctcacgatctcgtcttcttccacctctctctctctctcggctctcgccctcgcgcgccgcctgcctacgctaaccaaacattcctctccacgttatgcgaaagctgccttttcttttgccgtcttcgtccaaacatcttcgattcgtcgccattcgccacagttttgcacattttttttcatcaattattattattcttatggtatacagtagtattgtacagtagaccgacaccagtcagcgatttcttccagngtataatatattatgcgcgcgtaaaagcgtatctgacgaagtttgcatgtcatgatctgacgatcggtttctttttccctcctcctcctccatccagcggctacaccctgctgcgcgacccgcggcacaacaagggcctggccttctcggaggcggagcgcgacgcgcactacctccggggcctgctgccgccggcgctggcgtcgcaggagctgcaggagaagaagctcatgcagaacctgcgccggtacgagcagccgctgcaccgctacatcgccatgatggacctgcaggagcgcaacgagaggctcttctacaagctcctcatcgacaacgtcgaggagctgctccccgtcgtctacacgcccaccgtcggcgaggcatgccagaagtacggcagcatctaccgccgcccgcaggggctgtacatcagcctcagggacaagtaattcactctctctgttctactctatctctccttctccgtctctttcttctgtgttcttcctccattgctctgtacttattcatgcgcgctgccttttcaaccaggggcaagatcctcgaggtgctcaagaactggcccgagaggagcatccaggtcatcgtcgtcaccgacggcgagcgcatcctcggcctcggtgatctcggttgccaggggatgggaattcccgttggcaagctctccctctacactgccctcggaggtgttcgcccgtcagctgtaagtgctgctcacaatgctcattcttcagtattactactctgtcggaataaacttgtagcactagtcgtagtaggaaagatttggaatcgattttttttcttcagtattactactacttcagtattattggtcgtaataatgtttaccctcctgcagtgcctgcccatcacaattgatgtcggcaccaacaacgaggccttgctcaaggacgagttctacatcggcctccgccagaggcgtgccaccggcgaggtcagcaactcatctgcaatcccctccattgatttagttctacccctacatggctgttctgttcacccacttgcagctggtgattttgttcaacctgtaaccagtctcttgtctggattattgagacgtggcttgtgtttttgatggttcacaggagtaccatgaacttcttgaagagttcatgaccgccgtcaagcaaaactacggcgagaaggtcctcacccaggtcagtctcagtggaccagccacagatactaccagctgttggttttcgcctttttggccgaactttctctcatcctggatctgaaatggatgttctttttgacctctgaccgtgcagttcgaagacttcgccaaccacaacgcctttgacctgctcgagaagtacagggagagccatctcgtcttcaacgacgatatccaggtaggctaggctttccttgtgacagcgcatcacaggcaaacagcagcaccgtggatgccaagttcagaacaggggcctgcctgttctgtgctcgttccgtcgtccgtttctttccaccgcgctgaacgaaaacgatgcggatgtgtgtgattgctgcagggaacagcctccgtggtcctcgctggcctcctggcggcgctcaaggtggtcggcgggacactggcggaccacacttacctgttcctcggcgccggcgaggtcggtcgatttgacttgctagtatactgcatctgcatcagtgttaccctatcttttctttgccgatcaaagcttcggatcactcgcggcctcattcttttcgctgattacgctgtgttggtccatctgcaggccgggactggcattgccgagctcattgctctcgagatgtccaaacatgtaagcaactaatttgccactctgtccaatgatcgatcttttttttttttttttggaaaaaaaagaattaccgttcccgatgtgttgattgttccaaatacaaattaacataacaataaatataagcagactgggtctccgatcgaagagtgccgcccgaagatctggctgatggactccaagggcctgatcgtggcgtcacggaaggactcgctgcaggcgttcaagaagccatgggcgcacgagcacgagcccgtggcgaccctgctggaggccgtgcagtccctgaagccgacggtgctgatcggcacctcgggcaagggcggcaccttcaccaaggaggtggtggaggcgatggcgtcccagaacgagaagccggtcatcttcgcgctgtcgaacccgacctcgcactcggagtgcacggcggagcaggcctacacctggaccaagggccgcgcggtgttcgcgagcggcagccccttcgacagcgtggagctggacggcaaggtgctggtgccggggcagtccaacaacgcctacatcttcccggggttcggcctcggcgtcgtcatctccggcgccatccgcgtccgcgacgacatgctgctggccgcctcggaggcgctggcggagcaggtcaccgaggagcacttcgctaaggggctcatcttcccgcccttcaccaacatccgcgccatctccgcgcgcatcgccgccaaggtggccgccaaggcctacgagctcggcctcgccagccgcctgccacgccctgacgatctcgtcaagtacgctgagagctgcatgtacacccccatctaccgcagctaccggtaaggaccatggccggggcggcggcctgagcaaaaagaaaggaaacgggtaaattatgagtcagtgagtgaataaagggtcgatgcgatatttgttgcagctagaggagtgagtttacacatactttcatttctatacactgtatttctgtgtaccgtatacggcataccatacaacactactacatactcgtcagtcatttcaatacagttaatgtacctggttagaacgctaccgctctatatttacctagagccggcccagtgtcaaatttgtttttatataaaataaataaaattgcataatttataattaagcaaataaaatttcataatttattaaataattaaaattatgtaacttgcatacaaataaaaaaataatttataaataaatttacttaatttaaacataaaaataaaaagcatataattcataaataaaacctaatttatagttggattctagaattattttgaacttttaaatcttttcaaaattttcaaccttgttcgcaatctctcttgatgagtgtattgttaataccacctcacaaacataaagaagcaacaaagaaaggataactcatctcaatggcagaaggctaaacaaaaaagccaagataaggtcattagaaatgagaaaaacttggttgccaaagatataaggcaacgactcaataaaaataagaaaaaaatggctagccctcaagaagggactaagaaaggctcaataccactagccaataatctaagcaaaagatg

SEQ ID NO: 11185 - DNA, 2177 bp, Zea mays
aaaaaacccgcccggccgcccgtggagactactcggcgtctggagcgctataaatcccccttggggacccccgggccggccgggacatccgtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaagcggctacaccctgctgcgcgacccgcggcacaacaagggcctggccttctcggaggcggagcgcgacgcgcactacctccggggcctgctgccgccggcgctggcgtcgcaggagctgcaggagaagaagctcatgcagaacctgcgccggtacgagcagccgctgcaccgctacatcgccatgatggacctgcaggagcgcaacgagaggctcttctacaagctcctcatcgacaacgtcgaggagctgctccccgtcgtctacacgcccaccgtcggcgaggcatgccagaagtacggcagcatctaccgccgcccgcaggggctgtacatcagcctcagggacaagggcaagatcctcgaggtgctcaagaactggcccgagaggagcatccaggtcatcgtcgtcaccgacggcgagcgcatcctcggcctcggtgatctcggttgccaggggatgggaattcccgttggcaagctctccctctacactgccctcggaggtgttcgcccgtcagcttgcctgcccatcacaattgatgtcggcaccaacaacgaggccttgctcaaggacgagttctacatcggcctccgccagaggcgtgccaccggcgaggagtaccatgaacttcttgaagagttcatgactgccgtcaagcaaaactacggcgagaaggtcctcacccagttcgaagacttcgccaaccacaacgcctttgacctgctcgagaagtacagggagagccatctcgtcttcaacgacgatatccagggaacagcctccgttgtcctcgctggcctcctggcggcgctcaaggtggtcggcgggacacttgcggaccacacttacctgttcctcggcgccggcgaggccgggactggcattgctgagctcattgctctcgagatgtccaaacatactgggtctccgatcgaagagtgccgcccgaagatctggctgatggactccaagggcctgatcgtggcgtcacggaaggactcgctgcaggcgttcaagaagccatgggcgcacgagcacgagcccgtggcgaccctgctggaggccgtgcagtccctgaagccgacggtgctgatcggcacctcgggcaagggcggcaccttcaccaaggaggtggtggaggcgatggcgtcccagaacgagaagccggtcatcttcgcgctgtcgaacccgacctcgcactcggagtgcacggcggagcaggcctacacctggaccaagggccgcgcggtgttcgcgagcggcagccccttcgacagcgtggagctggacggcaaggtgctggtgccggggcagtccaacaacgcctacatcttcccggggttcggcctcggcgtcgtcatctccggcgccatccgcgtccgcgacgacatgctgctggccgcctcggaggcgctggcggagcaggtcaccgaggagcacttcgccaaggggctcatcttcccgcccttcaccaacatccgcgccatctccgcgcgcatcgccgccaaggtggccgccaaggcctacgagctcggcctcgccagccgcctgccacgccccgacgatctcgtcaagtacgctgagagctgcatgtacacccccatctaccgcagctaccggtaaggaccatggccggggcggcggcctgagcaaaaggaaaggaaacgggtaaattatgagtcagtgagtgaataaagggtcgatgtgatatttgttgcagctagaggagtgagtttacacatactttcatttctatacaatgtatttctgtgtaccgtatacggcataccataccacactactacatactcgtcagagaaaaaaaaaaagggaagccccccccgcggtgctgaaaaaaaaaaaaaaaaaagcggcc

SEQ ID NO: 11186 - DNA, 2194 bp, Zea mays
ggatagcttgttttacccttgctatcctacccgcattgcaaccttggtagggtagcgggtaagggtgtggtgttttgctctagcggagaatcagttcagaaatgcaattatagtcaattactaccagacaatggctagtgtccctagccagaagcttcattttttcaagtttgaattggttcatgctcaaacacgtgtttgatggatatttactccttctcccaccagtttttggatgccccctactgcaacaccaactgatgagcatgtgagagaatttgtgttgtcacctcgatgggcaccggagtgtcaggggaacaataacctcaaatcagaaaaggttgtcaagtcatatgcagacatagtgaagaagaacacatttgtggaagttgggacaagagatgtggatgtggaacatgcaggctcaggtgatgaatcttctggtggtttcgatgaactggattgtcagtacacaccaacagagagggaggactacgctctatcagatagggtggttcaagtgcaacaacagtaccctgataagcaggcagaagtgcttagctttgatcgggttttacaagggcgcatcacttttcctggtcagcagtggcattctgatttttatgccaatactacccaaactgaggataacgatgcatatagctgcgagtatgcccaagaggtcaaatatgcaattctggatggcagctctaatttgccagaaaccttagattctgaagttgataaactgtccctggggcattctgatttgctggtgcagttgttggactctgaatcatgcacagaagctaagctgattgatgcagtgaaacagttatctggacgaatagaggtgatggagaagaagcaggcttggtccaacaaagaagtcaaacatctacaagggatgaatgagaggttactgaaaagaattgttgaactaaagggaaccgttatgacattgaattctaaaatagatcctttaaccctagatgattcacttaaccagtttgtagaacaatgtttgggttcagaagatgtcatttatttagttggtggttttgatggcttctcatctttgccatcactagactctttttccccttcattggacatactaacaccccttaaaccaatggctgttggcaagtcatattcctcaactgttgcactagagggcaagatatttgttcttggtggtggtgacggtgcttgctggtttgatacagttgactgttatgaccgaagccgtgatgattggtccacatgcccatcgttgacttgtgacaaggggagccttgctggggttaatgtcaacgggagaatctatgcatttggtggtggagatggaaccaagtgtttctctgatgttgaaatgtttgatcctgtgcatggaaagtggataaagaatcaacctatgctggaaaagcgctttgctctagctggtgtagcactaaatggtgcgatttatgctgttggtggcttcaatggtgttcaatatttgagctgtgctgaaagacttgatcctcgggagcctaactggaaaatgctaccaaagatgagtgcaggaaggggctgtcatacacttacagttcttaatgagaagatattctcgattggtggatatgacactagggctaaagcaatggtgtctactgttgaggtgtgcgggcctagcatcccagcgtgcgcgggggttgaacccatgaactacaccagaggatatcattcttcagctgtgctcggtggctcaatattcacctttggtggggtgaaaggtgaagcagacacaatcttggatgtggtggaacactacaaggaagggtgtggctggatgacaacgggattgaagtcgattggcagaagatgctactgctcagcgattgttctctgactgtaactgccttaaaaccaagtgagaatgaggagactgataataggtaaaactaatatattaatattaggtaaaaactaagaaggctcttgcttagcctgaactgacaacactagacacgatggacctcgtagtttctgaatcggcgaactgtaaaacaaacattgagctgtttgtgttgtccgacactggatggtgggtggatgcatgcatgagtgaatcggtactgaactgatgtagagatgacacttccatggatgaatatccaagtatttgactctggatgttgagccttttctc

SEQ ID NO: 11187 - DNA, 1880 bp, Zea mays
  misc_feature (1243)..(1243): n is a, c, g, or t
  misc_feature (1477)..(1477): n is a, c, g, or t
  misc_feature (1624)..(1625): n is a, c, g, or t
  misc_feature (1642)..(1642): n is a, c, g, or t
ccacgcggcttgggaccctcgcggccgggccgggcttcgcgttcccaacctacccctgcaagccattgccctcgcctatcgcctcgtgcaagtccaagctcccacgactccaccgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgctacaacgggccagtttgcattcaccacttcagaagctggaaactaccttgcatgtttctggatagacagcgtggagaaaggatcaggaacatctctaaatcttgattggaagatagggattgctgcaaaggactgggatactattgctaagaaagagaaaattgagggcgtagaactagagcttaggaaacttgaagctgcagtcgagtccatccatcataacttgctgtatctcaaagcaagggaagctgacatgcgaacagtgagcgagagaacgaattctagagttgcctggttcagcatcctgtcattgggagtctgcgttgccgtctctgtgctgcagctgtggcaccttcaagggttcttccggaagaagaagctcatttaaattcacgttttatcagtgtgtacttcccgtgttaaataccttaggaggacaattgtcaaatttatttcaaaaggaaactcgtatgatggacaaaacatgtctttgatacatgacttgaaactagcaacctatattccgtggaattgaggtcgaccttccatcttgattgccttgcaactgccggtaaaaaaaaaaaaaaaaattcaactccttattctcaaattgaataaggagaggattctatcccctctaattcgctccggttttgtgactaccaaactagcccttgggaacccaattttttccaagggatttccattttttccaagagaaattagttcattttcctttacgaaaatagaaatcacttagggctagtttgggaactctattttcccaagggagagtgaactaatttcccttgggaaaatgaaaatccnttaggtcttgttcggttaatcccgttacccatagattggatgagatcgaaaaaattaagaagaagtttgacttgcttggaatttaaacccacccaatcacactcaatccaaatggattgagagctaaccgaacaagcccttagaaaaatgtggttcccaaactagcccttaggaaaatggagtttccaaactagcccggagattatttgcagctgctggtgcatggtctgatgnattcttgaatgttattaatacagggaagctgacatgcgaacagtgagcgagagaacgaattctagagttgcctggttcagcatcctgtcccggggccgctgcgttcccgggctctgtgcttgcagctttgtggctactcttcaaggnngttcttccggaagaagnaagctcatttaaattcacgttttatcagtgtgtacttcccgtgttaaataccttaggaggacaattgtcaaatttatttcaaaaggaaactcgtatgatggacaaaacatgtctttgatacatgacttgaaactagcaacctatattccgtggaattgaggtcgaccttccatcttgattgccttgcagctgccggtaaataatgagtgctacgttcaatttttctcattatctgcca

SEQ ID NO: 11188 - DNA, 1839 bp, Zea mays
  misc_feature (1420)..(1420): n is a, c, g, or t
aaaaatgtccagcccttcgcagcatgtagttgacaagaagccaatttttcagaaaaaaacacgtggttgccgagcgagcccgtaccggtctacgtgtcattgtgtcagggctgtttgatgattttgcgctggggaatctgcgtcaccagtcaccactgagacggaaccgagtaaccgacccacgcaaaaagcgctcagcagctcctgcgcgcccccttcccccgtcggccgatttcgtttatctcctcaatcctggcttgaatccgtgatacgtcgaggcggcgaagagccgaatcgtgccgcaccgtagaggaggctcaggcttctgcagggttttggagcggggcgatggaggcggcgagcaacggtgggctgctgtaccacgaggtgcaggaggggaagctctgcgccgtgcactgcgtcaacaccactctgcagggccccttcttctccgagttcgacctcgccgcgctcgccgccgacctcgaccagcgggagcgcctggtgatgctcgagggctcccgaagccccggcgcggacaacgctaccgcaggggacttcttcgccgagggcgaggggtcccacaacgtctccctcggcggagatttcagcatccaggtttgtgcagagccctccaggtccaggcttcatggaggttatccatttaggtttcttgggctcggttagatcgaccgatgcgtacatcacggcttcttccgtggactcggttacaagttggttgtctattaagatcgctgcgggcattttttgctcgagcattgctgcttggaacccgtcgattgccttctagtctagtcgaatgctctaggttaaatgtggcgatatatacttcaattagatggatttggtaacatcaaagggagttacttgaagcagacaaactcgcagggtttagtttatatatagaataaacgaaaattaggtagtcaatgcattatgccagtcatgtgaagaatgcttatcgagtgattgcatgagtaaagactttctcgttgaacatagatgattcaatcctatccctattctaatggtacttaggcaacctcctgcattcataaccatgctctgccagatgtgaaagggaattctgagggataaacagtacttgtctttgacactcaaataactgcattaaaatttgcatgattctctgcaggtcgtttgatataggattgtattttttttgcatcactggaaagtttagatgtagttgtttcctgtataaacaatagcaaatgtcttaccagcggtttgcaacagtttgcgctacgtacttgcttgcaccaatgcatgtgcatgcatgctagtgtaacgtattctattgtcgttacactgttcaaaattatttgattgatgtacatattcaagagtttatctgactaatgtagcttaacttttntcgtgtactgacttgctgacattaagaatgaattcagtcttacagtttatgtcaattgactgaaattgttctttgatttgaattaggaatatgatcaagcttggtagcggtgttaaagttagaagctttaaggttttaaatgctatttctatttaatctgctccataaacaattgtggaaagataactcgatggatgtctgaattctgaaaagtttcacaagtcgctaaaattcggtgttaccagatacccatttagccgtgtccttcctttttttttgacaagtcggacatgttggattccgactcctggcattggattccaagtggtatttggtgtgttcccaaataatttgcagtagacactggcaaccactgttgtcgtttttttatatatttttttatcgaacgcgcaggagaa

SEQ ID NO: 11189 - DNA, 1477 bp, Zea mays
cattgggtacctcgaggccggccgggggggaaatcgcgtcaccagtcaccactgagacggaaccgagtaaccgacccacgcaaaaagcgctcagcagctcctgcgcgccccctttcccccgtcggccgatttcgtttatctcctcaatcctggcttgaatccgtgatacgtcgaggcggcgaagagccgaatcgtgccgcaccgtagaggaggctcaggcttctgcagggttttggagcggggcgatggaggcggcgagcaacggtgggctgctgtaccacgaggtgcaggaggggaagctctgcgccgtgcactgcgtcaacaccactctgcagggccccttcttctccgagttcgacctcgccgcgctcgccgccgacctcgaccagcgggagcgcctggtgatgctcgagggctcccgaagccccggcgcggacaacgctaccgcaggggacttcttcgccgagggcgaggggtcccacaacgtctccctcggcggagatttcagcatccaggttttgcagaaggcgctggaggtttgggacctccaggttatcccccttgattccccagctgcagggtcgtcccaatttgaccctgagcaggaggttgctttcatttgccaccttcaggaccactggttttgcatcaggaaggtgaatggggagtggtataacttcaatagtctgtacccagctcctgagcacctgtcaaagttttacctctcagctttcattgacaccctgaaggggtcaggctggagtatctttgcagtcagaggcaattttcccaaggagtgccctatggcaactgaaggctctaacggttttggtcaatggctcacccctgatgacgcccggaggataacagcctcctgtaaccaggttcaagcacctactcagcaggtacaaccccctctacttggtgaccgatcaggagggatgagtgaaatggacatgattgtagcgcagcaagaagaggctgatctgaatgctgctatagctgctagcttgatggacactgggggtccatttgccagctatgatgcagatcaagaatacagcaactcacaagatgctcctgccgctggaccagctcggagcaaagaagaagctgataaatctgagccgagcgcacctccctgtgaggaggaaactcaggagttggcttcaggaagcgacaccaaaagggaggtttcttctgtagaggagaaaggaacagcgagagaagaataggatggcacttttgatcagtctgtaactgagttagactatacacagagaaactgccctccatttcagtggagttatgccttttttggttccgaacgccgtacgtataccaaaatgcatagtctgaactgaatgggcttaaaaactttaactggtgtaactgctatgtgcgaactgcatagagactagagtggccgttttgaaccccccctcccccgggttttttttcaaaaaaaaaaaaaaaa

SEQ ID NO: 11190 - DNA, 1144 bp, Zea mays
  misc_feature (956)..(956): n is a, c, g, or t
catatctgttgtgtattgaactatagttttaccataatttggaggtgttgaaatttttgtcgggctaaagattgacctggcccttttttttgtcgtgcttagtgggccgatctggcgcgaaccagcctgtagagctgtgccagggacgaaggctggaccacgtaaggacgcctatgaagcactgcgtgccgtgtcggaccggcctgttggccatccatgtcatcgtgtcaaggctttttgatagttttgacttttgagagtctgcttcaccaccgagacggacacgacccacgccattggcaccctcgacagcgccgcgccggcctttccccgtcggccggtttcatttacctcctcaatcctggcttgaacctgtgacccgtcgaggcggcgaagggccgaatcgcaccgcagaccgcactgtagggagaagcttctgcaaggttttggagcgggcgatggaggcggcgagcaacggcgggctgctctaccacgaggtacaggaagggaagctctgcgccgtgcattgcgtcaacaccgccctgcagggccccttcttctccgagttcgacctcgccgcgctcgccgccgacctcgaccagcgggagcgcctggtgatgctcgagggctcccgaagccccggtgcgggcaacgctgctgcaggggacttcttcgccgagggcgagggatctcacaacgtctcccttggcggcgatttcagcatccaggttttgcagaaggcgctggaggtttgggatctccaagttataccccttgattccccagctgcagggtcgtccctatttgacccagagcaggaggttgctttcatttgccacctgcaggaccactggttctgcatgaggaaggtgagcggggagtggtacaactttaatagtctctacccagctcccgagcacctgtcggagttttacctctcagctttcattgacacncctgaaggggtcaggctggagtatatttgcagttagaggcaatttccccaaggagtgccctatggcaaccgaaggctctaacggtttcggtcaatggtttacacctgatgacgcccgggagataacagcctcatgtaaccaggtgcaaacaccacctaatcagcaggtacaatcccctctacttgctg

SEQ ID NO: 11191 - DNA, 953 bp, Zea mays
tgaacaaacagttagagttagaaccctaactgttcatctcgtcctccttccccgatggcggccggcgcggccctgcagccagcgtgggcgcgcggccccggcgagcgcggcccggcgcaggcacagcagcctcgacgccgatcctctctggcgcgtggcgccgaccatggcccagcccgacgcggctgcggcggtccggtggcctggcccccacgcctagcatggggcccggcgcggctgcccggccacggcacgggcgcgtaggcgacggccccgtccctgacggcgcgcgggcgcagccccggtgtggcgggcacggcctccagcgggcgcggccttagccgcggaggcgagcgcgcggcctcggcccgatggcgggcgcggccccgtgggcggcgcgtgggcgctaggccccatgcgcgacggtgcgggcgcgaggccccctacgcgacggtgtgcgcgcatgggcaggcggccccgacgggcgtctcccctgtccaggcctcggcggcctctgcggtgcggccccaccatcctgcgggctcgtggccacggcatgagtgtgctgccacggctgggcggtcgggcaccggcgcgggcacgaccccatcctggcacaggcgccatagccatgcccgcatgcgccttggccgtcgtcgctgttcacttggatgcaggcaagcaaaagcctgcaggtctcaagcgcaggagtggcagaaatattcattaataatgaacttgtaagtgtgcagttcgtaccttgtaaaatcagacttctctgatttgtttatttgaacgaatgctcttataaaattggtgattttgtctgagggaacactaaggagcactgcttgtgcgtgcggcaattggacagggacttcatgcaggaaccgtttgttgatggcagtgccctattcttgtcgagaacaacaagtattctccttcgcatccct

SEQ ID NO: 11192 - DNA, 3018 bp, Zea mays
  misc_feature (26)..(26): n is a, c, g, or t
gtcaagtgactaaactttagtccctncactgtttggttgcagggactaaaagtattcagaacgcattaaatgactcataagaagactaaaacgccccttaactctcttccgcaattagcacaactaaaataaatatggggcaaaagttgaaattaatatgatttagccccttttagtcgccccttgagggatcagagactaaataagtttagtcctgttttagtcttaccgtttagctatttaggaactaaatgagactaaaatagagaaacttatctttagtccctaaacaaacgaggcctaaatgttgggtcgtttcgaacttagtacaaaagcaacaaataatcttagggtctgtttagtttctttagtccaggtactaaattttagtcgagtggctgaagtttagtctctaccttatttgtttgtagggactaaaagtattcagaacacattaaatgactcataagaagactaaaatgccccttaatattcttccaccattagtgcaactgaaataaataaggggcaaaatgtagaattaatatgatttagtcccttttagtcacatcttgagggactagagactaaaatagtttagtcccactgtttaactatttagggactaaataagactaaaatggaggaactaatctttagtcccttaaacaaaacgggcattacttccatgctatttcttttagttatattatatcctttgtaagtagcatgcatgcccttttccaaatcttgattttaataaatttagatactagtattttaggcttagcggcttaaccatttatctttctagaaactgatttgagaataattatgtaacatgaactttcccaaattaagaaattgatctttgacctccatatataaggcctgcctagaaaacgagaaatcctagcttttttttcttgcattggctaagagtttggttacataaatacttattccagagaacatctttccataaaccattctcactacatagtttgaaaagccattgtaagagacatttgttttgcaaatctggattttgaatgctcaaaccaccttgttttttaagttacacaaaatatttcacttggttagtctatttttcttaaactggccattgttttccaaaaaaaaaaatgatctaaagtatccaaaatttttaagatgtccttagcttgcatgggatcttatattcgttgttttgtcagtttgtctgccactctgggctgcatgcatctctgtaaaacgtaacgatgaggattcatgtctgttgctttgcattgtactgtattagtattgactgaactgtttacttttgttctagtgtttggatccatccttgttttttaaaactgatttattgattttgtttataaaaattggcttttaaagaaattagcagaagttgtttggattccacctagtttcttagaaactggttttagctaagggagactagcttcttggtttttaagaaactgagaaacaagtttttagaaactaactaaaaaactgactgttcggagacctttcagcttttgaaaaccagttcctaaggaactaggtggatccaaacagagcctaaaactagtaaactatatatatgttggttgtcgttatctgaaaccggtttgattgttattagaaattaactactgtccaataacaataagttggagtttctaatcactttatatttgtttaatttgttgtgagactcatgcatgcatatctgatgaatcattctcattctcatgagagaaagatatgtaagtttccaaaagttttagtctgacagaacttgtgcactcgatctggggtccggacctgatgattcttgcgatccttattgccacatacctaccaaacggaaacgtgggcgagccctatccactggctgtactgagacaacctcatctcacgaaacaatgcaacaaaagtttggagcgctgtatataaattcgcttattagtaccatatgattgctgttgcaaattacgttccctctagtctctactctagccccctctctctctcacacacacacacacccctatcacttggactgtgctagtataggtagccgccgtgtaatggagcaggagctcagccttgagctcaccctcttccacccctcggtctcgccggaaccgccgggctatttcgtctgcacgtactgcgaccgcaagttcttcacctcgcaggctctcggtggccaccagaacgcgcacaagtacgagcgcagcctggccaagcgccggcgggagatcgccaccgccctgcgcgcgcacggggcggccgccaccgccacgggcgtccaggacgccgccgctatgggctctcgcgatgtccccgccaggccccaaggcacgggtagcggtgccgacaagagcgcaacaaggatggataagcacaaggcgcctgctgatgatgccgctcccgcgcctgccgcgtcgagcaacaggaagaggtcgtcggaggagctggacctctccctcaggctttgattggttcctcttcctcgtccacctttaattggcccatttgtttacataattcgatccgtataaatgagtgcaagcatctgtttcgagtgtgtgtggtatctctagatccatcacttcttcctcatgtagtacgttgtgcagttatgttcttccatatgatgatgccacttatcggcaagaactgttgtcgttccatgcatcctgctacccaaagggcgcgtgtggtatttggtattctattcggttgtgccttgagtcctctttgtacgtaattagtttttagcactcaattaaaataataatggaaagggcagcaagagttttgctgcaatgtttggggcttttcaagtgattctaaattgcacttacgccatgtcaaactttgtgcaaaaaaaaaaaaaaaattatactagtagtaatatatacttcgactcctttactagtctaattgatatctctcgcgcctcgcgtgccccagaattattcagtaataatatatatc

SEQ ID NO: 11193 - DNA, 3813 bp, Zea mays
  misc_feature (3062)..(3062): n is a, c, g, or t
  misc_feature (3095)..(3095): n is a, c, g, or t
  misc_feature (3203)..(3203): n is a, c, g, or t
gtatactagctatttctacggtagagcatacagtgcatggagaaaagcgaactgtagccacgtccgggaagagcaagatagtgaggatccgaggagaaggaggcgagctagtttactcagttcagtttaatttcagaacgaagttgtagagtattatgggagaacccaagatttgtagtcgtagtaagaccgctgccgacacctaggcagtggcattcaccggcttgaactggaagtcgcgcgcggctagctctctagctttactatacaccgcatgccgcatgcagctagcaggagagcaagtagtggatggacaccagcccagccccgcccgcgccgtacggccaaatgacaccatacggccgactgcggcctgatgagccctgtcacaataatggcgatgctcgatctccggccgcgagatggagagggcaccacctggtccccggccggccgggcccgcccgctggggaggacacaccgttgatgcgcgagggcgaaggcgaaggccggcgacggcgacggccgtatatggatctgctgttttgtttcggctccaagtcatgacacataagctgtgtagcgaaacgccttgtcgttgctacccaccgggaggtatatggtgggggccggccggccggccggcgcgccatcgctcgcatctagatcttatattcgctgtgatcccgtgttctttgttttgtcagtctgtcctgccgccactatgtgcagtataacggtgagggcgcgcggcaataaactttccactactcctactttgtagtgaagattgcaataaaaacagtctgctttatctgaaagtagtatcgtcatacaaatgaaagcccaataacagtggttggagtttccaatcactttatatattggactttacttcgtcataacagtggttgaaattagttcgcatatatatgtgaagtatctcattctcgtgagaaagatatgcaagtttcctgaagtttctgtctccggggtccgggcctcaagcggcaagcagcaacttgacctgatgattcttcttccgttccttattaccacatacctaccaaaaggaaacgtgcgcgagccccgtccactggctgtactgagatctctctagtgtaacctgacctgatcacggacggaacacaacgcagcaaaagtttggagctgtacctaaactccatcgattagtactatgattatatattgccgttgcaaattaagttccctctatcctctagctctctctctctctcttctctcacacacacacacagtcacagacacccctatcacttagactgtgctagtaggtagcggccgcgtaatggagcaggagctcagccttgagctcaccctcctccacccctcggcctcgccgccggagccaccgggctacttcgtctgcatgtactgcgaccgcaagttcttcagctcgcaggctctcggtggccaccagaacgcgcacaagtacgagcgcagcctggccaagcgccgcagggagatagccgccgccctgcgcgcgcacggggcggccgccaccgccacgggcgccccggaggacgacgccgccgccgcgatgggctctcgcgatgtccccgccaggccacagggcacgggtaccggagtcgtcgtcgttgaagatgagagtgcaaccaggatgatggacaagcagaaggctcctgctgctgatgacgacgctcccgcgaccgcgtcgtcgagcaacatgaagaggtcgtcggagtacggctacggcgtcgaggagctggatctctccctcaggctttgattggttcctcttcctcctccacctttaaatataattcgccccgtttgcttagataattcgatctttgtggtcagtgcaatcatctgtttcgcgtgcgtggtatctcagtgctggatccgtcactttcttcctcatgtagttgttgtgcagttatattcttccatccgatgatggaacctatcggcaagaactattgtcggcccatcctgctatccaaagggcgtggtatttggtgtgctcttttcggttttctgccttgagtcttctttgtgcgatctaaattcgcagcttgttttttccaaaacggcggaaacagttttgccgcaatttcgtttggacctttttcaagtgactctaaattgggcaaaaaaaaaaaaaaaaactttgtttcgatttgtgtcgtagttgtaatgcttcaactcctatgcgagtctgattgatgtctctctttttgtgactgtggccacagtgcgctagtacagttatctatggtacaatatagtcagttcataataatacttttcaggatccctcattgaatatatataattgttgtatctgataagaaccgaactttcctaggatcccaacaatgtttttttcttctcgtgagttgctttcccagtttttttttactgttgagcttcagacgaagcacatttcactagtttatttgctaaaaatgaatttggttgtgaggcgtcttctgaaatcatacacagaattccatggtatgtgataaacccatctcatacaccttgccttctcgatcttacggatcccataggcatgtcaagtgaaattgagttggtccaaatccattgaatattcaagtcaaatatatattgaaagtgtgcatgattttcttgaaggaaaattcatagaacatagataaaatttgacactccaagaaaccatgcgaatatatttaaaaatcaacatatatcacaattcatacttctcgaatacctgtttcagataagtataataggcaggtttaatttatctatatttattatatcgtcatactagagaaaacacacaccacacacataaaggtggtaatgactcacgatacaaatatttcttcacaatttatttgagccctttattaattttagttcaaaataaatagaaatagagactaatcctaatcttatctgatccttaatttttatagtacaaaacttagagctcgttaccaccctacacacattcagaatatcatcacggtagacatagtgcctcaatgggtgaagacttcatctcnacaagcaaactcaagcatataggacagcaattncatctaatcaccccatccatcgatggtgtagtagtactcagattcatcaccagctaaacaattttcagtatgattcatactagccgttgttttctcaccactctatgntttgcttgctatgtaataagtggtggtatgcaagggtaaggaaaataacctattatatggctgtagttttcattctcataatctcatatctcattattaaagtatatttaaatcctcttaggtatcaactcatccaactattcctcacatgcatgtccaccacaacgcaccacactctcacacctcatcactcgtccttagctagctcaatggtctcaagatagtacctagggggagagaagaagaatgcaccactctctagacgtcatgttgaagagagaaacatagaaaataaccatggacatggacatggctatatctataggtcgatcaactctttagaacatgtacacttgtacccacaagatcaccaacgccaatgatagaccatcattacttttctatctcagtgtttatgagggtgtttgaatgcactagagctaatagttagttagctaaaaatatactagtagaattagctagctaacaaatagttagctaactagctaatttactaaaaatagctaatagctgaactattagcttggatgtttggatgtctttaactaattttagccactaactattatctctagtgtattcaaacacc

SEQ ID NO: 11194 - DNA, 1336 bp, Zea mays
  misc_feature (1336)..(1336): n is a, c, g, or t
gcacgagaccattacctagaacatcctaatccattcaaaaataactcgtcggagtcagtacggtgctctctccgtctcagccgtcgccaactaatctatccccgatcacgcggcgaaccgccgcaacaccactatcaccaatcgcaatggagaaccctccaccgtcctccgccggtccgtactcggcgcccgcgccggcagcgcagcatcaggacgcggcgaaggaggatcaggacgtggcgcagctcgtgctcaacctctgcatcccggagctccgcgagaaggccatcatcatcctttccaagaagcgagaaaaatgtgaagatcttgctctactactatggcactcttttggtacaatggctgcactactccaggaaattgtgtcaatttatcgattactttcacccccacaattatcttttgaccaatcaactcgagtctgcaatgtgcttgtactccttaagtgtgtggcatcacaccctgatactaggatgccatttttaaatgcacagtttccactgtacctgtaccctttcttgaacactacctacaaaacaagagaatatgagttcttgaggattagtagcctgagcgtgatcggtgctcttgtgaagtccgatgatcatgaagtcattgtgaatttgctgtgttctgaaatagttcctttgtgtctgcgtgctattgagatgggcagtgaactttcaaaaaaggtggccacttttattctccaaaagattatgcttgacgacacagggcttgcgtacgtatgcgcttcttctgaacgtttctgcgctgttgccaatgtgctagctcagatggtcgaagcacttgctgaacagccttccccgaggacgcttaagaacacaatccgctgctacctcaggctgacagatgatcgaagggcctgccaagcgttacgtgactacctccccatcgcgttgagggacgggacattcaacggcttaatcgaggtcgatctcacagcaaggctatggctccaccagctgctgcataacgtcatgatgtcagacagtggaggcggccctcgccctgccccgggtcctgtgatggggatgtgaatgaagccggtcgccacgcctcatcatctgtgaagatccaagagcgtgcgttgtagctgtaggtagcgaagtagtaacccacagggaagggaaagcaatcgtggtggtgttcacacccttttggagggaacaaacacaaacagctgagctttgtgccgtttggatggcgaagaagcaacgataacacgcgtcttcttgatacaagtctggctggccattggtcgttgggattttgaaaaaaaaaaaaaaaaaan

SEQ ID NO: 11195 - DNA, 1991 bp, Zea mays
tttgatcttgaattcttgatccactatttcgaggagaaagagggagagagatgactagctgtagttgaagccttgcaggtccaccgtcacctcgcgccgcccggcgagtcgcaggcatttgtttaagggaagggattctcttccgccgcggctgcctctgcctggctggctgcgatcgccacaccccgcgcacatcgcgctgcccagctctgctgctgctgccgctgcgtgcgcatcactggaaagatgggcctgtggggacgggctccttctttccttcaccgcgccatgaatgatgcgccttttttttgctgctttgcttccatctggctcagctctgtgcctctgtcgcccttctccttcctctcggtgtcccctctgtcggtccatgctcgtctgctggctcctgcttgttgcttaggcgttcttggtcaggtgagcagcactggcggcgatggcgaaggagacggagtactacgacgttctcggcgtctgccccgccgcatccgacgaagagatccgcaaggcctactacatcaaggcgagacaggtgcatcctgacaagaatcccaacgacccacacgcggccgagaacttccaggctcttggagaggcttaccaggtgctgagtgaccctctgcagaggaaggcctatgacggctatggcaagaacagcgtatctagggagaacatactggatggtactgtggtgtttacccttcttttcgggagcgagctgttcgaggactacattggccatcttgcaatggcaacaatggcttcctccgagttgacaagcgataacgacacccccgaaaagcttcaggataggctcaagaatgtacaaagggaaagagaagaaaagctagctagattcctcaaggaattcctctctcagtatgttcgtggagacaaagaaggatttgctaatcgtgccgaagctgaggcaaagaagctctcatgcacttcatctgggttggatattcttcgcaccattggatatgtctattctcgacaggcagcaaaggagcttggcaagaaggccatgtacctaggagtgccattcgtagctgagtgggtcaggaacaagggtcatctgtggaagtcacagatcaccgcagcgaaaggggccttgcagctgttgcagttgcaagaggaggcctgccggcagagtagcaaggatggcaatgccaccgagcaggatgtcgacttgcagatgaggatgaacaaggacctgatgatgagctcactgtggaagctgaatgttgtggatattgaaatgactctgttgcatgtttgtgaaatggtgctgtctgaaaacaatgtcaagaaagatgatctgaaggcccgagcaacggccttgaaatttcttgggaaaatatttatgagggaaaaggaggcattgccagggccagcaccagcgccaggtccatcaggaccgtcgaaacgaacggttcttgacgacgacagcagctcagatgacagttcagatgatgacctgactcggacagcgccataccggactcctgcatttacccagggaatcggcaggctgttccgatgcttatgcaatccggcttatgatgttgatgatgattttgagccccacaaatgagtcctaaagaggaaggtaccaataccaatggattttccaaaggttggtgacttttgtcaagcgtatgattcagaacagtgtgaattcggatcatacgttgtgatcctttgcttgccttgaggatacacgtgtagatgctatttcatctctggtgaccagaccaacagctcagagatcctcatttttttcctcccatgaacagtagacctcctctccgtttttttaaatagatccaactgaatggtgttgagcttatgtaatcgcttgctattgttgttgtcaaaaacacaaagaagtgaaagaacaagtgcctgtaaaaatccatttctgatcctgaatcgggaattcagtgtgatgaacatcaactttttgatcc

SEQ ID NO: 11196 - DNA, 889 bp, Zea mays
ctcgaggccggccgggccggggcttcgctgcctgctgaaccggcctacagactcgacgaaaccccaatttccgataaaagaaaaggcccatgactgagcacatcttttaggggtcggtctggcccatctggagtggccttctagtaaggcccataggccctggtgagcgagatgcttgctttaccgtggcgcagcgaggtccggcgggcgccgcaaaacgcaggtgcatgcgtcgtcgccaagccccaaggccagtctgagtgtgcgttcgattcgcttgtgctgcagctagggtttagaggttttctgggcgcggagcgggaggcggcggcggctatggctgcggcggaggaggagatcgcggtgaaggagccgctggatctgatacgcctcagcctcgacgagcgcatctacgtcaagctccgatccgaccgcgagctgcgcggcaagctccatgcgtatgatcaacatttaaacatgatacttggagatgttgaagaggtcgtgacaactgttgagatagatgatgaaacatatgaagaaattgtgcgcaccacgaaacgcactatcccctttctttttgtccgaggtgatggtgtcatattggtttctccaccccttcgtacggcatgaagtttgaagttagatcatgctggttgttaattatgataactggtgtatttggccacttgatggcgttgcatggagtgtatgttatgggcctagccgctactttttctgatgggatgtaggtttaacatgtgatacaatcgtgtaaacaactgcttgtgcttggattatctgtcggatctcaggggttcttctcagtatcagctaaaaaaaattcggccctttcgctcctatctctcgtgcaaaaactcgagcccgg

SEQ ID NO: 11197 - DNA, 717 bp, Zea mays
  misc_feature (665)..(666): n is a, c, g, or t
  misc_feature (668)..(668): n is a, c, g, or t
  misc_feature (671)..(671): n is a, c, g, or t
  misc_feature (685)..(685): n is a, c, g, or t
  misc_feature (693)..(693): n is a, c, g, or t
  misc_feature (710)..(710): n is a, c, g, or t
  misc_feature (712)..(713): n is a, c, g, or t
  misc_feature (715)..(715): n is a, c, g, or t
gagccactctgcctctggttggggcgaggtccgtcgggcgccgcaaaacgcaagtgcatgcgtcgccgcccaaggccagcctgtgtgtgcgttcgattcgcttctgctgcagctagggtttagaggttttctgggcgcggagcgggaggcggcggcggctatggctgcggcggaggaggagatcgcggtgaaggagccgctggatctgatacgcctcagcctcgacgagcgcatctacgtcaagctccgatccgaccgcgagctgcgcggcaagctccatgcgtatgatcaacatttaaacatgatacttggagatgttgaagaggtcgtgacaactgttgagatagatgatgaaacatatgaagaaattgtgcgcaccacgaaacgcactatcccctttctttttgtccgaggtgatggtgtcatattggtttctccaccccttcgtacggcatgaagtttgaagtcagatcatgctggttgttaattatgataactggtgtatttggccacttgatggcgttgcatggagtgtatgttatgggcctagccgctactttttctgatgggatgtaggtttaacatgtgatacaatcgtgtaaacaactgcttgtgcttggattatctgtcggatctcaggggtgcttctcagtcaagaaaaaaannanaanaaaaaaaaaaaaanaaaaaaanaaaaaaaaaaaaaaaanannanaa

SEQ ID NO: 11198 - DNA, 4135 bp, Zea mays
acaaaggttagaaaattagagttgtttagaatttctgaacaagacttttcaactcgacttagaacgaccataactttttcatccaaactccaatttcaatgatcttgaactttcagaaagtttattcaaagggctacgcaacccactttaatgcgtacaacatattaaactatactatattttataaagatgatatctataaaatcaggaaagcgttgttgcatatctcacgttaaccatccataaaaatacacaccgctcaatttgtatacccactttgtcgtatactaagtttcaaaagttaaactgatatgtctgcagctagcatctagatatgcgtacaccgtatcttcaagatatgctgacattaattttaatccaaccgcaaagatttgttgagtgtgcttgttgcttcgccgctcttcaccctccccctcggcccagtcctatataaagcgagaaccaaaacttcttcgattcatcctaaagccttcagtgcctcagaaaacccttccataagaattggatactgttgtgagagctgccctcattgtctttggttgtctacaactacaagtccttcatgagaattggaaagagtatatagaaaaaaaaccttgtcgttttagttttgggtaccccaagcaagagcgccaccattcactcgaaggtgggcctgcccctcggcgcccccctccccgccggccatagtcaactcccataaacaaacgatcttctcctttaccctccctttcccccaaggtcaactcttccatcccctccactcgccgatccccaaaatccaaagcccaaggaaacaaaatgggcaatggcatcaccaagaacccatgcttctccggtgactcgtacgccgccgccgtcgcgtctgacccgctcccggacgacagccatggtcactccttcacctacgtgccatcgggcgccgccttcgaccagccccagacgtctgccgcgacgtcgtcggagtcgtcgttcttctctctgtccggcgccgccatcagcgccaatccggcgacgtcggcgtcgatgccgtcgttccgcctttttaacgagctgacgtggccgccgtcgaccgcgtgcaccttcgagagctcgcggtccttctccgccgttcctctccaggcggcgccgcctagactttccatgtccgggccggtccagttcacgtccggccggttctccgagacatccggctccgcgtccacgatctccggcacgccctcggaccgcccattcatgtcagggccgctcgaccactccttgtccatctcctcgtcgtccgcggggctcctccaaccgagcgtttctcagctcatcgctgagcgccgcgccgcgcgctcccgactccgggatgagcgatccctgctacggttcttcgtcaggaccgcctccaaactctggctcgggtcgccgcgctatggccgccggccacaggaacctgctgatccgataaagttctccttcagcgatggggactaccgctcgccgccgaacagcaatgtggagtgggctcagggcatggccggcgaggaccgcttccacgtcgcggtgtccgaggagcacggctgggtgttcgtcggaatttacgacgggttcaacggccccgacgcgaccgattacctcttcgccaacctctacgtcgccgtgcacaacgagctcaaaggcttgctctgggacggcatccaagcaggcgacagcgccaggtgcggtgagcaagaagcgggcgcaggcaatgccgaacgcctctgtattgctcaggccgacggggacggcgcggaggctaagcgcagacggaccggaagtgcccatgccaggccacagcgccacgccagtgcaccgcgacgtcctgagggcgctggcgcgggcactgaagaagacggaggaggcgttcttcgcggcggcggaggaacgcgcggccgagagcccggagctggggctgatggggtcctgcgtgctggtgatggtgatgaagggcacggacgtttacgtgatgaacgtcggggacagccgcgccgtgctggcgcggaggccggagcccgacctgaagaacgtcctcggcaaggcgtcgcaggacctgcagcagttcaaggtggagatcatgcgcgagctggaggcgcacgacatggacggcctgcaggccgtgcagctcaccccagagcacagcaccgcggtccaggaggtacgccatctttccctcctctgctcctctgctcctctcctgttcacaacttcaattagactgacttcggaacaagaattcatcctcgtatattcttgtcacatctcatcatctcatcgttaagggaaaaaaaaggaacttttgactacgagagacactactgttcatgaacgggaaaaactgtaaacccgttccatgattgagttttgggttcaccgagccgttcttgtccgaattttgggatgatgcaggaggtgacgaggatcaaaggccagcatctgaatgatcggaacgcgatagtcaatggtcgggtcaaggggaagatcaacgtcaccagagcgttcggggtcgcctacctgaagcaggtaaaacttgggttcttctaccatttcgttttcagtgcgcatgctcaagtacatttctgttgtcggtcaggcttctgcagttccttgtgcataattagcgtttaaggcgtgcagttcttgtgaacatgctctgtgcattgtgctgtcgcagtctaggactagagaactgcgaggagccgaggaccaatcttgtaggccctatgctccaaatcatggctgattagtggccgtccaacagtggcttggtggagcaggactgtaggagtagcgtagtagcttctactagttccgacgattcttccccaccccgtactgtgtgtgtgtgtgtctcgtggtcccaacccaaattggctccaaggtcaatctgcaaacctgatgatggttctatcgacgttcgtcttctctctggctggcagcccaagtggaacagcaggcttctggaagccttcaagatcaactacgtcggcactgacccgtacgtgacctgcgcgccgtcgctgtgccaccaccgcatcggctcgcaggacaagttcctggtgctgtcctccgacgggctctaccagttcttcaccaacaaggaggtggtggaccaggtggaggcgttcaccgccgcggagcccgacggcgaccccgcgcagcacctcgtcggggagctcgtcaaccgcgccgcgaggaaggccggtgagcgacccaacccgtccatgagcacgcatatatggacccccggcctccaccttgtacagtgcagcacgatcaggcctgacgaattcgttctcattttgttgcgctgcaggcatggagacgcgccagctgctggacatcccgcgcggcgcgaggaggcactaccacgacgacgtctccatcatcgtcatctcgttcgaggggcggatctggaggtcgtctgtctaggtgtgtcgtgtctgagtctgacgtggttttcagaggtccaaggcgtcctcgtaggtcagatgaggaggagagatggaatgaggaggcgatggtcgacagtctcaagggcgagggcacggcgctgccatgagctgccttcagtgtccggctatcgtttttggtttaccttataccatatactagagccatgttcgttcttgccgaaactgttgtacatagttccgcaagacgaactctaatagcaaagaaaagaagaaaagaaaatgcagtattagtatgtaattaggggtttcgcatcaaaagaagaagtggttagtatctgcatttagtaagtagtaactgctgtgtctattgctctcagtctcagcctaggaatcggacatgttctgcgacattcatttcggcggctgttcgtttcagattaaagtcagttgttcctatagacaaaacattgtagaagattaaagccaagcgtccttcgaacgatagatcctggtttggttcgtagtttcgtgtcttctgaacgaatggggaaaaactgtgaccaaacatcgttgtcagatgcagcctagtacgtcacgcagacgcaggctaacagagccatcacaggtatcttcagtgcaaaagaaacatctgttcgtggctttcgcaaaaaagatag

SEQ ID NO: 11199 - DNA, 3591 bp, Zea mays
  misc_feature (492)..(492): n is a, c, g, or t
agctgagcccgcgaagcggcctggctggctcgcgggagagtctttatttccatcggcaccatcacggcagggcggcgcgcggcgcgcgcccagcgggtttacagacccttctgtctctctcgctcgcttccaacgctcgcgaccggctctccctgcgcccgttcccggcggccgaagcgagtcgcgaacctctttccgtggctcccgagcgagtcctacgggcgatgcgggcggatcgcacgatgggggaggggagcggcaaccagcggatcgaccttggcgcgccgctccgctcggcgcgcctggtcgacgcgccgacgcagtacaaggccggcctcaactccgggcccctgcggcaccccggcgccgtgcccttcgcgtgggagcagcgcccgggccagcccaagagcgtccgcacacgccgcgcgacgccgccgacgcccccgcgggaaacttcccgggcgcggccgggcgagacaggcggcagccccntactacgacgccctcgcggagcttgatctccaggcgcttcgtggcgtcgccgaccaaggttcccggactgccgccgcatcgcgcaaggtggtggtgggggagaacgagcttgcggtggcggtggaatcgaccaaggatgtgaagaagcacgaggcgctcccggcggctgcggtcctacagaagcaggacggcatagtagaagaggaagaggagaggttctccgacgcgctcgacacgctctcccgcaccgagtcctttgccatgaactgcagcgtcagcggcctcagcggcgctctggaccccggacatggcgccgagccaggctcccggggcttcatgatggaccggttccttccggccgcgcaggctgtcgccgtgggctccccgcagtacaccttccggaaggccggcgccgccggtggcaccggcaattctggcagcgggcacgcgcgcgcggctgcggtgaaggcaggcgtgggcaatggcgaggatcggatgaggagagcgcctgtccagctcccgtaccagcacctgccgcccaattacttgtcctgcgcctatccaagacacgaagagcatgaagaggaggatgaaggggatgacgatgacgatgactatgatgtgcatagtacccgggggttttcagccaaggggtgtggtttgctccctagcctatgtgcgaaaacttccttgttgctcttaaatccaatgcctgcaatgaagcgcggcaaggtgcgagggcgagttagaggctggcagttaccgtgcaaaggccaaggccaaggccaaatggcgcagagtccgcttgcgcggagctcgcagaacaagcacctgggatgtgattccaacggggtactaatgccagcgcacatagcatgcttgtttgattcagctttgtagttgtgtttcttgtgctcattcttaggaatgattcttctaaccatctggattttttttttggtgtggcagccaccaggggaggatgtgtataagcataagttggagcagaagtatcttggtcaaggagaggatgataggaggagcaagctgacaagtgagtcgaatcagcttactttctggagtgattcaccgactggggatggatcttcaccatattaccattccatagctggtggcatgtctccatatcgcagttatgctgtgatgtcaccatcaagtaaaccaaatgggtcgtctggaacaggagataaggatgataaagcaagtaggagcaatggttctggttcgtttgggaaagaccatgatcgaacctcgttggttggatcagatgatagtagcttcaagcgatcaagttccatgagctcaggaccagatggagcagtgcatgaagattcaatggatcaccacagagatactgattcagacacatgtcacttgggtgtgcttgtgcatacaaaagcagcattggatgcaaacatatatgacactcaacctggagggcgaaagacagttggaaataatttgattgtgaaagatcaagtcaatgatccattgactgaaaagatcgctgaacttagagaacccacatttccattggatgatggaaaagatttgcagcgtaatgctagtcatgagttaccacaacatctcgaagacaatgatgttgccaaaaaggaaatcataccattacaatctctgctccctttaccagtacccaaatcaccttcagagtcgtggctttctcgcactttgccatccgtgacaaataggtcacctctgccatcttttcttggaattcaagtacactcaaagaaacaggctccctgggtcataacgcaaccaaaggagaatgatcataaaccttccaggccacgacagataagatttgcagatgtaagagttaactttcttctactctgcatatatctctatgttttactctttcgttttactcacatgtcatggtgccattgcttatatgcttgtgtgaactttgtttaggtagtagaaaaaccaacttcgttggattcggagatatgatatcttctcgcaaaaccagtatctatccattcatggtgttgccttgaaggctatcaaggtcatatacctcactggcacttacgagttcctaggatgtgcctctgctttttacagatgtggtcacttgatacagctgctggttaccacttaccatgttggtaattggagttcacatgccatgtttgctggactgtggtcagtatgtttctcatggtaagctggtaggtggtggtttaggtttggagtaaatcttatattcgtacaggatgacttcagctttcttccttactgtcgatagtgaaataaagcaatagtacccaaaaccaaaaaaggccgagttgttgcaaaatgtaatgcatcccaaagaataagaagatgtcaaaacagattaggcttccattcctgatacattttctattcgtaattgtatcacctggatatgtcagtacttgtgcttgatagaatcatagaactgtatctagtgccatatgttgtgtcagttgtgtctgacagtaagtatattcagcatatttcatatctatagtaaatttatttgctacattgttgtcattgattgacatcaagatggaagattatatagcagaagcagcaacgttccaactgtaaaagctttagagattctccaaaaagtgttgccgtgtgatgagctcatgagcagaaccttatgaattgacgcatgaccttaacaattgactatcggatgtgggtcaactgccgaatgggttgtagtgctgttcaactagaacactcgtggggcttttcatttgtcgcctcacagatattttcttgtgctctgtaaacatcatatgaattctgtgggcaacttataaaaaaaagtagtcaaatgttacactgctggagttggcagatcgagtggttctggggctggaggtggtctttgtttgggtcttttgtgatgtgttgaagttcctggttggctggttggttgtttttcagctatcggctgtaaggtgtgcagtcgagttcctggttggttgtttagctcaaatttcgacacttgtttttgtccccaattctgccattagatgcagattctgatatcactgggcgcgtcca

SEQ ID NO: 11200 - DNA, 1724 bp, Zea mays
aaacgtccctcgtgccccgccggccaatgcctgcaatgaagcgcggcaaggtgcgagggcgagttagaggctggcagttaccgtgcaaaggccaaggccaaggccaaatggcgcagagtccgcttgcgcggagctcgcagaacaagcacctgggatgtgattccaacgggcaatcatgggaggatgtgtataagcataagttggagcagaagtatcttggtcaaggagaggatgataggaggagcaagctgacaagtgagtcgaatcagcttactttctggagtgattcaccgactggggatggatcttcaccatattaccattccatagctggtggcatgtctccatatcgcagttatgctgtgatgtcaccatcaagtaaaccaaatgggtcgtctggaacaggagataaggatgataaagcaagtaggagcaatggttctggttcgtttgggaaagaccatgatcgaacctcgttggttggatcagatgatagtagcttcaagcgatcaagttccatgagctcaggaccagatggaacagtgcatgaagattcaatggatcaccacagagatactgattcagacacatgtcacttgggtgtgcttgtgcatacaaaagcagcattggatgcaaacatatatgacactcaacctggagggcgaaagacagttggaaataatttgattgtgaaagatcaagtcaatgatccattgactgaaaagatcgctgaacttagagaacccacatttccattggatgatggaaaagatttgcagcgtaatgctagtcatgagttaccacaacatctcgaagacaatgatgttgccaaaaaggaaatcataccattacaatctctgctccctttaccagtacccaaatcaccttcagagtcgtggctttctcgcactttgccatccgtgacaaataggtcacctctgccatcttttcttggaattcaagtacactcaaagaaacaggctccctgggtcataacgcaaccaaaggagaatgatcataaaccttccaggccacgacagataagatttgcagatgtagtagaaaaaccaactccgttggattcggagatatgatatcttctcgcaaaaccagtatttatccattcatggtgttgccttgaaggctatcaaggtcatatacctcactggcacttacgagttcctaggatgtgcctctgctttttacagatgtggtcacttgatacagctgctggttaccacttaccatgttggtaattggagttcacatgccatgtttgctggactgtggtcagtatgtttctcatggtaagctggtaggtggtggtttaggtttggagtaaatcttatattcgtacaggatgacttcagctttcttccttactgtcgatagtgaaataaagcaatagtacccaaaaccaaaaaaggccgagttgttgcaaaatgtaatgcatcccaaagaataagaagatgtcaaaacagattaggcttccattcctgatacattttctattcgtaattgtatcacctggatatgtcagtacttgtgcttgatagaatcatagaactgtatctagtgccatatgttgtgtcagttgtgtctgacagtaagtatattcagcatatttcatatctatagtaaatttatttgctacattgttgtcattgattgacatcaagatggaagattatataaaaaaaaaaaaaaaaaactcgagagtactt

SEQ ID NO: 11201 - DNA, 840 bp, Zea mays
aattcgccgagctgctccgctccctaccccctactccccttgtagagtagagtagcgtagcgtagcttgcccgacgccgcgacctccgggggcttggctttgggaaatggaccagccgctcactgcccccagtcagtggccgcgcgccgcaccaagtgagctagctactctctaggcggagtgaagcgaagctagcttagctgcctcgagcttgagctgagcttgctcactcttctcccctcttcttctagtaccggcacacacaccgcagctgcgaaaaaggaagctctctctctctggtggtgccggtgcgccgtgcttgcttgcttgcttgcggctgcatccatggacgcctacgaagccaccaaggtggtgttctcgcggatccaggcgctggacccggaccacgccgccaagatcatgggcttcctgctcatccaggaccacggcgagaaggagatgatacgcctcgccttcggccccgaggcgctgctgcacaccgtcatggccaaggcgcgcaaggacctgggcctgctcccgtcgccaggcccggggacgcccacatccgtcaccgccgccgcaacgcactcgccgttcctcctctcgcgccagaactcggggcgctgcggcgccggcaccgcgccgtcgccgctctcggtgtcgtcgccctcgtcgtgggcgccgccgcccctcttctccaggaccaacagcgtcgtcagcaatggcgcgccggcggaggccttggccgccgacctcatgagcccggccgccgccgggaacgcgccgccgtcgcccttctttgccgccggggaaccgctcctcgacgagctccagctgcag

SEQ ID NO: 11202 - DNA, 1765 bp, Zea mays
tgagccgcgcggcgtccgcgtcactccaatcccctcgccccgcggcgcctccgttcacagcgccatggcggggtggatctcctccaagctcaaagcagccgagaccctcctccaccagatcgatcagcaggcggcggaatccctcggcaagtccccatccgcttccgacctcgccacgctgcactccacaacatctcgctccgccgatgacctccttgacgtgccgctcccgcgcaggccgccgccgtccggcccgcccccctcactcggcctccgtctcgcagcgaagcgccgctccccgccttcccaagggccccgtcgctccgcatcggcggctgcgatgctcgcggtgcaggatcaagccggtggtgaaccaacggtgggggtggtggccgaggtgaaaccggaaacggatggaggggatcgcgaggacggcaagagtgtcgcgtccgagagcgggagcgatgaggactccgatgggtcagggagcgaagattcggaggattccgaggaggagaggcggagggaggaggagaggacgcggcggcgggctgagcggcttgcggccatggccgcacgcgctattgctgagcgcgaagatgctgttgcgaggctcgagggggagaaggcggggcttgagaagctgctcgccgagcgtgagaaggagcaggctcaggaggcttcagagttgcagactagtatgattgaaacattggaagcagtggagatagagaaacagagacatcacagcactagaatggaagcccttgcacgtttggctagacttgaggttacaaacggtgagcttgcaaagtcacttgccagggaacaatggaatctggaagttcaagtagatcaagtggcgcagcttcgagaggaagttgaattgaagaaacttactcaagataaatacagaagaaagctaacaaagatacaaaagacaagtgcccctccggttgatgaaatagaatctttgagaaggttcaagctggaggaagaaattattgatgcagaatacactctgacatgtgacagaattgtgagcttgaaggacaaggcaaggaagattgaagaaagcattgagctgactagaagagacatggttcatcctacagaggtggaaattgagctcaagaagaggcttgatcaactaactgatcggttgattcagaaacaaatgcaggtggagtccctatcttcagagaaggcagctctgttaatgagaatcgaggcagtcacgaggttgcttgacaatagcacctcatcatcagcttcctcaagctcatcaagattggacattgaagctggtgcatggcaacaatcacattcaccaaagcttcgcgacagaatacgggctggacagcagcaactgggatctgcaatccgacagctcgattcgatcttttcagccgggcatatcttcttgaggcggaatccgaaggcacaggtttgggccttggtgtacctggtatgcctccacttatgggtactgtacatactaacatcacacccaacagtgtcggaaactcgctctggggcaaccttttctttggagacattaaacaagactagcacttgattgctttttcctggcatgttctgatgttatattctggctgtacacatgaggcatcatacctttttctggttgagaaaaatcttagcatataatgcctcgtgcattttgttttggtacctgtccctatccccaattaaagtgtaacggtggctggttgcatacatgaagttggaattacttttggac

SEQ ID NO: 11203 - DNA, 4795 bp, Zea mays
  misc_feature (213)..(213): n is a, c, g, or t
agtttcttaaatgtatcatccctaggttctggtgttgaatatttcatacctagccctgttctggtcattgtactccaaagaaaactaattatgcatgtgttataatttcttgaatatttcatacctaggttcgggtgctgttagctgagtgtcgtttgtgctagaaattttagtattttacattctgtaatgcagctaatagttctgttaacnaattatgtcgatttggtccatgtttatttttgtcaaataggcaaggaagattgaagaaagcattgagctgactagaagagacatggttcatcctacagaggtggaaattgagctcaagaagaggcttgatcaactaactgatcggttgattcagaaacaaatgcaggttcattccttatgtggactctttcatcatgtttgttttctgttttgcagcatctcttgcgattttgttgccagtttttttttttgatcagtatgggttttacagtaaaaaacattgtattgagaacccttccctattttcattggtactataaacggagttagggaagttgaaaccatcaagatctggaaagaaaagcacctcgatatgaataataataaaaagccctaacacagtaacgatggttacatgtctcccatatattattattcgcacggtgatactggcccttggtatctattgggtacaccggtacagtgctatcatttaaaggttcaaaatcaaatgtctctcttttcaggtggagtccctatcttcagagaaggcagctctgttaatgagaatcgaggtatgtctatatagacccacccactgtatttaagtcttctttataaaatattctgacagccctagtaaatttacccaactaaatgttatgcaaggagaataacagttaatgagaatcgaggcagtcacgaggttgcttgacaatagcacctcatcatcagcttcctcaagctcatcaagattggacattgaagctggtgcatggcaacaatcacattcaccaacaatcacattcaccaacaatcacattcgcgacagaatacgggctggacagcagcaactgggatctgcgatccgacagctcgattcgatcttttcagccgggcatatcttcttgaggcggaatccgaaggcgcaggtttgggccttggtgtacctggtatgcctccacttatgggtactgtacatactaacatcacacccaacagtgtcggaaactcgctctggggcaaccttttctttggagacattaaacaagactagcacttgattgctttttcctggcatgttctgatgttatattctggctgtatacatgaggcatcatacctttttctggttgagaaaaatcttagcatataatgcctcgtgcattttgttttggtacctgtccctatccgcaattaaagtgtaacggtggctggttgcatacatgaaagttggaattacttttggacaatggtggctggttttccacatgagcctcaaattgcttctgaatgtttactttacgcacattttatttaatcgcagaaaaggttaaataatataaagattatggaggcaaagttatatcaattatacatagcaaatgattaacattttacacaactatagatttaaaatttcttgcattgctaatgccatttatttaacttcaaatatagtgtttgacgctcttctatactacgggcacttttgctctcgggtaatgtcgtagtaggctaaaaccacattggtatatgcaatgggttacttggccggccggataatagaggcgaggtgagcattgccagatcggtgcaatctgcctggagaataggaggcacgccggtgtagaaagggaccaaaagcttcgctggacatcgaataccatcctccaccagcgcgcgtcctcgtcgttgtcgtcgaacatgcagaccaccataaggtcgtcgtcgctcgacgtggccatggccaggtaaaatacgcatcatgacgcaggtattttttttttttttttcaagttactggaaatagactgaactctaaaaactctcaccgactaactacaatgtaacatcttacttattagaaactaaaatcctagacaagacaaattgaacagactccgtaaccacctagtgtgggtactccgttggcaggaaccacatgggcatctggaacggctcattcacgagtgagtaatgcagctgctgcttgatgtggccgtcacttccgtggccctccttcttcaggtcaaagatggccacatcgtagccggagggtgtgtcggcgaggtagacgcagtccgcctcaagaccggtctcatgtcgcacggtgacgaagaagggatagttcgccccgagaaagagcgcgcgatctcccccgaagtccgtgacacgccgccacgtgccgctgctagcgtcgagctcgtggaccgacatgccgcggtcaccgaagctcctcctcttgtcgaacaccattctgtgcaacacgcgctcgtcccaggggtacgtccgatggtacttgtacacatcttcgatttcgtagccgtatatgtagatgagcagaagctgttgatggccatcatcgccggaagcagccaggtagaacgcgcaccggtcgtagtcatgttggcggctcatgtcatcaatattcggtccctgaaccaccgtaggctccgtcgtggcggctccaccatccaggtgccacgagtagatgcggcccaccttatccacggcgaacagcttcccgtcgaggacgatggcgtccatgtacgagacatcatcggccgcggtgttcttcaccgccgtccactcgccttcgccttcgccttcgtcttcgccttcgccttcgcctccgccgccggccgccgtgaacgccagcagatcttcggagaagatagcaacggcgaggtggccgtcagcgtgcgccggcgtccggcacaacgcgaccttgaggatctcgttgtacttgtggtcaccgacactgaagtgggcgagccttttgacttcgctgatggtgtagagcgatggcaggtaaacccgcgcgccggttacggggttcagcagctggacgtcttcgcaccgtatgtccgtggtcaccagccacccgtggttgccgccgacccaagcccggtccttgaatccctcggcctcgccgagaaaggacttgcggccgccgccgccgcaggcagacacgtcgtgcaggcagaatgcgcccgcctcgacgctgcgctcggtatcgtagccgtcggagtcaacgctgggcgtgagcagcgcgggcaagcccggtcgcaggagtggatacacctcgcacgcggtggaccaatccctgcagacggcaggaaatcgaatgatactgatggggtcgagacgttccctgacaaggttgcacatctccggcaggaggtcagcccatggcgccgcggtggctctgctattccattccgaagcagacattgattgtcgacgatgagatgccattgattgtcgacgatgagatgctgggcagtcgaacacctgcgtgagtgaggaatccttggatctcgttagtattgtttggtgtgatagcaaaatatgggtcgtcaaacacaaacccgctctttttatattttacatatacagatcgcttgttgtttggtccttctatcttcatatgctacatggctctagactgtgttgtttagacgtttattatgtaaccaacaactttcagtgactttgatgtatattttgtatccttggctaccaccacaaatgcatacttgtacagcgataacatctgccacccgcatgaatttgtttattcgtttatgtgaaactgtatcaagggagtcgtatagcttcctgttctagtcttttaacacaaggaaaagggagcccacataaaaaatcgaaagcgagttggtgcttgggaaagatactggtacctttagactagggtcaataattcattaacttttttatattttcctggcttaaggctttcaccgcagtattgtcttatgctttagccaagtatagctctgaaatctgtctgatttgccaatgaatcatgatttcccgtaaaagctcgttggaccgaaccatagctgggctctgagtctggactggatcaaatattttaggtctgggaggccgtaacgctaatgggctaaaactcggagattagtccgatgtagctgaggatttttttaaggaagcctatttactagtgaccagtgaaatagagggcatctatgaggaggaatcctcttgctattcaattttaaatagtaaagagacttctatcctatagattccctttatttttttggttaccaaatcagccttaaggatgaaaaactcacacactagtctcatactaatataatgttcgtacgttacgacatcacacaacaaacatcacactttattttagttaaaaggtttataaaggtatgagttgaaaaaaatagctcaacccttttttttatagctctctcgatcgctctcgtccacctttacctaaaattgtggtattatgcgtgagcactgcgctgcatgcgacaacttgtcatgttgggcttaaatggttttcatggtccatctatggagtagcggaccactaataaggtctgggatagttttcacactctagctatatatgggataacaacccactggttatggaagaggaacagacctacacggattcgtgtgtgacgcgggcataaaaaatggtgttatgtagcagcaaagataggttcaaatagataggttatatatctgttcatacaacttcactatttttttctgtacacat

SEQ ID NO: 11204 - DNA, 1440 bp, Zea mays
caatcggagtgtcccaagcgcacggccgcgcgacaagccttgctcggcgcggaggaggcaggtgccaactgtgagtgaatgaggcacgatctgacagccgctggacgtgagatttccggacaggagaaccgcgctgcctcacccccccgcacggcccctgcggcgcgatgcgctatccatccatggccacgatccgtccgtgccatgccgatcccgcctgcggttcagcagcgactccacgggccacggccgcggggggattcaccgcatcgcgatctccgatccgatccgatcccgcccgatcctcgcgccatcttttctttttttttttcttctatagtgtgtagatagtgtgcatataaatatacccacaccgttcctccggagattgcattgttgccagcgccattcatccatttgtctttttgatttgttttgacctgagggcaaggcagggcagagcagagcattcgtctcgatcacccagatctcggatcaatggaggtggcgggggcctgctgccacgccggcgaggagaggaaggtggctgtgcctatcggcaacgacgcggaggtggagccatgcgtcatcgccgtggacgacagctccgtcgaccgcgccatcgtcaccgcgctcctccggcgctccaagtacagagtcaccgcggttgacagcgggaagagggcgctggagatactgggctcggagccgaatgtgagcatgatcatcacagactactggatgccagagatgaccggctacgacctgctcaagaaggtcaaggagtcttcgaagctgaagcggatcccagtggtgatcatgtcctcagagaacgtgcccacccgaatcaccagatgcctggaggaaggcgcggaggacttcctgctgaagccggtcaggccgtccgacatctcccgcataacaaccaggatgctgctacactgaacttctttcaccagtggccacccaagccaggctgttaccagcgtagtgttttcaagtcacagcagaggtatagcaacggagtcaatttagggtcggttcggttatttaggattctgctccaggaaagaatacagttggaataactgtataatttatagaacaattggtaacctggaatagtttctactcttgttctggtataaccgaatggggccttagggtagcaattagccgcaggaagtttgatgtaatgtggcctttcattcattagtgcttcgagctttctttggcgtcttactcgatcaagaacaggcagggattagttgtagggttcgagttccagaagtagcgactttgttgtcttaagtataacgaatcgtgaaagtgtaaatcactgcacgaatcattctgttaaagaggaacattacaatttacattggcttaaaaaaaaaaaaaaaaaaaaaaaaaaaaaaaaaaggaaaaaaaaaaaaaaaa

SEQ ID NO: 11205 - DNA, 2123 bp, Zea mays
ttattcggcacgaggcttccgccctcaaggcttttccttccttctcatcttctgctcggaccggggacgggccgacggggacagggacaaaaggtggtgcgatcttgttcggcacagagagagagagagagagagagagagagagagagagagagagagagagagagagagagcgacggagggtggcagggccgccgcgccggtgagccgacccccagccatggcattgccggctccccccgtccgcctggcgctgctgctgctcgtcgcgctgccattctgcgccgcgcatcccgggccgggggccttcaatgctcctcgccacttccagacgcccgcgctccactctgatggatttggcttggtggcaagaaggtcgattgctgaagctcctgctgacatcaacgtcactacgaatagctcctttgtgctggcggcagataggacatatcgaagggaccctttgaatggcttcaggaaatacccgggcggctggaatatcagtgaagtgcactatttcgcttccgtcggatatacagccattccgctgttcgccattgctctcgtgtggtttgtgatctttttcctggttatgcttgggatttgctgccgtcattgctgttgcccgcatcacacctacaagtattcacgaacagcatatgctctatcattgatacttctaatactgttcacatgtgctgcaattgctggatgtgctatgttatacgatggccagggaaaattccacaaaagcacaacgactactctgaagtttgttgttagccaggcaaattatactgttgacaaccttaggaacctatctgatagtttgtctgctgcaaagaaggtcgacatagcacagtcctttttgctgcctcctaatgtgcagaacgagataaatgaaattcaaggaaagctgaactcatcagctactgatcttgctattaaaacaacagataatgccgcgaagataaaaaaggtgctaaacagagtgcggcttgctttagttgtcattgcagctgtgatgcttcttctggcatttgttggcttcttgttatccatctttggtctggaattccttgtctctgtcttggttattattggatggatattggttactggaacgtttatcctgtgtggtgtatttcttcttctgcacaatgttgtttcagatacttgcgttgcaatggaagagtgggttgctcatccgacagaacacacagccctggacgaggttatcccctgcgtggagcctgccacggcgaacgaatccctgtacagaagcaggcaggtgacgttcgagctggtgaacgtggtgaaccaggtgatcaccaacgtgtcgaacaggaacttccccccgcagctgacgcctttctactacaaccagtcggggccactgatgcctctgctctgcaaccccttcacgcctgatctgagagaccgcaactgcagcagaggagaggttaccttggacaacgcaacccaggtgtggaagaagtacgagtgccagagcaccagcgtctcaggaggagccgagatctgcgcgacggtggggcgcgtcacccccagcatctacgggcagatgaccgcgggcgtgacggtgagccaggggctgtaccagtacgggcctttcctcatccagctgcaggactgcaccttcgtgcgcgacaccttcacgaccatcaaccagggctactgcccggggctggagcgctacagcaagtgggtgtacgtgggcctggtgatggtctcgtcggcggtgatgctgtcgctcatcttctgggtgatctacgccagggagcggcggcaccgcgtgtacagcaagcagcaccagccgtacccggtggaggacaagccggcggcgacggtcccgggcgcttgaattgatggggccgttccagtgctccggcctactcccgtgccgctgtgcatactctactccgcgctagttgggttttacgtggtggtgtatgtaggtggatgtaccctggatttgttgtttcgtttgcttggtgttgctgtacgtttgctgattttccgtagacgaagttgctgtgcattctcgtactgacggtagctggatgaattgattatgttgggattgggcataaaaaaaaaaaaaa

SEQ ID NO: 11206 - DNA, 2064 bp, Zea mays
aaaaaaggtggtgcgatcttgttgggcacactccgcctccgcgcgcgggaagagagagagagagagagagagagagagagagagagagagagagagaaggacggagggtggcagggccgccgcgccggtgagccgacccccagccatggcattgccggctccccccgtccgcctggcgctgctgctgctcgtcgcgctgccattctgcgccgcgcatcccgggccgggggccttcaacgctcctcgccacttccagacgcccgcgctccactctgatggatttggcttggtggcaagaaggtcggttgctgaagctcctgctgacatcaacgtcactaccaatagctcctttgtgctggcggcagataggacatatcgaagggaccctttgaatggcttcaggaaatacccgggcggctggaatatcagtgaagtgcactatttcgcttccgtcggatatacagccattccgctgttcgccattgctctcgtgtggtttgtgatctttttcctggttatgcttgggatttgctgccgtcattgctgttgcccgcatcacacctacaagtattcacgaacagcatatgctctatcattgatacttctaatactgttcacatgtgctgcaattgctggatgtgctatgttatacgatggccagggaaaattccacaagagcacaacgactactctgaagtttgttgttagccaggcaaattatactgttgacaaccttaggaacctatctgatagtttgtctgctgcaaagaaggtcgacatagcacagtcctttttgctgcctcctaatgtgcagaacgagatcaatgaaattcaaggaaagctgaactcatcagctactgatcttgctattaaaacaacagataatgccgcgaagatcaaaaaggtgctaaacagagtgcggcttgctttagttgtcattgcagctgtgatgcttcttctggcatttgttggcttcttgttatccatctttggtctggaattccttgtctctgtcttggttattattggatggatattggttactggaacgtttatcctgtgtggtgtatttcttcttctgcacaatgtcgtttcagatacttgcgttgcaatggaagagtgggttgctcatccgacagaacacacagccctggacgaggttatcccctgcgtggagcctgccacggcgaacgaatccctgtacagaagcaggcaggtgacgttcgagctggtgaacgtggtgaaccaggtgatcaccaacgtgtcgaacatgaacttccccccgcagctgacgcctttgtactacaaccagtcggggccactgatgcctctgctctgcaaccccttcacccctgatctgagggaccgcaactgcagcagaggagaggttaccttggacaacgcaacccaggtctggaagaggtacgagtgccagagcaccaccgtctcaggaggagccgagatctgcgcgacgatggggcgcgtcacccccagcatctacgggcagatgaccgcgggcgtgacggtgagccaggggctgtaccagtacgggcctttcctcatccagctgcaggactgcaccttcgtgcgcgacaccttcacgaccatcaaccagggctactgcccggggttggagcgctacagcaagtgggtgtacgtgggcctggtgatggtctcgtcggcggtgatgctgtcgctcatcttctgggtgatctacgccagggagcggcggcaccgcgtgtacagcaagcagcaccagccgtacccggtggaggacaagccggcggcgacggtcccgggcgcttgaattgatatggcccgttccagtgctgctgtgcatactccgcgctagttgggttttacgtggtggtgtaggtggatgatgtaccctggattgttgttcgtttgcttggtgttgctgtatgtttgctgattttaagttgttgtgcattctcgtactgacggtagctgtatgaattgattgtgttgggattggttattattaggtgttcttaaaaaaaaaaaaaaaaaaaaaaaaaaaactcgagggggggcccggtaccc

SEQ ID NO: 11207 - DNA, 973 bp, Zea mays
agagaaatccccgcggccaccgtcaaggtatacgagtggtttcctgccccctctcttccaccgtctccatcccagcgcgctgcatgccaggtgtttgttcaaatgcgtcacccatatttgtgcccgcagatcctgatgtaccagctctgcaagggcgtggccttcgtccacggccgcggggtgctgcaccgggacctcaagccgcacaacctcctcatggaccgcaagaccttggcgctcaagatcgccgacctcggcctcagccgcgccatcaccgtcccggtgaagaagtacacccacgagatacttaccctgtggtacagggcccccgagattctgcttggagccacgcactactccaccccggttgacatatggtccgttggctgcattttcgccgagctggtcactaaccagccacttttccctggcgactcggagctgcagcagctgctccacatcttcaagttgcttggcaccccaaacgaacaggtgtggccaggcgtcggcaagctgcccaactggcacgagtacccccagtggaagccgacgaagctgtctgctcttgtgcccggcctcgacgctgatggctacgatcttcttgagaaattgctggaatacgagccagcgaagcggatccccgcgaagaaggccctggagcacccctacttcaacgatgtgaggaagggagatgcgcactgactgaagcgacccaccaagggcccgccctcacgagttgacatatatatacgtgtgtgtcgtcgtgtcgagcatgattgccctgaagcaattcttttgctaccagggcacagcctactttctgttctctagctgatgttcgtgtcgtgtgtgctgtgaaccgttcgctttggctggtgatggatgaaaatgttatgtttctaggattactgatgaaaaaaaaaaaaaaaaaaaaaaaaaaaaaaactcctcgagggaggggcccggtgtaccc

SEQ ID NO: 11208 - DNA, 1702 bp, Zea mays
tcatcttttcttatattaaataattacaactatgtcttcggctttttaagaacaagaaccttgaagttttttttttttttttgacaaataagagtttgttgccaaaaaaaatattttatacaagatattgttcatctatttatagaggagataaaccgcctttgtacaaaataataaatctctactactattatgtgaatactgtaggcgtccacaatcgcgtggtgcacgttctgccgctctgctcacgcccgcggccgaacctcccccgcatcccgcagccgccgacgctcaccttccatcctccgcgcagccactcatcccgcagccgcgatccccgcggcgctcaccttccatcccgcagcgcgcaccttcatcctccgccttccatcctccgcacagccactcatcccgcagccgcgatccccgcggcgctcaccttccatcccgcggcgcgcaccttcatcctccgcgaccgctcgcggatctctcatcgacgtcgatgctccgcgattaaggggatccgaggccaacaaacagcatggcgctccccgcggcgggcgggcgaggaggcatgcgcggatactcggcaggatgctccggcggaagcggagccacctccccgtcggccgcccgtgttctacagctccgtgttcgcgcaggtacgccagccgctcgacgaaatgctgtggttgcgctgacatatgctgcaaggaaatcttttttttgcccatatgtggggttggtggcatggcgtttttctatttggacttttgcgcgtgcagatcgaagagatcgggtggaagcaactggtgagcgccacaggagagggagtgtcctgtactcctgtctcaccttccgtgtcgtgtaaggattcatgttgctgccagtcggcactaacctctttctatatgtttatattgtacgaatgtttggagaaaaaaactactgccgttcaggtggttgagcaacgctggcgcattacatactaaattttgtcagtttgatagttgtttgaaaaggttatttcagaaacctgtctttgtccgaatgcaagagagagaacagacagagcgaatcttccattgatcatcagcacacgacatgaatttttttcttatcaatttccaccaatctttgtagggtaaaaacatctctggagatgctctaacatcccattctgtctctctgctattgtctttaagcgccaaaacttattgttcatttgatctcttttcatgtacacaaactcagcacggagctcaagctttgtttttttactactactactactatcctgtactacagtagtatgaagtatcgtatcatactcatgctctgtatttatatttgctagattctggctatgcgccatcctaggaaactcgtattagcaggctgtttaactgcactaagagtgagtatattctgaattttacatgctgacatatggtatccttttattatatgttcaatttttaacaaataatttaattgatttagttattaattttaggtcatgacagctgtatcgacttctctaggttgggttgcaccaaatctggtaagctactataatgatttttgggtgtctactatgtcaagaaggcaaagtagttatttcttttgtgtgtgtctgtttgcttcctgcatgcatagagctgtcatgacaaaaatcatgatgcatacaagcagaatatgc

SEQ ID NO: 11209 - DNA, 1386 bp, Zea mays
ccggggctctgcctcaccatcgacgccgaatccacagctgccagcccgccacatctgccacgcccaaatctgcgtcgtgcgcgagtgagaagaccggatctgcggcgggatggcgacgatccagaacaagccgactccgacggcgccgtccacgacgacgggcggcggactgcgcgccatggatctgtacgagaagctggagaaggtgggggagggcacgtacgggaaggtgtacaaggcccgggagaaggcgacgggccggatcgtggcgctcaagaagacgcggctccccgaggacgacgagggcgtgccgcccaccgcgctgcgggaggtctcgctgctgcggatgctgtcgcaggacccgcacgtggtccgcctgctcgacctcaagcagggcgtcaacaaggaggggcagaccatcctgtacctcgtcttcgagtacatggacaccgacctgaagaagttcatccggggctatcgcgccaaccacgagaagatccccgcacaaaccgtcaagatcctgatgtaccagcttgcaagggcgtgggttttgttcacggccgcggggtgctccaccgtgatctgaaaccgcacaacctgctcatggaccgcaagaccatggcgctcaagatcgctgacctcggactcagccgtgccatcaccgtccctgtaaagaagtacacgcacgagattctgacgctgtggtacagggcgcccgaggttcttcttggcgccacacactactccacgccggttgacatttggtccgtggggtgcatatttgctgagttggttactaatcagccacttttccctggcgactccgagttgcagcagctcctccacatcttcaagttgctgggcaccccaaatgaggagatgtggccaggagtaggcaagctgccgaactggcacgtgtacccccagtggaagcccactaagctgtccactcttgtccctggtcttgactccgatggctatgatttacttgagaaaatgcttgcatatgagccagggaagcgggtctcggcgaagaaggccctggagcacccgtacttcaatgatgttaacaaggaggtgtactgaagcgacccgagtagtagggttcatcgagagaggatcattgtcaccttattcttcgcttagtgtgttaatatggctaccctgaagcagtacttgaagtatctctgtgttcaagctgctacttttctatttgttgtgccattcactttggttgtgatggataaggcagggagagttttcagcatgagtgagcttatgttgacactgtttcttgcaaattgtagccggaaagcttgcgatcatcttccatttgatttataaagcttcactatatggctctgaagctcaaaaaaaaaaaaaaaa

SEQ ID NO: 11210 - DNA, 1469 bp, Zea mays
ccacgcgtccgcaaaaaaaaaagaagccgttggagcgcctccctctaaaacggcactcttccccactggcccactcctccgctccctcccgcatacaaatcgtccgccaacaatcccccaaaccctactccaccacgcgatcaccgaccgacgcctctccgacgagcaactcaaccccccaccgcgcacgcgagagccggatccccacgatggcgacgatccagcaccaggcgaaaccggcggtggcggcggcgccgagcacgactactggcggtgggcagcgcgcgatggacctctacgagaagctggagaaggtcggagaggggacctacgggaaggtgtacagggcgcgggagaaggcgacggggcggatcgtggcgctgaagaagacgcggctccccgaggacgacgagggcgtgccccccaccgcgatgcgggaggtctccttgctgcggatgctgtcgcaggacccgcacgtggtgcgcctgctggacctcaagcagggcgtgaataaggaggggcagaccatcctctacctggtcttcgagtacatggacaccgacctcaagaagttcatccggggacaccgcagcaacaacgagaagatccccgcggccaccgtcaagatcctgatgtaccagctctgcaagggcgtggccttcgtccacggccgcggggtgctgcaccgggacctcaagccgcacaacctcctcatggaccgcaagaccatggcgctcaagatcgccgacctcggcctcagccgcgccatcaccgtcccggtgaagaagtacacccacgagatacttaccctgtggtacagggcccccgagattctgcttggagccacgcactactccaccccggttgacatatggtccgttggctgcattttcgccgagctggtcactaaccagccacttttccctggcgactcggagctgcagcagctgctccacatcttcaagttgcttggcaccccaaacgaacaggtgtggccaggcgtcggcaagctgcccaactggcacgagtacccccagtggaagccgacgaagctgtctgctcttgtgcccggcctcgacgctgatggctacgatcttcttgagaaattgctggaatacgagccggcgaagcggatccccgcgaagaaggccctggagcacccctacttcaaagatgtgaggaagggagatgcgcactgactgaagcgatccaccaagggcccgccctcacgagttgacatatatatacgtgtgtgtcgtcgtgtcgagcatgattgccctgaagcaattcttttgctaccagggcacagcctactttctgttctctagttgatgttcgtgtcgtgtgtgctgtgaaccgttcgctttggctggtgatggatggaaatgttatgtttctaggattactgatgaaactttgatgtctacctggtcaaaaaaaaaaaaaaaaaacaaaaaaaaaaaaagaag

SEQ ID NO: 11211 - DNA, 1979 bp, Zea mays
  misc_feature (1844)..(1844): n is a, c, g, or t
  misc_feature (1938)..(1938): n is a, c, g, or t
  misc_feature (1972)..(1972): n is a, c, g, or t
cggtcggtagaataatggcaaacatctaggcgtaaataaatatataatccagcaacaagaatctagctgagaccctaggcaggcaggcagttcgtcagttagtcgtgttcgaatcggaaggttccctgattaattaatctacctgctactactagctaacaaacaaataaagttacacccagctcgatttccactaactctaacaatctttgcactttcattagagcttgttcggttcgagatatatcggaaggactagaggagattaaatcactagttaaaattgaatagaaaagagatttaatcctcatcaattctctccaatccaaaagcaaccgaatatagccatgattggattcccttctgccaaatcatgccaagagttctctttgcaaggaactttgtttatgttggtgatgcgtttccgctattttctggtgaccggactccattctcgctcctgctttcgtgtttgggataaatttcagcatcatatgggatggttgcccgcttaattgacgaccaatataatctctgggggaaagagtgggagtcttgacaaccaaagcttgaattttgttcgggaaaatttcgctcatatgttgcatgtggtacatgtatgacgatgaatcatgaatgacaacaaagattaataagttgctaattaagctaaatatatacgaaaagtaatggatctgtggctatacgcttatcagatcatgcatggcccattatattggcggttcagagacaaataactagagaaaaggatcagctggttactcttcccttccatgcatcgaacttttgcctttgctgctgtttttttaagctgtttcaattgtgcgatgaaaattcaggatgctgacgatgagatgagatgtgttcagtctagctagctggaggatcaacaaagacatgcacatcagatgagaaacagcagtgctgcatgccacctttagttctctcttctctgctatatactatcacaaccacaacaccacagacaacgccgcctgaggcctataaatggaggccgccccgcccgggccgaaaagggcaaacaaaacaagctcaaacaacgtgtcctggggtacacagctatagcttcctcgctccgatcccttgcaacaaatcgaacgccatggctcctcgcgctaagaactctctagtggcggagggtgacgtgagcgtgcagaaggtgaagaagatcgagcctgtctacgactacgacctagtcaccagaccctgggtgttcggcaacccgagagtggtgacggtgctggcaaggccgccgccgggtgccggggtttctgtcgcctcaggccagaagaagctgttccagagggcgctgtcagagcaagagatcatcaacgactacatcgccagaaagaagaagcagtttgccggggagatcccatatagtacctagggtgtttacatatatagtttgagaagagataaaaaaacctacaattaagccctctctatatatatctatatatgtactcagagagtacatcgttaattatatgtgttgtgttatggaattaataccttatttcctatttctgagggtttaagccgtcgaaaattcctcgttttagtgttgtgatatgtcattagttatgaatgctgctgcaaaatatatatgtacatgtgtgaggtgtttgctttatgatatgtgtattaattgttcctgatataaaaaatctttatctatatcatcatggttcaagagacactactggttattccttgcgcccctattaatgtttttagctatttcaaactctgaatggcctgacactagcttgagcagcgaaagttcatcagcagatgangacgaaagtacatatatgcttataggagtattatatatagagtatcgcatcaatttcgatgacgaagcattatttataccaacttcaggacgtngttggcctgtagtctcccaaacaaagaatggganttggaac

SEQ ID NO: 11212 - DNA, 1845 bp, Zea mays
cagaaagattattgctgcactgtttgaagatgttaatgatcatcggtatcatccacctcggaattggacaattgctgcacgtgagcacctcaacaggagtgcaaatgtggagggcgtagtgtcatcagctatgttatcaagacctgtatcttttctcgcccaccctttgccagagtgctcttgcagcacatcgaagtcacctgctgttgaaccggtgaaagatagcaatggcagattcctatttggaggtgaggaagagtgtgctggttggatggcacgcagccctgcgatggcgtctgccaggaataatgaacctcaaattgaggactatgaggataagttgcctgaagaaggctctagttcagacacgcaggaatctgacagaagtgactcgaataaatcttcggagcaagatgaggagatggatctggatgattagagatatgtggagcatggatgtatggcacacctttcaaccgctaccagctccaggtccaggctactcgaagacaagcatacatacgctcagaatctcctggacaggtgggaatcatcttgcatcgcgcagcgacacatcagcatctggattagtcccaggatcacaattcacaaggtcatccagcgtgggagcttgcctggaccgtactcggtatacaacaaggctttaatacgaaactaacactttgttcccttcttcattcacgtgtcattttttgtgggtacagccctaagaaactgtttatgtacaaatgtcttaactgggaatacatcattttttttgggtgagtttgatatctaatggcgactatgagctaatgagattggcttatggtggacagatgtgcacctgtatacaggacaacattgcaattgtttgtgagttttattgatcgccgaagagtgtgcttacacggatggagttggttcttctgcatgacctgtgctatggatcagaaaatcgtgtatatctactttggctacacgaaaagtttgtgtttcacatgagaagtttttgagtgaaaaaccttctctgaattcggctggctgctgtagtcggatcaaactgttgcatcttacttgttcttgttcatacagggagtgaacagaatgcatcgctgttcagtatatcgaacgcaggattccaaagtttggacatttcaagtatgttctctcaaagtttaatactgctttgacttggtattatcaacatgcctggctccttggacatttcaattgctacagctatgcttatgttattctgcttattttccagtgcttgtaataaccagtggcagatcttaaaaaggaggccatgtctcctccccagttttaaaacacacatctttgtcaagctccgccactgcctataactgttaaatacatctcaataatcaacattggccatgagacttgacaaattgagattcttctgtctgccaggtatgtgccataagacagatgatacagagagactgattgttatattagtaaactgtgtaatttcgagggacaacactatattttgttgcaactcaactcttaaatttgacacatgtatgtgacaaattagaaaatgtgatggatggttgatcaagaaacattattttacttttgtgtgtcaaatgtaaacttgcgttagttgataacaactttctctgagatactctgatccaacggtacactagctttgttgacgtggggaagacttgcccgcagagttgtgttttccagcttgtgattccttcaaaatcttggtgcacaccattgaagctaacacagtttcaggtgtaacttccaaaactgtaggtcatcatgctattcatttcaatctcttctcatcccaag

SEQ ID NO: 11213 - DNA, 1896 bp, Zea mays
  misc_feature (18)..(18): n is a, c, g, or t
cccgggccactatcacgnactcatccacccacccccgccccggggcccccccgcgccgatcacggcacggcgaagcccgcccgctccctccctccctccagatcaggcgccgcctctccgcccccactgcccgcgccgccgctcgccccgttagccggggcgtggattgattcgcacctccttctcctcctctcgatcgggtttggaggttagagtaatgaaataaaatgctactcaaaagcaagtttaagttggccacagccattggcatcgtgctatcgatgctatcgctgctcgtgcacctttttcttgctaattattcagctgggggcattacaaagtacagcatgcacatggacgatgtccttccatttggaccgaggcctcgaccacggagactgtggggtccgttggtcccacttgatcacttgcatccttttgtgaaacctagcaaatcatatgctgttcccagtaagcataatggttttatttatgcaaagatatatggtggttttgagaagatacagtcttcaatctgtgatcttgttgccgttgccaggctattaaatgccactctggttattcctgagatacaagcaacaactcgtacaaaaggcatcagttcaaagttcaaaagcttttcttatctatacgatgaagatcatttcatacattcactgtccagtgatgtggttattgtgcatggcttgccaaaggatctcagagaggctaggaaaaagataaaatttcccacagtatctcctaggaattctgctactccagaatactacatcaaagaagtattacccagacttgtaaaatcaaaagttcttgggataattgttaatggaggtaattgtcttcagtcaattctccctgcaagtctggaggaatttcagcagcttagatgcagggtagccttccatgctctgaggttgcgccctcaaattcgggctcttgggagccaagtagtaggaaggttgcgagcatctggccgtccttatgtggcctatcacccaggactgcttagagatactctagcttttcatggttgtgctgaactgttccaggatattcatacagaacttattcagtatagaaggaatcagatgattaaacgaggaacagtaaaggagcagctaacagttgattcagtgtccaggaagatggctgggttgtgtccactcatgccagaagaggttggacttctacttcaagcagtaggttacccaccaactacaataatattcttggccggttctgagacttttggtggacaaagaatgcttattcctctacgagctatgtttcgctaacctagtagaccgcacttcattatgtagtcagagggagctgtttgatttagttgggccagaagatcctcgaaccccagatttgccacagcctccacctcccaaaagtgaaaaacaacttattgaagaatggaggagagcagggcctcgtccaaggccgctgcctccacctcctgcaaggccattctatgcacatgagaaggaaggctggtatggttggattggtgagaatgacacagaaccggatgcttcactgatcgagttcaggaggcaagcacaccagttgctctgggatgcacttgattattttgtttctgttgaagctgatgccttcttccccgggtttcacaatgacggtagtggttggccagactactcaagtttggtcatggggcaccggttgtaccaaacaccttccggtataacctacaggccggacaggtacagagctattatatttttattgttacatattttttgtacagcttggaacagtttttcttatccgcagcaaataaataatgcattcaatatttgctaaattgcaaaggaaaaaacgtaactgacattagtggtagtaaag

SEQ ID NO: 11214 - DNA, 2044 bp, Zea mays
ttttttttttttttttgtatgataattttcctttaccatgtgggcctttacctttgaaatatgaacttcatgttttgcttttatacgacattgtttgtactaatctaatcattatgaaaatcaagctcgagacaaagaagtttaaagaaagaaaagttaactataaaagtagaaagacttcgtctcttctttccattccttggtcttgtggcacacattgagctgcacgatataatctgcttgatactatgcctgattcaccataccagcttactgattcatttttattgctaatgctgtgatgtaaacaatcctgtgattccaggctggacttctacttcaagcattaggttacccaccaactacaataatattcttggctggttccgagacttttggtggacaaagaatgctgattcctctacgagctatgtttgctaacctagtcgatcgaacttcattatgtagtcagagggagctgtttgatttagttgggtcagaagatcctctaacctcagatttgccacagcctccacctcccaaaagtgaaaaacaactcattgaagaatggaagagagcagggcctcgtccaagaccgctgcctccacctcctgcaaggccattctatgcacatgagaaggaaggctggtatggttggattggtgagaatgacacagaaccggaggcttcactgattgagttcaggaggcaagcacatcggttgctctgggatgcacttgattattttgtttcttttgaagctgatgccttcttccctgggtttcacaacgacgggagtggttggccagactactcaagtttggtcatgggacaccggttataccaaacaccttccggtataacctacaggcctgacaggaaaattattgctgcactgtttgaagaagttaacgatcataggtatcatccaccacggaattggacaattgctgcacgtgagcacctcaacaggagtgcaagtgtggaaggcatcgtgtcatcggctatgttgtcaaaacctgtatcgtttcttgcccacccattgccagagtgctcttgcagaacaccaaagtcacctgctgttcaaccggtaaaagacagcaatggcagatccctatttggaggtgaggtagagtgtcctgattggatggcacgcagcctggcaatggcatctgctaggaatagcgaacctcaaaatgaggactatgaggatgagttgcgtgaagatggctctagccaagacacgcaggaatctaatacaagtgactcgaataaatcttcggagcaagatgaagagatggatccggatgattagagatatgcggagcacctttttaactgctaccaggtccaggctactcaagcaagaaaagcaggaatcatcttgcatcgcagcagcgcatcaccatctggagtagccccagcatgacaagctggtcatccatcgtgggggcttgcctggatcgtactctggtatacaaccaggctgaatacgaaactaacactttgttctcttcttccttcacgtcttactcatttttttgtttacgcgaaattgtttctgtacaaatgtcttaactgaaaatacattaatttttgagtgggtttgatatgtagccatttgttaggtaatgagattggcttacggtgggcagatgtgcacccgtaaaataccggacagtacaggcattgccattttgtcccacgttaattgttgagttttgttggtggccgaagagcctgcttagaccatccaggtgcatcaaaatagtacccaaaaaattaaaatgttacattatttaaagtgtttaggtactaaaaataaatttagcttaaagtgagccttaaatcatgtattttaggaaaaagaaaagattgaggatgatatagaaaataaggacgtgacattaattcaggatatttttataaaattttgtaaaaatagagtattgttggagctattttttatggaataagttttatatattgagatagtatcgattgaagacagatgctctttgaagggtggtgcttatgcatgact

SEQ ID NO: 11215 - DNA, 1949 bp, Zea mays
aattcggcacgagggccgcggccgcggcccgagtttttaatacgttggctacctcgaggccggccgggacggcctagtttcacctcccccattcccttggaattggatttgctcccgaatccggcgaggaagcgaccggcactccacgccacgccgcggcgcccaaggaagggaagcttggggccctaggcctcgtctccatccccgccgcagccggcgcgaggcggcgcggcacgagcacgacggtcaccatcagccaccgcgcgatcccgggggacggccaggccagattccacaacgttttactcttattaaactccccaacttcgtctaaggaagcaagtgatttcattatgaaagactggtctattttctccaaacttgatcacaatggaggttacctccccaggttcccaatggactctccaatatctcatgatattgggttacgattggtatcgcaagtcggaaacttagttgagtgttcatttcaacatccaaggcatatatgtgctacggggagtggagctgttcaggaagcattcagctgtttcaacaagtttgctggagctttctatttctggttttctagagcatcgaatcctaagttattccaaaggctatcagctgctgcaggctcaagttcaagagcttgtcggtcacacataaagcaagtgacctcttgcttgcagcatttacctggactggagtttggttcacaattaagagaagatcatgctgtacaagtgcttttagcaaggcttgcaagcgcaacttttggacgcctgtggacagaggtggaggagcggcatgcctgcaacatccttatgctggctgctgctactgtaattccaccatttgaaaacatatcaccaaagatgctggctgcgtcaatggcactaagaaaagatcgtggaaacatagagcctactgaacagtcttattcagaggaaaaccgtccaggttgtgcgtgtgttgctgtgccaagagtactcttaccagaagatgcaacggaaccaacaactggcatcaagttccccactgtactcgaagacaattccaatctgactacagaggtccttgttggaatgggttttagaagcatgcgaataatgagggtcaaaaatctgaatctttatgcctttggattatatatacaacctgattctgtctgcaagaagctgggtccaaagtacgcttatattccagatgctgagttaaaggatcacccagatttctatgaagatcttctgagggaaaatattgatatgactgttaggctagtagtaagctacaatggtctcagcattggcacagttcgagatgcatttgagaagtctcttggcttccggttgcaaaagatgaatcctaatactgattatggttgcttgaagacttttggttcttgttttagtgaagacattcgtatacctgctggtacaaagattgacttccggcaaacatctgatggccagctaataactgaaattgatggcaaacaaattggcactgtccagagcaaagatctttgcagagccttcttcgatatgtatattggtgaccccccagtttcagtggagactaaacaagacattgcgcaaaatgtggctggactcataagaagatgctagggaaacgggaaaactaaatcgaagaacctggaattatttcattcatctatacaaggagaggacatataaacagaaaggaagccaggagaggatcgattgtatttatagtggtagactgtctttgtaagctataaacataaagcatatgcttggcaaaggcctccatgcctttcatatggtttggcatctttgccatttcctggctggctggcgtgctgtatcatgtcgacaaatatatgatacagtaaaaagttgtacaacaagagcatgtttctgtgccccaagtgaaaaatgacggggttcagctttgttcatccc

SEQ ID NO: 11216 - DNA, 1004 bp, Zea mays
gggccaacttttagcttattaaaattggacaacttcaaaaattaacatctgccgctagttatgaagataattgttcgtatttctttctgtcggtaaactttaggagtcttggccgagctctctgcaaaactatattgcagtcatcgaatacctctagtgttaaatgggaaaaaaacacgacagctttggtcatggaaaatagacgtagaaggtttacactctcgccggattttttccaatgggaggcactgaaggatagtagagtgccaaatccaggctatgtagaaggatccactaatcgtttcattgggtcagtgatgtttggcgaacgcctcttccaaagtcttcagccaattcacatactggttgcgctccttctgaaggaggtgttgaagaatcgaacttgccagcttggagttgaagcctctcgctaccagatactctcgtaaagcagcctgtagccgaggatccagatctctgaacgccggcccttcgtactcgtcttccccaccgccgccaggagaggagtggtagcggacagcgttgatagcgtagtcagcagcgccgccgccgcgctcctcctcccccacccaagacgcacggcagtcgaagtgcaggacgggcggcgcgccaggcttactgacgaagaccttgacgagcgcggccctgggcagcgggtctcggcccacgaaccgcagcggggcgagcagcgccgacacgaggacctcctcggacccggcccggcggcgcaggagcacgtcctgcgcgcgcggggcgtcagacacggtgtcgaagtcgggcgccagctcggaacggaatggagggggagccgaggaggagagctcgttggccagctcggcgcggacggcggccaggactccgccggtggtcgcgccccggcggagggcggcggacgttctcagccgccgcaggaacatggcgccccgggccgggccgtgccgatcgattcggtctcgcagcccgcaaggagtcaccccggccgg

SEQ ID NO: 11217 - DNA, 2080 bp, Zea mays
  misc_feature (2024)..(2025): n is a, c, g, or t
  misc_feature (2076)..(2076): n is a, c, g, or t
attgccgaccaggctccctcgcttctgttcgtctccctcctcgcgttcctctcttccgctcgccgccgccgccgcatccgtcaccttcacactgcgctccctccatccctccctgtctgcggcgactgggtggtctaccgctgccctcgctttcgcgggcgaagagcgcccaccagtttccttggatctttgagctttggaagatgccgaggtggacagagaattctgcttccaccaaatcagctgaattggtgaaacaacaagaccgtttggagtttgacgatcctgatgaggtagacgaagaggaagaagttgagtatgaggaagttgaggaggaggtcgagtatgaagagacagaggacgagtatggacagactgaagctgtacgccaagttgatgctaaacatgacagtaaaatggtggatgctgatacggatgagggtggaaaagggagtcatgatgaacttcttgctcttcctcctcatggatccgaagtttatgttgggggcatcgcctctgatgtctcttctgatgatctcaaaaaactctgcgagtctgttggggaagtagtcgaagtgcgaatgccaggaaagagtggtaggctgtatgcctttgtcaatttcagaactaaagagctggcttcaaaggccatccagaagttgaacaataaagatctaaagggaaagaagataagagtttcttcctcacaggctaaaaacaggctatttatcgggaacataccctataactggacagagaatgaatttaaaaaagcagcagaggaagttggccctggagttttaaaagttaatctcgtgaaggcaccacattcagatacgaacaagggttatggatttattgaatactacaaccaggcttgcgcagagtatgctaagaagatgatgtctaccccagaattcaaactagataaaaatgcccctaatgtcagttgggcagatactaagaatggtggtgaatctgcctctactgcacaggttaaatcactatatgtaaaaaacctgcccaaggctgttactcaagagcaactgaaaaaactatttgagcaccttggagaagttacaaaggttgttattcctcctgcaaaagctggtcatgaaaatcgatatggttttgttcacttcaaagaacgatccatggctatgaaggctctggaagacactgagagattcgaacttgacggtcagctgctggattgttcacttgcaaagcctcttgctgataagaaggacgatacatcagcacctaaaggaggtccattgctcccaagttataccccagttggatatggactgatgggagcctataacccactcggaaatggcctggcagtggcaggcgcttacaatccgtatggaaatggactggcaggtgcttatggtgtgcttggtgctcatgctgcacagccaatgttgtatgttccaggtgctcctccaggttcgacaatgatcccaatggttctaccagatggtcgtcttgtatacgtaccgcagcctgcggggcagcagcctgtgcccatgacttcgcctccgccgccacagaaaggtgatcgtcattatggtggcagcggtggatcgagctccggtggaaggcgacaacagaggagagatgacagtggtggtagtaacaccaacagccgcaggggtcggcgccgtccctattgatgcttgtcgctgttagcgcttagaagttagaacctagtaggcatattcagagtatctctgctgcagtacaaccatgatgcagacgccaactgatgctggaaaccgtactttctagtggttagttttttcgctgtgcgtctcgtgtctgtaacacaggctgctgttgtgataagagtaataacagttccaagtggcagatgtggtttgggatgcagtggtaaaatgaatcagttccccagcttcatgaataactatgctgttagtgtctgaggtttacattgtgtcagtttggtcacttttggtgtgatgagttttagtagtggtgtggccggtggatatgcnnaaaaaaaaaaaaaaaaaaaaaaaaaaaaaaaaaaaaaaaaaaaaaaaaaanaaaa

SEQ ID NO: 11218 - DNA, 2866 bp, Zea mays
  misc_feature (2261)..(2261): n is a, c, g, or t
  misc_feature (2828)..(2828): n is a, c, g, or t
attagtttacagagaagaaatggttcgatcaatgtgtgcttataacataaagttatccagtacacgatagatgtagtaactgaaggatgtaagaagtgtggcacgcctatcaaatgtctggtctctgttaaggcacatgtattttatttagtatctgtggctcttgaatttggcgagagacagacctagagaatctaggtgagaagagtatctctgttttaggagtttctgcgaagttttctttggtccttgcagcattttcatctcctcatcttagatcttaagagcagttctctgaaccaactgttgcagtggtatttccctgttgatttccttcatattaatatccttggtctttggcagtaccgcagcctgcgggacagcagcctgtgcccatgacttcgcctccgccgccacagcaaggtgatcgtcattatggtggcagtggtggatcgagctccggtggaaggcgacaacagaggagagatgacagtggtggtagtaacaccaacagccgcaggggtcggcgccgtccctattgatgcttgtcgctgttagcgcttagaagttagaacctagtaggcatattcagagtatctctgctgcagtacaaccatgatgcagacgccaactgatgctggaaaccgtactttctagtggttagttttttcgctgtgcgtctcgtgtctgtaacacaggctgctgttgtgataagagtaataacagttccaagtggcagatgtggtttgggatgcagtggtaaaatgtatctgttccccagcttcatgaataactatgctgttagtgtctgaggtttacattgtgtcagtttggtcacttttggtgtgatgagttttagtagtggtgtggccggtggatatgcagtgaaattgtatcgcttgaacagtgatcagatacctctatggaagggtgaaaacccacaaatgcttcggccaaaaagctgtctttgctctagtacaaaactgaaggtagcttattgccaacttttagtttattaaaattcgacaactttaaaaattaatatctgccgctagttatgaagataattgtccgtatttccttctgtcggtaaactttaggagtcttggccgagctctctgcaaaactgtatcgcagtcatcgaatacctctagtgttaaatgggaaagaacacgacagctttggtcatggaaaatagacgtagaaggtttacactctggccggatttttccaatgggaggcactgaaggatagtagagtgccaaatccaggctatgtagaaggatccactaatcgtttcattgggtcagtgatgtttggcgaacgcctcttccaaagtcttcagccaattcacatactggttgcgctccttctgaaggaggtgttgaagaatcgaacttgccagcttggagttgaagcctctcgctaccagatactctcgtaaagcagcctgtagccgaggatccagatctctgcgcaaagaaagaaaggcaaacactgtcactgaatgcagatgcgccagttctacaaacaaaaactctagtaggcaggcagttgtgttgatgttctgttctggagaacttgcatcgtttatgattccttggtgaaccggcataccatgatctgaagaattgtcagtcaactactttaggaacgagaaggggcaaagaataacagcactagtcttgacatgcaatgcaatgctatttacaattttaatcctgcatggattaactatctataaatttcaggaagccatcctcagctatactgtgacaaatttaagatgaaaaatggcagccatctttgcagaatgtgtacacgatgttgatcaaaatcataacatacgtatgtgtgggaaggagatactcgtcttacagaaggtcagttttattcattagtctagttcatatgatttacatgagcagtaaagccagctctaatctctgtgtatgcattacgcaaaaggaaacaaaaaaaaaacagcatccgcagaagtatttttaaaagagaaaaaaaagaaacaagcagggcatacgagcagcacccacctgaacgccggcccttcgtactcgtctgctccaccggcgccaggagaggagtggtaccggacagcgttgatagcgtagtcagcagcgccgccgccgcgctcctcctcccccacccaagacgcacggcagtcgaagtgcaggacgggcgccgcgccaggcttactgacgaagaccttgacgagcgcggccctgggcagcgggtctcggccnacgaaccgcagcggggcgagcagcgccgacacgaggacctcctcggacccgtcccggcggcgcaggagcacgtcctgcgcgcgcggggcgtcagacacggtgtcgaagtcgggcgccagctgcgagtggagtggggggcaagggcaaaggcgtgagcagagcttcttgggctggatgcggtgcgggggttagggatgcgggttacctcggaacggaatggagggggagccgaggaggagagctcgagggccagctcggcgcggacggcggccaggactgcgccgtcggtcgcgccccggcggacggcggcggacgttctcagccgccgcaggaacattggcgcacggggcggggcggggcggggcgatgcagatcgattcggtctcgcaggctcgcagcccgcaaggagtcacaacagtacaacacaacaaaggaagcattttttttttttgcaaaataggctggtggaccctcaaaactcaaaaggaagtctctatgcctctccatagcctatttttgcttttgcaacagtttagttgctgccaaattaatttacaaacgaaacanccgttcattaatgttatcgatttctgacagcatgagag

SEQ ID NO: 11219 - DNA, 1799 bp, Zea mays
  misc_feature (1493)..(1493): n is a, c, g, or t
  misc_feature (1573)..(1573): n is a, c, g, or t
aataccagcatcattttctacctaaaataaaaacctataaaacgggagaataaagaacggacacgatctggttgcaacttgcaagtgcacgcgacgcaacgagcacacctttgtcgctttgcagtctaccgcgccaccgtggctggaaagttgggcccacacggcagcgaggggaaccgggaacagccgaacagccacggaacaagagccgggagcagggtttttggctgggagacccgaccaagagaggaaggtcagccagccaaacgccaccgccgccgtgctcgcgccgcacgcaactctcagctctctgacgcctcctcctccgtcgattccgacgagagagacgcaaaccaacgaggtaggaaggagcgcgaagatgggagcgggggacggtgaggtcgctgcgagcaaagacaaggccagcggcggcggcgccgagcggacgtcgctggacggcgtgcgggataagaacgtgatgcagcttaagaagcttaatacggcgctattccctgtccgctacaatgaaaaatactaccaggacgccatcgcctccaaggatttctccaaactaggtgcgccatccaatcctctctccgttcaccctcctctgttccctgctctatgccatgatttttcccttgagccattggatctacgattggggtccaaaaggacgagctgttgcggcgagattgagaagatgccgctaggattcagacgaatgtgatgtgtaaaaagcgatgacttgttgggtaggcccgatcttggagggtcttggtagctgcggtgtttatactgggtaatgaagtgtgactgcccccagattgtgtggatgcatttgagggctcatactgattatattgattcatgtattgggtcagctgattatgtgtgaaactggttgctacccctcttgatgagtgacgccgacagctgaactgttgtttccctgcatttttctgcagcatactttagcgatatttgtgttggtgcgatagcttgtcgcctggagaagaaggaaggaggagcagtccgagtttatatcatgaccttgggtgtactggcaccgtatcggggtcttggtattggtgagtttcccccttcggatccacttttgcagttatttgaagcgattaacctgttttccatgatgtttgtaatgcctcggaagtcagatatgtgtgcatcatcattgatttcaatagatatgtggtgactacatcttgagtctgcacacatctattcctgataattgatatcgtgaaattaatatcaattgtattcttgtttatgcattgcaataccccattctcattttattttacaacctgacgtcaactgcattaacaatgctctaacactatcttctttcatcacaacctaaagaggtagtattgcttacaacttcacatacagtgctgatgtgttgtaggacattatataagctgtttagttggcactattattgttaacttataccttctgtaagntaagactatgtgaaaagttgaactacagctatttatttactagagctgttccaaattgctgatgcaatttatgttagtanacatgtcttctcagcttgcttgcatttagctactaggctttcatctcctagtaaagttggtgcatattgctgctgcttttcccaagtgtcaatgcttaagcaataacctgcatgtgtcactacataaaagttaaaattagtgtgcgtacagatcttgtttttagcacatctgaagcctcatgctagacaatcagtgttattacttgtagattttccatatcaaggc

SEQ ID NO: 11220 - DNA, 1126 bp, Zea mays
tgggacctcgagccggccggacaatttcaaagagaagagccgggagcagggtttttggctgggagacccgaccaagagaggaaggtcagccagccaaacgccaccgccgccgtgctcgcgccgcacgcaactctcagctctctgacgcctcctcctccgtcgattccgacgagagagacgcaaaccaacgaggtaggaaggagcgcgaagatgggagcgggggacggtgaggtcgctgcgagcaaagacaaggccagcggcggcggcgccgagcggacgtcgctggacggcgtgcgggataagaacgtgatgcagcttaagaagcttaatacggcgctattccctgtccgctacaatgaaaaatactaccaggacgccatcgcctccaaggatttctccaaactagcatactttagcgatatttgtgttggtgcgatagcttgtcgcctggagaagaaggaaggaggagcagtccgagtttatatcatgaccttgggtgtactggcaccgtatcggggtcttggtattgggacaaagctgctgaatcatgtgttcgatctctcagcaaagcaaaacatctccgagatatacttgcatgttcagaccaacaacgatgatgcaattgctttctacaagaagtttgggttcgagataacacagacaatacataactactacatgaacataacgccaccggattgctacgttcttatgaaattcattggccaggctgctacaaagaaatgagaagcagcccgcgcagctttgagagaccactgccactcaagttatggtggagatagttgggatccggtcacagtttgtgctgtgctttcatttttgtgatcttgaacgctgtagactcctgagtagcctttgctatcatttacattgggagtcatcttgcttcagggcatggattcgtgcctgaacaatttcttgagttgctgcttttgtgggacagctgtgatcttgtaggtctgtatgcccaatcgggcttgtatcttgatggatcacgatgtcaggatgttctgcatgctcattttggttgaggtgtgacgattcagttattcatgcctaaaaaaaaaaaaaaaagacatgataagataatccccgagcttgaaat

SEQ ID NO: 11221 - DNA, 1434 bp, Zea mays
gcctcgcgcactcgcacttaacctagccgccagccctcgacgaccgacgcgacgtcgccttcgcccctgctccaacccctgcccccttcgtcgcctccggcctcggcaggaagcatcctccatcgacggtcctgtcgatgcctctgctgtcatcgttctgaggagagcctcagtggtcggatccttgatgtgttgggccccgtcgaggcgattgtcaccacttcacacaggggcaaagtgcggtcggtcctccccctctggatcctccaccgccaatgctcgatgcctgcatcgacaaagctcccgtccgaagtctccccctttcggatccttcccctgcccgtgcttgcttcctcgtcctgggatactccgccggccccttcatcgtccagagaacctggcatgagacacgccaccagagcttgtttacagttcagcccagttggccattactttgctagtgcttcacatgacaggactgctagaatttggtcaattgataaaatccagcctttgcgaataatggctgggcatctttctgatgttgatgtaagtgaacttgttggtcctatactctgtgaatagagctttggttaaattgaattattggtgtttgtaattcttttatgtttggatatctacttgtttttatcaatgccctgtattgccagcatgatttggctgatcttttttccttctgcctgaaaatgttttgcataacagtgtgtctagtggcacttaaactgtaactacattgctaccggctctagcgacaaaactgtaagactatgggatgttcagacgggtgaatgtatacagatgtttattggtcataggagtatggttttgtcactggcaatgtcacctgatggacgatacatggcctctggagatgaagatggaacaatcatgatatgggatctctcgactggccgttgtgtttcaccactgctaggacacagctcttgtgtgtggacaattgctttcagctgtgaaggagcattgcttgcatcggggtcggccgactgtactgttaagctctgggatgtcgctttcagcacaaaagccatgaagacagaggataccaaaggcagctcatcagctaaccgactgagactgcttaaatccctgcctacaaaatcagctcctgtctatagcctgcggattcagtacctaggatgaagtttcagggctgccagatttcagtttcagagctgcaagatttatgcagaatttgaagactatgctaccaaaaaagctttcctaatttacctatgatacagttcagtattgtttaggataagtcatatgtttatatctgtctccaaaaatatttgtacacgcatgaagtggtgattattttaagttgtgctactctgtatattgactattttatttcaatgagaaatggtttgtccaaaaaaaaaaaaaaaa

SEQ ID NO: 11222 - DNA, 2685 bp, Zea mays
gccggccgggctgcgaactcgacacgacgcattgaccggcccattacggctgaagggagtcgctcgccgccgcgtccccagtccccccccccccccccccccccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacaatggaggacgaggagatggagaagaaggtgcagcagtacttgcagcgcaagggtttccgcctcactgagcttgcgctccaggaggagcgcaaccgcctctccacctccgccatctccgacgttgcgcttgcacggtctgacaatgatccagcgagatactacgatggatatagcagattaagaacatgggcatacagttctcttgatcaatataagcacgaattacttcgcgtcctttatccagttttcatccatagcttcatggatctagtggcagaaggacatatgcaggaagctcggtcatttttccatacatttcgggaagatcatgaggtgatgcattcaagggatcttcagaagctggaaggcgtcctgtctccttcacacttggaggaaatggaattggcccggtcttttaggaaaaataaatttaaaattaaattatgtgagtattcgtatgaattgcttctccagtatctccagaaaacacaagcccttgtggtgcttggagtaatcaatgagcacataacttttgaagtatctcctggtcagccctcattaatctctgatgacgctgatgttgttgctctgattgggacaagtaaggacttggcaaaacagataaatcagaaggaagtacattgggggttgcttgaagattctgttgaagagcgaatggagaaggcactagcagaatctgataaaatagaagctgaaagcaaggatgctgatgcagaagataacaagaaaagaaatgcagaaggtggaaagcaaggtgcttctcttaagaaagccaaaaaggacaagcttgttggtgcgactggaaaaagcgtcagaactgaaacaagcatggtttctgtggcacctcgagtgaaaccggagctaactcttccagcaacgcctgttgaagttgaacaatcaattcttgaggacctacgaaaccgtgcacaactgaatagtgtggcattgccatctgttagcttctacacattccttaatacacataatggattaaactgttcctcaatatcacatgatggatcactggttgttggtgggttttctgattcgtcagtgaaggtctgggatatgtcaaagatgggccagccagcaaaaatatcaagatcacagggtgagaatgggccttcccagggtgagcgcatatcaacattagatgaggggaaacgaacctatacactatttcaaggccattctggaccagtttattctgcggcctttagcccgtttggggatttcctcttgtcatcatcttcagactcgacaattagactatggagcaccaagctgaatgctaatcttgtctgttacaaaggacacaactacccggtttgggatgtccaattcagtccagttggccattactttgctagtgcttcgcacgacaggactgctagaatttggtcaatggataaaatccagcctttgcgaataatggctgggcatctttctgatgttgattgtgtccagtggcatgtaaactgtaactacattgccactggctctagcgacaaaactgtaaggctatgggatgttcagacgggtgaatgcatacggatgtttattggtcataggagtatggttttatcactggcaatgtcacctgatggacgatacatggcctccggagatgaagatggaacaatcatgatatgggatctctcgactggccgttgtgtttcaccactactaggacacagctcttgtgtgtggacacttgctttcagctgtgaaggagcattgcttgcatcgggatcggctgactgtactgtaaagctctgggatgtcgcttctagcacaaaaaccctgaagacagaggataccaaaggcagctcagctaaccgactgagactgcttaaagctctccctacaaaatcaactcctgtttatagcctgcggttttctcggaggaaccttctatttgcctctggtgctctctcgctaagctcgtcgtaagctgtgtttttttttgcagaaaactagaactggtcctgttttgacattgagtagtgaagctggcatttcagagactgcctattgtacagctaatattttcattagcaattccaacgaactcagcatgtactgccgaattgagcaccgcagattcgttgtagcgggttgtgatattgtaacaatattattaggtaattacgttctgtaaaattgttttttaggttgtgaccttatgaacgcaactaaatgtacaagtgctgacaggcgatagcgtgaatgcaatggtctatcaggtctggagtttggttttaaaaaaaaaaaaaaaaaaaaaaaaaaaaaaaaaaaaaaaaaaaaaaaaaaaaaaactcgaagagggcgcggtcc

SEQ ID NO: 11223 - DNA, 2234 bp, Zea mays
gtgatgtttatgttatgtatatatatagttatgttatgtatatatatagtttaactatttatctatagatgtatgtgtgacgtttataaacatgaatgtctcacacacactcttttactcgtacacacagccgcaataatgggtgatagacgtgattggatgtatgaaggtttcaagaagggtgggtgtcacacaagtgaatggtttgccaagacgcaaatgtttctggaccatgcagctgctttgtcacaaatagataatattaggtgtccatgcaataaatgtagaaatatgacgagccacaccaagaggcaggtcacactacacctgtgctcacatggtttcgtgccaggctataaggtctggtatctccacggtgaagatgttgaacgagcaacagaagtagaagttgatgacggtgaagatgatgttgataggatggaccagatgcttgaggatctgcagcctgaactggcaccagatcatcatgattcacctacaccggaggttcagaagttcttcgacctactcaaagcgtcagaagagcctcttcacgggcacactaacgtgaccgtcctcgaattcgtgacccggctgatgtcaatcaagtccaagtttgcattttcaattaattgttacaaggagcttgtggatttgattagcgaggttcttcctacgggtcacaagatgcccaaagacatgtaccagtccaagaaattgcttgaaggtcttggtatggagtatgagaagattgatgtttgccaagacaactgtatgcttttttggaaggaacatggcagagaacagaaatgcttaaaatgtgggaagtcgaggtacgtggagcttgtaaatgaagatggggagaaggtggtgacaaaggttgcacataaacagcttcggtacatgcctctcactcctagagtgaaacgtttgtttctctcgaggaagaccgctatgcacatgaggtggcataaagattgtacggacagacaagatgggttaatggtgcacccgtcagatggtgatgcatggaaggctcttgacaaatttgatccagattttgccagcgatgcaagaaacgttcgtatcggcttggcaactgatggtttcacgccgttcaatatgaccgctgcgtcgtattcatgttggcctgtcattgccataccgtacaaccttccacctgctctttgcatgaaatatgagtttatgttcctatgtcttgttatacctgggcctgagcatcctggcgtacgcctcaatgtgatgcttcaaccactgattgaagagttaaagaagctatggcaaggtgtggaagcctatgactgcttcaagaagcagaaattcaatcttcgtgttgcatatctgttctcggttcatgattttatggcgtatggtattttctctggatggagcgtgcatggtagattgacgtgtccttattgtgctaaagatacagattgttttcgtcttagtgctggtggcaagatatgttactttgattgccatagatgttttctacccttcaatcaccccttcagaaggcagagaaaggaatttaggaagggcaccattgtcacgaagggaccgcccaagcgacgtagtgggatagaaattacagaagagcatatgaaacttgtcctagacgagagtgggaaaaggtatcaaggttttggtgaggagcataactggactcacatatgtggcttgtgggagcttccttatgctaagtcattgattttgatgcacaacatcgatgtcatgcatcaagagagtaacttttgccaagccctcataaatacatgcatggatttccctgataaaacgaaagacaatgacaaggcacgcatggacttagcagtgatatgtgatcgtccaacccaagtgcttagagaaaacggaggcaaaccaaaagctgactattgtctgaaatctaagcaacggaaagaagtgatgaagtggatgaaggatattaaattccccgatggttatgccgctggttttagaagatctgtgaacttgaagacaatgaagatgaatggactgaagagccatgacttccacataattatggagaggctcatgcctgtaatgtttcgtgggtacatttccgaagctgtgtggaaaacgttagctgaagttagctatttctacagacagttgtgtgctaaagaaatcagaagagatgtgatggaacagctggagaaagagcaccggtgcttttgtgcaattggaaa

SEQ ID NO: 11224 - DNA, 1487 bp, Zea mays
  misc_feature (7)..(7): n is a, c, g, or t
ctcaacncgtggatcccccgggctgagggagagctcactagtccccccccccagagcgcacggcccagttgggcccaatactcgacacgactcattgaccggcccattacggctgaagggagtcgctcgccgccgcgttcgaggcgttccctcgtcgcgctcgcgccgtcgaccttcaccgctcgctgtcaggtctgacaatgatccagcgagatactacgatggatatagcagattaagaacatgggcatacagttctcttgatcaatataagcacgaattacttcgcgtcctttatccagttttcatccatagcttcatggatctagtggcagaaggacatatgcaggaagctcggtcatttttccatacatttcgggaagatcatgaggtgatgcattcaagggatcttcagaagctggaaggcgtcctgtctccttcacacttggaggaaatggaattggcccggtcttttaggaaaaataaatttaaaattaaattatgtgagtattcgtatgaattgcttctccagtatctccagaaaacacaagcccttgtggtgcttggagtaatcaatgagcacataacttttgaagtatctcctgggcagtcctcattaatctctgatgatgctgatgttgttgctctgattgggacaagtaaggacttggcaaaacaaataaatcagaaggaagtacattgggggttgcttgaagattctgttgaagagcaaatggagaaggcactagcagaatctgataaaatagaagctgaaagcaacgatgctgatgcagaagataacaagaaaaggaatacagaaggtggaaagcaaaatacttctcttgtgtggggacacttgctttcagctgcgaaggagcattgcttgcatcggggtcggctgactgtactgttaagctctgggatgtcgctttcagcacaaaagccctgaagacagaggacaccaaaggcagctcatcagctaaccgactgagactgcttaaatctctgcctacaaaatcagctcctgtctatagcctgcggttttctcggaggaaccttctgtttgcctccggtgctctcgcgtaagctgcgtgtttcgtagaatacagctagaactgttccggttttgacatggagtagtgaagttggcatttcgcagactccgctgtggatcctattgtagagctaatattttcgttagcaatctcaacggcccagcatgtatgcacagcggaattgagcaccgcagatgctttgtagcgtgcttgcaacattgtgacattgttattaggtaaatacgtcgtgtaattttttttaggttgtgatcttatgatttataaacgccactaaatgtacatatgcctgataggagatagcttgtaagggatgaccggatgatttggtgacaaaacaatgcattttatctacttctcaaacatgtaaaatatggatcatcctatacctttgacgaagcaacccctgtaccc

SEQ ID NO: 11225 - DNA, 1078 bp, Zea mays
gcacgagaccattacctagaacatcctaatcgaaaactcgaagcctcggatctccgccgagaaagcatctccaggtgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgagctctgccatcgcattcatgttacctctgaaagcactcagacaatcctctagatttattgtcaataacagctgcgtatttggcattggcttcatcaaagttgccactatcaaagttaacacgacgctagaaacactgtttgtcaggaagatgaacatcttcaacgaggccaaagtttacacttggaaaatcgaggatttctctgctctgaagaacccgtcccactcaccggagtttgagatcgctggatacacatggattatctctttgaatccatcctacgatggtaacagcctgtccttattcctgaaaatgaagaagacaaacgacgtccccaaaggctctgggagcctggtcgagttcgctttatccatcaaagaccaggaaaacggcaaggacaggaaatatccaggcaggtgccagttctcgagcaaacaccatcgctggggatggaagaagttcatctcgctggaggacttcaaggactcgtcaaagggttatctcatcaagggcaagtgctgcatcgaggctgaggtcgcaatcagtggctcttcgaagacggagtactctatgtaatttgatttgtgagagctcatgattagtgtttattctcgctagaaccaactatatagcgtgttccatatgtattagcatgccatcgagactctagcttgctctatagatatctcgacgtatccgctcttcaagcttcgttctgtcgagttgaatgtggtctaataagtgaatatatgcaaactgggatcttattattttaggctattctggcaaaaaaaaaaaaaaaagacgaa

SEQ ID NO: 11226 - DNA, 1437 bp, Zea mays
  misc_feature (17)..(17): n is a, c, g, or t
gggcacaataaacaagntagaggctgtacatatataccaaatcgaacacaccccgccggcacacaccggacacgaatcgctagtagacacagcgcacagcggcaagcaagaaaccaaacattccagtgcccttaccgttgcatgcagccatgacgaggatgagcttggcggtgtcggcgacgttctttgtgctcgcggtcgcctcggcggcgcagccggcgccgagcatgcccccgccggcggtggccgtgaacagctcccggctggagaaggcgtacgtggcgctgcaggcgctgaggcgcgccatcacggacgaccccaagaagctgacggagaactggtgcgggcccgacgtgtgcaactacttcggcgtgtactgcgcgccggcgcccgacgacccctgccagcgcaccgtggcctccgtggacctcaaccacggcgacctcgccgggacgctccccgaggagctgggcctgctgtccgacctcgccgtcttccacctcaactccaaccgcttctgcggctccctccccgagtcgctccggtccctgcacctcctccacgagatcgatgtcagcaacaacaggctgtccgggcccttcccgtcgcagctcctctgcctccccagtgtccagtacgtcgacatcaggtttagcaacttctgcggcgaggtgccggcggccatcttcgacaagaagatcgacgcgcttttcatcaacaacaaccactttcgagttcacgctgccggccagcttcaccaactcgacggcgtcgggtgatcgtgctggcgaacctgccgcgggtgagcggctgcctgccgagcagcatcggcgacatggcccgcacgctcaacgagctcatcctcctcaacagcggcatctcctcctgcatcccgccggagatcggcaagctggacaagctcaccgtgctcgacctcagcttcaacagcatcgccggcgcgctgccggacacgatcggcggcatgcgggcgctggagcagctggacgtcgcgcacaaccggctcgccggcgagattcccgagagcatctgcgagctgccgcacctcaagaacttcacctactcgtacaacttcttctgcggcgagccacgccggtgcctcgaggtgccgcgcgtcgacgaccggcagaactgcatcgctggccgccccgaccagcggccaggcgaggagtgcgtctcattcctacaccaaccgcaagtccactgcgacgcccacgggtgcgtcgcgccaccacctccagcggtgcatgctcctccaccgcctgtatactgaattactgatcagtggtaacttgtaaatgtttcctgcctcgtggtgtggaaacttgaagggtaaacacatacacatggtatatactgtaatttttattcatcaacagaagagagtaataatggattcatagattttcattaagaaaa

SEQ ID NO: 11227 - DNA, 3766 bp, Zea mays
  misc_feature (132)..(132): n is a, c, g, or t
gcgcgaaacgagagcaaaatgtctcaccaacggccaatgggcgaacctgacgtgccaccagattgtgtcgcgctgcaatgaacagcagcaagtcgcaggtcacgtcaggatctgatgcagacggggttcttntgccggggtgtgatgttaatatcgtgctgcagttctgggaaattaggaaatataacaaatgagatgaattgaatacgattgttttagagaatccttctgcgccaacagacatgataggattcctctgtccgtattcctctctttcttgagatttttcaactacgtactggttcatgtagtagagcatgacggcttaggcatcaaacaataggcttaattaattgtctgctgtagagcgatgcggctgcctgatcgcctaaatcctcacataagtagcagctgaaatcgatgaccaacaagactcagacgctgagtattgatgaacacagaaaggaaaaagagaaggaagaagaaagctgcccctcctcgactattattccaaacaggaagcatccttgaagcagccagccaaattctcaaaaaatcgtgcagtgcaggcgacatgattttagttgttcctgttgtcgtgcaggctaattaatataaagaaggctacgtaaacaaagctaaaggaatagcacaaacggccaacaaacacggggaataaaactagctacatccaaagcgcctaccgatacttggctttctcacgcaatcatttgatttgagcactacacaatccaacttttagtgtgtatggtttgaaaatcagagaaagaagaacgtagccaatcaagatcagtgcggaaataaaaaaggtactagcagtaacagcatcttatgagtgggtggggattagcagcagctacacaaacaagctccacggctcaagaaagcgaaaggatcacgaattcactggcagccaggtcaggcaggcaggtaggaaaattgtagtcacggctgcccaacttgtatcatggccccccaaacatgaacaaaatcgaagtggtcaacaatgatccaagcacaataaacaaagatagaggctgtacatatataccaaatcgaacacacggcaacggcacacaccggacacgaatcgctagtagacacagcgcacagcggcaagcaagaaaccaaacattccagtgcccttaccgttgcatgcagccatgacgaggatgagcttggcggtgtcggcgacgttctttgtgctcgcggtcgcctcggcggcgcagccggcgccgagcatgcccccgccggcggtggccgtgaacagctcccggctggagaaggcgtacgtggcgctgcaggcgctgaggcgcgccatcacggacgaccccaagaagctgacggagaactggtgcgggcccgacgtgtgcaactacttcggcgtgtactgcgcgccggcgcccgacgacccctgccagcgcaccgtggcctccgtggacctcaaccacggcgacctcgccgggacgctccccgaggagctgggcctgctgtccgacctcgccgtcttccacctcaactccaaccgcttctgcggctccctccccgagtcgctccggtccctgcacctcctccacgagatcgatgtcagcaacaacaggctgtccgggcccttcccgtcgcagctcctctgcctccccagtgtccagtacgtcgacatcaggtgagcgcgcgtctgcagaccgcatcagatttaattacttcaaccagcgaaacaagtagtactgcaacttacttgattacgtgatgcacgtgtgcttcaaggtttaacaacttctgcggcgaggtgccggcggccatcttcgacaagaagatcgacgcgcttttcatcaacaacaaccacttcgagttcacgctgccggccagcttcaccaactcgacggcgtcggtgatcgtgctggcgaaccttccgcgggtgagcggctgcctgccgagcagcatcggcgacatggccggcacgctcaacgagctcatcctcctcaacagcggcatctcctcctgcatcccgccggagatcggcaagctggacaagctcaccgtgctcgacctcagcttcaacagcatcgccggcgcgctgccggacacgatcggcggcatgcgggcgctggagcagctggacgtcgcgcacaaccggctcaccggcgagatccccgagagcatctgcgagctgccgcacctcaagaacttcacctactcgtacaacttcttctgcggcgagccacgccggtgcctcgaggtgccgcgcgtcgacgaccggcagaactgcatcgctggccgccccgaccagcggccaggcgaggagtgcgtctcattcctacaccaaccgcaagtccactgcgacgcccacgggtgcatcgcgccaccacctccagcggtgcatgctcctccgccgcctgtatactgaattactgatcagtggtaacttgtaaatgtttcctgctcctgcctcgtggtgtgaaaacttggagggtaaacgcatacacatggtatatactgtaatttttattcatcagcagaagagagtaataatggattcatagatttacattacgaaaatgcttcgctattctgaaaaggaaggaaaatttgctgctgcacgactcaactgaaagtttggtgaaagagacgtatcaatgtatttcattagtgtttcttgtactgtttttatatgtcgtagtacttaaaagtcagagccatcttaatgttctcttattagcagtacgacctgcaaatatatacttcaattcttataacattcatcagagtataaataaacgagttatagctgtagtttaaacgaggggccatgcctagacagaattaggaccactttgccttttacaggttaaaaaacgatataaatgttgggggcaatcgtgcaacctttgagtgttcataagagttgttgatgcaccaaccattgttgaaaatttatgtatgacaacaatatatgacctgcttaagaattgaagctaaggaaacagagaataataaattgaagagaatctagttcagtacaccaaatgatgtacagtagtggagtaatgcaactgatgaggattggtcaggggggggaatatgaaaaggtgctctcatggatcccccctgcacacagcgtttccttctactctttgcttgatcaacgcggagggcaagaaacttcccccctacctctctcgtcttggctgaagatgggtgacagagaccataaaactatgtacagatggctgtgatggggacatgaacgcatgtaagtatcaccggagaatgcaatcccaatcaggctcggtttgatcaactgaatgacaaaccaatacatgtcaagtagggaaaaagcaggataagttggtgcgtagtgcaaggagagaacaagttgtgacaatgacagccagtattataccaagtgtaccacggatacttaccctaaaacaaatgaccaaaagaaaagttgatggcgtcattcttacacccatgatcgggactcccagttcaaagatagagttaaggatcaggtcctcagaaaaccaagtctggttagcagctggcctaatgtgttctcatcgcaaagaagacagaaagacagggtcggtcaaccaagtttcatgggcacggacagagatgctcacattcgacctcacccacagaccagccacagtccacagagatgctcccaagagaaggatcctggccgcacgcgcgagaagacttccaagacgaaagttccgacccgactacagactacacg

SEQ ID NO: 11228 - DNA, 1466 bp, Zea mays
gtgtacgcgcagaaccttaaggaaaaatcaagtctgagaagccccagagatgaagcgcctatatatcagcgcacacccccgaccccgccgccccggcaacagcacacactggacacgaagcaagcacacagtagacacagcagcaagcaagcaagacaccaaacattccattccagtgcccgccttataccgttgcatgacgaggatgagctcgagggcggcagtggtggcggcggcggcgttcctggtgctcgcggccgcctgtccgcagctggcctcggcgcagccagcgccgggcatgcctccgccgtccccggccgcgaacaactcccggctggagaaggcgtacgtggcgctgcaggcgctgaagcgcgccatcacggacgaccccaagaagctgaccaagaactggtgcgggcccgacgtgtgcagctacttcggcgtgttctgcgcgccggcgcccgacgaccccttccagcgcacggtggcctccgtggacctcaaccacggcgacctcgccgggacgctgcccgaggagctgggcctcctgtccgacctcgccgtcttccacctcaactccaaccgcttcagcggctccctccccgactcgctccgctccctccacctcctccacgagatcgacgtcagcaacaaccagctctccgggcccttcccgccgcagctcctctgcctccccaacgtccagtacgtggacatcaggttcaacaacttctgcggcgaggtgccggcggccatcttcgacaagaaggtcgacgcgctcttcatcaacaacaaccacttcgagttcacgctgcccgacagcttcaccaactcgacggcgtcggtgatcgtgctggccaacctgcagcgggtcagcggctgcctgccgagcagcatcggcgacatggccgccacgctcaacgagctgatcctgctcaacagcggcatctcctcctgcatcccgcccgagatcggcaagctggacaagctcaccgtgctggacctcagcttcaacagcatcgccggcaccctgccggacacgatcggcaacatgcgggcgctggagcagctcgacgtcgcgcacaaccgcctcgccggcgagataccggagagcgtctgcggcctgccgcacctcaagaacttcacctactcgtacaacttcttctgcggcgagccgcaccggtgcctcgaggtgccgcgcgtcgacgaccgccagaactgcatcgccgcccgccccgcccagcgcccgggcgaggagtgcatctcgttcctgcaccagccgagggtgcgctgcgacgcccacgggtgcatcgcgccaccgtcgccgccacctccacctccacctatgcatgctcctccgccgcctgtatactgatccgtgaaccgtggtaactcgcgattattgcttcccttgccttgtggtgtcaaaattgaaagggtaaatgcatacacatggtatatactgt

SEQ ID NO: 11229 - DNA, 1742 bp, Zea mays
  misc_feature (1701)..(1701): n is a, c, g, or t
  misc_feature (1713)..(1713): n is a, c, g, or t
ccggccggatacagcacggaactccagttcaccgctgcctttcttctactgttcaccccgcgtgcgctcgctcactcgctctctcccctctggctctgagtggcgctagtgggcgaccgccgccgcgtccctccgtcaggtgcccaggtgtagcctcgtcagcccctccgtcaggtcttcgtcggccccctcgccgacgagcacccaccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgagaaaacctcattcatgttatttcttaacaaatttgacatatttgagagaaaaatacaaaaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagacattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctttttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgtctatgcaaaanaaaaatatatanattatattatattttatatcttatttagg

SEQ ID NO: 11230 - DNA, 1058 bp, Zea mays
gcggccgggaatctcacccacacggccccaccacgccaccaccacactgtgcagcagcctcctttcgtctcgtagttggctggggttgccaacgcgacacctcgtcggaatccggtcgcgcgacctccccttctcgccggccggagcgggtgcgccatcaccatggacccggaagcggtacggaaaagcctggagcccaccgcaactgtcgaaaaaatcaccggctccacccctgcgcggctccacttctacgaccccttcgtcctcagcggagtcagcatcgaagccgccgagcacggtcgcctcctctgctcctttgtcgtcacccctcgccttgcgagtcccgcggggtacctccgcagcggtgtcacagcgacgctcgccgaccagctgggatcggccgtgtttttctgcagcgggctccccagcagcggggtatccctcgaaatcagcgtctcctttgttgacgcggctgccgtcggggaggaaatagaggtcgagggaaagctgttgcgtgccggcaagtcagtcggtgtcgtctctgtcgatttcaggaagaaaaagacaggaaaactgatggcgcaggcccgtcacaccaagtatcttgtggcatcaagcagattgtgaggctgcccccttctgttaacaagatgtcaacataattgcgcccgaactgtccattactgatgccattattaataggcagcaacgatacaacgcttgtagtatatcctttatgtcaaattttttttgtgctgtatatttatttacatatgaaatccaagtatcagtggtgcctctgtgacagccaatcaagcgtgatcagataaggtcttgttagcgtgatcagataaggtcttgttcggttattctaattttacttggatcgaagtgtattggaatgtattgtgatagaattcgactggttatgaatttaaaccgattcaatactacccaatccacatggattaatgctgaaacgaacaagccctaagacattgttcggttattctaattccatgtgtattggaatggattgaaatagattttgacttact

SEQ ID NO: 11231 - DNA, 900 bp, Zea mays
gcgacaaatgataatggcaaaattgccaatggctcgagaattgagatgttgttttggcggcgacgacaaagggctaaaaaacaatcttgccgctccaaccaattcgtcttggttgccgacacggcacctcgtcggaatcaggtggcgcgacctcctcgccggccggcgcgacaccaccatgggcccggaagcagtgcggaaaagcctggagcccaccgcaaccgccgaggaaatcactggctccacccctgcgcggctccacttctacgaccccttcgtcctcagcggcgtccgtatcgaagccgccgagcacggccgcctcctctgctctttcgtcgtcacccctcgcctcgcgagtcccgtgggatacctccgcagcggtgtcacagcgacgctcgccgaccagctgggatcggctgtgttcttctgcagtgggatccccagcagcggggtctccatcgagatcagcgtctcctttgtcgactcggctgccgtcggggaggaaatagaggttgagggaaagttattacgtgctggaaaatcagtcggtgtcgtctccgtagatttcaggaagaaaaagacagggaaattgatggcacaggcccgtcacaccaagtatcttgtggcatcaagcaaactgtgaggcgctccccttttgttaacaagatatcaacatcaattgcgcccagactctccatactggtgccattattagtagtcagcaatcatgaaatgtttgtggcatatctttttttttcaaaaaaattcctgtatatattatatatatgaaattcaagtaagtatcattggtgcctctgatgcatatcggtctagtcatgttactttcacttgacagccatgatcagaatatatatgcccccaagggcgcggccgctctaa

SEQ ID NO: 11232 - DNA, 853 bp, Zea mays
  misc_feature (817)..(817): n is a, c, g, or t
ttgggtacctcgaggccggccgggtcagacctcttcaatcccgcccctcgaggccggccgggccactgtgcagcagcctcctttcgtctcgtagttggctggggttgccaacgcgacacctcgtcggaatccggttgcgcgacctccccttctcgccggccggagcgggtgcgccatcagtccatcaccatggacccggaagcggtacggaaaagcctgaagcccaccgcaaccgccgaaaaaatcaccggctccacccctgcgcggctccacttctacgaccccttcgtcctcagcggagtcagcatcgaagccgccgagcacggtcgcctcctctgctcctttgtcgtcacccatcgccttgcgagtcccgcggggtacctccgcagcggtgtcacagcgacgctcgccgaccagctgggatcggccgtgtttttctgcagcgggctccccaccagcggggtatccctcgaaatcagcgtctcctttgttgacgcggctgccatcggggaggaaatagaggtcgagggaaagctgctgcgtgccggcaagtcagtcggtgtcgtctctgtcgatttcaggaagaaaaagacaggaaaactgatggcgcaggcccgtcacaccaagtatcttgtggcatcaagcagattgtgaggctgctcccttctgttaacaagatgtcaacataattgcgcccgaactgtccattactgatgccattattaataggcagcaacgatacaacacttgtagtatatcctttatgtcaattttttttgtgttggatatttttttatatatgaaatcccagtatcangtggtggccctggggccaccccatcagcgtgaccag

SEQ ID NO: 11233 - DNA, 1877 bp, Zea mays
cgtctctcccccttccgtttcctcccgtccctgctcacacctctgtagctgcgcccgaccgaacccctcctaccccggaatcctccccccgatgcggcgccgataaggcgccgggaccggcggaagagcggggaatggcggggcgcggcgagaagcggcgccggacaggaggggcccacgaggagcccgaggaggaggaccgcatctcggaccttcccgacgtgctgcgcctgcagattctgagcctgctgccgctcaaatcggccatccgcaccggcgcgctctcctcgcgctggcgccgcctctgggcgtaccgctggccggagccgtcctcggtgagcatccgcctcccgccgggcggcggcgccgccgccgccgcggcgaccgcggccgcgctcgcggtgatcgaccgccgcgggcggcgccgcgtcgacggcttctcgctcgccttccacggcgggcagctcgcgcaggcggacctcaagcgctgcgtcgactacgcggcggcgtgcgaggccgaggacctgcacctccgcgtagacggcggcgcgggcgccggcggccgcggctcgcgcggcggcacgcgccgcccgggcatgctcaccctgcagttccccatggggtccccgctgctcgtgcgcctgtcggtgcgcgggctcaacctcacggccgtcaacaacgccatggtcgccacgctcgaggtcgtccacctccactccgtcttcctcaccgacgccgcgctgcgcccgcgcgtccccccccgcccccgcccccggggccgggacctccgctactgccgccgcctgcgccgcgtcgacttcaccaacgtcggcgtgcccaacctcaggagcttcaccgtcgtcgactgctcccgtaccaccgagctgcgggtccccgtggctccccgcctccggtccttccgcttcagcggcgccttcctctccagcaacatcctatccggcgccaaggcctctctcgagcatctctacctctgctccggcgggccagagaccggccttccagtcaccaacttgccctacgcagttcctcgcctgtcgaacctcactgtcctcaccctctgcagcattgctctccagtatgtttcttctttcacagccaaggatgtaatggagagcaacctgcatggcttgagggagcttcatttgctcatgttcgggatggccaactccaaccttgctgacatctatagcttcctcaagacctgcccgtgtcctcagttagagcgcctctttgtgcagctcccgacaaacaccggtgatgcattcacggagaacttcttgaaggtggaggaggaggacccgccaaaaggtggattagaaaaccttcgcttagccaagctgacaaatttcaaggggcaccgtaatgagatgcagctagtagcatttctgcttagacagtctagtagtctgaagaaactatttctgattgctcccaaggaggatcaccctcaaggactgcgcaaggttcattcagatatgctgcctgattttcttaaaaaagaaatatcgcatctggaaagagcttcagcaaatacccagatatttttcggcgagcctgatgctcagacccacccgttgcattcggaggtctttgtcaggttttagcttgaaatgagcaaaagctgttgtagcccaattcctgctcatatagatttagatttctcgttgttagataacggacatggggaaaaaagtatctgcaaggcatacagagtttgatatatgtttcctcttttgcaattcatattactaaagaagtcctgcatagcagttgaaatgcgagttgttctgatctgccacattttcttatccctctcttctctccctatttgtgtccattgtccaagatctctttgg

SEQ ID NO: 11234 - DNA, 863 bp, Zea mays
aggccagtcgacctcgaagcatccatccatccagtggagtcgagcctctcgcacgctctcctccagtgtcgcggagggaagcgtggccgacggggaaaaagatgatggaggcggcgtggacctccgcggtgaatcgggccaccggcatggccgactccgccaagcgcttcctcctccccttccgccgcccgccgccgccgccgccgccatgtacggaccccgaccctaaccccgtacagatcttgaaacgtttgcagcgacaagcgttttacgacattatgcagctgagggagagacaagagaaagttgaaagagtgatctcgttgttcaaagctaccaaagttggtccgttcgcagaagaaagcactcgggtcaagggcgttgtcaatgtcgctggctcgctcccaagagacatctcagaagcagaatcgtgtatcagttcacggtttgtgtttgaggctccctgtcaggaagaaggattccctgtttgccgagctcagcaccgaacatagttacgtgtctcaggaaaacgatcatatcgagaccccttttgtgttgtcaaagttgatgtacctgtcgaacatcagtgactcgttttcggttgctgttgtaccaaaaggagcgaggtgtaaagatttttcaacggaccaaaatatccgagaggtactttcttcagacgagcagcgatgccttcaatactaccatttttgcctgctaatgtggtaaggtaacagtttgcttaacaggaacattggctggccagtttgcgatcttcgctgaggccacctttgctgagtaaaagccacagatatgctggcggcctaatactgagatcgaagaacttcgctgtttctatagcgcag

SEQ ID NO: 11235 - DNA, 646 bp, Zea mays
ttcggatgttttttccccgggtgtgtcctcccctccggaaggaggttcctgaactggattgtggcttcgagctgactggtggtgtcatctgaacatagtttgtcgaccagctctgacaggccttcaagctctgactcagcagcatcccggggagccgctacgtcgggcggtgaggagggagtgaatgccggacgggtgattcctgcgaatggggctgtttcggcgcgtgtaggagtcagatcggaggcagggacggcgggagcgggctcgtcgcggcggcgcttgaagagtcccgtgtcgcggttgaggcggcggagggcgaggaggcagagtaaaagacgggctggtaggcgctgaatttaatgatctggacaaagcagtgtggaagttgaatatcattatatacttccgttctattcatgaatgacctttcatcatcatctgaacatgtgccggccttctcggatccaagaaacagatttagcatttgctttcctgaacggtagcactgataattttcactgtatgttcctatgatctttgtgtgaaccattgaatcctgtatcaatattcacctatggattttccaaaaaaaaaaaaaaaaaacggcacgagaagccggcacgagaagctttttttttttttt

SEQ ID NO: 11236 - DNA, 832 bp, Zea mays
ttgggtacctcgaggccggccgggagactccaggccgcctccccaaccacaccgggaccgggcggcatcctccgtctcgtaccgacccccgcaccgccaaaccctagtccacggcggcgaggcgaccttgcgacctccgttcctctgcgctccggctgagttgctgatttgggataatcctgttctctctgagtgaatcaacatgtctgggaatgatgataagccacatgctgctgcagacagaataaaggcagccacgttatcagtggctaagggattgagcagggctcaagctgaacgggctgcgactgctgctgcccgcaatgtgaatgcctatgggcagaaggaagagggaccaagccgctggcaggagaggaaggaagccaagagacagatgtatctgatgagtacagagaaggctgcgaagctgggcactgtgaagccaaaagcttcagaaacttcttctgttggcgcatatacccaatgccagaagtgtttccagcatggtcactggacatatgagtgcaaaaacgagcgggtgtacatatcacggccctcaagaacgcagcagcttaagaaccccaagctgaagaaaagcgtaccggtttcttatcaatttgagaatcctgatattataaaggagagggaagaggagcagaagatgatgaaagaaaagcagaagaaggagaaagccgaaagaaaaaagggaaagagtaagaggaagcatcgatcgccgagtgattcagatagcagcaatagtgctgcttcggtgttcgactctgactctgaatcatccggctctgaatactcttcccgaaccgattcagcctat

SEQ ID NO: 11237 - DNA, 2283 bp, Zea mays
tgcagctgcttctgtcccggcgatggcgacggatcttcgacgtaccgtcacctgaggaaagcgagcaagtgtgcaaaacactgtttttccactgtaattaagtttagaatgagcccaatagtgtgtgtagctcctagctgcggtctgcggagctccatttcaacagccagcccaatctttaacctttcagcagcacgcgccaaataacccccatacctctttttctcttggcccaaatcctccattcaaaatgctccaatgtcgcctacagaaacgtgatgcgaaaattctgcacataacagctaccacaccttcacacgttcctctctacatcgacctgatcatagtaagtatcatacaatatgccagtgccactaagaaaaggaaccaggctttcctctcctgaaatacaatctacaatacaacatctaccatcactcggcttcatctgcagtggacggcggcggcggtactggtggtggctgcacagcagcagcagcatcttcggacgttgcttccacagtatctgacgagtcattcgaacctgggatgttcggatcatcactctcgcttacttcctcctcccagtagctctgtagcagcttcatggctagctcgtagatcctgtcgctgtccacgtcctgcagatcctccagtttctccagacctccgcactctagaataaactcggcgtatgggttcgtccctgattcctcgcccttcttccccgcctcacctgcacggagtatgttctcaagaccttcaagacacgtgtatacaaggtcaggatcgttgtgggtgaggacgctgcagaggggctctaaacatccccggctgaccaaatactgaatttgatcacttgaaccaccggacgcagcagttgatatagcccaagcagcctcctttttaacatccgtctctgacgttcttagcaagacaatgagaggggttataatgtctgcatcgattacagcctgaatctgatccttgctaccagcagcgatattagaaacaattaaacacgcttgtttcttgatgttctttgggtaatttcgtgctaccaactgtcctaagcaattgagaatgtcattctctattaagacctcaacttgcttatcatctcccgcagaaattcttgcgagtgccataatgacagggagaagaacattagctgatgcatgcatcaaaagatttacaagttgagggcagaccccagcatctaatacatcttggacagcatcacctttatcgccacatatgtagtaaacagtccagcatgcatctgccagtatcttctcgtcagcagagtgaataagctggctgataatttctagtattggtttcacttgcacttcggctggcaattttccaaaacaaagatttgacagtgcccacatagcagttctcagaactggaatcttcatgccttctctaaattgagaaagtaaaggtgtaagagcaccatgatcgaagagaatgcctctgcagctaggtaagtctgcagctatattcccaagacaccagatagcctgatgcctgatgtttgcatttagtgatcctaatagttccaccaaccttggaacagcaccgcattctgcaaccagcagtgtataatcagatgcagctatgttggtaagaacccaggctgcctccatttggagctggggaagcccatgtcttgaaagaaactcggcaaatctgggcaggacatccgctcggatgatttttatcacagttgagttcttctcatctgaaagaagtttcctgaactggattgtggcttcgagctgactggtggtgtcatctgaacatagtttgtcgaccagctctgacaggccttcaagctaactctgactcagcagcatcccggggagccgctacgtcgggcggtgaggagggagtgaatgccggacgggtgattcctgcgaatggggctgtttcggcgcgtgtaggagtcagatcggaggcagggacggcgggagcgggctcgtcgcggcggcgcttgaagagtcccgtgtcgcggttgaggcggcggagggcgaggaggccgtcctcgcggcggcggcgcgagcggctgaagtcgacgcgcggcttgtaggcgccacggcgcgcctcgtcggactgccggcgtggggcgcgcggcatgccggagtgtcacggcccgtggccaccggcgaggggtcgccgggacgtgagcgaactcgccgccgccagaggcgataagcacagcgtagtttttttttattgcaagcacagcgtagttggtagaatttgttcacgttt

SEQ ID NO: 11238 - DNA, 2649 bp, Zea mays
gggtgagatgttgggtttgaatgttgtgtgcacgtgtcctaattctggctggtttgaggttatcctattatcatattattgaactcattagttccttactgatcccctcccgctgcgccccgtctgagttgctgatctgggataatcttgttctctttgagtgaaccaagatgtccgggaatgatgataagccacatgctgctgcggacagaataaaggcagccacattatcagtggccaagggtttgagcagggctcaagctgaacgagctgcggctgctgctgcccgcaatgtcaatgcctatgggcaaaaggaagagggaccaagccgctggcaggagaggaaggaagccaagagacagatgtatttgatgagtacagagaaggctgcgaagctgggcactgtgaagctaaaagcttcagaaactagttccgttggcgcgtatacccaatgccagaagtgtttccagcatggtcactggacgtatgagtgcaaaaatgagcgggtgtacatatcacggccctcaagaacgcagcagcttaagaaccctaagctgaagaaaagcgtaccggtttcttatcaattcgagaatcctgatattataagggagagggaagaggagctgaagttgatgaaagaaaaacagaagaaggagaaggccgaaagaaaaaagggaaagagtaagaggaagcatcgatcgccgagtgattcagatagcaacagtagtggtgcttcggtgttcgactctgaatcatcagtgacaggctctgaatactcttctggaagcagttcaagttatagttcatcagactcggaggacaagaagcggcaacacagaaggaagcagaagaagagaaggcacaggagggacagcacatcatcatcatcatcttcttctgaatctgagtctgcgtcagacacagacagtgattctgatgacaagggcagacggaggaagagtaaaagacgggctggtaggcgctgaatttaatgatctggacaaagcagtgtggaagttgaatatcattatatacttccgttctattcatgaatgacctttcatcatcatctgaacatgtgccggccttctcggatccaagaaacagatttagcatttgctttcctgaacggtagcactgataattttcactgtatgttcctatgatctttgtgtgaaccattgaatcctgtatcaatattcacctatggatttttcaagtttggtgtggttcatcgtcctgttccctgtagtattgctgtaatcatttatccctggatcctcctatttgcttcattcttttctaacctgcagtcctttgctgtgtctgtgtggtgtgcacctcttctagaaagttttctgttaatattgggtcatcctttctcttgggactctctttcatacctccagtccttactgttcaccgtttgttcagaggaaaatcacatcactggccagttaccctcgcattcccaggatgccagaggatcagtgtggcagtgcagtcatttcccatgctggaccgtatgtcacaggcaatgatattgccttcgaagtggagcaagtggtgtgtcactaccagctgtatccacagtcgccagtgcttgatcagaaacttcagatgaacagtttcactgtttgggattttatctgcacacacgtaataacacgtaataacatgttgttactgcacagcctgtaatctgcaagaccgagaagtaaacatcttattactgcctgttctcctcgtcacctgataacatgttgtttgaggcatgcagctgaagattcaagacaagtgttggctgggaacttgagctgggatcggaagacaagagcgtccaagaatcaaaagatggaggagatgcctggcaagcatggcttccggttccagtccagcggatcggagctgatcctgcgcatcgccatcatgggctagaactgctccggcaaagggaacaggtagcaacgcgagcccagctgctgcgttgaaaaccttttgcttggcatggggacggacgcgcctgcgggctgcgtcctcctcgtcttgtcggcagcgggctgctgcgcacatgatcggcgccaggcgcctgtcggcggacggacggacggacgacgggacgggatggttcctgctgccggtcgtcgcctccgccagcgcgccgggctagctaccggtgcggtgtagtctgccttgttctctaccgccttcacctcacgttcaacggttcagagcctgatggacacgcgctccaggccaagacctcgaggaatctaccgcctctgtttggctttacccctggctttcatttcatccgccagcgacgcaccactgcactgcacgctgtggtcgctacggccagcagcaggaggaggtacgtacgcatacatccccctataatacaaatctgagtcatacacatacacttggacccgtagaatacggactggtagtggggcatacatgtcagagtattgcctgtatgtagcttgtctctcatctgagtcaactagaacactagatcactatacaagctgtgttttcagattatatgttcttgctagctgttgcaaccttttttttactaccgtagctgaaagtaaatctaaactggttagatcgatcattctacttcggattcctgctggc

SEQ ID NO: 11239 - DNA, 1267 bp, Zea mays
acgaattaactgtccagactgacctctcaaatcaaatcggcaccgggcggcctcctccctccctcccgaccccgaccccgaccccgaccccgactgccaaaccctaatacacggcggtgaccttgcggcctccgttccgctgcgctccgtctgagttgctgatctgggataatcttgttctctttgagtgaaccaagatgtccgggaatgatgataagccacatgctgctgcggacagaataaaggcagccacattatcagtggccaagggtttgagcagggctcaagctgaacgagctgcggctgctgctgcccgcaatgtcaatgcctatgggcaaaaggaagagggaccaagccgctggcaggagaggaaggaagccaagagacagatgtatttgatgagtacagagaaggctgcgaagctgggcactgtgaagctaaaagcttcagaaactagttccgttggcgcgtatacccaatgccagaagtgtttccagcatggtcactggacgtatgagtgcaaaaatgagcgggtgtacatatcacggccctcaagaacgcagcagcttaagaaccctaagctgaagaaaagcgtaccggtttcttatcaattcgagaatcctgatattataagggagagggaagaggagctgaagttgatgaaagaaaaacagaagaaggagaaggccgaaagaaaaaagggaaagagtaagaggaagcatcgatcgccgagtgattcagatagcaacagtagtggtgcttcggtgttcgactctgaatcatcagtgacaggctctgaatactcttctggaagcagttcaagttatagttcatcagactcggaggacaagaagcggcaacacagaaggaagcagaagaagagaaggcacaggagggacagcacatcatcatcatcatcttcttctgaatctgagtctgcgtcagacacagacagtgattctgatgacaagggcagacggaggaagagtaaaagacgggctggtaggcgctgaatttaatgatctggacaaagcagtgtggaagttgaatatcattatatacttccgttctattcatgaatgacctttcatcatcatctgaacatgtgccggccttctcggatccaagaaacagatttagcatttgctttcctgaacggtagcactgataattttcactgtatgttcctatgatctttgtgtgaaccattgaatcctgtatcaatattcacctatggatttttcaagtttggtgtggttcatcgtcc

SEQ ID NO: 11240 - DNA, 868 bp, Zea mays
ctcgggcaatcgccaatagactcgtcctctcgagtcagcttcctccgccccacccccaaaccaaaccgggaccgggcggcatcctccgtctcgtactgacccccgcaccgccaaaccctagtccacagcggcgaggcgaccttgcgacctccgttcctctgcgctccggctgagttgctgatttgggataatcatgttctctctgagtgaatgaacatgtctgggaatgatgataagccacatgctgctgcagacagaataaaggcagccacgttatcagtgactaagggattgagcagggctcaagctgaatgggctgcgactgctgctgcccgcaatgtgaatgcctatgggcagaaggaagagggaccaagccgctggcaggagaggaaggaagccaagagtcagatgtatctgatgagtacagagaaggttgcgaagctgggcactgtgaagccaaaagcttcagaaacttcttctgttggcgcatatacccaatgccagaagtgtttccagcatggtcactggacatatgagtgcaaaaagagcgggtgtacatatcacggccctcaagaacgtagcagcttaagaaccccaagctgaagaaatgcgtacctgtttcttatcgatttgagaatcctgatggtgatcggcgatcgtgagcttccatgttatgtgttgtgatacttgagacttttattatgactatatatgagatattgtctattattatgactggatgagatgtgtcttattatgactatggatgagacttttgtgatgtaattgatgagactatgaatttcaatattggtatgcgaatgggggtgagatgttctatgcgaaaaaaaaaaaaaaaaaagcggcc

SEQ ID NO: 11241 - DNA, 1459 bp, Zea mays
aatgtcccaaggtccagcggcagcctcgcccagtcgcccgcatctgcggcccgcaagagaagcgcaagcgctcctgcgccgccgtccaccgaatccccgaccgcgcccggcgcccctcgacctccgttctccatgtcggcgtgaaggctagctcctgctaggcgctgggtagcgggttaggcagtgctgtgcagatccacctgcgtcccgccttgttctgtgctgccgcttgtcgctgcgtcatttaccaagtgctcctgtgccagccggcctacggccagcaccacagttcgcagggccgctggtgttctctcttggctggccccagtcccctgctcgtcctacacagtctgccactgtccctcgctgttgcagtggccaagtaacgaatcactgtctcgttctcaatgggacacagtttcttttcgatgcacaggataacatctcgctcgatgttacagctctgccgtgaagggaggcacctcgatcgctggcgtatgtgacatcattgctgtcgcatctgggaaaggcggcgtaggcaagtccaccactgcagttaacattgctgtagcacttgcaaaggagtttaagcttcaggttggtttgctagatgctgacatctatggaccatccattcccacaatgatgaatctccatgccaagcctgaattaagtgaagacatgaagatgattccaattgagaaccatggtgtgagatgcatgtccattggttttcttgtagacaaagacgcaccaattgtttggagaggtcctatggtaatgagtgctcttgagaagatgacaaggggagttgcttggggggaccttgatattcttgttgttgatatgcccccaggcactggtgatgctcaactatcaatgtcccaaaggcttcggttatctggtgctttaattgtttcaactcctcaagatattgctcttatcgatgctagaagaggagccaacatgttccgcaaagttcaagttccaattctgggattggtagagaatatgagttgctttaaatgctcaaaatgtggtgagaaatcttacatctttggggaagctggagcacagaggactgcagaggaaatggacatgaaattacttggtgatgtacctcttgaaatcagtatcagaacaggttcagatgaaggcaaccctattgttgtatcatcacccaactcagcatctgcgcaagcgtacgtaaatgttgcggagaaggtgactcaaaggctcaaggagttagcagaggagcgacggatgggcccagaaatcttactttgagaaattcaggctgcttttctcacacctttccctgtttgacgctacggcgccaaaacaatgtactgataagtagattgctgttggaagtaaactttaaatttcgtcactctgtctgaaaatttactcaaacaaacttctgctgcttctatggtcaataaaaaaaaaaaaaaaa

SEQ ID NO: 11242 - DNA, 1905 bp, Zea mays
cggagtagcatggtccctgggggcatcatatcggaaaccttatgacagccgatttgatcaccacccatacccacagggaaccaggatacccgaattcgcaaaattttcgggtgatcaagggaaaaacacacgcgaacatataggccagttcttagcacaattgggagaattggccgacacagaggcatttcgcgtacgtttattttcattatcgctaacaggaaccgcgtttgcatggtatgccactttgcctcctaattccatttcatcatggggggatctagaacaaaaatttcatgatcattttttctccggtgattatgaattggatttggtagatttagtgtcattgcgacagacaaaagacgaatcggttaatgattacatccggagattccgcgatacaagaaaccgatgctttcaaattcatttagcagaaaaacagctagtaggattagcctttaatggtctacgatattatttaaaagagagattagaaggcatccaattttttacactagcacagttacaccagagggctttggcttgcgaaagccggagcaaagaaactgctaaaacaatgcgtcacaacgtacatatagtagaatgcgaccaaagtagctcagatgacgaatcagcagaagtatatgctgctgaaatggtttggccaaaacaggccaaatcttcggcttgttcctccttgcagccggttcaaaagaaacggcaagaggaggttaagtttacgtttaatgttggtaagtgtgatagaatatttgatgaattactcaaaaatggcaatattaaaataaatcacactgttccatccgccgacgagctaaaacgtcgtgcgtactgcaagtggcataactcattttctcatgccactaatgattgtaatgtattccaacgacaaattcaatcggccattaatgagggacgattgaaatttcaggaaatgcaggtggatacagagccctttccaatgaacgtgatcgactttgagggcaagaaagtcctggttcggccaaatacagccgataaaggcaaaggcaaggaaacaatcatcggcaatgctaaaaaggccgatggggattgtaaagtttctggcagaaaagtggtggccgagaagactcccgatggaggggagaccctgaaggtgaccatcatagcctctagcactggggggcaagcgccgacagggagacagttgcgggaacccgtgctgcgcatcacggacagtccgccgtcccgacgcggacggtccgacgcttctccggacggtccggaggactctggtggacggtccggccatgctcaggactcgcagcgaccacgtaccttcaaaccacgacgaccagagataggtacgtggaaaacaaatacatttaaagcagctggtcggctgatcaagcctggcccaactttcgatcaattgttgtctaaatatgtgaaaaagaaggccgaccccagtgaccggccaccgaagcgaccccgctcacccattcatgagcaacgtcaggtcaggccgattggaccacctcaccaatcggaagaaatgaaaggtcatactatacaagtgagacctaacatacctgcatggacacctccacctccatatccacctatgccatatccatacacatatttacctccgccatatgtcccaaatcaaatgtggggcatgccaccatatccatttgggatgccacagtaccccgtctggggggcaccccaaacatctgtttttgacaggttgacgccaccagtacaagaccgattgagcactgctcaatccggtcaccaggcacaaacccaacaggattgccggactactcggccttccaggccgaccaatccggcagggggcatattgtaacgccccgaattttgcagttgaattttttc

SEQ ID NO: 11243 - DNA, 1744 bp, Zea mays
aacggtccagccgcacccgcgctcggcatacggcgcctctcggcctacgttctccgtgggccgtggcggcgtgccgcccacccgccctctgccctcgccccacccggccacccgtcgacgacggtcctccgccctcgccccacccgtcgacgacctcgtctcctccgtgcgcgggcctcggctagctcctgcttggcgctgggtagcgggctcgtcggtgctgggtagcgggctcgtcggtgctgtgcagatccacccgcgccccgccttgttctgtgctgccgcttggcgctgcgtcactgaccaagtgcgtgcctgccagccgaccgacggccagcaccacatttcgcagagcccttggtgctctctcttggctgtcagcaccagaagcacagcgcagagtcgccccagccccctgcgcctgctgcatagtctgccactgcccctcagttgttgtggtggccaagggacgaatcactctctcattctcaatgtggcacagtttcttttcgatgcaccggatagcctctcgctcgggtttgcttggtaggagatgttacagctctgccatgaaagggggcacttcgatcgccggagtaggcgacatcattgctgtcgcatcagggaaaggaggcgtaggcaaatccaccactgcagttaacattgctgtagcacttgccaaggagtttaagcttcaggttggtttgctagatgctgacatatatgggccatccattcctacaatgatgaacctccatgctaagcctgaagtaaatgaagacatgaagatgattccagttgagaaccatggtgtgcgatgcatgtccattggtttccttgtagacaatgacgcaccaattgtttggagaggtcctatggtaatgagtgctcttgagaagatgacaaggggagttgcttggggggaccttgatattcttgttgttgatatgcccccaggcactggcgatgctcaactatcgatgtcccaaaggcttcggttatctggtgctttaattgtttcaactcctcaagatattgctcttattgatgctagaagaggagccaacatgttccgcaaagttcaagttcctattctgggattggtagagaatatgagttgttttaagtgcccaaaatgcggtgagaaatcttacatcttcggggaaggtggagcgcagagaactgcagaggaaatggacatgaaattacttggtgatgtacctcttgaaatcagcatcagaacaggttcagatgaaggcaaccctatcgttatatcatcacccaactctgcatcagcacaagcgtacgtaaatgttgctgagaaggtgactcaaaggctcaatgagctagcagaggagcgacggatgggcccagaaatcttactttgagacattcaagccacttttctacacaccttcccctgtttgacgctacggcgccaaaaaaaaatgcactgataaatagtgttgttggaagtaaacttcaagttttatcagttgggctggaaattttactcgaataaaacctctgctgccaaccttgtctttgtcacgcatgtcccttatctagtattctagtctctgcattttttttcatgactcattgagtgataattgtatactagtaatatatagtatgtgacctctgcttttgacaaaaaaaaaaaaaaaattttgcaccttgttggggacttgttctcaaatgctatgaatcaagaacaagacaacacaaaatgttaaatgct

SEQ ID NO: 11244 - DNA, 1413 bp, Zea mays
tcggaaaccttatgacagccgatttgatcaccacccatacccacagggaaccaggatacccgaattcgcaaaattttcgggtgatcaagggaaaaacacacgtgaacatataggccagttcttagcacaattgggagaattggccgacacagaggcatttcgcgtacgtttattttcattatcgctaacaggaaccgcgtttgcatggtatgccactttacctcctaattccatttcatcatggggggatctagaacaaaaatttcatgatcattttttctccggtgattatgaattggatttggtagatttagtgtcattgcgacagacaaaagacgaatcggttaatgattacatccggagattccgcgatacaagaaaccgatgctttcaaattcatttagcagaaaaacagctagtaggattagcctttaatggtctacgatattatttaaaagagagattagaaggcatccaattttttacactagcacagttacaccagagggctttggcttgcgaaagccggagcaaagaaactgctaaaacaatgcgtcacaacgtacatatagtagaatgcgaccaaagtagctcagatgacgaatcagccgaagtatatgctgctgaaatggtttggccaaaacaggccaaatcttcggcttgttcctccttgcagccggttcaaaagaaacgtcaagaggaggttaaatttacgtttaatgttggtaaccccgggaaaatatttgacgaattactcaaaaatggcaatattaaaataaatcacactgttccattcgccgacgagctaaaacgtcgtgcatactgcaagtggcataactcattttctcatgccactaatgattgtaatgtattccgacgacagattcaatcggccattaatgagggacgattgaaatttcaggaaatgcaggtggatacatagccctttccaatgaatgtgatcgactttgagggcaagaaagtcctggttcggccaaacacagccgataaaagcaaaggcaaagaggcaatcatcggcaattctaaaaaggccgatgaggatcataaagtttcttgcagaaaagtggtagccgagaagactcccgatggaggggagaccctaaaggtgaccatcacagcctccagcactggggggcaagcgcagacagggagacagatgcaggaactcgtgctgcgtatcccggacggtccgacacataggcgcggacggtccgggaccccaccggacggtccggagagctccggcggacggtccggccgtactcaggactcgcagcgaccacgtaccttcaaaccacgacgaccagagataggtacgtggaaaacaaatacatttaaagcagctggtcggctgatcaagcctggcccaactttcgatcaattgttgtctta

SEQ ID NO: 11245 - DNA, 963 bp, Zea mays
tatatgctgctgaatggtttggccaaagcaggccaaatcttcggcttttgcttcccgtccgtccccccccccccccccccaggaggatgtaaagtttacatttaatgttggcaagtgtgataaaatatttgatgaattactcaaaaatggcaacattaaaataaatcacattgttccatctgccgacgagctaaaacgtcgtgcatactgcaagtggcataactcattttctcatgccactaatgattgtaatgtatttcggcgacagattcaatcggccattaacgagggacgattgaaatttcaggaaatgcaggtggatacagagccctttcctatgaacatgattgacttcgagggcaagaaagtcctagttcggccaaacacagccgataaagaaaaaggcgaagagacagtcatcggcaatgctaaagaggccgatggggatcgtaaagtttcttgcaggaaagtggtagccgagaagactcccgatggaggggagaccctaaaggtgaccatcacagcctccagtactggggggcaagcgcagatagggagacagatgcaggaacccgtgctgcgtatcccggacggtccggcacgtaggcgcggacggtccgggaccccaccgcacggtccggagagctccggcggacggtccggccgtactcaggactcacaacgtccacgtactttcaaaccacgacgaccagagataggtacgtggaaaacaaatacattcaaggcagctggtcggttggttaaagccagcccaacttttgatcaattattgtctaaatacgtaaaaaagaaggtcggccccagtgaccggccagcaaagcgaccccgctcacccattcatgagcagcgtcaggtcaggccgattggaccaccccaccaatcggaagaaatgaaaggtcatactgtacaagtgagacctaacatacctgcatggacacctcc

SEQ ID NO: 11246 - DNA, 1349 bp, Zea mays
gacccctgatttgatcaccacccgtacccacagggaactagaatacccgaattcgcaaaattttcgagtgatcaagggaaaaacacgcgcgaacatataggccagttcttagcacaattgggagaattggccgacacagaggcatttcgcgtgcgcttattttcattatctctaacaggaaccgcgtttgcatggtatgccactttacctcctaattccatttcatcatgggggatctagaacaaaaatttcatgatcattttttctccggtgactatgagttggatttggtagatttagtgtcattgcgacagacaaaggacgaatcggttaatgattacatccggagattccgcgatacaagaaaccgatgctttcaaattcatttagcagaaaaacagctagtaggattagcctttaatggtctgcgatattatttaaaagagagattagaaggcatccaattttttacactagcacagttacaccagagggctttggcttgcgaaagccggagcaaagaaactgctaaaacaatgcgtcacaacgtacacatagtagaatgcgaccaaagtagctcggatgacgaatcagcggaagtgtacgctgctgaaatggtttggccaaaacaggccaaatcttcggcttgttcctccttacagccggttcaaaagaaacggcaagaggagattaagtttacggggggggggggtaagtgtgataaaatatttgatgaattactcaaaaatggcaatattaaaataaatcacactgttccatccgccgacgagctgaaacgtcgtgcgtactgccagtggcctaactcattttctcatgccactaatgattgtaatgtgtttcagcaacaaattcaatcaggcattaacgagggatgattgaaatttcaagaaatgcaggtggatacagagccctttccgatgaacatgatcgacttcgagggcaaaagggtcctaattcggcacaacacagccgataagggaaaatgcaaagaaatcatcatcggcagcgcacgagatgccgatgaaaataataaaatttcttgcaggaaagtagtggcagaaaagactcctaatggaggggagaccctgaaggtgaccatcacagcctctggcactagggggcaagcacagacagggagacaggagcgggaacccgtgttgcgcatcacggacggtccgccatccagacgcggacggtctgaagcttctccggacggtccgaagacttctggcagacggtccggctatattcaggatccacaacaaccacgtacattcagaccatgacgaccaaagataggtacgcggaaaacaaatacattaaagcag

SEQ ID NO: 11247 - DNA, 2867 bp, Zea mays
ccccttgcatcaggaacattggtgagtcacactcccttgcgtgccggtggccttggtgggtttgaggaatcatggcaaagaaataccagggagaatatgcctggctgggatcctagaatgaacatgcttggcagtggaaatgttcgctctgacttccgagatgtgaatcaaatgcctgcacttccagccccagaactataccgtggcacgaattttcagaatggctcttccatgggccgtgcaccccgcacatgagttcctctgtggcatatgctggatcacagtgctcagtaccggtgacttgcactattatgcagaaaaatgttgaaacccaaactcagcttttgaaaaactactgtaacttgagacagttttaatagtcgagagctttccttagtttcagcagctctatccgagtactccaatcactgtagtttagtgctgcctgagatgcaactaaaatctgtttggacagggaggattatttcttgggaaatttactggtttttggtgaaatctgaagaaaatgaaccatcctgatcttacccatcacgtgttggtgatgtagcctgttaaaccttcatgaataaactgtgagcctcagggtctgtatgcttgtagtttttctcattctagctgccaataagctatgcaaagtacattcattacggttacatctagatagcagcagctaaacaaacaaaggtgcatatatacgtatatatagttgtgtcatcaaacgtggccgtcagattcaggtggcttcgccgcgttcttctccggcgaccggctggtctcaccggcggctgccctggtctgctgttgcaccaccaacgttgagacccggcatccgaaatccgtggacgtgagcaggtccccgaggacgccgagctccaggtgctcgctccagtccgatatgccgaccgttagcggtgacttggggccgtccgctcgccggccgacgatcagcaggtccgacgccgggctagacttccggatggtgtccaccatctcgtcggagccacagaccaggttctcgctgtaggcgacgcggtggccgtcgacccaacggcggacgtacgcctgcagcgcctcctcgtcgagccggtcctcctcggggtcgccgcccttgcgccactccggcggcggcaggaaccggaagacggtgaggccgatgggcgcgtcctcggccatgtgcgtggcgagcgcgagcgcctcccggtcgtccggcccgccgaggaagtagagcgcgacgcggtgagggaagccgtcggcgtcggctgtggccgcggggcccccggccacggcggacgatgcgacggagaggctgccccggtcgacgaggatggcgacggagcagggggagtagtggagcacgttgacgttggcggcctggacggagccggcgctggccgtcgtgttctcgacggagccgtcgatggcgaggcgctggtggaagggcacgacgatgagcatggcgcgcttctcgagcgccacggcgcagacgtcgtcgtgcatggtggcgtagggcgcgatgcagacgtaggggagcagcgacgcggaccccacgggccgctgctgcacgaagtactggaaggcgttgacgatgcgccccgagtcggtgcccccagacggcacgcagttccggtcgccgtacttgaaggcgcggagcacggagctggtgagccccactagcggcgtgaggtggaggaggtagacggagacgggcgacacgggcgacgggctggcggcgtccagcagcgccagcatgggcgccacgtccgcctgcgagtgcacgcacgccagcatccgcagctcgtcgcccagcttcttgtgctgcaccgtgcgccgccggtacgccacgtacttctcctccgggtggtacaggtgcttgaccagcgacgacgtggcggcgcccagcagcaggatgttgagcatgaaggcggcgtacacctgctcgtcgaagatgtccgagtccacgaacgccgaggcgtaggcgacctcggtgatgcccttgaagttcatcatgaggccgacgatgaaggcctcccggggcgacatcccgcagtagatgcagggcagcatgcaggccgcctgcttggcggcgacgccgacgaggaggaagatctcgaggaggaggcacgtggaggcgtcggtgatcttgaagacgtccagcctgaggccgccctgcgcgaagagcagcggcatgagcaccccggcgacgaggcggtcgaggcgctcctcgagggtgaccccgagcggggcgccgccggggagcatgagccccagcatgaagggcccgtaggtggcgtgcaggcccaggacctcgctggcgaagctgcagacgatggtgatgagcagcacggcgacgaggcgcgcctcggagaggaggcctccctcggggacgtcgcgcatgaggcgcaggatggccgggcgcgccacgtaggtcaggaagcctatgaagatggcgaaggtgacgagcgacaggaagccgatccgctggaccctctccaaggggctggacgcgaggaggtaggacgtgatgcccgcgacaaagatggtgttggcgaagtcgccgatgagcgccgcggacatagcgaggcgccccagcttggaggagaggaggttgaggtcgcccagcgtggagcagacgacgatgaaggccgagagcgaccaccacacgttgaggttggtgagcatgaagttggccttccacggcgccggcacgcgcgccccgagcgcggcggcggcggcgtacatggccatgtgcggcccgatggcgccgaagaaggcgatggccacggccttcttcccggacttgacgatcatccccaggtccgtcttcacgccgataacaaagatctgca

SEQ ID NO: 11248 - DNA, 1903 bp, Zea mays
ctaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttggtttcggcggctttggacagccagggaacataatgtccggtttctttggtggcgcaaatccctttgatgaccctttcttcacaaacccctttggtggcatgatgcaacctagtttctcaacccctttcagcggcatgatgcaacctagcttcatgaacccctttggtagcatgatgcaacctagcttgcttggatcaagtatgtttgcagcccatggcaatctcaatggaggcacttttggaagccagacacatctcaatcaaggcatgagcaatgccagtggtttcattcagcaagcctctgaatcgagcaggcctaaagggccaattatcaaggagttgtcttcagatgacgaggataaaccagaggatgataaagaagatggcaagaagaatggcaactttaggaagcatccaagggaaagcagagaaccgtgtgtggaggacccagatgaagaagaagaagaagataataaaagacctaaacatagacaatttgggagggagctcagcagatctggtacatcacgtctacagcctcagacatttatgtttcagagttcaactgttacatatggtggtccaaatggagcctgttatacatcttcaacgactaggaagactggtgcaaacggaattacactggaagaaagcaaggaggcagacacaactactggtaaagccacccacaggatctcacgtggcattggcattaagggtcactcgttaacaagaaaccttaactccgatggacgtgtgaacacccttcaaactttacacaacttgaatgaagatgagcttggtgggtttgaagaatcatggcaaagaaatgccaggcagaatatgcctggctgggatactagaatgaacatgcttggcaacggaaatcttcacacgggcttccgagatgcgaatcaaaggccagcacttcctgccccaggacgatcccgtaaagcgaattcctcatggaacttccagaatggctcttccacgggtcgtgcaccccgcacatgagttcttctgtgccatacgcaggatcacagtgctcagtaccggtcgcatccactattttgcagaaaaatgttgcaacccgagcgctcattcgaaagactactgtatagcttatgacagttttttaatattgaagagcttcactggagacaactgaaaatcagaagctttccttagtttgagcagttctatcctagtgctccaatcactgtagtttagtgctgcctaatatgttttgatgggaaggacaatttcttcatgaatgactcgccctagaatcatgtagcctcttgccaacagcttatacatccacatatttaaactctactctgcgaacacttgaaaagtcttatatggtggtatatggtggcatgagtatgtatgtttgtaatttttctttcagatgcattctagctgccaataagaccgtctgcagcagtctatctagagtttattttatactgttctacactgtagattatactgtccatagagtatagtttaaatatggttaaatatggctatggagatgaataatctgctggatatagtctaagctaaagtacattgattacggttgcttctaatgtaggggcagcaaactgtcgtgattcgtgaaccagctaactctgctgatctgacctgacctgacctgaccaggggtacccggc

SEQ ID NO: 11249 - DNA, 1594 bp, Zea mays
gtaccctcgggccggccgggagcctccggcaactctcccttccggttccttcatctacggctccacctccagtcctccaccgctgctccacacgggcacacctttgcctcgcccaaccgctgcctcgctcgcgtccgccattccccagacctcgagagctaccgtctggtccgatcggacggaccccttcgcgcgccccagagatttcaggtaaggtgctgtaacagaagatgcaagggggaagaggtgggaggcagggcttattcggtttcggggacccttctggtggttccggtggctttggacaaccagggagccttatgcctggtttttttggtggcgcaaatccctttgacgaccctttcttcacaaacccctttggtagcatgatgcagactagtttctcagcccctttcagcggcatgatgcaacctagcttcatgaaccccttcggcagcatggtgcaacctagcttgcttggaccaagtatgtttgcgccccatggcaatctcaatggaggcatgtttggaagccagacacatctcagtcaaggtatcagcaatggcagtggtttcattcagcaggcccctgaaccaagcaggcctaaagggccaattatcaaggagttatcttcagatgatgaggatgatgtagatgatgatgaagaaggcgagaagaagaatggtaactttaggaagcatcaaagggaaagcaaagagccatatgtggaggacccagatgatgaagaagataataaaagacctaagcatggacaatttgggagggagttcagcagagctaacacatcacgtccacagcctcagacatttatgtttcagagttcaactgttacatatggtggtccaaatggagcctgttatacatcttcaacaactaggaggactggtgcagatggatttacgctggaagaaaataaagaggctgacacaactactggtaaagccactcacaggatttcacgtggcattggcattaagggtcactcgttaacaagaaatcttaattctggtgggcgtgtgaacacccttcaaactttacacaacttgaatgaagatgagcttgctgggtttgaggaatcatggcaaagaaataccagggagaatatgcctggctggaatcctagaatgaacatgcttggcagtggaaatgttcgctctgacttccgagatgtgaatcaaatgcctgcacttccagccccagaactataccgtggcacgaattttcagaatggctcttccatgggccgtgcaccccgcacatgagttcctctgtggcatatgctggatcacagtgctcagtaccggtgacttgcactattttgcagaaaaatgttgaaacccaaactcagcttttgaaaaactactgtaacttgagacagttttaatagtcgagagctttccttagtttcagcagctctatccgagtactccaatcactgtagtttagtgctgcctgagatgcaactaaaatctgtttggatagggaggattatttcttgggaaatttactggtttttggtgaaatctgaagaaaatgaaccatcctgatcttacccatcacgtgttggtgatgt

SEQ ID NO: 11250 - DNA, 798 bp, Zea mays
gaatgctgcatcagactcaatgaacaggagcaagtagcacctcctaccaagctgcaatcgaagaagcgtggtagaaatgttaaagatcctgctgcagctactacaggggctttgaaatgcagcatcggactcgatgaaatagctacccgccagcaagcagcacctcctactcctgagcaatctaagaagcgtggtagaaagagcgaacctcttcctcaagttatcacagagggtttgagacgcagcagccgacttagtgaaaaaggcaagcaccatcaagtagcgccgtctcaggagcaagccaagaagcatggtagaaagggagcgacactttctccagttaccacagaggccctgagacgcagcagcagactgaatgaaaagggcacgcatcagcagatagcgctttctatcccagagcaagctaagaagtgtggtagaaaggccaaaaggcttcctcgagtaaccatagagggtttgaaacgcagcaaaagaatgagtagaaacaacagcgaagaattggctgatgtggattgcaatccataaatggcaaggaagcgacgcctacctgccgagtgccgactacatcaaaggaggttacaacagaattgtataggttgggacatgtctgcagcaagcaacatgatcgacccttctcgcactacaggaaactggttaaagaacgtgggtgaaaaaccgtcaaacttaatgtaataggccgtcgaacttaccgtaagaacgtgggtttaccgacgaatatagccgacggcgattttggacgaaaaaaaaaaaaaaaaa

SEQ ID NO: 11251 - DNA, 2400 bp, Zea mays
cgacctttgtaaaccctaaaaatcaatcttgttcgcaccaaatcgatcgcgcctcagctcaaaatccgaaacggttcgaacgatcagaacgattcagcttcagctcctgaatccagcagcaatggatcgctcccgctccaagcgcggctaccactacgaccaggactccccgccgccccgctccaagcagcgcttcgaccgccgcagcggtggcggccagaatgctaactcgagctatcaccgccgcggccccctcggcggcggcggctccgaccgccgcgggttcctgccccctgcccccgcgccgcccccgcccccgcccccaccgccgcttcctccctcgtcggccacggcgggtggcggcgctggtcccaccaccaccaccacctccttccgcatcctgtgccccgagtgcaaggcctacggcttcccacccggcttcgttgccaaggtccgggacgacagcggcgcgcttgtcactgtgcacccgcccttcgcgggcgactacgtccgggtcatcgagacggtggacggcgcgaggcgcgaggcagacggccgcccgcccatgttctccccggcccaagaggcccttctcatggtgcaccgccggattctcgagaccgacgctgacgacggcgacgaggatggcgagtatgggcccaggggcaaggactccagggacagggggaagaccaccacacgactcatcgtgcccaagatgcacgtcggatgcttgctcggcaaaggtgggaagatcatagagcaaatgaggatggagaccaagacgcacattaggatcctgccgcgtgaccagcacactccgcgctgcgtttccttgtccgaggaggttgtacaggttgttggagatggaaattgtgttaagaaggctgtagcaataatcactgatcgcctaaaggaaagcttacaccgtgaccgtggtcccttccgtgggcgaatgaattcaccagagcctcgaatttctcaggaagatgattatttgggtgtttcgcagatgcctgcatacgaggaatctctgggacgatctgatcagattaggaacaacactagcatggagccaccaggatatgagtttgattcttctgagggccaggtgattgaacatccagatatcctgtacgatgacataatttttcgaattctatgcccaaatgacaaggttgacaatttagttgcaacaaatgatggaatactggagatgctacaggctgatgttggtgttgatgttagactatctgatattattgctggttctgatgaaagggtagtaatcatcacatctagagagggaccagaccatgagcttttcccagctcaggaagcagtgctgcacattcaaactcatattgtagacctcggcccagacaaggataacattatcacaacaagactacttgtaccttcaagtgaaattgcttgctttgatggaagggaggggtcattatctgatatacagcgacagactagtgcaaacgtgcagatattaccaaaagaagatcttccattatgcgctttagagtcagatgaactcatacagattgttggagagattagtgctgctcggaatgctctgatacaagtaacaacaaaattaaggagttttctataccgtgagatgtctggtcctattcaagttggcaatattaatgtacatggagccatttctccagtagcaggctcacctggaggacccaacctcggaaatgatatgccaatgagtgcttatcaccaagcatcacaactggcaacttcatggcattcaaaagatagtggaggcagtgcaagtggctcatttgatcaaggcagcaacattattgatgagatcagacaaggtgctacaaaaagatttgccgttcctctagtaactaggagcacactagaagttgtcataccaaatagtgctgttgcaagcctcaccatgagagctggtagcaagcttgctcaaataagcgagatctctggtgctactgtaacgctagctgaggacagacctgacatcttagagaaagttgttcgaatatctggtacccctgagcaggctagcaaagctgagaatttgctgcagggatttattctaagcattccagatgacattccttcaggctagttgaagacactctgcatgtcatagttgttagttcgtaaaattcctgtgtatattcgaggtagaatatgctgatgtcatgtgattatttgtttaattgagcagcatgtattcatgtgtggatacatgctgttttccttgtagccgttaactggctgacgggggtgtaagattagcatgtgaatttacagattgattcaacattcaattctcatgtccatatgtgaccgctgaacatgaaacctccaacttatttaaaaaaaaaaaaaaaaaaaaaa

SEQ ID NO: 11252 - DNA, 2636 bp, Zea mays
ccggctgaaagtcctgttttgtgtttagcaacaagataattcactatcttgcttttctgttggtttgtacccccataaaccgaatcaggaattccaaggatcattgatttccagttctgcggaattacccaatttggtcaaagttttaatataaatacaactggtcattgcattttgttagatcaaatatcatggggattttttttttgaaagggttagttcatggacctagtaacatacactgtttgctatccaaagatatgctcactgaaaacatacctcactgaaagatatcagttcttatggtgtgctataattttgcatgtaaatatgatggcctttcctccagcgaactgctttggatagcgtacctcaatgctatttccatccaattttatcaagccacacgcccacacaccttgtatatacatgcgagccagcgcgctcaaaccgtaggtgccaatcgccaaagatagccacgccccctccgtcactcccgccacccgtgtatcagtaactgacccgcggtcaccgcccggccgcgacggcgtcatggtcgcacgcccgcagcttcccttttcccttcccagtcgatagaagccgcgttccaccatggcccccgcccccgtacttgccggcattctgctcgccctcgtcgcaatggctgtcgccgtccacgcacacgcgccagcccactccccggaggcgtccgagtcaacgtcgccgtcggaggcacccgccggggcacctgatgatgccagggagatggagaccccgtggatgtcccccgccgaggctccggtgctctacggcgaaaacgccgcgcccgctgcttccccggaggaagaaggcgcgcccgccatggcaccgggcttcgacgctaacggacctgccgcagcctcgccggaggaagaagacgccaccgccatggcaccggactacgacgctaacggacctaccgcagcctcgccggaggaagaatacgcgcccgccatggcaccggactacgatgctaacggacctgccgcggcctcgccggaggtagaagcgccgacgatggcgccggacctgtctccctccgcgagcgagtcaccggaggaagcgccgacgatggcgccggacctctctccctccgccagcgaggcgccggaggaagaagcgcccacgatggcgccggacctctctccctccgcgagcgaggcgccggaggaagaattgcccacgatggcgccggacctctctcccgtcgcgagcgagtcgccggaggaaaccccagcgggagccccagaattcgagggcgcctctatcgccgctcccccactggatgacgcgcccaccatggcgccggcatttgctcccttcgggatcagcgagtcgccggaggagtctgaggccccagccggcgccccggaggaggagccgaggccgaggccgaggccgagagcccatcctccgagacagccgccgccccgctctccgaggactacggcgtgttagaagaggaggtcgtagtactctcgcccgacgggtcggccgcggtcagcagcgaaccggaaaccgaggagagcccggccaaggcgactcccgcggccgcggaggctccaggcccctcatccgacggcgaggacagcggcgcgagcacgggcgccccgtgtcgcagcctcgtgtctgccgtcgtcgtcgcggtcatgtgcgccgttgctgctttctgaggtgccgcctgcgcgatcgatgaggcaccagaccccgcggtggagataggggacggatcgcagggcatacatgcatgcgcgcggcgagcgatgtaaacgatgcatgtcgtggaggggggatagcaatcagtggtattctttcaatacttcctcccaatcggaccatgtttgctctgcagactgcaggcatcgtgcattcaggtactgatttgccccaaaaggatgcacgtaaatgatcgggtcattcgaacctcgagcatggatggatgaatatatggggaaaaaaaaagctatgccacattcggttcagttcaacacacgttttttttacagtccgatcgagcattgctagccgcatctggcgagaggatctgtgttttcattccattgttttacgtttgacgtcatttcatttcgttgtttttcttctgcgaatttccatttctttgtttcatcctcaagagaccttttggacatgtttgaaacagccttagggatcgtttgggagaaaagagattcaaaggactaacatccctttgctactcaatcaccttcaatccacttgcttccaaacaagtttttattggaatctagatttaaaatactggttgaaacctgcgagaaattgtctggttttgtgttcccggcttggcccatgaacgatttttccagtcgtttttaaagtttcgttcaaaattttaaaacttgaaaaagttataaaatacaaaaatatgataaaaaaaactacattcttttatgagcaatccgatatatcccatattatttttaataaagaaataatcagcattttcggtaaaaacaactaatttcgctgaaaacacgcccccgacagttttcgaatttctcgaccggttgcaactcaaacgtgattttcccgaggaaacaaatatcggtcgagattac

SEQ ID NO: 11253 - DNA, 1028 bp, Zea mays
aaagagtttggagatgctcttagacatgattagaaacggctaagcaataacgcaaagattcggctgacaatggggaaggggttcccgtcgtacttggcgatgaagacggggccggagggcggcgacggcgcggcggcggcggcgcagcaggcgctcatcgacgcggacctgcggaacctcggcgtcgccgcgcgaaagctcgccaaccacgccttcgtcctcggcggcgggttggggttcggcacttccttcctcaagtggctggccttcctcgccgcagtgtatctcttgatattggaccgcacgaactggaagaccaacatgctgacagctctcttggttccttacattttcttcactctgcctaatgtgctgttttctctgatcagaggagaggtggggaaatggattgcgattattgctcttattctgcgcctattttttccgcgccacttcccagattggttagagcttcccggttccatcatcctgctcacagcagtcgcccccagtctgttcgcacacaccttcagggatgacctcgtcggtgtcttcatatgccttgcgatcggatgctacctgctccaagagcacatcagggcgtcagatggactcaggaacgccttcaggaagggcaatggcgtgtccaactccattggcatcctcctgctcttcatctaccctgtctggaccggggtgctgcagatcctgtaggcgctgttgcctccgtgttcccgtctgctgtccaggcgtccagctccgttgccgttcgtctcttgtgcaaatgtttcttctatggtgatcgtggttctgtgctatcgggatgggatgtagatcgagatgttggccatattatcaggcgtgtaaacccttgccgcttctgttaagttgtcgcaagtttgaggatgggtgtttatagcaactactgtatatcatttgatgttatttctgaatatgatgtcaaggcggtgacaaatatcaaaagtcggcgcggccgcgaattgccaaaaaagagggcggacgccaac

SEQ ID NO: 11254 - DNA, 1350 bp, Zea mays
cgccaagcgcgcaattaaccctcactaaagggaacaaaagctggagctccaccgcggtggcggccgctctagaactagtggatcccccgggctgcaggaattcgcacgtgcccacttaccgagagctttccccagccaaccaaccacatcgcatatcaaagaccagaaagctcaaaccaagaccggcgtgcgcggacgaagcacagatccatcggagtgacagcgagcgagcgagagcgagagcgagagagacagagagattatccgcgcgtcaccgactcccggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcacctccttcctcaaatggctggccttcctcgccgcagtgtatctcttgatattggatcgcacaaattggaagaccaacatgctgacagctctcttggttccttacattttcttcaccctgcctaatgtgctgttttctctgatcagaggagaggtggggaaatggattgcgattattgctgttattctgcgtctattctttccacgacacttcccagattggttagagcttcctggttccatcatcctgctcacagtggtcgcccctagcctgttcgcggacagcttcaggggagacctcgttggtgtcttcatatgccttgtgatcggatgctacctgctccaagaacacatcaaggcgtcaggtggattcaggaacgccttcaggaagggcaatggtgtgtccaactccatcggcatcctcctgctcttcatctaccctgtctgggccggtgtgctgcaagtcctgtaggcaccattgcctcagtgtttcccctgtgcggtccagctccgttcccgttcgtgcccgtgcaaatgttccctctatggtgatccgtgatcctgtgtcacgagtaggtgatgtttttatgtgtgcttgagttgatcggttgggcatgttgccatgttggtggacagttttgtttatctcatttgttgtagttcgatgtcagcatttggttcgttcgagtacataaacgccaataaaatcagtagccgtggcttgatgtagattgagatgttggtcatattatctcgtgtaaatccctgcgtctcttctgttatagtgttatgcaagctagaggacgcatgtttatatgtcaactaattattttttatatcaacagcatcatccggtgttatttcaaaaaaaaaaaaaaaaaaaaaaaaaa

SEQ ID NO: 11255 - DNA, 1226 bp, Zea mays
ccacgcgtccgtaacgtgttgcatcgctggcctagaatcgtctggatccagcgtgccacgcgctcacgccagttcatgcacatccacacttacagagttacagttacagccaaccaaccacatcgcatatcaaagaccagaaagctcaaaccaagaccggcgtgcgcggacgaagcacagatccatcggagtgacagcgagcgagagcgagagagacagagagattgtccgcgcgtcagcgactcccggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcacctccttcctcaaatggctggccttcctcgccgcagtgtatctcttgatattggatcgcacaaattggaagaccaacatgctgacagctctcttggttccttacattttcttcaccctgcctaatgtgctgttttctctgatcagaggagaggtggggaaatggattgcgattattgctgttattctgcgtctattctttccacgacacttcccagattggttagagcttcctggttccatcatcctgctcacagtggtcgcccctagcctgttcgcggacagcttcaggggagacctcgttggtgtcttcatatgccttgtgatcggatgctacctgctccaagaacacatcaaggcgtcaggtggattcaggaacgccttcaggaagggcaatggtgtgtccaactccatcggcatcctcctgctcttcatctaccctgtctgggccggtgtgctgcaagtcctgtaggcacaccattgcctcagtgtttcccctgtgcggtccagctcccggtcttcccgttcgtgcccgtgcaaatgttccctctatggtgatccgtgatcctgtgtcacgagtaggtgatgtttttatgtgtgcttgagttgatcggttgggcatgttgccatgttggtggacagttttgtttatctcatttgttgtagttcgatgtcagcatttggttcgttcgagtacataaacgccaataaaatcagtagccgtggcttgatgttaaaaaaaaaaaaaaaaaaaaaaaaaaaaaaaaaaaaaaaaaaaaaaaaaaaaaaaaaaaaaaaaaaa

SEQ ID NO: 11256 - DNA, 901 bp, Zea mays
agcatttcgcagaaaagaaagaatcaccccgtcgttcctgcaggctgcaggtgcggtagcggtgccccgtctccatccatcgcaaagcccccgggctttcgatcccgtcccctgcttttcttcccgcccgccagattctttccaacatcccggctgcactgcactgcactgcaccacgagccgaggtgaaaagcaagcgagaaccgcgccgccccggggaggaggcgaggggtgagtcgggtcgggtgtgccgtgcgcgcgcgtatgggaatggcgtgatcgtccggcggcgccgtggatggataacggggacaggtcgggcgctggcgcgggcgccgtcggcagcgccggcagcctcggcctccgcgtcgggcaggcggtcttctcgtcggcgtcgctgctgttcatgtcggtcggtgttgagttcttcagctacaccgccttctgcttcctggtgacgatcatggggctggtcatcccctggagctgcacgctggccatgatcgacgtgtactccgtgttcgtgggatgccctctgcgcgtgccgggcgtcatggtcatcgtcgtggtaggagactgcgccctgtcgatagtctcgttcgccgccgcctgctcgagcgccgcggtgatcgacctcctcctccagctccatggatcccacagctccccgacgttctgcgggaggtaccagctgtctgccatgatggcgttcttgtcctggctcctcatggccgcctctgccaccttcaacctctggttcgtcgcctcacggtggtaaagctgcagcaggccactcttttttgttttgtttcgtagatagcgcacataatttggctttggagagcgtatgctacttcagtgttcaggtaccttgagattttggccaaaaaaaaaaaaaaaa

SEQ ID NO: 11257 - DNA, 2943 bp, Zea mays
  misc_feature (2910)..(2930): n is a, c, g, or t
ataaagacagaaagctcaaaccaagaccggcgtgcgcggacgaagcacagatccatcggagtgacagcgagcgagcgagagcgagagcgagagagacagagagattatccgcgcgtcaccgactcccggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcacttccttcctcaaatggctggccttcctcgccgcagtgtatctcttgatattggatcgcacaaattggaagaccaacatgctgacagctctcttggttccttacattttcttcaccctgcctaatgtgctgttttctctgatcagaggagaggtggggaaatggattgcgattattgctgttattctgcgtctattctttccacgccacttcccagattggttagagcttcctggttccatcatcctgctcacagtggtcgcccctagcctgttcgcggacaccttcaggggagacctcgttggtgtcttcatatgccttgtgatcggatgctacctgctccaagagcacatcaaggcgtcaggtggattcaggaacgccttcaggaagggcaatggtgtgtcgaactccatcggcatcctcctgctcttcatctaccctgtctgggccggtgtgctgcaagtcctgtaggcacccaccattgcctcagtgtttcccctgtgcggtccaggcgtccagctccgttcccgttcgtgcccgtgcaaatgctccctctatggtgatccgtgatcctgtgtcacgagtaggtgatgtttttatgtgtgcttgagttgatcggttgggcatgttgccatgttggtggacagttttgtttatctcatttgttgtagttcgatgtcagcatttggttcgttcgagtacataaacgccaataaaatcagtagccgtggcttgatgtagattgacatgttggtcatattatctcgtgcaaatccctgcgtctcttctgttatgcaagttaagaggacgcatgtttatatatcaaccaattattttctataacaaaaaaaaaaaaaggcgccgtttctgaatagggtgccaactagtgagaaaaccgtgaaacatcaaccggccggagttgagaacgatctgggctgcggccggtcagcttgtggatgggcgtacttttctgctccggcatccacgctgctgtcctcctacatacacctggcatcctggcggccgttggttcagcaaactttgcctgccattcactcgcacgtacccgtcggaccacgcgtggtggccggcacattcctcctcgcccggcccttatcctctgcccaactgcaacaggagagaagcgatgcgatattcctgttctgtaacagatcgaattctccagcatcttcagttgtgcggttgagctgagtggtcagataatccatccattccttttacgttgcatacatgtccaggttgagcttccacatgttctttattaacagtcacgatcagcgtggagcagcgtgtggttacgtgcaccagtttagcttagcagctgaagaaaagcaacgagacatggggaggatgagtgtgcgacgcgaggtcaaaagcagcaataaccatggcgagcagaaagaaagcatttcgcggaaaagaaagaatcaccccgtcgtccctgcagtctgcaggtgcggtagcggtgccccgtctccatccatcgcaaagcccccgggctttcgatcccgtcccctgcttttcttcccgcccgccagattctttccaacatcccggctacactgcactgcactgcaccacgagccgaggtgaaaagcaagcgagaaccgcgccgccccggggaggaggcgaggggtgagtcgggtcgggtgtgccgtgcgcgcgcgtatgggaatggcgtgatcgtccggcggcgccgtggatggataacggggacaggtcgggcgctggcgcgggcgccgtcggcagcgccggcagcctcggcctccgcgtcgggcaggcggtcttctcgtcggcgtcgctgctgttcatgtcggtcggtgtcgagttcttcagctacaccgccttctggtacgtgccttttctccgttccatctggtttggtgtttcagccacagcgagcacagcgctgaaggccgtcaggctgatcgaacgtgtgtggtcgggcggtcgtcctaatcctgtgtgtgtgacgctggctgctaaacagcttcctggtgacgatcatggggctggtcatcccctggagctgcacgctggccatgatcgacgtgtactccgtgttcgtgggatgccctctgcgcgtgccgggcgtcatggtcatcgtcgtggtaggagactgcgtacgtatctctctacagtcttcttctgcgtcccggcgtgccaattcaaaatcaataagagttcatggtcatcgtcgtggtaggagatctctcaggccctgtcgatagtctcgttcgccgccgcctgctcgagcgccgcggtgatcgacctcctcctccagctccatggatcccacagctccccgacgttctgcgggaggtaccagctgtctgccatgatggcgttcttgtcctggctcctcatggccgcctctgccaccttcaacctctggttcgtcgcctcacggtggtagcagctgcagcaggaccacttttttttttgtttcgtagatagcgcacataatttggctttggagatgcgtatgtgttagctactggatgctactgggattcgagggagagaagatcagagaagagagtagcgtgtggagaggggagagaatgacaggaagatggcgatnnnnnnnnnnnnnnnnnnnnnaaaaaaaaaaaaa

SEQ ID NO: 11258 - DNA, 1152 bp, Zea mays
tcggggcccgcccggcccggaattagacatgattagaaacggatacgcaataacgcaaagattcggctgacaatggggaaggggttcgcgtcgtacttggcgatgaagacggggtcggagggcggcgacggcgcggcggcggtggcggcgcagcaggcgctcatcgacgcggacctgcggaacctcggcgtcgccgcgcgaaagctcgccaaccacgccttcgtcctcggcggcgggttggggttcggcacttctttcctcaagtggctggccttcctcgccgcagtgtatctcttgatattggactgcacgaactggaagaccaacatgctgacagctctcttggttccttacattttcttcactctgcctaatgtgctgttttctctgatcagaggagaggtggggaaatggattgcgattattgctgttattctgcgcctattttttccgcgccacttcccagattggttagagcttcccggttccatcatcctgctcacagcggtcgcccccagtctgttcgcacacaccttcagggacgacctcgtcggtgtcttcatatgccttgcgatcggatgctacctgctccaagagcacatcagggcgtcagatggactcaggaacgccttcaggaagggcaatggcgtgtccaactccattggcatcctcctgctcttcatctaccctgtctggaccggggtgctgcaaatcctgtaggcgctgttgcctccgtgttctcctctgctgtccaggcgcccagctccgttgccgttcgtctcttgtgcaaatgtttcttctatggtgagttggtgatcgtggttctgtgccatcggggttggatgcgtaatgtatgcttgaggtaatcagttggacccgttgccatggtggtggacagttttgttatctcatttgttgtagttggacgttggcatttggtttgttcgagtaataaacagcaataaaattattcgagtacataaacgccaccaataaaattggtggcttgatgtagatcgagatgttatcaggtgtgtaaatccttgcttctgttaagttatcgcaagtttgaggttgaggatggatgtttatagcaaaaaaaaaaaaaaaattgatgttatttctgaatatgatgtcaagtcaagcagtgac

SEQ ID NO: 11259 - DNA, 5606 bp, Zea mays
  misc_feature (1883)..(1883): n is a, c, g, or t
  misc_feature (2031)..(2031): n is a, c, g, or t
  misc_feature (2181)..(2181): n is a, c, g, or t
  misc_feature (5347)..(5347): n is a, c, g, or t
gacatcctgaagcagtcaagcactcaacctctccttcagtccttcccatctcatcctccatctcgatctcttcgctccgtcgaactttcacctagtcagcctgccgcgctacccctccaccgccgtctccacgcccgtggccaagccagcggaaccctagcatggcgaagctagcgcgatcgccaacgacctccccgccggcggcggccgcggataagcaccgctccgcggccgggtcggggctccggtccctcgccagtgccgcctccggatggtgggaccggtggacggtcattggttccggactctccaagctcgaaagggccttcggcgaccagttccccgagggcgagcgctacttcgggctcgagaacttcggcaacacctgctactgcaacagcgtcctccaggcattgtattattgtgctccattccgggaacagttgctggaatactatagcaaaaacagaaatctcgaagatgctgaagaaaatttgttgacctgcctagcagatcttttttcacagataagtgcatcaaagaaaaagactgctgttattgctccaaaacgtttcattcaaatggttaggaaactaaatgaatattttcgtggctacatgcatcaggatgcccatgagtttttgaatttcttactgaatgaaattgttgatattctggaaaaagagtctagttgtgcaaaggattctcctgggaccacatcttctgaaaatgtctcaaatggcgcagctgttgatggagttagaaaagaaccactggttacatgggtacataagaattttcagggtattttgaccaatgaaaccagatgcctaatgtgtgagacaatcaccgcaaaggatgagacattttttgacttgagcgttgacattgaacagaatagttcactcacaagctgtctgaagaatttcttttctactgagactttaaatgcggatgacaagttcttctgtgacaaatgctgcagtttgcaagaagcagagaagagaatgaagataaaaaaggcgccacaaatattagtgatccacctaaagcgcttcaagttcatcgagcagcttaaccggcacaagaagctgtcgtaccgagtggtgtaccccttggagcttaagctcagcagcaactccgctgatgccgactgtgagtactccctctttgccgtggtggtccacctggggagcggccccaaccaggggcactacgtagccatgatcaagagccatgaccattggttgtccttcgatgatgacaatgtcgagatgatcccggagtctaccctacagaccttctatggctcttctcgtgaatattcgggcaacactgatcatggctacatcttgttctacgggcgcattggtgggagtggaaatgagaagaccgactcttccgatggagtgtgaccgttgacatgggatcctgggtggttcgatgtacatgggctttcctggccttcgtatacttcggttggataggatatatttacattttcaacaagaaagtgtttttttgcggaagaccgtggggggaaaacataaaagtttagtttgttgttagttacagttccttgtaaaggattagttggcaggttagtatatcattttattttgttttcataattctaacttgtcatcgggacaaaaaaaaaaaaaaaattttttttttgtgaaaaagtcctgttcggaagcactgattttttttgttttgagaaattgatttgttgatgtagaaagagaatatccgcttctctcctatcacgtggtttatacatctgatatcgatgatctagcttatacctccggacatataaacttataaaacaagacaagttttatgcttggtgtttaggtatccaactagagttggtcctntcacataaacctttggcacctaaactcaagtcttaccattcttacgcttgggtctcttatgcgcttagagcccacataagagtataagaggcatttataataaagaatataggatgcatcaaaattgcgatatgagatagaaggaccnaaaattacatacctagcatctgacacatgaataggtttatcatgaaaaatattgcgtctatacctaccatgagtaacagataattgagaagagctagcaatcatggcatgacgtataacatgaacacgatgatcaacacaagcaacatcntgaacattcttaacatgcacataaatataaacatgactattacgagcatgtgaagaatggacactagtaaggcgtctctctcttttccttgatgaatttgggggcctcttggctcttcatggatttgttattggctcccttttggaaatcaagaccatccttaattaagggatgcctaccacttgtataggcttccctagcaaattttattttatcacactcatcattataagttttaagttgagcatttaatttagcaatatcatcattcaacttagcaatgatagaaacatgatcatgacaagcattgacatcaaaatttttgcatctaatatagataacaacatgctcaatagatgaagaataagcatgacattcattcaatttcactatcttagcatttagatcatcattagcaatcttaagacaggaaatagaagaagggtaattagacagctcactagacaataattcattctttttagtttctaagcaagagccttttctacattaacaaacttatcatgttcatcataaagtacgtcatcttgcttttctaggagtcccttttcattaagggcatccattaattcattaattttgtctattttagatctatctaaacccttaatcaacatgttataatcttcttcatcatcactagattcttcatcgctagaagaggtatacttaggagtagttctagagaataccttcttctcctttgccatcaggtaggtgtgacgctcgttggggaagagcgaggacttgtccaaggcgatggtgggaaggccctcgtcatcgaagttggaggaggagcagtccgagtcccattcctttcgaatatgcgacacgcgcctcttgtagaaccttttcttctcaaacttcttcccctttgtgtccttttcctagtcatcattgttagggcagtttataataaaatgaccagacttgccgcacttaaagcaggcacacattccctttgatttgttcttgttggagaagtccttgcgcccccttcaatgaggttttgaagcactttatgacaagtgccatctcctcatcattgatgccaccagcctcgacttgcgccaccttgttgaggagcgtcttcttgtcgtttgtcgcttcgaaagtgatagcttgcggctcaatggaggggaatctcccgttagcgacgttgtcaatatactttgcatttctaactatcatttgatggctcacgaattttccaagcacctcctcgggactcatcttagtgtacctgagattttcacgaactaaggaaacaagatttgcatcaaaaacaacaaatgaccttagcatgagtcagatgacttcatgatccgtccatattatgcttacatagttgcgaacttagttccccaaggacttgagcctgttgtacattttttgtggcccttcacccctcttcatggagaacctcccaagttctcccttaatgacctccatcttggtgactttggtcatcaagttttcttcgtgcaccatcctcgatgtgtcccatatttctttcgcattttccaagttattgactttggtgtattcttccctacgtagagaagccaacagaacagtagtagattgggcatttatatggattagttcctctacttctacctcattataattttcatcatcgacatcaggtatattcattccattctctacaatatgccaaatgctagggtgaagcgaaaaagatgactacgcattttatggctacaccaagaatgatcctccccatcaacgtgaggaggtttgtcaagaggaattgaaagcaattgatcatttgagaaacgaaaaatgcgtgaataattaaaaggagtatgattgaatgtattttgatcgttttttgctgggaagaagaagagacattgtccttttgcgaagaagttaaagaagtatcgctcttgtagtagacgatcttcttgatgcgcttcttcttcttctttccctccttatgcgatcctgagtcgatgggcttctcgcctttgggctcatcatcgatgggatcttctccttgtcgtcatgtatgtcggacaccttcccttccctttggagtcttgtcccgccatcccttcgggttgttagacccaatataaagagatcgaatctgataccaattaagagtcacctagaggggagtgaataggtgatgcctgcaaaacacaacttcaaacacaaacttggtccaaattaagaattagtgcaaagtaagaccaagtcagagtgagaagaagagagaagaacacttgattgatctttacagatatgtaataaactaagagccatattgcaagtgaaacatagaacttagatagaggaagaacaatcacaaagaagcaaacacaagagatattgtgatttttctcgtggttcggtcaagcctaaaatgcttgcctactccacgttgtggtgtcccaatggataagagttgcactcaacccctcttaagtgatccagagatctacttgtgtgtcatggtcttccttatataaatagtaatcccattgcaaggaatctccataagttggagtctcttgcagccgtacatagtttgatggagtttataactcaaaagcaaagtaagagtgaggggagagtacatacactagaccaaacacaacaacacaacacaagaaagaagatcacaagagcgcaatcacacataataacaagaacaccttagaactgtgttcgggtctcactagaatcactagaatgtgttgtggcagagtgtcggagtgatcaagtgctcttggtatgcttggggtacagaaggaggtcacctagggggaccttttatagcccaacaagctcccatagtagttgctccttcctcctaaaacttgttgaaattctgcactgctcgggggcatcgaaccggtccagtgcaccaccgaattgggtccatgtgcaccttcttcgggatctgactagacaccttccttagctgactgacaccagaccggtccgatgcacatccaaaccaggtgccacattagctaggccagcacgcggtcgtgtggaagtagctattggaggcggtctggtgcaccaccggttaatgcataatgaaggcccgatgatttttataaataaaaaaacccaaaactcactgttcagcagaacgagtggtacngtgcacatggactcgatccggtgcaccaggccgccaaaattcctatgttctaggcctctgcagacacggtccggtgcaccatcggaccggtccgatgaggcccagaacaacccaagttaagctcttttgagcctaatttcttcaatcttatttgaatgtccttgagagcttccctacgacttagacaaacatcattggcacataaacaaatgaactaagtatagggaactcaccttttccatatcttttcaatagaatt

SEQ ID NO: 11260 - DNA, 2014 bp, Zea mays
  misc_feature (165)..(165): n is a, c, g, or t
tattagagataaattttgctttagatttttacctaccgcacccttaaatatttaatacatattttagttttgcttaatttattatttaaagtattaaaaagaataaaaaagagaagggataaaatctgtatatatgaatgaacctatgtttataggacgttgttngaagagagagctgagaaaatctactctatatttagagaagagaagcgtttacatgctccggccagccttaaaagtacataaattatcatagaaatatatataaggaaaaaattgtgatttctaacctcatgctagtttccttcaaccataggaactggaagaaataatttaattctctatataaaatgaagatataacaatttttataggtttagaattctctaagaccgatttgtttcttttagagctagtttgagagctcaattttctcaagagattcttattttttcaaagaaaaatgaactaatttctttaggaaaatgaaaatcccttgagataatgtggtttccaaactagtccttattttttaaaaaggtctaaatgtacatagttccaatcgtgtgtatcagtatatggtagtaaatcacaaattgccagacagttcacgctagccatcgctaacgttaagcatctcctttgataaatatgaaaggaaaacggaaaggcaccagcgcatcagcaccaaccctctctcctcatgaaatcgagccagcaccagccacgccaacagcctgccacccgtgtcatccctgcatgcgcgaagcaggtgagactggacaggagcagccagccccatgacgccctcttaagacgaggacgaggaggaggcggtggaccagttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcggatgggtgatttgagcgtctgggttgtcagcggcgcgccggagggcagccggttggcggcggcgatggagctgcatcatcaggcgcagaaggaggctatggcgccgcagcaggctcaggctccgcccctcttcttggacttctcgcatggaggtaagcagatcaaacaaagcgcactccttggctccgcggcggatttcgtcttcttgggcagcagcaccgcacccttctgttccgatttcggatcgtgaaaaggtcgccggggacttaattgtcgggttgctgtgtgcacatagattacggcggcgggaggaagcggcagcgcgaggcggagcccatggtcgtcgcagttcttctctctgcagcagcaaccgcaggcgcaggggcccaaggtgatcaacctggcgcaacttcagaagcggacggcgatgggcctccggctcgacttcgacgagggctcggagcacgtgtcgtgcacgtccccggcctcggcctcggcctcatgtctcctctctaaagagctcgccgcgcagcgcgatcagcacaggaacgagatggaccggctgatccaggaacatgtaagaaccgtgcgtcgtttgtcgccgtcggtatccaccagagaccgtcctatgtcgctgatgtgctccttgtgccttgcaggcggacaggctccggcgcgcgctggccgacactcggcggcggcactaccgttcgctggtcggcgcggcggaggcggcggctgctcaacgggtaagggagaaggaggcggaggcgtcggaggccgcgcggcgccgcgcggacctggaggaccgggtggcgcggctgagggcggaggcggcggcgtggcaggccaaggacgcagcggatcagtccacagccgcggcgctccacgcgcagctgca

SEQ ID NO: 11261 - DNA, 1789 bp, Zea mays
ttgggtacctcgaggccggccgggagacggctccgccccgctgcgcccagcatcggccgaactggtctatcggcgccgcccttcacgccgagagttccctctttctcgcttgctcactcgcgtcgacgactgggctaccggcgcctccaccctccgcctggtgtccttcgccgtcgacgagcgcacaccagggtacagtacgtattgctcgtgatttgtgtaactacggagcaagctgcatacagcacaagatagaagatgggtatccttgagaggatcaaggagattgaggccgagatggctcggactcagaaaaataaagcaacagaatatcatcttggacaactgaaggcaaaactagcaaagttgaggacacaactattagagcctccaaagggttccagcggaggtggagatggttttgaagtcacaaagtttgggcatggtcgtgttgcacttattggatttcccagtgttggaaagtcaactcttttaacgatgttgactgggacacattctgaagctgcatcatatgagttcacaacgcttacttgcattcctggaattgttcattacaatgataccaaaatccagcttcttgatcttcctggtatcattgaaggagcttctgaaggcaaggggcgtggtaggcaggttattgctgttgcaaagtcatcagatcttgtgctgatggttctggatgcctcaaagagtgaaggacatcgtcaaatattaactagagaactggaagctgttggactccgtcttaacaaaaggcctccccagatatacttcaagaggaagaagacgggtgggatttctttcaataccactgttcctttgactcatattgatgagaagctgtgctatcagattctgcacgagtacaaaattcacaatgctgaggtgttattccgtgaagatgctactgtggatgatctcattgacgttatcgaagggaaccgaaagtacataaagtgcgtctacgtatataacaagatcgatgttgttggtatcgatgacgttgataatcttgctcggcaaccaaattcactagtgatcagctgcaatttgaagctgaacttggacagactacttgcgagaatgtgggaggagatgggcctagtgagggtgtatacaaagccacagggccagcagcctgatttcacagaccccgttgttctttccaccgacagaggtggctgcacggtggaggacttctgcaatcatatccatagaagtttgctcaaggacgtgaagtatgtgctcgtatggggaaccagcgcaaggcactatccacagcattgcggcctcggccatggccttaacgacgaggatgtcgtccagatagtaaagaagaaggaaaaggaggagggtgggcgaggccggttcaagtcgcacacgaacgcacctgaccggatatctgatagggtgaagaaagccccactgaagacataataacgggttccctgagcgcgtcgtgatcagcttctccaaaccagatggacaacacaagctcggtgggagatcataaaatctggaactagctgagccgcggcgtgctacttgttttgtagtaccagaacagaaggggccaccgccatgtttggagtactccaccttccacaatacctacaccaatgcggcaccaccatgaacactgctgcgtcttgctcgtatgatgtgggcttatcactgtgtgttacctgctatatatgatatgataaatacttgccaactcaaaaaaaaaaaaacccccgcggcgcggcagcctagcctttgttgtggg

SEQ ID NO: 11262 - DNA, 5343 bp, Zea mays
  misc_feature (1841)..(1841): n is a, c, g, or t
  misc_feature (1851)..(1851): n is a, c, g, or t
ttgagttgaggctataaaaggaggagcccatggcttcattcagggaggggaacacttcgcggtttttacctctacgactgatattgacacttgcctcaatcatcaacaggagcttgaaaacttctccctctccctaccggcttgtatcccatactacaaccacttgtgtgcaagtaatataagtctcattctcctttgctagaaggaggagcttctcttatccgaaccagaataaagacttgtgtctccttgcatcacacatctagatctagacacacagtactaattcactagttggttggatcctcggatcgaaacgctaacatctctattgttaatattatattttacaacagtagacacattgcacatgcatgaaaaatcaagccggcctgctgctgcttcctgatacaaataccacccgagcgagctgagcgagcaacagcacccactgtttcagtatatcctagcgctggtgcgctgcccatggttttcggctatacgagcagagagaactgcgccgatcgaccgcgttgaaagaatgccagtatataggggtaggtgaattgtttcaggcgaattgaactgcccatggtttaattcaagcgaattgaaggcccggcgcaggccttttcagagaggtagctcggctcgcacaccatccgcctagctagctctctcggcctctccatgcctgcagcgcccagttcgctgatgagagacaggaggagcagggagcatcaggcacatgcgtgcatggtctcctggtccaatggctacagccgtacaggctaccgaggaaggacgggcctacagtacaattattatagagcaaggcaggtacaatggctcggttcggcgctggatccggcgccacggcgggccggccggcgatggagccattggcgcctttggttggctgggagctgggaccacggcgtccgcaccagccatttgatgcgctataaaccaactgtgccacggtactgcaacgggtgtgggaggaaggatccatggggttgggctgtgtgttgcgggagacgatggtgattggctaccaaccatgtcgcgaacttaacccaaagaagaatgtttcccttctgattgttgcgtctctctgagatcttctttgacgacgggagtgaaccaggttttatagaagctaaaattaaagagtcatcacatatataaccactaatctactgggaaataaaccatcttacaaagcagaccgcgggacagaaacaagcgaacaaagaaacagaagacaagacgccagagaggcctgaacctgaagcaacaaccagaatcaactaccaataactagcctacagaacatcttcaacatccatgtcttcggcccttctccaaaacccttgaagccgccatttcatcgtcttcaacttatcatccaaaaatctgacatcccactctctctctctcaaaaaagtgccatctctgtaaaaaaagtgaagattttatgaaagttttcattagaactcttcgaaaatgtgatgctctatccctattttgtttcgtacattccacaaaccacataaaatagcagtagctaaaatggaaagttctatatgataatctctactccccatagcaatcctggacttcatctagatctatcggaaccctatcccgtcctaaatagaaaatcattcaccattctcataaaagtacccttcaacaatgtcccaacattcttgtctagacttagattttcgtcaagcaaaacataggtcttttgaacaatcctatctttttagctttatgattagcctcaaagtagcagctctcaaatgttcctttagtatcaattcatttaagantttctattcnatttgcctccaaacaatatcacaatccctcactgagattctctcgcgccatcttgtggagtgtgccatataggatcccatctcggcccatcaagtgctgggcctggcaagcgtcttgcgccaggcgcccagacaggtggttcgggtgcaaagcccagccagacgcaacaaattagaatggcccatccatggcaccagcgggcgctacgccatttgcagtgagagcggaactgaaaaggccatttgtagtgaaaagcaaggagaaggaaaaacgcgaaagctttccccctgctcaccacctgctggctgctgctacagtgctactgccattacgccaccacacgagcttgcgcggcgactcggcggcggtggacgaagcgggacgccatggactcccgccagggccagcagcccaactacaaggttcgcatcgcttcctcttgggcctcggttcaccgtaccgttaggtcgtctgttcgcggcgggtcggagtgcgggtcgcggccaggagtgggaggaccgaggtccgaggacgtcgacacctctcgaggatgcgaggggagcgcgtgcggggtggtgttcgcggccgaattggggtcccggttttcatgcccgatcgatcgcttctaccatgacgagggttttgggtttagtttagccttgtagggcggtatccatgtttatcccggttttcgagacggttttggtcgcggcgtgatactttctgtaacagagtactagtggtgaagcaggttttgtgcgtcaatgctcttgacgtcgtttgcatattgagccttttttgtgaggattttgctcttaggtctgtttgttttacttctaaattatataagttagattatagtagaagagtaggaagataaaatatcactttggtacaacaaataagctagcagcttatttgtgataccaaaatgatattttaacatattactcttctattataatccaacttatataatctagaggggtcttaatctggctgccaggttttgggagtttttttgtccaggactaaacacaaagtcaaggctttgatataaaaaacagggttttatttagatattcttttttgaacaagagccgtggaaatttagattaccagaaaacaaatagatgattatgtgagtcttgagttaaagggctcataagctggactacagttacatggtggtcgggagcttcatctgaacaccaggtcgtctgacgctgcaactggttcctcaaagtaactgcagtcggtgctgtacaatgtgcacttgctcctgtgcactagcatcaacctttacaagttcttggaagttatttagcactaagatttcatcagcattcttagcattaattgctatagtatcaaaaagggatagtggtacgagttggttggatactaactattgctatacgttgtgaaggaaagtaggtaataccaaaagggattaaggtttatgtgtggtgtttactggatcagtttttattattttcttgtgctttgtacaactacctgcattcttgctttgatgttcttttactgcaaagttcgacacattatattttttatgaaagattgaagattacttattatttttttttggttccgctgtcctctctgcagatttatattaggatgatgaaaacagttctgcttgacgtgaagtccactgataccatagatcagattaagtctaagattggtgctttagaggggattgacaatagccagcaagagctcttttttgctggaagtcatttggagaaggacaacagacttgctgattacaacatcatgacaaactcttgtgtcgacctttatgtaactgatgggatgcagatctctgtcagtatcccctctgtttggaagaccatcaagctcaatgtgatgaaatcccagagtgttgctgatgtcaaggcgatgatcgaacagatggggggaattcctctggatgaacaaatcctgatgcatggatgccaaaagcttgaggacaacaagttgttgagtcagtgtggcttgagcaatggccacaccctgcatgttttggtccgccccaccgacaggctgcatatctccgtggatgttgatggtgaagaaactctgaatctggatgtcaaaagctggtatactgttgctgatgtcaagttgatgatcgacaccttggagggtttacctgcaagaacacagatactcatgcacactcaacctggtggcgctaacacagtactcaaagacattgaaacactgcagaatcaaggcatcaagaacaacgacattgtcgctctgtatcataaagtcaacttcttcgtcaagacatatgaggggaggaatctagtgttatcaatgaggacttgtgacactgcagaggaaatcatgaaggtgattgaagaaaagcttaaggtcaacacaggtgtttactacctgcactacagggggcgtgttctggctcttggggatactcttcggaagcacaagatcgagaacaattgcacggtcgatgtccgccttcggaattcacatgtaacgaagtgaaacaaaagggggtgccttgggtcttctgggtgctagaccatggggcaaaacttaaaaagttgcttagcctcagagagaactatagcttttgccattttgcggtcgtggttagttagtggatgtttgtggctcttgactgggtaaggtcttttgttacctgtctggtggttgcacctgcgtaacctctcaagcatgcattgcctgtctgatggctgtacttgtgtaacctctcaagaacggtgtctgtctggtgactggtggtaaaaatacagttctgttatatggttccagttcaaaaaaaaaaatttttctcatagtaaccattgatccgaaaaccccagcatgatccgaaaaccaagcacagctaaagtttgataaatgcgcaaattgagacaggatttgtacaacaaggttccaccattaccctacttttatcacctatcaccgcgagaagagacgggtaccaagtagtcctacttgaacttgaagctgcaagagaacaataatgggatgtgtaagtaataattgttcattgcgtcaaccattggtgtttatatacacactccggtttctaaaagaaagccgttttagatatgattttagtataaaagcccgtttgatagggctccggctccggcttttgtctaaaaaagccagagttttgccaaacatcttttttaaaacggcttatgcgaaaagcatctaaaagccagagctactttagtacaacggagaagaagctataaacagtaagtagctttaccggctctggctctaaaactttaatacaaggaaatgacttcagctttaccaaaaaaaaactgtttttcaggaaaaaccagaggtaatttccatcactaacctctggtagaagtgatcttttcagtaatgttttttatcatggttttcaaatggtctgatttatcgcgataaatcagtctggtcagtcagggg

SEQ ID NO: 11263 - DNA, 1390 bp, Zea mays
atttgtagtgaaaagcaaggagaaggaaaaacgcgaaagctttccccctgctcaccacctgctggctgctgctacagtgctactgccattacgccaccacacgagcttgcgcggcgactcggcggcggtggacgaagcgggacgccatggactcccgccagggccagcagcccaactacaagatttatattaggatgatgaaaacagttctgcttgacgtgaagtccactgataccatagatcagattaagtctaagattggtgctttagaggggattgacaatagccagcaagagctcttttttgctggaagtcatttggagaaggacaacagacttgctgattacaacatcatgacaaactcttgtgtcgacctttatgtaactgatgggatgcagatctctgtcagtatcccctctgtttggaagaccatcaagctcaatgtgatgaaatcccagagtgttgctgatgtcaaggcgatgatcgaacagatggggggaattcctctggatgaacaaatcctgatgcatggatgccaaaagcttgaggacaacaagttgttgagtcagtgtggcttgagcaatggccacaccctgcatgttttggtccgccccaccgacaggctgcatatctccgtggatgttgatggtgaagaaactctgaatctggatgtcaaaagctggtatactgttgctgatgtcaagttgatgatcgacaccttggagggtttacctgcaagaacacagatactcatgcacactcaacctggtggcgctaacacagtactcaaagacattgaaacactgcagaatcaaggcatcaagaacaacgacattgtcgctctgtatcataaagtcaacttcttcgtcaagacatatgaggggaggaatctagtgttatcaatgaggacttgtgacactgcagaggaaatcatgaaggtgattgaagaaaagcttaatgtcaacacaggtgtttactacctgcactacagggggcgtgttctggctcttggggatactcttcggaagcacaagatcgagaacaattgcacggtcgatgtccgccttcggaattcacatgtaacgaagtgaaacaaaagggggtgccttgggtcttctgggtgctagaccatggggcaaaacttaaaaagttgcttagcctcagagagaactatagcttttgccattttgcggtcgtggttagttagtggatgtttgtggctcttgactgggtaaggtcttttgttacctgtctggtggttgcacctgcgtaacctctcaagcatgcattgcctgtctgatggctgtacttgtgtaacctctcaagaacggtgtctgtctggtgactggtggtaaaaatacagttctgttatatggttccagttctaccc

SEQ ID NO: 11264 - DNA, 1717 bp, Zea mays
atggaataattcggacaaggctcaatgaagacaaatccttgataaggaacaccaaggacaccattgtataataacaattacaaatatatcaattatcaagagataacaataagataaaaataaatatataataaccaacaaacatgtagatgtcacaactcaaagtcactattatgtttaacacaatcatgatctcacaaatcacataatacacaatcatttgaattttaattattacagcacaagtgacattttttctaaatacaataaaataaacatcactatacatataaattctagtatttgaatttactaaaatattagtatttagaatgcttttactaaattcgtcatggaatgcattactatttagcgtcattgacattgatacttttatatcaaatgttttgaagcaaatacgttttttattctttcagaaggtgtaaataccgacgtggctacaagggtcccacgtgtcagttatcttcatcctgtcccacgcgagtctgccaacgcacacattcactgacagcctgacctaaccagacgagtggggccccctgccagggggaggaccaaggcctcacccttcccctcctctcctctccacctcatccgtatctccctccctcttctcggcggccgtggcggcgccggaggactatgcgcggcctccaccgctgcccgcaccagctcctcctggtctctccaccgccgcggtccgcccccgcgtgccgccagtcggccaccgcctcatcgcggggcctcaggagctccctcgccgtcttctccgcacccggggctcgggtagcggcggcggcgcgcgagcagaagtggggccacgtggagggtgatgaagacggtggagaggagggcctaggggaggcgctccacaggacgcgggagctcgtggagtgcgccatgttcgcggccgtcgctgggctggcctacttcctcagcaattccctcgccattgagaattatttcagttgctttttcccattgccgatagtcatttcctcattaagatggggactagaagccagcaggaaaaccgtggtggctactgttttactgctattcacattatctggccctgtaaaagcgtcaacttatctgctaatgcatggagtagttggtctcatcatgggtactgtttggagattggagaccaactggattgtctccatcatcctctgctccattgtccgtgccctgggagcttgtggttacgtgctagtgtcatcgtttctgataagagaaaatattctcgcgctgataacggttaacattcatgcttcgttgacatacatcctgacggcagctggcgtgaacacaattccttccatgggcacaatatatctactctttgggacactgcttctacttaattgtgggttcttcgtcttcctcctgcatgtgatgtatacggtattcctggcgaagcttgggataaagccgtcgctgaggtcaccaagatggctggacagagtgatgtgaaaattttaggagtagggcatcgtacgtagtgactgttcttcctgttctgctgttttagccttgctgtttgtcgcccctacctatactgggacctgtaaccatggggtgcatctgtgcatgcaaacgcgacaagcaaaattcgggattatcaatcaatcatctgtgctactcgtgctctgttgatgatcttcttgttaaggcaaaaaaaaaaaaaaaa

SEQ ID NO: 11265 - DNA, 3995 bp, Zea mays
ccagtattacggtctatttaactttatctgtaatagtgcaaacagtatttgcaaggtagtggccttatatattagttaaatataatttcgagaaggcgaaatttattttaatttaaaaagtgtcaccgccaccggacgaggttccttaaggactctactgcaagcagtaattaatgagttcaccagcaatgcatatctgccacggctcatttatctccaaagattgcttgattcagtacagattgcattttccagcgaaaggcaaatctgggatatctgtacattagtttttttttcccgtagatgagatccaaatctatctaccgatgctgcaaaatccaaaatacagccaaacaattttgtggagtcgccattaaatgcttggattgggacccccctgcttttaattccgtgcagacgagttggtgtgctccaataactcccttccgcttcctcctcctcctcctcgtctgtcctctctctctccccttcggcccttgcttcctcttcctttcactcctccgcctgtccccttctctctctgctcggttccttgatccagattccgcagcggtgagggcacccagcccgatcgtccgtctccgtcgatcccccgaagccctaggagagacccttgtccgcgtcgaattcgatcgcgggctgatttgatcccgagaattcgcgagggggccaccggcggcggggggaatcggatgttgtaggaaaggtcccggatttctgcgcgggcaggcgggcgggcggccatgcatctgaaactgtggaagccgctgtcccactgcgccgcgctgctcctggacaagaagaaccgtccgccgaggacgccgccggcgggggcgggcgcggggtccggcggcgggcggcggctgcaggagagcaagctgcgggaggcgctggaggaggcgtccgaggacgggtccctcgccaagtcccgcgacgcggcgctcctcgatggaggggacggcggtgccgaggaggggtccgtggggcggtcgcggtcgctggcgcggctccacgcgcagagggacttcctgcgcgcgacggcgttggccgcggagcgcgcgttccagtcgccggacgcgctccctgtgctggaggaggcgctcgccaagttcctcgtcatgtaccccaactacgcgtccgcgtcggacgtggaccgcctccgcgccgacgagtacccgcacctggacaaggtatgcctcgactactgcggctttggcctcttctcctacctccaaagctgcaaccctgcggactcgtcagcggcgttcacgctctcggagatcaccgccaacctcagcaaccatgcgctctacggcgccgccgagaagggcaccgcggagcacgacatcaagaaccgcatcatggattacctcaacatccccgagtccgagtactgtctcgtcttcacggtcagccgcggctcggccttccggctcctcgccgagtgctaccccttcggcaccaacaagcgcctgctcaccatgttcgaccacgagtcccagtccgtgaactggatgacgcaggtcgcgcgtgacaagggagccaaggcatactccgcctggttcaagtggcccacgctcaagatctgcaccacggagctccggaagctgatctccaccaagaagcggcggcgcaaggactccgccactggcctcttcgtgttccctgtgcagtcgagggtgacgggggcaaagtactcgtaccagtggatggcattggctcagcagaaccactggcacgtcctgcttgatgctggggctctggggcctaaggacatggactcgctggggctgtctctgttccggccagacttcatcatcacttcattttacagggtgtttggggctgacccgacgggctttggatgcttgctgatcaagaagtcggtaatggcgtgcttgcagagcccaagcggcgggacgggggcggggctggtgcggattgtgccggtcttcccacagtatctcagtgattcagttgatgggtttgatggtgtcctcgacggcctggaggatgataacatcattccaatcgaggaggggtcagcctcgaacagtcaccatgcatcccaattgcctgcattctcaggcgcatattcatcggcgcaggtgagggaggttatcgagagcgagatggaccaggacagttcagacagagatggtgccagcacaatatatgaagagagcgagagtgtttctgttggagaggtgatgaagagccccgtgttcagtgaggatgagtcatcggagaactccttctgggttgatctgggacagagcccacttggttccgaccattcagagcaatcaagcaaggggaaattgggctctccgttgccagcgtcctggttttctggcaggaagaaggcgtcgccgaaggtgccatccaaactgtcaaggagccctgttcatgacaagcatgttttgtcatttgatgcagccgtgaggtcggtatcacaagagccagggcctgtggaagttgttccagatgaagaccattcacgtaacggcatcaagaacattcatatcagtgagattgaagaagacaacagagatggtaaagtgaacaagaggttcgtaaagttttcttgtgccaatggccctgctgaaggcagtgcaacctccgttttcgggacctgtaccgcccgcgagaacggctccacatccgagatctgctcagaaactcaagcggagaccaaggagagcgcgatcagaagggaaaacgagggcgacttccgcctgctgggaaggagggaagcacacaacggcaggttcaacggaggaggaagattcttcggagtagaagaaccggagcgggtgtcgagcatggggcgcaaggtatcgttcaccatggacgacagcaggctgtgccgtaactcggatgccggcgagacatctgggtacgggatggcagccgacgaccaagacgacgacgacgcgtacagcgactacgacgaggctcaggacggcaggaaagagcccgagatcgtctgcagacacctcgaccacgtgaacatgctggggctcagcaagaccacgctcaggctgcggtacctgatcaactggctggtgacgtcgctgctgcagctccggctgcccgactcaggggacggcgagggggcggcagcggcagcggcgcccgctctcgtctacatatacggtccgaagatcaagtacgaccgcggggcagcggtggcgttcaacgtgaaggactgcgggtccggaacctcgctgatcaaccctgagaccgtgcagaagctggcggagaaggagggcctgtccttgggcgtcgggttcctgagccacatccggctcacggacagccagagacacggcgcggccgacgtggggctcagctcttcctcctcgccagctgcggcgagcggccgccgcgagaagaagagtactcgcaagaacgctgtcgtcgggaccgaagtggtcactgcttctctcgggttcctcaccaacttcgaggacgtctacaggctgtgggcgttcgtcgccaagtttctcgactcgtcgttccttgagcaggagaggctgtcgtccattccggaggatgcagaaagatagcatcagatggtttcatagtagtaactgaaagtggggtgtgggggtagaagaagagagatgccaaggcgcttgtgcgtagtattgttcttttgtatccaaatgcctcagcatggcatcgacttggcggcgcggctgtttatatttcttcattcttatttcctcccctttttttttcttctaggcatgggacttttttttttggtctgtaggttttgttggagatctatatgtacccacctacacctactaattgttttgaggagcatcctttccatgtactcgcttgtaaattggctccattggccatgaaattaggtccggtcgcctgtattgttgttgcggcatgaatattgaatagcagcatgatgataggtgattctacccttttcggttttgctgttg

SEQ ID NO: 11266 - DNA, 1948 bp, Zea mays
ctggccgggcgggccccaacagtggccgcctcctggccgcccgcggaaccttctttactttgtccccaaatggcctcctagccctcttcacgtttcccttcaccataagcacaggcaccactccccccctcctgcaagctcctccctttctcggctcttggttcttgcattactctgtcagcccagaggcagagcaagtaagcaaatggttgctatggcggcgccagggcgagtggcgctcctggccgccgcactcctgttcggcgccttcttcccatccgcgttcgccacgtcctcgtaccccgcaaggcttgcgggcaggctcctgtccaccacggcgtcggcggtggccaagcagctgtggtcgctcaaatcggccgccaccaagacggcgacggcgtccgtggcggggcggtccatggtgcggtacgagggcgggtacgcggtggacacggtgttcgacggcagcaagctggggatcgagccgcacgccgcccagatcaaccgcgccggcgacctcctcctgctcgactccatcaacagcaacatctacagggtccagctgccgttgtcaccatatagcagaccaaagctccttgctggttctccggaaggtttatctggccatgttgatggaagactgcgagaagcgaggatgaaccatcctaaggggttcactgtggatgataggggcaacatttatgttgcagacgctatgaacatggcaataagaaagatcagtgacacaggggttacaaccattgctggggggaaatcaattagaggagggtacatagatgagcccagtgtcagtgatgatgcaaaattctcaaccgattttgaagtccaatacatcagcagtacctgctctctcttggtcattgatagaggaaaccaagcaattcgagaaattccactgaacgatgatgactgtgcatatcagtatgaagctggttttccactagggtttgcattgctttgtgctgctggtttctttggttatatgcttgcattgctccaacaccggcttttaggaatgccgtcaacaatcaataaacctcaagcgcctccaagacccagcattgcaagtatccctccataccagaaacctttaaacccttatgttcgtcaaccattcatcccaagagaagaaactgcaagacaggaacctgaagaggggttcttcacctcagctggaaaacttgttggaggggcaaaatcatctgtggctgaggtatttggtttcaagaagaagagcctgagcaacccataccatcagcagcaacgaagagctaacccttggccggtgcaagaaagctatgccatcccacacgacgaaccacctccggcgctggacacgagagcaccagcccctcagaagaactacagctccgagaagatccactacgtccgccatgggcacccgtatttcaacagctgggacggtcaccgtctccctcagcagcagccggaccagcagctgtatcaccagcagcagcagcagcacctgcagcagcacaggcagtgctctgcaggcccccagacgttttacgagcagagttgtgaggctacaaacgaggtcgtctttggtgcggtccaggaggtggacagcaagcggcgaatggtcgagatcaaggctgtcaactacggagacacattctatgaacagtacgggatgcggtaccgcaacaatttcatcggctacaacaacactaacaactattgaacagcctgtctatttctttgacttccctgtctctcttttcctttctttttttccatcttagttacgagttatttgctttatagtatttatttaaagtggcttttctataatagtattaatagattaggtttctctataatagtatttacaagtgagcaacttctctaaaacattatttcacctttatttcacccattcttttctttaaaaaaaaaaaaaaaa

SEQ ID NO: 11267 - DNA, 1525 bp, Zea mays
  misc_feature (1380)..(1380): n is a, c, g, or t
  misc_feature (1387)..(1388): n is a, c, g, or t
  misc_feature (1428)..(1431): n is a, c, g, or t
  misc_feature (1460)..(1460): n is a, c, g, or t
  misc_feature (1517)..(1517): n is a, c, g, or t
  misc_feature (1524)..(1525): n is a, c, g, or t
cctttttcacccggcgacgtcgagcgagaacggccgggccccaaaagaggccgcattcttggtgctttctgaaccttctttactttgtcctcaaatggcctcctcgctctcttcacatctcccttcaccataggcacaggcacctctccccccctgcaagctcctccctttcgctcctcctgattcttgctctgtcagcccagaggcagagcaagcaagcatcggcggccatggcggcgccaggtcgagcggcgctcctggccgccgcgctcctgttcggcactttcttcccatccgcgtcctctgcgtcctcgtaccccgcaaggattgcgggcaggctcctgtccaccacggcgtcggcagtggccaagcagctgtggtcgctcaaatcggccgccaccaagacggcgacgacggcagtgacggggcggtccatggtgaggtacgagggcgggtacgcggtggacacggtgttcgacggcagcaagctggggatcgagccgcacgccgtcgagatcacccccgccggcaacctcctcgtgctcgactccatcaacagcaacatctacagggtacagctgccgttgtcaccatatagcagaccaaagctccttgctggttctccaaaaggtttatctggccatgtggatggaagactgcgagaagcaaggatgaaccatcctaaagggttcactgtggacgataggggcaacatttatgttgcagacggcatgaacatggcaatacgaaaaatcagtgatacaggggttacaaccattgctgggggaaaatcaattagaggagggcacatagatgggcccagtgatgatgcaaaattctcaactgattttgaaatcaagtacatcagcagtagctgctctctcttggtcattgatagaggaaaccaagcaattcgagaaattccactcaacgatgatgactgtgcatatcagtatgaagctggttttccactagggtttgcattgctttgtgctgctggcttctttggttatatgcttgcgatgctccaacgccggcttttaggaatgtcatcaacaacagatgatcctcaagcgcctccaagacccagcattgcaagtatccctccatcataccagaagcctttaaatccttatattcgtcatccattcatcccgagagaagaaactgcaaaacaggaaaccggagaggggttcttcaccacagctggcaaactcatgggaggggcaaaatcatctgtgggtgagatatttggtttcaagaagaagcgcctgagcagcccataccatcatcagcagcagcagcagcgaagagctaacccgtggccagtgcaagaaagctatgccatgacacacgatgaaccacctccagcactggacncgagagnnccaaccccgcagaagaactacagcctcatgagaaaggagnnnnagaagacccactacgtccgccatgggcanccgtatttcaatagctgggacggtcactgtcacccccagcagcagccggaccagcanctgtatnn

SEQ ID NO: 11268 - DNA, 2356 bp, Zea mays
  misc_feature (2151)..(2151): n is a, c, g, or t
  misc_feature (2323)..(2323): n is a, c, g, or t
ggctaaaccctaatcaatcagtcggtcgccgccgtccgcccgtccgctcagccggccgagcgctcgagcctcctccgtcccgctcccgcccgtccgccgagcgccgacggcccgagcagccagcaccgcccagcaggcgagccgctccgcctccgcgcctctatccgccgtccgctcgtcccgaggccgcgagccgctccgcggctacgaccctccgcccgccgtctgcccgtccagcgagcgcccgacggcccgagcagcggagcaggcgagcagctccgcgcctccggccttcgcccgccgtccgctcgggctcggaccgagccgctccgcccaccgtccgccgagcgcctgacggcccgagcaggcgagcagctccgcgcctccgcccgccgtccgctcggcccgagcagctcactcgctcagccgcagagccgctgtgccttccaatttcagccggacaccaccgtgtcgcccccgcgtcctaaacctctcacctcgccggggtccggtagccgcgaacgatgttccgccgcgcgctcctctcctccgtctccccactccacggaacggtacgaatcccgagccccagctattctcctatccaagcccttctcgctcaatggagcaggtacgcctccgtggtctcatcctcggccccgccgccgccgccgccccctccatctccgcctcaaggtccatcgaggtcgagcggtggaggtcccacttcctcgtcgctgaaccctgcagaggtcgccaagttcgcctccatcgccgagacctggtgggattctagtggcccattcaaacctttgcatgtgatgaatccaacccgactgtcttttatccgctccactctctgtagacatttcaggagggatccaaattcatctaagccacttgaaggtctcaaagttattgatgttggatgtggaggtggcattctgtcagagcctcttgctcgaatgggtgctacggttactgcaattgatgctgttgacaagaatataaagattgcaagtattcatgcggcatctgatccaacaactgcttctattgagtattgttgtgcaacagctgagggactggtaaaagagaaaaggctgtttgatgctgtaatttctcttgaggtgattgagcatgtcgccaatcctttggagttctgtgaatccctctcggctttgacaattcctaatggtgccactgtgatttccacaatcaaccgatcaatgcgagcatatgccactgcaatagttgctgctgagtatatcctcagatggcttcctagaggcacacatgagtggtccaaactggttaccccggaggagcttgtcctaatgctgcaaaaggcttccgtctccgtcgaagagatggcagggttcgtttacaatccgttgagtggagaatggtccctgtcagatgatatcagtgtgaactacattgcttttggcgtcaagaagggtgaagcatcatcgacaaatggcagagatgcaagtttatcatagctgaagaaaaacacgtgaccttgaattgtcgggcatcattttcagaggaccaattcatgtcactgaaatcttactgctaaggatgcaaccaagtagcagaagagaattctcttgccctttgttagtcttggaaactggagcttgtggagtgatgcttcctggaagcgccattgagaagtcaagttgacaacaagtgactgctaacaagtagagctatctgccttttttgggtaatgtttcgggcagtttttctcaattttgtggcaatcactgatgatctaaataaaaataatactactacactgctgtacgtgaaaactgaacagatttgctgtctggaaatgtaactatttttaacagttaaggcttgttcgtttttgcgttaatccatatggattgggttgagtgtgattgagtcggattaaatctatagcaagttaaaatccattccaattccacccaatacacttcaatcctcatggaatatcaataaccgaacaaggtcttaagggaaagttaagaggtgtttgaatgtgctagagctaactgtctaaaaaattgctagtgtaattagctagctaacaaatagttgctaattattagataatttgctaaaagtaactaatagtcgaattattagttagtntgtttgaatgtctttagctaattttaagaactaattattagcttattacatttaaacaccttctaaatgcatgtgcagctccttagcttgtcaaagaccgtcacttaaatccacgaactttcaaaatgcacttgtgtgccacttacatgtcggcgtaccggtgcataccgtngccagatgatgagctagcgcctgcgattccgta

SEQ ID NO: 11269 - DNA, 1403 bp, Zea mays
ccggtccggaattcccgggtcgacccacgcgtccgctcacctcgcctgtgtccggtagccacgaacgatgttccgccgcgcgctcctctcctccgtctccccactccacggaacggtacgaatcccgagccccagctattctcctatccaagcccttctcgctcaatggagcaggtacgcctccgtggtctcatcctcggccccgccgccgccgccgccccctccatctccgcctcaaggtccatcgaggtcgagcggtggaggtcccacttcctcgtcgctgaaccctgcagaggtcgccaagttcgcctccatcgccgagacctggtgggattctagtggcccattcaaacctttgcatgtgatgaatccaacccgactgtcttttatccgctccactctctgtagacatttcaggagggatccaaattcatctaagccacttgaaggtctcaaagttattgatgttggatgtggaggtggcatttctgtcaggagcctcttgctcgaatgggtgctacggttactgcaattgatgctgttgacaagaatataaagattgcaagtattcatgcggcatctgatccaacaactgcttctattgagtattgttgtgcaacagctgagggactggtaaaagagaaaaggctgtttgatgctgtaatttctcttgaggtgattgagcatgtcgccaatcctttggagttctgtgaatccctctcggctttgacaattcctaatggtgccactgtgatttccacaatcaaccgatcaatgcgagcatatgccactgcaatagttgctgctgaatatatcctcagatggcttcctagaggcacacatgagtggtccaaactggttaccccggaggagcttgtcctaatgctgcaaaaggcttccgtctccgtcgaagagatggcagggttcgtttacaatccgttgagcggagaatggtccctgtcagatgatatcagtgtgaactacattgcttttggcgtcaagaagggcgaggcatcattgacaaatgacagagaagcaagtttatcatagcgaagaaaaacacgtgaccttgaattgtcgggcatcattttcagaggaccaattcatgtcactgaaatctattgctaagtatgcaaccaagtagcagaagagaattctcttgccctttgttagtcttggaaactggagcttgtggagtgatgcttcctggaagcgccattgagaagtcaagttgacaacaagtgactgctaacaagtagagctatctgccttttttgggtaatgtttcaggcagtttttctcaattttgtggcagtcactgatctaaataaaaatactactacactgctgtacgtgaaaactgaacagatttgctgtctggaaatgtaacttttttaacagtt

SEQ ID NO: 11270 - DNA, 706 bp, Zea mays
tgggaccctcgaggccggccgggcctggatacaaaaccaaagcaaggcaagtctagtcttgcttcgccgaattccaaaccctagcctcgcctgttgcggccgcggcggagatggcgaagtctctgcgatccaagcgcgagaagcggctgcggacattgcgccgggagatagcggagcccttctacgacaagaaggaggccgccaagctcaccgcgcaggccgccgcccttgctgctcccccgctccaggtccgcggccccccgccgtcccaggatgccggcagctcccgcggcgctagctcagcctcggctatggatgtggagatgtccgatgaaggaaacaacaggtctaaaaccttcttgaagccacttggcatcattagcaagaagaaggtacagcttcatttgaagatcaagaaagacaagagaaaagctaggaagaaggggaagttttcttttaaaaagtagacgcgtaaagcctgtagtcttataaatcatgtagttctgtttccagtttgaacaacaaatctaaaggcagtcatgcgcacctaagtccattcatggctagcttactatgtcgaaatgagtatggaaaagatggcgctgacctatcagttgtgttcatcttcacatggtatcgttgtgaactatttccttcacgccattttatgactgcataaaaaaaaaaaaaaaaggcccctagggcc

SEQ ID NO: 11271 - DNA, 2914 bp, Zea mays
cgtgtctccgcccaccgtgccctcggtcacctcccccgctcacgggatgggatgggagccaccggcaagacggtcgtggccaacaacaagtgggcgcgcactatagtcagccacacgcccacacagatcttctagaagacatgttggaatcctgcatgcatggttagtcgatccactcatcatccaacaataaatggctgacacattttagagcttcttcgcttctatccaattcatatggattaacgaggattgagaggttttaatttctagtaaatccaattttctcccaatcaataccaatcctttccaatatatattgaattgaaaaaaaaactcgtggaggcttctgcgactgtgcctctagctacgtatttataaaagactccacccgctcagccgttgattgtggaacgaaggatttagatttaacttatgcatttccatggtggtggcgaactggtggcgcgcggcggtcaacctaacaaacttgcgcgcggcggtcaaccaaacaaacatgcgcgcatggtcagatcgacctgcaattaatttgtccgtacgtgatcttgttcgttgtattggcctctaataatgtccctgagagtcaactgccccaaatcagacagtagtcgtcgtcgtcgtcgattcctaattaggtcaacaaaagctgcaccgaccttttgcgatactagtctcaatcatttaattttaacctggtctaaaatcatatgggccgggtgcatatatactagctagctctatgtgtgctgtgccaggttaagagacctatacatacatgctacagttagcgttacagtttagcagagggtgacgacggcggcgttacagttcagcatggagacgacgatgttgcaggttctccctgctctagctagaacgtaggtaggactagtatgtagctagcactgcttgccatgcatgtgttgagtacgtagaaatatcgaaagattgcacgttaagattgcttagcttatgactaattccgatcaagagtcgtctaagactaagagtgtatattgtcaacaagcttgcttgtgggatgcctgcgttcagaggaaaaaagcgtgcagcagaacaggtcatctgctgatccattcattcatctcgatggtcgtcgatgcatgaatacagaaacagaaatgatcaatgagcaggccgggtctctttttggagctctagtcgtctgcccaagcaagctgcggggcatgcaggcgactcgtcttccttctctagctagaaattaaactggagcagctaggtagctatgggacatgcatatcctcatcctctagttgatcgattggcattttatctccaccacaacgttgccctgcatatgcgccatgtgctgtgctccacacacaaggccaaatggccccaaaagctccattcgtcggtctccactaggaacagtaccgggcccatatattgcatgtgcatcccatcaccacccccccaaatgcatccatgatccacacgcacacgcccattattctcgtcgtctctcgccgcagccacacatatccagtcaactacggccggctggctgcgccaagccgccaatcgctagctagctggtcctcttctcgatcgacatgctccataacttagtcaacgtactccatggccccatccccatatatacgtgcatgcaagccgaccggccccgcagtcgacgcgacgctcgacggcacggcagcagagaaagccaacagcatggctccaccaccatggccggtcgtagcgctgctgctctgcgccgcgctagcgttcgcggcgcggccgagctcggccgtggacccggtgggcacgtactgcgccaagaacttcacgggcgcgcagacgcaggcgagcatcgcccaggtcctggccgcgctggtcccgcgcgcctccgcggcctactacgccacggcgacggccgccggcggcggcggctcggccaccatctggggcctggcgcagtgccgcggcgacgtcccggcgtccgactgcgcgctctgcgtggcggcggcggcgcggcaggcggcggcgtcctgccggggccaggcggacgcgcgggtctggtacgactactgcttcctccgctacgacgacgccgacttcctgggcctgccggacaccgggtacgcgctcatcctcatcaacaccatgaacgccaccgacccggccgcgttcgaccgcgccgagcgcaggctcatggcgcgcgtcgctgccgacgccgccagcgccgggctggccagggagacggccaggttcggctccgacgggaccaccatctacggcctcggctggtgcaccagggacatcaccgccgccgactgcggcctctgcgtcgcgcaggccgtcgccgagctccccaactactgccgcttccgaaggggctgccgcgtgctctacagcagctgcatggctcgctacgagacctaccccttcttcttcccggtcaccggcgccggcgccggcgccggcgctgacgcctcctcctcccacgccggcgagtacgagactgtcgtcttgacgaaccacaaatagcagttccaactctcaagctagctagtagtgtacgattacgcttcctgtttgttaatcgcgcgcggtaaatcaatcgtgcaatagctatatgtcacctattatttgttgcacttatgatgataaatgtagagtaaataaatatggatgcttgcttgttgcatcgcatgcagaactgtactaatacaatatatatatagatgatggaaattgttgctgaaatttaatcaattaaatgcaagaatcttcaaatcttcatgtgcttcacaattacagcatggactagagatggacatagctgctctggcggtcaaactaattacagcatggatcggacgcgaaatgcgccctgcgctaccggaat

SEQ ID NO: 11272 - DNA, 1171 bp, Zea mays
cgccgtagggttcaacggacccatccaaatgcccgaaccccatcagcgcatcccttttcgcctgcctgcacacgccgccgccggcaatggccgcctgcgacgacgacgtcgccccgtcaaccgcctccgcctaccttgacccctcttactgggacgcgcggtttgggaaggaggagcactacgagtggttcaaggacttctcgcacttccgccacctcctcgcgccgctcctctccccgtccctctcggtcctcgaggtcgggtgcggcaactcgcggcttggcgaggatctcctgcgggagggcgtcgccggcggcatcacctgcgttgacctgtcccccgtcgccgtccagcggatgcgcgaccgcctcgccgctctaggcaccaaaggcgtggatgctgtggtggcggacatgcttgatctgccgtttgagcaagagagctttgatctcgtcattgaaaagggcaccatggatgtgttgtttgtggacagtggcgatccatgggaccccaatcctacaacagtggaaaacgtgatgaaaatgcttaatggtatccacagggttttgaagccagaaggcatctttgtatcaattgcctttggacagccacactttcgacgccgattttttgaagctcctgagttcacatggtctattgagtacagtacctttggcgacagcttccattatttcttctacactcttaagaagggcaagaggtcactggagtccagcagttaccaaaacacattaccatcacctgttgctccaagaataaatatggtccacgaagagctcgagagcgaggattttatattcctcacaaaccttgatgggttgtgagtggctgcttaaacaagcatctggctaacagcctaacacatcaaaagggtgaccaggccagcgttggtgaccctgcagtgatgtttttttcctgggcggcaaatgagaatgatgcctgtaaaatgtgtaatttaggatagatttaaattttgagctttgttgtctagtaatactataatactctatattactgcaggctagaggtctgtatgatcttgtaaaaattagtattactttccttttgaaatctaatgcttcgacttaacttaaaaaaaaaaaaagatgttatatgaaatccatagatgaaagtacttgttggtcattcc

SEQ ID NO: 11273 - DNA, 1819 bp, Zea mays
gaaaccaggaatactaatctaaactgtcctatttagaagttccattttgtctcagaaatagcgtttatctactgtaatattctttctagtattaacattttctttgttttttatttgaattggtagctgcaaatttatttcattgattttatttctgtttcttctttagtttgatgttgaaaaccatttgtactgactttcgtttcagatgaattcaaataaaaggcgaacaggggaaagcaactcattgttacctgacgtaccggacgcagagaacataagaactggacctgatagggattcagaggggagtgctgatttgcatcaggataatctacctaggggcaaacgtaagtgtcggaaacgcaggcgacttgagctcaaaggtaggagagtcagggatacaaggaagagatccagcattgattcttcctcagaagatgctgctgcccccttgtctgattccagtagtgacagaaatagtaatcccagggacgacgagagcaaagaagataattctgttgcccaagaaattggcggttacatagacgctaagggtgcagcttcaagtacataatattcaactggtggtatatgcatatgactagaactgaatcttgtggtgaattttcaagttggtcagtgttcgatggatttctttatccatctacaaatctaggaccaaaaagaaaaatgggtactgcagtccgcatcaccaccagtcctttgaaagagcaggaaatggaggagtttgtctaacaaatctgttatgttcaacaatggtgtatatattattagtcagaatttagccttgcgctattatgatagaattagttgcctggtaaacagtggtaacaatgttgttttgtttatttaatgtattgatggaccatcttatgtatgagtgaattaagtagacattttcgtgtcgagtatgataaattgttagattgctaggttaaataaatctgttcttgtttttgaccacttgtctattcgataaggcatgtaacctgtaatatgcaatccactagtattcaattgctgtggctcgttttcattcatctcgtttcaattcgtcagctccacaaattatgtgcatctttgattcaaaatataagttgtcttagaattcgtgtgtccactgattacaaattataagttgtattaggattcatgtgactccaattcctggatatcttggttccgttttattttagtgcgtcgtattctacgaaatctggttatagacatcgccagttcactcacacacgctgcatttacatgccacatatccgctctgtgtttgtgacctgtggcttgaaaatgcgcagccttgttacaagatctacctatataataagaaatcaggaggccagcctaatttcaccgttcgctttcaacgccggtcctcttgcgaatctcctgcctccaaatggagccgtcacagtccatttggcgtagcaacactgagagtatcctgcatgccatcgcctccatcgcatggccaactatttctgtcctctgcatgaaaggaagcatctccgctccgctgctcgatagggtgtcatacgcagtgtctccagcctaaagcgaagcctgttgcacatactatactcatagtttgttcactcaccgcgtgtcgcccatataccgaatatgatgaattgatgaccgcttgagatagacatccagcagatcagacacctaggtgacttaggtttattagttttggaacttgcacacgtgccaccaaaacatcttcaccttgagcttccacaaaaccttcgggccctcactaaggcctctgcaggcagca

SEQ ID NO: 11274 - DNA, 1911 bp, Zea mays
cattggggccggccggggggtctctgccctccacacctcgagagcccaccaaacccaaagcccaggcctctccgtccccaatcccccatccggcttgcccaccatgtcgtcgcagtgcccctactgccgcgcgtcggggccggcgcggtgcgcgacgacgcagccgccgctctcgcgcgccgtctccgagtgctccgcctgcgcccgaatcgtcctcgagcgccacctccacacgcaccccttcttccccctcctcccctcactccatccgctcccccttgtcacccccgacctcgccacagccatcgatcccgccccatctccttcccccggcgacgaagatgacgaggacccctttctccccgcgggcttcgtctccgccttctcggctttctccctcgagcgccaccccgtcctcgcccgctccgcctccaccttctccggacacctcgccgagctcgagcgcgcgctcgctgtcgactccgccaccgcggcctccaacccggaccccgccggccccatggtctccgtcgacagcctccgcgcctacctccagatcgtcgacgtcgcctccatactcaggctcgacagggacatagcggatcacgctttcgagctcttcaaggattgctcgtccgcgacttgcctcaggaatcggagcgtcgaggcgctcgcgaccgccgcgctcgtgcaggctatccgcgaggcgcagcaaccacggacgctgcaggaaatctctactgctagcaatcttcctcaaaaggagataggaaaatacatcaaaatactcggcgaatctctgaaactgagtcaaccacttaacagcaactcaatagctgttcatatgcccagattttgcagcttgctccagctgaataaatctgctcaggaacttgcagctcatattggtgaggtggttgttaataagtgcttctgcacacggcggaatcccataagtatatctgctgctgctatctaccttgcatgtcagcttgaagacaaacgcaaaactcaggcagagatctgtaaggttacgggcctcacggaggtcacactacgcaaagtgtacaaagaactgttggagaattgggatgatttgctcccccctgactatacgcctgccacaccaccagagaaagcttttcccatgaccaacatttactcagggcgctcagcgagtggcaaggatatgtatcaggataagatattcgagagcattaagcaaaaatgccctgagcctgcagagcctgaccacatggtcgtggtgaaagaagaggaagacttccgaacagctgctcttggccgtccgcctacaaaacttgaccatcctgagttgggcaaggtgttccggccaccaaatgcccctttctcaacatctcctaaatctgatcgtgacaaaacggaaactagcttacgtggattcaaccttaatgaggtatcatgtgcaatggactctgatagaacagacatcacagtgaaaccaacttttggtgatcgattgtcaaatgatcccaatgcgaatccatctcccaacaggcagcctttaccctggcagcttaagcaaggggcgcctgcaactgctccatcatattcaaggcttcgcgagcagcagtcgggcctggatcttgtagctgctctgaagggggttgggaaaaggagtcctggggatagtgatgtccgggataaagaagggaagtgaatagttggtgccttgtagatggggaacgactcttaagtgttaaatttgcaactatggtcggatcacgatccaaaggcccagaggactcgcacacctaagtcttgtctgtagtagagttagtttagccacctctatggctctatcactctgtatttcttttgcctcaggccggggctgtgaaatgtcatttcaggcgcattagcttctgtagt

SEQ ID NO: 11275 - DNA, 671 bp, Zea mays
gaatcctcgggctgtccgctgtccccttcccgcgtcgaaaccctagctcgtcacctcgccgccgtgctgtccgctgtcctagtccgcggctccgcgccccatctctcttgccgtcgcatctgatgttcttctcccgcaacgcattccgcgacctggaccccatcgactcgccggcctccatggcgtcctcgaagaaggttgcgacccgtgacgagtgggagcggaagcttcgcgacgtcaagatacgcaaggaggacatgaaccgcctcgtcatgaacttcctcgtcactgagggcttcgtcgacgccgccgacaagttccgcatcgagtccggcacccagccggagattgacctagcgatcatcgcggatcgaatggaggttaagagagcagtacagtcgggtaatgttcaggaagcgatcgagaagatcaacgatcttaaccccacggttcgattctgtctatgttcctagcaaaattagttcgaataacggccgagacgtactttgttgtggaagatctccaagtaggttgtggttgctgggttgtacagatctggttttcatcctcctgtaagtctgaaatagatgtggtcaagtagagaagcactcagttctgcaatgtggttaacttggatgtactgtcaccacgtttgtctttgtcagccattt

SEQ ID NO: 11276 - DNA, 1413 bp, Zea mays
cccacgcgtccgcggacgcgtgggtgcagttggatactgttgcaggtaacaactactcttctccggactctcggggtttcccgacgtccaccacccatcctcgcttctctcgagtcctcaatccatcctccggctgttccctcccagcgacgaaaccctagcccgtcacctcgacgcctagcccgccaccttgccgcccgtcgctgcaggtttatggcgcctgtgtgatcggatcagcagtccgctccgtctccctcggcccacgcatctgatgttcctctcccgcatcgtactccgcgacctggattccatcgactctccggcctccatggcgtcctcgaagaaggttgtgacccgtgacgagtgggagctgaagctccgcgacgtcaagatccgcaaggaggacatgaaccgcctcgtcatgaacttcctcgtcaccgagggcttcgtcgacgccgccgacaagtttcgcatcgagtccggcacccagccggagattgacctagcgaccatcactgatcgaatggaggttaagagagcagtacagtcgggtaatgttcaggaggcgatcgagaaaatcaacgaccttaaccccacgattttggacacgaatccccaactatactttcatctccagcaacagaaactaatagagttgattcgcgtgggaaaaataaatgaagctttggagttcgctcaagaagaacttgcaccgagaggcgaagaaaatcaaacatttctcgaggaaatagaaaaaactgtagcactactggtttttgaagatgtaaaaaattgcccttatggggaactattggatgtttctcaacgtttgaagactgcaagtgaagttaatgctgctattcttacaagccaaagccatgagaaagatccgaagcttccaagcttgttaaagatgttgaaatggacccaaaatcaactggacgaaaaggcggcttatcctcgaatcaacgatttcaccactgccgcgctggaagatccatcgatatgaatctgctgtgaaggaactgagggtatgcaccaagcctgcctggtgcctacacgtggttgccccggatctgtcaatagatcatcgtctgcagcgattgagttcaccccttgcactagtgtttaagatcaatgcaagcaattgatccgaaaacatcacctgtgttctacctgtacatgatgtagaagacatgtttgaaacctttttaagttagtgaaatgttggatttttttcatggacatatattcgtttcaaacctgtggtacttgcaacacgcaaattgtttcagtcaaaaaaaaaaaaaaaaaaaaaaaaaaaagtcctactgtcaaaaaaaactctctctctctctctctctctctctctctctctctctctctctctctctctctctctctctctgtctc

SEQ ID NO: 11277 - DNA, 935 bp, Zea mays
agatctctagcactagctttgatcctttccgccgccaactttggcttgggatttgtctctgacttgggacactcgctgaagagagtacatctccgacttgggatttgtcttacgaccagcagcggcggcggcggaatcttcaccggcgcgccaggacaaggagcagcgggactacagactcatcgcaaaagccgtggacgaagcgtaccgggcggtggagtgcgacggcggcgggtaccccttcggcgcggtcgtcgtccacggcggcggcgacgacgaggtggtcagcagcagccacaactcggtccggaaggacgccgacccgtcggcgcacgccgaagtgaccgccatcagacaggcgtgcaagaagctggggaaaaccagcctcgccggctgcgagatctacacgtcctgcgagccgtgcccgatgtgcctggggctcattcgcctggccaagataaagaaggtggtgtacggagccaagtcggaggtcgccgctgccgccgggctcaacggcgtcctcccagaggtcttcagagagtactaccagaaatccggcgtggagatgaggcaggccgagggcgaggcggcaacccggatcgccgaggaggtgttcgagaagaccaagggcaagtttcgcaacaagtaaacgcgctggagatggcgccgggcggatggctgttgcctgttgctagtggaatggttgccgtttccaagctttttgtccgggggacctttgatcagaggtcacatgcccagagaccggaataaattcacccctttccccccctaaaaaatactccatttcacatggtttgttgtatcagtgtgttatttctttttttaacgcccgcctcgaccgtgtgacattttttttcttaataatgtagggtgttacttgttgggaacataattaggtgtaaaaaaaactcttc

SEQ ID NO: 11278 - DNA, 854 bp, Zea mays
gcactagactggtcggagatatgtagcgaccccggcctcccccggccgcgccgcgccctcaccatcttcaccggcggcgcgccaggacaaggagcagcgggactacagactcatcgcaaaagccgtggacgaagcgtaccgggcggtggagtgcgacggcggcgggtaccccttcggcgcggtcgtcgtccacggcggcggcgacgacgaggtggtcagcagcagccacaactcggtccggaaggacgccgacccgtcggcgcacgccgaagtgaccgccatcagacaggcgtgcaagaagctggggaaaaccagcctcgccggctgcgagatctacacgtcctgcgagccgtgcccgatgtgcctggggctcattcgcctggccaagataaagaaggtggtgtacggagccaagtcggaggtcgccgctgccgccgggctcaacggcgtcctcccagaggtcttcagagagtactaccagaaatccggcgtggagatgaggcaggccgagggcgaggcggcaacccggatcgccgaggaggtgttccagaagaccaagggcaagtttcgcaacaagtaaacgcgctggagatggcgcccggcggaccgcggatggctgttgctagtggaatgattgccgtttccaagcttttgtccgggggaccgttgatcagaggtcacatgtccagagaccggaataaattccgccccccccccccctactccatttcacatggtttgttgtatcagcgtgttattttttttaacgtccgcctcgacctgtgacattttttttcttaataatgtacggtgctactctatctgtctccgaataaataaataaatagatttgt

SEQ ID NO: 11279 - DNA, 1122 bp, Zea mays
atttttaacacaaggagcactagactggccggcctttccgggatgtagcgaccccagcctcacgcggtcacgcctcaccatcttcaccggcagcgcaccacgccgccgccgccgccgtcccacgcattgtctgttgctcagcttctcctagcccagctcctgctagctaggctaggcctaggctgctacatactgccatcatccatggagtcgcctcctgatcaggcggcggcggcggcggcgcgccaggacaaggagcagcgggactacagactcatcgcaaaagccgtggacgaagcgtaccgggcggtggagtgcgacggcggcgggtaccccttcggcgcggtcgtcgtccacggcggcggcgacgacgaggtggtcagcagcagccacaactcggtccggaaggacgccgacccgtcggcgcacgccgaagtgaccgccatcagacaggcgtgcaagaagctggggaaaaccagcctcgccggctgcgagatctacacgtcctgcgagccgtgcccgatgtgcctggggctcattcgcctggccaagataaagaaggtggtgtacggcgccaagtcggaggtcgccgctgccgccgggctcaacggcgtcctcccagaggtcttcagagagtactaccagaaatccggcgtggagatgaggcaggccgagggcgaggcggcaacccggatcgccgaggaggtgttcgagaagaccaagggcaagtttcgcaacaagtaaacgcgctggagatggcgccgggcggatggctgttgctgttgctagtggaatggttgccgtttccaagctttttgtccgggggaccgttgatcagaggtcacatgcgcagagaccggaataaattcatcccttttttcccctaaaggcttgttcgtttgtaccggatttatgggttggaacgattcctaatcggattgcttctctaatttatataaactttgattagctggaacaattccgggtgcaatccgacgcaaacgaacaaagcctaaaaaatactccatttcacatggtttgttgtatcagtgtgttatttctttttttaacgcccgcctcgacctgtgacatttttttcttaataatgcacggtgctactct

SEQ ID NO: 11280 - DNA, 1281 bp, Zea mays
ctacgaccagatcaaagtcctgaggatttgcaacgttggaagccggctcccggacgcgcaactgcgcggacttttcctgcaagcttcttctgcaaccgaagcaactcttcaatccagaagtggctgctccagggcggcatggcgccaaaagtctccagcccgttcctcctccgcctaccctgggtcgtcgcgcacgttggatccatcaaatcttccaatgcacgctgcgccggcccgggtcgtcacgcaagagagctcccttcttgctagcgagtagcgactagcgagaggtcgccggcgcggcaaaaatccgaaaggcgagccgagatggcggggtcgcagtcgcaggcgatgctggagaagatggagctgcggcagagctaccgcaacgtctggcacaccgacctcaccaacgccgtcgccgcggacctcccgtggtgctgcctgtctctgtggtgcggcccgtgcgtgtcctacatgctgcgcagacgcgcgctctacaatgacatgtcaaggtacgtgtgctgcgccgggtacatgccgtgcagcggcaagtgcggcgagagccagtgcccggaagtatgccttgcaaccgaggtgttctgctgcttcggcaactcggtagcttcaacccggttcctgctgcaggacgagttcaacatccagacaacgcagtgcgacaactgcatcatcgccttcatgttcttcctgcagcagctggcctgcatctgctccctggtcgcctgcatcgtcggcaacagcgagctctcggaggccgcgcacgtcatctcctgcatgtcgaatctggtctactggacggtttgctcgtgcatgcagacgcagcacaaggtggagatggacaagagggacggcacgttgaacaccatgtctgcgcctccgatgcagcagatgtcgcgttggtaggtgcgagtgagattatgtgccgacctcgatacggaggagggtagctgctggagctggaggctatcagcaatctcctactctggttaggacggtccatttttcagatttgggtgagataccatggctagtgtgtaaaccatgtcccgtttgtttgggcaaattttcgtgtttaatgagttgtgcatttttcacaacttctgttatacctcttacggctagatgccgaaattagatatcctaataatttattttaattgactacaaaaaaaaaaaaaaaaaaattttatttagaaatgagacgagagcaacgagtgtagaggctcaacttatcctccgggtgctttgtgcctattgagt

SEQ ID NO: 11281 - DNA, 2313 bp, Zea mays
ggggaactttccatcatattttttgttatcttatagcatgacacatcaccatgtttatcctaccactataaaggcgcacaaagcttccaaagcgaagaagctcttgaggagatactgtaacgaaacatggctcctctgactcctagactggtagtgcccatagacgtgaagaagcagccatgggagcagaaggttcctctccacaaccgctggcatccagacatccctcccgttgctgatgtaaccgaaggggaactgttccgggtcgagatggtagactggactggagggagggttagagatgacaactctgcagacgacatcaaatccctggacctcacaatcactcattatcttagtgggcccctaagaatcgttgattccgaaggggttccggcttcaccaggcgatcttctcgcggtggaaatctgcaaccttggcccgcttcctggcgacgagtggggctacactgcgatatttgagagagagaacggaggtgggttcctaactgaccacttccctactgcgaggaaggccatctggtatttcgaaggaatctatgcgtactcccctcagataccaggtgttcgtttcccaggattaacccatcctggtattgtgggaactgcaccgtcagccgaacttcttaatatatggaacgagagggagaaaagattggccgagacaagcccacagacccttaaactgtgtgaagtgctgcaccagaggccccttgccaatttaccgacccctgagaactgcttacttggaaagattcaggaggggactgctggatggcacaaagtggcgaatgaagcagccaggactattccgggaagggagaatggcggtaattgtgacataaaaaacctaagcagaggttccaaagtttatctgccagtatttgtcgaaggagcgaatcttagcaccggtgatatgcacttctcccagggcgatggtgaagtttcgttttgtggagcaattgaaatgagtggattccttgagctcaagtgcgagatcataagaggcgggatgaaggaatacttgaccccagttggtccgacaccgctacacgtgaaccctatctttgagatcggtcctgtcgagccacgcttctcggagtggctagtgtttgagggcataagcgtggatgaatctgggaagcagcatttccttgatgcgtcagttgcttacaagcgtgcagtcctgaacgccattgagtacattgctagatttgggtactcaaaggagcaggtgtatctcttactatcatgctgtccctgtgagggtaggatctctggaatagttgactctcctaatgcagtggcaactattgccatccctacagcaatatttgatcaggatataaagccaaaacacctgagaggaagaccgggaccaaagttgataaggcttccagatctcctgagctgttcaaacaatgggcatattcctgtcacccaagaccaaagtggtacaagggcgtcctaggggcgtatatgatctggaagctgatgccgtatccttctacttatacacacaaataatcgtgttggtgtttccaacaatgtatgaggatagagacacctgagtggtgccatattttcagtgcctgtattgctacaaagttgttcattaatttcactctatagaaaatttcttatttggggtcgagtatgtaactagcagtgaagtgaggatgagataatatgaaagaaccaggcagctggtagtggctggagcgaagttgcagttgtgacagattcactctacctgcacacaagaaaccaacacacactgttgatccagttctagcatactatagacagatgctggttggattcatgaaatagcctccggagctgaaggaagtcctaaagagggtgaagaaatgagtttgacaaacgatgctggttgtagccttagggtgatgttagaggaccatatatgagcggtggatatttgatggaatgggcattgtggagttgtggttcagtcaatctgtaccattgtcaattgcccttccttcactaccagccagatcaccaatgtttggaagctgaacacacgaacttcatgacatttaaaaagttaataagatgaagcgactttatgacattttaaaaggttaataagttgaggcgactttgtataacccaaataaagtggtgagaaataagaaaagaaaatgaaaataattaaagaggctagagtactactccctccgttccatataactcgttttgagctttttacaccaaaatttaattagtttgtcttattaaaaaattcacaattactccttctgtcccc

SEQ ID NO: 11282 - DNA, 791 bp, Zea mays
  misc_feature (768)..(768): n is a, c, g, or t
gactaaacaaactaaaccatatttctcaaaccctagattcggatccgccatcaacaggctccgccatcaacaggctcgaacgccctctcctcaaaccctaccagatcttgtcgttcggcgcctcaaaccccagattcggatccgccatcaccatagaggtgggggcagacggcatagcgctcatcaccatcgccaacctgcccgtggtggatgcgccatcgcctgaggcgagccgcggggaaatgagggatccttggaggcagagctggcgtcgcgtcgccggtggacgctggtgctggtgaacatggcgtcgatgctggaaaagatagacgagatgttgctgctcgccgtgtacaagaaggtgtgcacgtcgctgggcgcttctcgacggcgctgggctcccaaaccctttgtcgcgcgctcgttcaagccgcctactacctactcaaagcctacgcctccgcgcgtcatgatcgggcccgtgtcgtcgctgtcggagccttcacctgggccaccatcgccttcctcgtcgccatctccggcagcttcctctaggaaggccatctggtatttcgaaggaatctatgcgtactcccctcagataccaggtggtcgtttcccaggattaaccccctcctgtagtggggcgaaccgcaccgtcagccaaacttcttaatgtatgggatgagagggagaaaagattggccgagacaagcccacagacccttaaaactggttggagtgctacaccagaggccccttgcccanttaccgaccccctgagactgctt

SEQ ID NO: 11283 - DNA, 643 bp, Zea mays
cccagttggtccgacaccgctacacgtgagccctatctttgagatcggttcagctacgtaggcccccccccccccgctagtgtttgagggcataagcgtggatgaatctgggaagcagcatttccttgatgcgtcagttgcttacaagcgtgcagtcctgaacgccattgagtacattgctagatttgggtactcgaaggagcaggtgtatctcttactatcatgctgtccctgtgagggtaggatctctggaatagttgactctcctaatgcagtggcaactcttgccatccctacagcaatatttgatcaggatataaagccaaaacacctgagaggaagaccgggaccaaagttgataaggcttccagatctcctgagctgttcaaacaatgggcatattcctgtcacccaagaccaaagtggtacaagggcgtcctaggggcgtatatgatctggaagctgatgccgtatccttctacctatacacacaaataatcgtgttggtgtttccaacaatgtagatcttttatttgttgggcagtcatcatgtatgaggaatagagacacctgagtggtgccatattttcagtgcctgtattgctacaaagttgttcattaaaaaaaaaaaaaaaaaatttcc

SEQ ID NO: 11284 - DNA, 940 bp, Zea mays
  misc_feature (940)..(940): n is a, c, g, or t
tcggccgggatttctaaaccctagattcgcccccccccaacagcccccccctcaacaggctcgaacgccctctcctcaaaccctaccagatcttgtcgttcggcgcctcaaaccccagattcggatccgccatcaccatagaggtgggggcagacggcatagcgctcatcaccatcgccaacctgcccgtggtggatgcgccatcgcctgaggcgagccgcggggaaatgagggatccttggaggcagagctggcgtcgcgtcgccggtggacgctggtgctggtgaacatggcgtcgatgctggaaaagatagacgagatgttgctgctcgccgtgtacaataaggtgtgcacgtcgctgggcgcttctcgacggcgctgggctcccaaaccctttgtcgcgcgctcgttcaagccgcctactacctactcaaagcctacgcctccgcgcgtcatgatcgggcccgtgtcgtcgctgtcggagccttcacctgggccaccatcgccttcctcgtcgccatctccggcagcttcctctaggaaggccatctggtatttcgaaggaatctatgcgtactcccctcagataccaggtgttcgtttcccaggattaacccatcctggtatagtgggaactgcaccgtcagccaaacttcttaatgtatggaatgagagggagaaaagattggccgagacaagcccacagacccttaaactgtttgaagtgctacaccagaggccccttgccaatttaccgacccctgagaactgcttacttggaaagattcaggaggggactgctggatggcacaaagtggcgaatgaagcagccacgacagcaccgggaatcgaggctggtggtaattgtgacataaaaaacctaagcagaggttccaaagtttatctgccagtatttgtcgaaggagcgaatcttagcagn

SEQ ID NO: 11285 - DNA, 1752 bp, Zea mays
gcacgagagaacacctcttagaacacgaaacgtgaaggagacagaggaggaggaggaggatcaatctgccccgttcttggctgcgaggcgatctttgtgccacccaccagcgcgcgaggggcttcattcacctgatcctcgcttcttcttcttccgtcccactggttcgcgttgattgcatttggaggagggggcagtcaagatgaggcttcggctcctggcctgctgctacaatgatccggagatgcggatcgatccggacaccgtctaccccatccgccccgactgccgcgacgacgcccccaagacgcgcttcaagccccggcctggcctgacccttagtccaaagagatggaagcttctccacaacgaggaaggctgcgtggacatagctggaatgatcaagagagtgcaacgtgggggagtccacccaacaatcaaaggagaagtttgggaatttttgctgggctgctatgaccctaaaagcactaccgaacagtgcaaccaattgcgacagcagcgaaggttagagtacgagcaactgaaagctaagtgccgagaaatggacacagctgttggtagtggaagggtaatcactatgcctgtagtaacagaagatggtcaacctatcgaaaaccctaacggaggggcatcaggttctgagcagaaaaatagtggggcaccactcccgaaagaagttattgattggaagcttaccctacaccagattggtctcgatgttaaccgtactgatcgtttgcttgtttattatgagagacaagagaacttggcaaggttgtgggacattcttgcagtgtattcatggattgataaagacatagggtattgtcagggaatgagtgatctttgttcaccaatatcaatcattctggaaaatgaagcagatgctttttggtgctttgagcgtctaatgcgcagggtgcgaggaaatttcaaaagtacttctacttccattggagttcgagctcaactaactaccttgtctaccataatgaaatctgttgacccaaagctgcatgaacatttagaaaatcttgatggaggggaatacttatttgccttccgaatgctgatggttcttttccgtagggaattctcatttgttgatacgatgtacctttgggaactcatgtggtctatggagtacaatcctaatctcttttcaatgttggagagtgacactggcacatccagcgcaagcacaaaggatgaaagtgttctaggacagtgtggaaagtttgagcggaaaaaattgcaagcagctaagaaagatgaccagatccctctatctgtctttgttgttgctagtgttcttgaggctagaaacaagaagttattgggtgaggcaaaaggtctagacgatgttgtcaagattttaaatgaaatcactggtagtctggatgcaaaaaaggcatgcagagaagcattgcagattcacgagaaatatcttaaaacggtaaaagcatcataaggacatgtacagcttcacttggatgggctatttatttattttttggactagagaagatataccacagaacttttgttatcctttgtttgtgtattgtgtaattctgacacatttgtaacattgcatttacacaaccaaaagaaaggacgaggatttcattcaaaaataaaaaaaaagaaggggaaaaaggatgctgatcttgtaaagacgcgagacaaaatgtttataccataataacgtcatcatgattcttttctgtt

SEQ ID NO: 11286 - DNA, 4381 bp, Zea mays
gtgtgcggaagtgctacgagtcgtgtcgtgctcgtgcttagtaacgactcatttagcattgtccacttgcacacgtatagttcaacataaataacatttgcacatgcaacgagcgatagctttggagcaactcatcatttcttatgttttgcatccttgactatgaacctcatgcaaataaaagagaaaaatgaccaatgtggatttccatataatgtaccgatgggcaagtaaataaaggtagtgagacatgaaatatatttttggtgaggttgcagtcatactctatattctcttatttttattgtcaaaatgaataatatttctttatatatatatatatatatatatatatatatatatatatatatatatatatatatatatatatatatgcgcgcataaacattctaaaatatagtgagatctagtagggttcaagctcctcccctaccgtcggccagtagactacctataccattttctatttcaaactctactctataaatagagcaatttacagtataaaacaatattttgcatgaccatttacacgacctttcagagatgatctaaggagataaaagatttgcatgagcacaagaagagggaataggagaagaacgaagaatatgagtatttggtgtacataggtctgaagcaagatgaatggagaagggtgaatggaagcatgccaggtgcatatgagtatttggtatacatgatgtatatatatattaaattattgtcatccaacttagaactatattgttccattcctctcctttattgcatagagaaggatgcggatggtcggggtgttatttataaaataaacggagcaaaaaacggtgggtgatggacgaccacgatttaatattggcaccatacacacgaaaggcttatgtgcatatgagatgttcttatgaagaagagcccaagggttgcttcttatgtccacccaatataatttttacattcatttttatggtcaatataaaagaacacccacaatttataaaaaaatagaaacataaggactatgtgagagcacgtggaaggtctaggtgattccaaaatatcctctaatgtttataaatgtcgtatttctagctttttcctaagtcaactatgcaattttctatcgtgaattcctataaactcgtattgtttaacaacgtccgaattatatattacgaaaatattttttgagtaactcaaacgtaaatcttatataatggtgaattttacaaattccgacaaaattgatagtccgtattggacaaaactaaatcaacaatctattagaaagaaatggagcgagtattagaaagccgtctggaacttatcctcccgcgtgcaagtcgatctttgactttaagcatgagatttgccacttgccagcagcgctccttgtataaataccacgcaaggcgctcgctcgacctccaccattcgaaagatccctccaggaaagatttttcttccctcctccgacgccccagcccaccaacacactctataaagcagccctcagtcacacacagaacgcacaagcgcaagccgggcaagaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggttagtcgccgtaggcaactactactactcatgcgggcagcgtgttcgtccttcgttctggatccgcccccttgttcacaagctgctaatgattcgaacggaacgaccatgcatgccttgtgtgcaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacggtaaggaataataataatagtcaagcatgcatgcgcggccaattatataatgttggaatgaatcgggtgctgagaattaatacgattgtttgcttctgttgttacgtttcagctgtcgtttgatgtgggcatcgtgacgatcttcggcggccggctggacgagcggcgcaaggcggagctgaggaagaattactccgtcgtggagaaggggtacaactccttccccaacagcctgccggggacgctccattacaaggcgatgcaggtgagcacacacgcgacacggcatttacacaacccatccaacgcattacacgtacggtacgtctcgggcaacggcagtacgtactgccctgcccctggcacgcacgcatgcatgtgacgaaatcgctggacaccgtaccgtacgtacaccgtaggcgcggcggcggctgcacggcgtgctgtgcgacatcatgcgggagcgtcgtggccaggcccaggcggcgggcaccggcctgctgggctgcctgatgcggtcccggggcgacgacggcgcgccgctcctgagcgacgagcagatcgccgacaacgtcatcggcgtgctgttcgcggcgcaggacacgacggccagcgcgctcacctggatcgtcaagtacctccacgaccaccccaagctgctcgaggccgtccgggcggagcaggcggcggtccgcgaggccaccggcggcgggaggcagccgctggcgtgggcgcacacgaagagcatggcgctaacgcatagggtacgagcgtgcgtgctgggaaacgcaaaactggctctttattatttttttcttgtggtttcatccgtacgtcgcccgtccaggtgattttggagagcttaaggatggcgagcatcatctcgttcacgttcagggaggccgtggccgacgtggagtacaaaggtacgcacgcacgtgcgcgcaccacgaagagtagctagaggagcaacgagagtgctttgcttaattctgactcggattatgccgtgtagggttccttatccccaaggggtggaaggtgatgccgctcttcaggaacatccaccacagcccggactacttccaggatccacacaagttcgacccttctagattccaggtacgttacgtacagaagcatgggcctcaccgccgttagttgctgtgggacgacgacgacgtgactgaccggacgttgcgtattatgcaggtggcgccgcgtccgagcacgttcctgccgtttgggcacggcgtgcacgcgtgccccgggaacgagctggccaagctcgagatgctcgtcctcatccaccacctggtcaccggctacaggtgcgtccatctcctctcagatcctctccatatattccccgcttgtcctatagcttgtggaccaggatgacacatggctggctgctgccgctctccatggggctccggctctctctctccgtgcatgctccaaatctcctcctgtctgtatgtatgcctgtatcgatcatgtatatactcctgtaccataatctgtggggtcctcgaaatgtacgtcttcactagccccgctgtgctctccttcctcctatatatactatatatatgatgagcatggcgatcgactgctataacgacggtttactgatcttacactgaggcactgattggcgtccctgcatgctttatttttaaatttgcaggtggcaaatcgttggatccagtgacgaggtcgagtacagcccgttccctgtgcccaagcacggcttgcctgtcagattatggagacaaaacaatccggtcgtcgacagaaaggggcgtgagaccgacgacgatgatgtggaggatattttagtttgactcttgagttaggcatgaatttaaccccaagctagctagagaagttttttttccctttgaaattcttctttgctcgccttcctcctggatcaaattacgttggaggacaagaaacggcagctttctctttcgttttctttgcctgcttcaccgcgacgataatggtgaaaatatgtaagctacgtggacatcaatgatccacagcatcgttgatatatataatatagagagaaaattctctgcacggtcaatgcagtttt

SEQ ID NO: 11287 - DNA, 1956 bp, Zea mays
catcggggggtacccggcgggccgcgaaaaattcgaaagatccctccaggaaagatttttcttccctcctccgacgccccagcccaccaacacactctataaagcagccctcagtcacacacagaacgcacaagcgcaagccgggcaagaaaactccgcaggccagtctgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgatgtgggcatcgtgacgatcttcggcggccggctggacgagcggcgcaaggcggagctgaggaagaattactccgtcgtggagaaggggtacaactccttccccaacagcctgccggggacgctccattacaaggcgatgcaggcgcggcggcggctgcacggcgtgctgtgcgacatcatgcgggagcgtcgtggccaggcccaggcgggcgcaccggcctgctgggctgcctgatgcggtcccggggcgacgacggcgcgccgctgctgagcgacgagcagatcgccgacaacgtcatcggcgtgctgttcgcggcgcaggacacgacggccagcgcgctcacctggatcgtcaagtacctccacgaccaccccaagctcctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaaggggtggaaggtgatgccgctcttcaggaacatccaccacagcccggactacttccaggatccacacaagttcgacccttctagattccaggtggcgccgcgtccgagcacgttcctgccgtttgggcacggcgtgcacgcgtgccccgggaacgagctggccaagctcgagatgctcgtcctcatccaccacctggtcaccggctacaggtggcaaatcgttggatccagtgacgaggtcgagtacagcccgttccctgtgcccaagcacggcttgcctgtcagattatggagacaaaacaatccggtcgacagaaaggggcgtgagaccgacgacgatcatgtggagaggatatttatttagtttgactcttgagttaggcatgaatttaaccccaagctagctagagaagttttttttcccctttgaaattcttctttgctcgcctcttcctcctggatcaaattgcgttggaggagaagaaacggcagctttctctctttcgttttctttgcctgcttcaccgctacgataatggtgaaaatatgtaagctacgtggacatcaatgatccacagcatcgttgatatatataatatatagagaaaattctctgcaaaaaaaaaaaaaaaaaaggccccta

SEQ ID NO: 11288 - DNA, 1823 bp, Zea mays
acaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgacgtgggcatcgtgacgatcttcggcggccggctggacgagtggcgcaaggcggagctgaggaagaattactccgtcgtggagaaggggtacaactccttccccaacagcctgccggggacgctccattacaaggcgatgcaggcgcggcggcggctgcacggcgtgctgtgcgacatcatgcgggagcgtcgtggccaggcccaggcgggcaccaccggcctgctgggctgcctgatgcggtcccggggcgacgacggcgcgccgctgctgagcgacgagcagatcgccgacaacgtcatcggcgtgctgttcgcggcgcaggacacgacggccagcgcgctcacctggatcgtcaagtacctccacgaccaccccaagctcctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaaggggtgggaaggtgatgcctctcttcaggaacatccaccacagccctgactacttccaggatccacacaagttcgacccttctagattccaggtggcgccgcgtccgagcacgttcctgccgtttgggcacggcgtgcacgcgtgccccgggaacgagctgggccaagctcgagatgctcgtcctcatccaccacctggtcaccggctacaggtggcaaatcgttggatccagtgacgaggtcgagtacagcccgttccctgtgcccaagcacggcttgcctgtcagattatggagacaaaacaatccggtcgtcgacagaaaggggcgtgagaccgacgacgatgatgtggaggatattttagtttgactcttgagttaggcatgaatttaaccccaagctagctagagaagttttttttccctttgaaattcttctttgctcgccttcctcctggatcaaattacgttggaggacaagaaacggcagctttctctttcgttttctttgcctgcttcaccgcgacgataatggtgaaaatatgtaagctacgtggacatcaatgatccacagcatcgttgatatatataatatagagagaaaattctctgctcgatcaatgcagatatatccggt

SEQ ID NO: 11289 - DNA, 1092 bp, Zea mays
attcccgagccgacccacgcctccagcatcatctcgttcacgttcagggaggccgtggccgacgtggagtacaaagggttccttatccccaaggggtggaaggtgatgcctctcttcaggaacatccaccacagccctgactacttccaggatccacacaagttcgacccttctagattccaggtggcgccgcgtccgagcacgttcctgccgtttgggcacggcgtgcacgcgtgccccgggaacgagctggccaagctcgagatgctcgtcctcatccaccacctggtcaccggctacaggtgcgtccatctcctctcagatcctctccatatattccccgcttgtcctatagcttgtggaccaggatgacacatggctggctgctgccgctctccatggggctccggctctgatctctctccgtgcatgctccaaatctcctcctgtctgtatgtatgcctgtatcgatcatgtatatactcctgtaccataatctgtggggtcctcgaaatgtacgtcttcactagccccgctgtgctctccctcctatataaactgtggtgatcgactgctataacgacagtttactgatcttacactgagacactgattggcgtctctgcatgctttatttttaaatttgcaggtggcaaatcgttggatccagtgacgaggtcgagtacagcccgttccctgtgcccaagcacggcttgcctgtcagattatggagacaaaacaatccggtcgacagaaaggggcgtgagaccgacgacgatcatgtggagaggatatttatttagtttgactcttgagttaggcatgaatttaaccccaagctagctagagaagttttttttcccctttgaaattcttctttgctcgcctcttcctcctggatcaaattgcgttggaggagaagaaacggcagctttctctctttcgttttctttgcctgcttcaccgctacgataatggtgaaaatatgtaagctacgtggacatcaatgatccacagcatcgttgatatatataatatatagagaaaattctctgcaaaaaaaaaaaaaaaatatcccggcccttatttccc

SEQ ID NO: 11290 - DNA, 1754 bp, Zea mays
gagcctcacttctccctctgccccacgcaaagcacccaaggcgcccacggccccaccgcctcggcacctcccgctcaaaatcctcgccgcgccgcgcggagcgccgtagtgcccgagctcgcatgaagcgtgcctcctcgcgcccgcagccatgggagctcagcagagcgtcaacgcagggaaagccaaggtggatatgaaagtcgatctcacccacatgctgtgcgaggcgctgctgctgccgcccctcagaagctctggcgtcacgttatcacaaatcgttgaaggatctctctcaaacatccaaacctctttgggagaagtgagaagttggatgtgatattggataaaggaatcaacgactccaattttgtcattgcctatagacgccctagggctgaccggttatcacagcaatcatttgtatttcagcactcaatgacaccagaagttgccgtccatggattcccagctgataacttcacacgatcagggagcagagggataaaccttagtcgactgtcatttggtttggagcttaacgaaccagctacatcaaactggacatcgggaaccagtgttaaatttgaggcgggcctcaaacttaatttcaattgattattaatatccgtcctgttaataatcagggccactctattgccagagaccatgatggttttcctctgacatgcagtggcaacctccatgacaacatgatcatcttgaagcaagaatctggttatgcagatgtcaatgacaatagcttcttaaaagttaacttccaaatggaacagggattgccacttgtacctaagtcattgaccttcaatagagttaaatgtgcagtttcaaaaggcattaagttgggtccgacatttttggttactagtttgacaggcggatccattgttggggacatggcaccttatcaagcttttgccataggtggacttggtagtgtccgaggctatggtgagggcgctgttggttcaggaagactatgtctaattgctaactgcgaatatacgattcccttggtgaagcatctggagggttctattttcatggactgtgggagtgacttagggtctgctcgtcatgtccctggtaatccagctctgcggcaggggaaaccaggatttggtattggatttggatacggacttcacttcaacactgacctaggtcagatccgtgtcgactacgctatgaatgcatttaaccgcaaaaccatctattttggaatcaacagtagcggtggctcttaggttatgaaagacatagctctcacttaacatagactggcaattcaattcgattcttttccgtggacatagaaggggagttctttttcttgacagtgtgttccggacatgccagcagaatcttattgtttgtactacgtgctggcattcaaaaggtgtatagttgggatccacaagatgcattcttcttattatttattgttatgatctttttttgggggtgtgggtagatgctgaacaaatgtttttgctgagaagatggtatgtgtaggagtaggactgctccaaatatacttccactgctttatagcttaatttcattaggtttgcaaaatatataccaatggatgttcatggtcaatgtaacttcgttagatgctaaatattttttaagttagacgctgagcaaacattttgcctgtatgataatgtgagaactgctcactgacgcttccattacatcacaacttcattactatggtcgatgtc

SEQ ID NO: 11291 - DNA, 1863 bp, Zea mays
ctacagattctaagaaaaatttgagtgagaacagcagttcggaccggattctagatgagagtttctcaaaacagaatggagaacattctcggtcaagtctgagtagtatggtgtcatttagtggagcatctgccacagaacccgttgttccagggagtggcacatcggaaaattacgtggaagatcttacaggcgttagagatcgtcctgttgcaacactaaattctggggaagagctccaaaaggtctgtgatttactttatgagtttaaggatgaaatgttgggggcctccgcagcgaagtgtataaataagagcagcccgtcacttgaagccttgcttgctgaatcatctgattctgaagcgcaaatctctgatctggagggtactgacagtggtgctggcattggctccggtcgactgtttagtacactctcatcttcagatgacgatgatgcttctgctgcggacgagcctttagttgatgttgctgacctgactacgccaccagagcgatatacttctgtccccagcgacgagcctctggttgacatagctgacctgacaaacccttcagggatagatgcttcttcagtgaatgagcctccggctgatgtggttgatctgctacatacttcaaacgagcctttggtcagtttggatggtctgccaaaccatccagagatgtgttttggtgggagcagtggagaacataccgacagtcttatataaaggataaggccatgcggtactgatagttcaaagatgagcggaacatataagtccatgcggctgatgtgaacgacagtctcatataagtgtgttccaagttatgcataagtttttgtacataaataagtctttgtgtctgcatcagtttatactaaatactatgaaagcagagtaactttggttttggttgctgttctcccgtttgtgtaaatccattacaactaacactttgccgatataactttttactgttgctcgttctttttcaagttctgagcattgcaggagaaatcaaagttactacttaccagacgcgcctatattggtaccatttcagtttaaactgaagtcaccagacctgagttacaatcaagaatcaacccttcatctagaccagaccagacaagaactcatgatcatttaaccgctggccgctgacagtgacaggtgaagctcggaacatgctgtgttcttttactttcgatggaacacgccatgttccttccataagtaagcgaacagagtaacaggcggcgctctgttcacatgtgagcatgcctgccacctgctgcgcgcctgcgctccgtgtatagacgcacacgggctagccctgtctatggtcctggcgaagtcgtcccgccattaatacgagacacggcccggcccgcgcggcccattagtgggtccgactccgtcttcgctctgtctaggttcaaggaataggaatccgtggattcgcattcccgcgagatcacaaacataaagagacacatgagaaacaatagtggataaacttttctcttgttatttagtatgtgcctgattggatgcctgtatccggacgcgtaggctcaagatcaatctgatactgcaatttttgcgtacgagtggatgcaatcaaatgactataaaataacttgttttgcatccgctcatgcagcttgcgtctctcttgtgcaggccaccaaacaggagcttagacagagtcaatgcatacactgctccaagacgaaacagatggtatgagaaggtagatgcttatgatatacaaaagtagagccacttatggatatgtttgatattgtgcacttaaccatcgtatggtttcttaatattataccattttgtctcc

SEQ ID NO: 11292 - DNA, 3017 bp, Zea mays
  misc_feature (303)..(303): n is a, c, g, or t
  misc_feature (324)..(324): n is a, c, g, or t
cattgaggaaatctacatatttgctgatcctgttgagcccaccgatgatgtttcagtaagaggtcctgtaaacatgggaggtagttctttgctggcaatgcttgttcctggccttatgcaaatgtctaaatcaaggaatttgaaaatcgatgacagttatttttctgacggatcaaggaatcaagaaagcagcaaatgtgaaagctttacacaggaagcagggccatgtagcacaaatgattcaaaacatacgtctgcaggaatagaaaatggaatgaactctacagtcggtgtttcagcatntgatgataaaagcagccaagntgaattccatttcaaggacccagattctcttccactccctgtacaaacattagaaagtacacaagcgccttcagtgaagaaccagcatgaattaaacacaggttatcttgctaatcccatcatgagtgaaaaccttactccttctaatcatattgagagaaagctggacactctgctttcgaaggtagagaatatggaattattttgctctaggtttgaggacagcatgataaagccccttggtagcattgaggcaaggcttcagcgactggaggaacagtttagttcgttcgctgttgatattcagtctttgagagattattctgcatttaggtcagcaccagatggtatgcctaatacaaagagctcacaggaggaagcacataatgatgctaatgatagaagtacttctacatctgacaggaagccaggtttagttgtcagggcgccagatcttgtgtcagatgattcatgtggttgtaatgtgataaccaatggaagccgtgttaattgtcatgggcctaatgtggtgccaagactacttgtgaaggcccctgattttatttcccaacctgagttaacggatgaaaacctccatgacggacttgctctatctcctgaaaaggagtgtaagacttccccaggtttagttgtcaaggttcctgaactcccagatgatgatgatgatgatggagtcgaagataagaaacaggcagaagtttgtggtgatggtgatgatcacacaaggtctgatgatactctaaggaaaagcacagctggcaacaccaagagcaaaaaatctgtatctatcaatggcgcgttggcatccgcattggaggcattactcacttctaccataggaacatcatattcaaaacctgctatttgcgctaccagtaatttaagtgctgaaaatattaatggtttcttcagttgctccccttgtcctgaaaaaactggcgagatgtccactaaagatggttcagctgtccaaattctgggtacatctggtgatccaaattttggtcggtgccttcatatcttctcaggatattgatacagctccacataattctctctcaaaggaaatgttggatagcaaggttgagataaatgaacagaactgtgacatcaatacagaaaatgtggcatttgttgcaatcacagaaccattggatgttccctcgcaggctgatacagttgaggaatctattaatgatggaagttgggtgaatagacaaaactatggttctaatttgaatgcaatgccttatgccatgaacgttgaacctttggatcctcctaagcctcctacagtttctgaacctgttgatagtggagttcaggtgaatgaagatagaccttccatatccttggtggagtttcttgcagcaaggaatgctagctcttgtaagaatggtacttctgaggtatgccttggtaatgttgccgctgaaaaactgtcttttgagagaacatcggctggagctggtaaaaactcgaaaaatatcagtcagcttctagtgaagaaagctcttgaggttgatgcggacaagatattttttttgtttagtgtacccattgggccaaaatttgaaggatcaagcagtcccacccccagaactagtgggcacaatattaataatacagaagaagctgtctcagataaggaatgtggcgtgaaggataccaagaatggatttaggccctctttggggatggactctatattttctcagtaccatgctacagattctaagaaaaatttgagtgagaacagcagtttggaccggattctagatgagagtttctcaaaacagaatggagaacattctcggtcaagtctgagtaggatggtgtcatttagtggagcatctgccacagaacccgttgttccagggagtggcacatcggaaaattacgtggaagatcttacaggcgttagagatcgtcctgttgcaacactaaattctggggaagagctccaaaaggtctgtgatttactttatgagtttaaggatgaaatgttgggggcctccgcagcgaagtgtacaaataagagcagcccgtcacttgaagccttgcttgctgaatcatctgattctgaagcgcaaatctctgatctggagggtactgacagtggtgctggcattggctcaggtcgactgtttagtacactctcatcttcagatgacgatgatgcttctgctgctgacgagtctttagttgatgttgctgacctgactacgccaccagagccatatacttctgtccccagcgacgagcctctggttgacatggctgacctgacaaacccttcagggatagatgcttcttcagtgaatcagcctccggctgatgtggttgatctgctacatacttcaaacgagcctttggtcagtttggatgatctgccaaaccatccagagatgtcttttggtgggagcagtggagaacataccgacagtcttatataaaggataaggccatgcggtactgatagttcagagatgagcggaacatataaggccatgcggctgatgtgaagacagtctcatataagtgtgtcctgtgcagtgaataccgctttcttccaagttatgcataagtttttgtacataaataagtctttgtgtctgcatcagtttatactaaatcttatgaaagcagattaacttcggttttggcttgct

SEQ ID NO: 11293 - DNA, 3481 bp, Zea mays
ctctaatataggtatttgggtataatgacatgatttagagaacgttgttggagaggaagaaaatatagaggatgaaatcttttagaggagattgtaaaggatatatatagaggacgttgctagagacaatcttacaaccttttattatacttctttggatgaaaatgtcttacttaaactctttttaacttctttggatgaaaatgtgtttatgcagtagcaaaaaaaaagtaggaaactccaatatatatgtgaaaattttaatcttgatctaataagttccctatagaaacctccgaacagtccaactagattcatgaaagcctgattagattaattaacttaagttgttcgtctctagcgcgcatcatcacgtaaattttcttgtaacacaaataagaggacgacatggagggagagcagggaatctagcgctgtgtcattcgaaagaactccccagttttgctggcaaaaggcttccgtttcaacaaatgacgggcaacgtgccaacgccgtccagttgtggggtggctgcagcatcctgcggtcctgccaatgcaaggcgcgccccatgcaagtttaacgttgcaggcttgcgcatgtagacatgcagtagtggagctcaaattgtgtgatgctagcttgtacaatgctgcactagtttaaccgctagcggcgtgaggattatgcagctgactcacaatattatacagtattgattaattattttttttgcatagaaaaagggacctaattaatctcagaaaagaattatttttttttccttttcgtagtacagcagcttggaatcctatgccctttttttgtgcttctcctacagactatagtcttatgcatttaaagaatcacacaaagaaaaaaaataccttctatgccgtctgattcaaattgtaagtttttctgactttttttaaatacatagcgacgtatgtagacataatgtatgtctaaatacatagaaaaaactgtataactttagaaaaaactatattttataagaaaaatagataatgaaactaaatctgatcgagttgaagacaactcgaacctgggtgtggtcagtgacagccacacttcccagcccaacagtaaagctagctggctctataaaatgaccacctccgtatcgtatatcacctcaaaattcacagtagccagatccagcagaattgagtgacaggctcaaacacaagctagaagataggtgcttagtgagttaaccagtgggatgtcgctggaagatagtttgaagaagagggtggccaagtgccgcagggagtatgacattatttacaagcaggtaatcatcggctggttggtcacttaactaaaatctgcttcactatggttcattgaataatacgatttcaagagaacggcaaataagaactgagtgtactaaacctccataaacagctaccggtgctgctagagaagatggaaattctatttcctacggggaagaagatggagagctccgagccggaggtaggcaaatggtcatcatcttcttttcttttcttgttttttttttacttcccagcggtctgtgaaccagagaaacacacagaagagatgccctacgctgaaccatatatacgtaggcaactgagtgtaatctagtactaattcgtctctggatcttccttgcttctgaattctcgatcgtctcagaacaaatccgaagcaaagggggagccggtcgacccgctgcgagccatgacgccggcagaaataggggagcgctacaaggatctggcggacaccgtcaagggattcctcaaggatctggacgaggccgagaaggagatcgtcgcaggcacgagccaggcggcaacgccacctgcttcagtggaagaccagtaataatcaagagcagcagcagcacaaccgcacaaggagagggaggcctggatctgcatcaggagggtcatcatcccgtctaataataattactccgtattagtttcctttcgtcagtcatgtttcccagttggttaatcatctggatgttgggtgataatttagctgttctggtgtgttgtgattccgaccgagtcgagcaggtcgtagctagagcgtgtgttcgtcggctgtatgtatcgctttcgatccgtggaatcggtcggagtacactgcctgctatatggttgtttatgtttatgattcagattatccttactgatgatgtgctgactgctgagtggagaaacaaggttcaaccgggcgaagaccatgcggcttatgcatctctcgcgtcctactgcacaaacggttaattattagggcctaaaacgaaggattgtaaacatgccacttaacttttgcaaaattagatagttagttcatttggatggatgccactgacatgtttctaattaaccctaaaagaaacaggtacagccgtgcaacccagttttcttttgccatgtttactgtgccaatctctcgttgatgtttccagctcatatatactcgtcgttacagactagaacaactgactagctgtttggttggggcttttaatttcggcatgtaatcaattcactgtacaaactgatcacgctgcttctcctgcatgcttggttgcgtctgactgtaatgggatacggccagtacaagtgccgaaagacgctcagcaagtgctacggcggtttgggatgctaccatatatgccacccacgcacttagcacaccattaagagcgtttaggaaaagtctatgagaaataatcccaacaaaattatacatggcaatcatccgtgaagaaccacgatggtacaaggaaaggtaaaatgaaaagatagataaaccaacactgtagaaatttaagcttgagcgacaacctgtacaacgagaaaccaagaattaaggagactgacggacatacaactatttacgcaatgatttctctttttttttgtttctcctcgcacaatctttcgttcaagctaattttgcgcgctcaggtatgatcgcatgttctatcaatccgtacttttgttcgaatattttatgcaattcattggggtgcgtgcgcttaatacttgcgtcatttctagtttgtggtcaacaaaaaggcatctcctcaaataagtgacgccatttttttttctaattatatgaaaatatatcgggcacaccactaaattagaaacaggaaatatctttattcataagttattgtataaaatcgttttctgagagccaagcatctttctgttttaacatctaaaataaaagaagtattttgtatgataaaatgactatatggacatgagttggatttgctctagtaaatctagctaagagacaaaaggtcttgatatagtacagtaatatagtaggacctggcctcttttaatgtggacaaattcccagattttaaactctattactccagacataacaaataagtcctaaaacatccccaacataaggcctcccctagagaattcgt

SEQ ID NO: 11294 - DNA, 752 bp, Zea mays
cgggccgggaaaaattcacagtagccagatccagcagaattgagtgacaggctcaaacacaagctagaagataggtgcttagtgagttaaccagtgggatgtcgctggaagatagtttgaagaagagggtggccaagtgccgcagggagtatgacattatttacaagcagctaccggtgctgctagagaagatggaaattctatttcctacggggaagaagatggagagctccgagccggagaacaaatccgaagcaaagggggagccggtcgacccgctgcgagccatgacgccggcagaaataggggagcgctacaaggatctggcggacaccgtcaagggattcctcaaggatctggacgaggccgagaaggagatcgtcgcaggcacgagccaggcggcaacgccacctgcttcagtggaagaccagtaataatcaagagcagcagcagcacaaccgcacaaggagagggaggcctggatctgcatcaggaggatcatcatcccgtctaataataattactccgtattagtttcctttcgtcagtcatgtttcccagtttgttaatcatctggatgttgggtgataatttagctgttctggtgtgttgtgattccgaccgagtcgagcaggtcgtagctagagcgtgtgttcgtcggctgtatgtatcgctttcgatccgtggaatcggtcggagtacactgcctgctatatggttgtttatgtttatgatccagcggggccttactg

SEQ ID NO: 11295 - DNA, 1711 bp, Zea mays
gggacctcgagccggccgctaacgctaatcttctccccctgtccagtcttcagtcttcacttccattccaccggctccgatcccaactgccatggcgctctccatctacacgcccacctcctcctccctcgtcccgccctccattcaggaggtcaggttgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacggcggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcttgcaaatgttggcgctgaactggctcatcaagtccctgggagagtttcgacggaaatagatgctcggttagcttatgacacccagggcataatccacagggtacatgaactgttgaatctatacaaccaacatgatgtctcaactgaccgcctgttattcaaaattcctgctacatggcaaggcatagaggcctcaaggttgcttgaatctgaaggaattcaaacgcatctaacatttgtttacagtttcgcacaagcggcagcggcagcacaagctggtgcatctgtagtacaaatgtttgtgggccgattgcgggactgggcaaggcatcactctggtgacccagagatagatgaagctttgaagaatggagaagatgctgggctttctttggcgaagaaagtatatgcctatattcacaggaatgggtacaaaacaaagctgatggccgctgccatacggaacaagcaggacgtatttagccttctggggatcgattacatcattgcaccactgaagatattgcagtctctggaagaatctgtcaccgatcccgatgtgaagtacggctatgtcccgaagttgactcctgctattggcaagacgtacaacttcactgaagaggagcttgtgaagtgggaccagctgagcctgtcagctgccatgggaccagctgcagaagaactgcttgcttcagggctagaggggtacgtgaaccaagcacgccgcgttgaggagctctttgggaagatctggccacctcccaatgtttaacaacggcgttgagagcaatagcaatgtgatttgcctggcaggctcacaatgctgcgcggaagacgatttgcttctttttggataatacacgaagcactcccgtgtttacgttgacttgacttgcagtgtgcatgtattctgtttttgtttgtaattcagatgatttgctggatccatgagaacctgtcgcctgatattccctgcaactgcaatcgtcctcgtacgtacggctggcaacggcttcttggaacatcaccacctgagctgcagttacatgattccatttatacacacacgtatctgcctgctatcacaagtcatttctacgctggttagccaagttcatgttttggggatacaatcgcccacctagcgtcaagatctcccttgtgaagcgtcatgctgaatgtatgaatttaccatatgcttttgtcc

SEQ ID NO: 11296 - DNA, 1753 bp, Zea mays
ttgggggtaccatccgttaggacgaaaaaaaaggtccctctcctcgcgtctcgttgtcccatctagcccatctgctctctcagcgaggacgaaggcacaaacccctcacctccctcaaaccctagccctcgctctcccgcttgttcccgtcaccgccatcatgggctcagatgcggacatggaggactacgggttcgagtactctgacgaagagccggaggagcaggatgtcgacattgagaaccagtattacaactccaaaggtttggtcgagacagacccagagggtgcacttgctggttttgatcaagtggtcagtatggagcctgaaaaggctgaatggggatttaaagctcttaaacaaactgtcaagctttactataagctggggaaatacaaagaaatgatggatgcatatagagagatgttaacatacataaaatctgcggtcacccggaactacagcgagaaatgtataaacaacataatggattttgtttctggatcagctagtcagaattttactcttctgcaagagttctaccagacaacactgaaagcgcttgaagaagcgaaaaatgagagattatggttcaagacaaacttgaagctttgcaaaatttggtttgatataggcgagtacggtcgcatgaacaagatattgaaggaactgcataaatcttgccaaagggaagatggttctgatgatcaaaagaaaggcacacaacttttggaagtctatgctattgaaatacaaatgtacactgaaacaaagaataataaaaagcttaaggaattgtatcaaagggctctttccatcaaatcagcgatacctcatccaagaatcatgggtataattcgcgagtgtggtggaaagatgcatatggctgagaggcagtgggctgaggctgcgactgatttctttgaagctttcaagaactacgatgaagcaggcaatccacgcagaatccaatgcctaaaatatcttgtccttgccaatatgttgatggaatctgaagtgaatccttttgatggacaagaggccaagccgtacaagaatgatcctgaaatccttgcaatgacaaacctgattgcagcgtaccagaagaatgacatcatggaatttgaaaagatcctgaagagtaatagaagaacaataatggacgatccttttatccgtaactatattgaggacttattgaagaacatcagaacccaagtgctgctcaagcttattaaaccatatactcgaatcaggataccattcatttcacaggaactcaattttccagaaaaggatgtcgagcagctgttggtgtcactcattctggacaaccgtatccaaggccacatagatcaggttaacaagctgctagaacgtggagaaaggtccaaggggatgaggaagtacaatgctatcgacaagtggaatactcagctgaagtccatttaccaaacattgtccaacagagtttgatgagaaggatcgctgctgctgctgcgtgcattgcacacctagcattgttgatagcctgttttgtggatttgagggcaactgcaaagaactgtctggtgacgcttgcgatagaatcctggatctgggtaaagttaatattgactacgaggtcgtctctgaattgaatctggtgttttgatagtgcaagactacttgactggtcaaaagccaattccaatatacgatgcccttctggttggtctttggaaaaaaaaaaaaaaaagggcgggcccgaaa

SEQ ID NO: 11297 - DNA, 1775 bp, Zea mays
cggacgcgtggggtcgagcctgggtctggtttccagacctacccaaactgaaaagattgttcttgcttcccgatttccagtcctctgtcgtttgttgtcccatactcccatctgttctccgcgaggcgcaacgaaggcacaaaacccttacctccatcaaaccctagcgctcgtgtccccgtttagctcccgtcgccgctaccatgggctcagatgcggatatggaggactacgggttcgagtactcagacgaggagccggaggagcaggatgtcgatatcgagaaccagtattacaactctaaaggtttggttgagacagacccagagggtgcacttgctggttttgatcaagtagtcagtatggagcctgaaaaagctgaatggggatttaaagctcttaaacaaactgtcaagctttactataagctgggaaaatacaaagaaatgatggatgcctatagagagatgttaacatacataaaatctgctgtcacccggaactacagtgagaaatgtataaacaacataatggattttgtttctggatcagctagtcagaactttagtcttctgcaagagttctaccagacaacactgaaagcgcttgaagaagcgaaaaatgagagattatggttcaagacaaacttgaagctctgcaaaatttggtttgatatgggcgaatatggtcgcatgagcaagatattgaaggagctgcataaatcttgccaaagggaagatggttctgatgatcaaaagaaaggcacacagcttttggaagtctatgctattgaaatccaaatgtacactgaaacaaagaataataaaaagcttaaggaattgtatcaaagggctctttccatcaaatcggcgataccacatccaagaatcatgggtataattcgtgagtgtggtgggaagatgcatatggctgagaggcagtgggatgaggctgccactgatttctttgaagctttcaagaactatgatgaagcaggcaatccgcggagaattcaatgcctaaaatatcttgtccttgccaatatgttgatggagtctgaagtgaatccttttgatggacaagaggccaagccgtacaagaacgatagtgaaatccttgcaatgacaaacctgattgcagcgtaccagaagaacgacatcatggagtttgaaaagatcctgaagagtaatagaagaacaataatggatgatccttttatccgtaactatattgaggatctgttgaagaacatcagaacccaagtgctgctcaagcttattaaaccgtatacacgaatcaggattccattcatttcgcaggaactcaatttcccggagaaggatgtggagcagctgttggtatcgctcatcctggacaaccgaatccaaggccacatagaccaggtcaacaagttgctagagcgtggagaaaggtccaaggggatgaggaagtacaatgccatcgacaagtggaatactcagctcaagtccatttaccaaacattgtccaacagagtttgatgagacgaatcgtggctgctgtatgctttgcacacctagaattgttgatagcctgttttggggatttgagggcaactgcaaagagctgtatggcaacgcttgcagtagaatcttggatctgggtaaaatgagatgtccatgtaagcatttgatattagttttttcagttatattgactaggaggatgtccatgtaagcatttgatattagttttttcgttaatctcgagaatgttactggtgccttttactgttg

SEQ ID NO: 11298 - DNA, 3971 bp, Zea mays
  misc_feature (588)..(588): n is a, c, g, or t
  misc_feature (870)..(870): n is a, c, g, or t
tatgtaatctaacttattttaatctaacacttagtctaaaataagttagattatataatctggatatattataatatcaaacaaacaacccctttagtatataccttttgtgaagttgaaaaggtgacgtatgtgccacacgtacatgtgctcgctcgcgcctgaaagttatatgctctaatgaggatgaatgtttatgtttgttttgctagcgtccatggtcattaaactaagcttctgtcgcgcctatattagagagcaccccttctgctcaaccacgccaagtgacaactcatagttactcctacgtaggagacttgtcaagagcaggtctttcgaaactactgatgttcaagtgttcatctactcagttgaaggatgccactcatgttttgggaagtgacagtgacacagctactctcgcttcatctccttcctggtactgagctccaacatcctgttgctgatcactgcatcaagcaggatgaatactccaattgataacatgtctgtccttaggtatagttcctcttttcagtcatattcagttacgttgttttctactttgttcatatgctaagatcacanacgttaataagaaatatggatgagtgtattcgttatgagcatctgttttgtaccgcaactcaaagaatttagattgtcgcctttgttaggctgtgtccagcagtccgctgacgtgaatgtgcaaaacaggatgatgaagaacgatgcgagcatacaaacaagatgctcacttccagcatgtggacacacaaacaaagaagagggggagaggatccgtgaatttgggttacgaggagaggcagcgtcttggaaatgtgaacaatttgcttgtgggcacttgtnttacgcatttgcgaccgtttacacactccgatacatatatatagctgcaattcatttttttctagatgaaattcggtcaaaatttatccaacaatcgaggtttcttaaccgaggatcgtctaccagttctattgggcactctgaatcttttacataaaaaacaagtatgcaaaactattttataaattggagactccatcatatttatgtggcaaaacggtatgcatatccaaactctcgactggtatataccacggacagccccactctttccacttcccttcttgtcttttgtgtgggtctactgtcacaatgttcacacctttattcttgtgctagtatcttgcgtactttgtggcagccattgacaaaggtaaactgacatcaagagatgcaaatgcacccgctgaaaatgaaaaaaaaacaaatgtgattcgaactaaaattccgtcataattcatgcaccttcgacgacataagcccatccacccacaagacaagttagatactagcaggaggcggcagcccaagaactcgatctctgaaccatccacccacatgcgggcccgggggaaggcagatggcccaagaactcgatctctgaaccatcaactgccgagtattctgtctccgatgcattaatctgcagtcgccatccctataacggttacaggccaaattgcaacatccaggatcagtgtaagccagcaatgccgtggcgtcaaatccaaatcgaattgcttaacctctcccaagaacggccaaagcctatttctgtgacactggcaacgagtgtagcaacagtcacactggcaagcaagcaagcagcaccagcgtttactcaaagtcgcaaaccaacgaaatgccatggcgaagctattgtggaagctggcgtacgtcgagcgccagcgctacgcccagcgtcggctcatcgtgtggcaagtctggacattgtgtaatttggaggattgcagaaaaataaataacttgtggagtttggacaaatccagccggtccttatcagttagttcaggctatacaaagacgacaatgcacacgtcgccaccaatcttgttttacttggctttgtccactgcacttctgctgcggtatatatataagccgctctgctagcagaagcaaaacatgcatcgggaacccttacacaggtagataccacaaccctgtgcagagttcttgcattctcgtcaaggtgacaggaacgacataggaaatggaggccaccctgtgcccaaagccccatttcgtggtcatcccatggccagccaccagccacatgatccccatcgtggacatcggctgcctcctcgccgcgcacggcgccgcggtcacgatcatcaccacgccctccagctcgcaactcgtccagagccgcgtggaccgcgccgggcaaggctcagcgggggtcacggtcaccgcgatcccgttcccgggcgcggaggccggcctgccggacggctgcgagaggacggaccacatcccctcccctgacctcgtgcccaacttcttcgtcgccaccgcgcggttcggcgaggccgtggcgcggcactgccgccgcctgcccacggccacggcggcgcacccccggccgagctgcgtcgtcgccgggatgtgccacacgtgggcgcacggcgtggcgcgcgagctcggcgccccctgcttcatcttccacggcttctgcgcgttcgctctgctgtgctgcgagtacctcaacacgcacaggccgcacgaggcggtcgggtcgccggacgagctcttcgacctccccgccctgccgccgttcgagttcaggttcgccaggaggcagctgccgatccacttccagccgtcttcctccatcccggaggaccgccaccgggagctccggaagttcgagctggccgtggacggcatcgtcgtgaacagcttcgaggagctggagcacggctcggtttcgcgcctcgcggcggccacgggcaaggccgtgctctccgtcggccccgtctcgctgtgcggcgccgccgcacctcctagcctcctcgactcgcgggccaactcggacgatgccaggctgtgcatggcgtggctggacgccaagagagccgactccgttctctacgtcagcttcggcagcgccgggcgcatgcctccagcgcagctgatacagctcgggctggcgctcgtgtcgtgcccctggcctgtcctttgggtcatcaagggcgcagacacgttgcccgatgacgtcaacgagtggttgcagcgcaacaccgatggaagcggcctcccggagagccagtgtcttgcgcttcgcgggtgggcgccgcaggtcgccatcctggagcacccggccgtcggcggctttctgacgcactgcgggtggggctcgacgctggagagcgtcgccgcgggcgtgcccatggccacctggccgttctccgccgagcagttcctgaacgagaagttgatcgtccacgtgcttggcatcggattgtctgtcggcgtgacgaagcccacggagagcgtgctgaccggtgccaaagacggcggtggcaaggcggacgcagatgtgggaatggaacaggtgaagcaagccttggatatgctcatggatggaggggcggatggggaggcaaggaagacgaaagctaaggaactgaaggccaaatcaaagactgctctggagcatggaggatcgtcatatatgaacctggagaagctgatacagtttggtgcttgaaaatggagtggtcgtggactcgtggtctgtttcggcacccaaacttagtttatttctccctaataaaggttaataaactaggactgcaagcaaaacgtggtacatgtaggtttcaggaacgctgcaggccgggcaaactttgtccaggattgcgagtggacaggacaggagcagaggaaaaacggcaacagaagcgacaaaatgaagagtaacaaagagccgttggattgaagatcaatgactcatgtgcgttgcctaagaattagacatatagtcatatgagcgtcttctctatgatacctgaggtttcttcgattcaaaaaaaaaaaaaaaagtttctccacttagtacgcgttcggttagc

SEQ ID NO: 11299 - DNA, 2733 bp, Zea mays
gtagagaagtgaaacgaacaaaaggtgtttcaaggattcgtggatgcaatttctcttctaatataatcaaccaaactgacgaatgtctcctgtcctttttccaccagggcttggatttgaaccccacctcttgcatcgtttttaacattttacgctaatttaattgaatgactcgacaggctaacgagctggtccgatacggccagcaggccggcgtgccgtccctaggccggagctgcggtctgcgggcattgggactagctggcccgtgctgggccgtccgtttgaccatctatatgcggaggtgtggtttgggacgtggagattggttgcgcggaggggacatacgtaagttaatttgaaatagatgtgaggagttatttgtaaaaacatgatgcagaacgaaactgatgctttaatatagtagtatagtagagaagagatagaaatagagaaaatatggaccaacccttccatcacttactatacatccaaccaaaccaaacgtaccctaaattagcacaaagcgtcccaaaggaccgaactgtaaattcttaaaatcacgtgcgttcttcagtgttagttctccaccctctccttggcggaaaaccctaaccccctttctcggcgacgatccgacccctaccccatctcccggccgaccccacggcgctctccgccatgccggacgtgcaacctctcgtcagcgacttcgtcctcaagctcaagcgccggaaggtggaggggtcgcacgcggtggcccggcagacggcggagctgctacggtcggttgtgtcgcagcatcggatgggtagcagcgccaaccaggcggccacacttgccgatgccgtacgggctgtgggggagcagctcattgccgccaatcccattgagcttgctgttggaaacattgtgagacgtgttttgcatataataaaggaggaagatatatcttccacagcagttggtatcgaaggtctttctgttactgttgacagtgatgatgaatatgacagcgaacatgatgatcgccctgcattatctgctgctgttcttgctgcacatgctagaaatgcccttcgtgcaccttcattgcagactctgctagaagacattcctgtgagtcctgcaatttcccgcactgcatcatcaactggtgactcagacggaaaaagtaaatcagctggagataagagctcaactagaaaactgaagcatgatgtcatcgcagccattggtgatcttattgatgagattgactcatgctatgagccgatttctgagcaagctgtggaacttattcaccaaaatgaggtaatcctaactctaggtcgttctagaaccgtcaaggagttcctgtatgccgcgaaagaaaagaaacgatcttttcgtgtatttgttgctgaaggtgctccaagatatcagggccatgttctcgcaaaagagctggttgagaaaggtgtacaaactacagttataacagattcagcagtttttgctatgatatctcgagttaacatggtcatcgttggagcgcatgctatcatggcaaatggtggagtcattgcaccagtagggatgaacatggttgcacttgctgctcaaaggcatgctgtgccttttgttgtggttgctggtagtcacaagctgtgtccgttgtatccacacaatccagaagtgttgttgaatgaactcaaatcgccgtctgatttgctcgattttggcgagttctcagattgcatgaatttcagtactcaggatggcagccccttgttaaatgttgtcaacccaacatttgactatgtgccaccgaagcttgtgagcctattcatcactgacactgggggacacagtccatcttatatgtatcggcttattgctgagtattactcagctgatgacctggtagtgagacggaaggcaacatcttgaaggaagacaaaagcgctgcgaagtctccttggtgttctgatcataggatttgcgatcttattggaatcctagtgttcttgtactcgtcatgatctgttgcctgtagagcggtgctgctgtgataagtggaatcacctgtttgtggatccagttactgtcaaactgcaggaaatcgatgcaagcattctcgcgcatcgttgtaaccatggcggcattttaagtataaactgttgaggaatggagcgttacgtcatggaagaattgtttcactataggagaggttcaaatatatgattgactggttgtgtagagggtgtctgtttcttttctggtcataggttaatctgggccttggctggtccaaattttgaatgttataaactccagcaagctgttcgatatgtctatgaagtgttaccatgcacactgatgggtatttgctgagccattttgttttctatatctgtcgtcgcggccgcgttgccctcatttcatgctttttttggtgattcaatttcgtagatgctgggaaagggaaaaaaagggaattttaaggcttaaacaaattagtaagacaacttcgtagatgcttggaccggcgacgacctggacgcacacgcgccgcaggaggtcgtactctggcggggccatcggtggcagcgagaagtggtcgtacgtggagctcccggtccggacttcgcccatgttccggaagatgccttgcccggcgactgcctgttaacaacactagcaaggtactagagtggaagagaatccgggtacaagagagataaagtgggg

SEQ ID NO: 11300 - DNA, 1854 bp, Zea mays
cattgggtaacctaattctaaattcgtaaaatcatcacgcgccgtctgcagtcctctgcctcctcgtcggaaagccctaatcccactcaatcctctcgctgccgatccgacctcaattccgaatccctcccccatctcccggcgtccccaacgccctccgccatgccggacgtgcagccgctcgtcagcgacttcgtcctcaagcttaagcgccggaaggtggaggggtcgcacgcggtggcccggcagacggcggaactgctacggtcggttgtgtcgcagcatcggatgggtagcagcgccaaccaggcagccgcgcttgccgatgctgtacgcgctgtgggggagcagctcatctccgccaatcccattgagcttgctgttggaaacattgtgagacgtgttttacatataataaaggaggaggatatatcttccacagcagttggaattgaaggtctttctgttactgttgacagtgatgatgaatatgacagtgaacatgatgatcgccctgcattatctgctgctgttcttgctgcacatgctagaaatgcccttcgtgcaccttcattgcagactctgctagaagacattcctgtgagtcctgcaatttccggcactgcatcatcaaccggtgactcagacggaaaaagtaaatcagctggagataaaagctcaactaggaaactgaagcatgatgtcatcgcagccattggtgaccttattgatgagattgactcatgctatgagccgatctctgagcaagctgtggaacttattcaccaaaatgaggtaatcctaactctaggtcgttcgagaactgtcaaggagtttctgtatgctgcgaaagagaagaagcgatctttccgtgtatttgttgctgaaggtgctccaagatatcagggccatgttcttgcaaaagagttggttgagaaaggtgtacaaactacagttataacagattcagcagtttttgcaatgatctctcgagttaacatggtcataattggagcgcatgctatcatggcaaatggtggagtcattgcaccagtagggatgaacatggttgcacttgctgctcaaaggcatgctgtgccttttgttgtggttgctggtagtcacaagctgtgtcctctgtatccacacaacccacaagtgttgctgaatgaactcaaatcgccatctgatttgctcgattttggcgagttctcagattgcatgaatttcagtactcaggatggcagccccttgctaaatgttgccaacccaacatttgactatgtgccaccgaagcttgtgagcctattcatcactgacaccggggggcacagtccgtcttatatgtatcggcttattgctgagtattactcagctgatgatctggtagtgagacggaaggcaacatcttgaaagaagacgaaagcactgcaaagtctccttggtggtctgatgtcatggaattgttggtgggtccagtcactgtcaaacagcaggagatcgatggaagcattctcgcgtttgggcgtaaactgtcgagggaatgggatgtgacgtcatggaattgttgtcgtactacaggagaggttcatatacatgaatatatgattgactggttgtgtagagggtcgctgtttctgatctgggccttggctggcccaaattttgtcttataaattccagcaagctgttcggtgtcacgtattcactgagccccttttctatttctatatactgtatatggtattacgcctgtcatgcttcttttttggcgattcaactgcgtagatgctggaaaagtaaaaaaagaagaattcgacagaaaaaaaaaaaaaaaaaaaaaaaaaaaaaaaa

SEQ ID NO: 11301 - DNA, 1386 bp, Zea mays
aaagttaacctctcgtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggcacgcgtcgcgggggcccgtggcgcccggcgcaatgcggaggccgtcgggggccggcgtgccgagccgccgccgccgcgcgatccaggtgctcgtggcggtctccctcgcctacgcggtcgccgtgctgctcctcgagtcgcccctcgtgtccacgtcgctgcccggggcgggggcgtccgccgcggcgtcgcggaagctccacctcgacggcgcgtgggagggcgcgggacgagcagcgccggcgcgccccgcgaagcacccgcacagggagaccctctcggcggacgcggggcggggacgggcgcgccggttggcggggatcgtctctggcctcgagctccgccacctcaactccacccgctccggctcgctccgcaaggtcgccgcggaggccgccgagtcaggggcccgcgtgttctccgacctggaggctctagcgacggccttgactttctcgggcgattcgtcaggggaggaggaggagaagagcaagtgcccgcactcgatcgtcctcagcggcgacgagttccgggagagggggcgggcggtggagctgccgtgcgggctcacgctgggttcgtatatcacggtcgccgcgacgccgcacgaggcgcaccctgagcgggatcctaagatcacgctgctcagggagggggaagagccgatcatggtgtcgcagttcatgatggagctgcaggggctcaagacggtggacggcgaggatccgcccaggattctccacttcaacccccgcctccgcggcgactggagcggcaagccggtgatcgagcagaacacctgctaccgcatgcagtggggcactccgctccgctgcgatggctggaggtcccgtgccgacgaggagactgtggatgggttggccaagtgtgagaagtggattcgggatgatgaagggcggtccgaggagtcgaaaacatcatggtggctgaaccggctcattggccgtacgaagaccgtctccgttgattggccatacccattcgtggagaaccacctgtttgttctaactctcactgctggattggaaggttaccatgtgaatgttgatggacggcatgtgacatcatttccataccgcactgtaagtggctctcgcttgtacatgaatggatggggaatgcaatgcaatattaatattggtgcaaaaaaaaaaaaaaaa

SEQ ID NO: 11302 - DNA, 3203 bp, Zea mays
ctcggtacccctgcacaggcttcagcccgatataggccactgctcccccgccggtctacatggggctgccccgtaagtcgagagtttcgtgctccctccggtggctccgatgacctggcgtccacaaccggcttacccctggccggatctggccgttgtgttgccggcgccccgtggtggttgctagccgggcccgtacaggccctcggcggccaggcgggcgtggctggggtccgcgtacacccacccccactgtgttgtgctctgcttcgtccaactacagtgcgtccgcgtgtctgctccttcctgtgcagctcaccgccggtggatccggtatgcctgtgcctggatctaacccctacgaagcggacgaggatagccattgccgaaatgcagcggggccctctccggcggtctctgccagctgggtcggggcaggacgcccgatctgttggtgctccgccgaagcccaccattggcggcgccctatcgtggatgtggtggcagtcctgagcagcgaaagctctgtgcccggtgcgcggggggtcctatcaccttcgctcggtctgctccaatgcccattctcggcggtgccatgaccttggcgggactgggctccatggcggtctccttgcagcgaaagctccatgtcagtacgtggaaggtgcccacctttgcaaggcccacgtcatggcttggtcgtcagggttttctttgcaggtctctttgtccctattggcacctctgctccgtcaacgctcttctgtcaacaagggacacatagatcttatgtcgggtcggtgttttccgcctctcctgctctcgtacggcgctggatggtggcatgcggagcccggatgcgctgtcgggtgttgctgccggcttgaagggagatcatcgtctctgggatcggctcacgcttgcgcggtccctcacctagagggccgcacggcagtggagcgacgttgctacgaggggccatgtggatgcgcaatggtcctcatgtgctggcgagtatgttgttctctggtggtgctagtcgtcgatcggctgttgtcgtcctagccgttatagcctgcgtcatgtttgtgtaatccgaccgggctgtgttgggccattggtattgttctccccttttgtaatctccgttctgctttgtgtaatcctacggcccattttgagccattgatctaatgaaatcaggtggtgtcactcccccagttgaccggcaagaaaaaaaaaaagattctagttgtttcaatgcaagagcacggattgacgtactagtatggacaaatagaagaataatgaagaaaacctatgttggtcttgatgcaggcaaaactaggactgaactgaaaatctttgcaagggtgtgtttaactcatgaccccaatatatgacaagccaaaatttggccatgcccttaatatttagcctccatttggtcagtgattgtagctagccaatacttagtgacgtgttataaaatacacgtctctaataaagatattatttgtgatgtgtctgtccacatcagtgacgtctctaataatgcttgttcggctgtccttgctgcggctgcgacttctacagtatttttgtctctatggattgcagctgctacttttgcagccgctacagtgcccaaataagggcagccgaacaacaccgaataaatctctggttgcttgaataaatcggagaatctagtcacgggcttcttcgtcaccgagccttctcgtcctcgcggacttgtgacttgtgactccagtcccttccaatcaacaagttgctatagtagtcccttccaaaatccacactggaaccggaacctccatctccaatccaatccaactccagatccgcctccctgctgcatccccatcccgcacgagcaccaccccttgtcctctccgcctctacatctcatcggctggtgcacctcctccctcctctgctcggcccctccctcccttctcgtgctacggcagcgtggatgcacgagactacagctgtggcaaagcggagatccggcgggagtgcagcggccggcgtgcctctacgtggtatggtgacatgaagatgcgaggcgaggcgagcaaggccagctccggctccggctctggctccagcgaggatggtgagcgaaccggccccgtgccttcccccgctcgtcgcgcgccgcccatccgcatcgacgtcgccatgggctccttctccgcatgtcgccgccacgagatctgcccgcgcgtctccttcggcagccgatgcccgacggccgtccgacctccgacgcatcgtcgccggtccggtcctcttcgccccctctccgctgcgtggcgccacccgtcgtcacctccgcccccttcaccgacctctcctgggtcctccacacactgctcgtcaccatcgtcatgcgcgaggcgctcaaggtaacaccatcctctccgtccgtccagcatctccctccttgcagatctccctgtttccccttccctaattccatttagtcccgccattatctgatccgtacacaagatgatgttaggtagttgaatttgatggcaaaatcgactgcttgctaggactggtgattgcggtgtgttggttgaggatgccagagatgagctgaagcttctagcattatgtacaaaaggtatttgtcgaattacctggatgggattttgctatacttcacttgatttatcatatttcctttgctcatcagttctgaacaagtgaccacgtctaactcacaactctcccatttctggttgcgcgaatttcttcaattctttcagaaatcagaattgcatgacttttatcttaacataagttagagtagctgtgcataaatgtggagaatattgatcagagtttatgatttgttcaaactgaaactcactaaattcttgcaattaaggactatcggatggtcagcatccaatttatctatgttcagcataatggcatcaagtttttgctaatatgactgtagagtcttaagacttcaattaatttttgcaggggattgacatgctatcatttgtatcaattaaaactagagctgttctcttgatataagggttttctccatatttgagatggattgaacactgtatcctttacctgcagcattttttctgtatctcgtgataattttccggtcactctaatctctctctccatgcagggggatc

SEQ ID NO: 11303 - DNA, 1207 bp, Zea mays
tcgtaactaggaaaagtgaaatgcgtggtcgaaatgtgttttgggacctcttatttaatctttttgaactttaatcctaagaaacgagatatttttggttttttttaaaaaaatattcttatccttgcgccgcttccttcagtctaggatttttcctgccttcgttctcatccgcgcgggtgggaagggaacaacatttgtcgttgggagaaaatcccaccgcccctctctctgatccttatctctctgcgcacgcaggctacttatccccaatcattttctccttccctgcagcggcgcggtcctctgctcctccccagcgtccctcgccgagcaccctctgccccggctcctccttcctggccgcgcgtcctgtgcctgctcgtgcccagcctgtgcttcctctctaccgccgctcgcaaggctccctccctcagcttgccggtcgtgagtccctggtgccgtgcgcgcgcgtccctgggcccagtttggtgctcaccccgccatggagctagcgctgaccgcgccctctccagccatggcgcgctcgaccggagctctgctccccccagctcctctgcgcgcgccgtcttccagccgccctcgccccacctctctcctctgccgtcgtctagctcggatccgcccccagccgcgaatacccaatgccgcccaagcccagcttctttctccctcagctcccatggtgctctctctctcctgctcgctctctggtgtcgcgcgtcttctctgctcgtcggtgctcgccacgggagacggcgctcggtcgcccaaccttcctgctcctccctgctatcgtgtccctcagcgccggtcgcttcttcttgctattccatgccgcggcaatcgccctgctgctccagtgcgcccagccgagcgattctctgctctgtgcgcgcggtatttctccagcatgccgcgcccagtccctgctccttgtttttctcagagatgtggagtctcatcgtcgcgcggatctctctccttcctaccctgctcggattgtgccgcgcttgctgtcgcgttcggcctgcttcggatccgaagttggtcgcctcggtgtgaaatcgccgtcgcgtccagggttttgacatgtctccttgctcgccgtcgaacttgagttccctgctcagcctttagcgctggcgcgtcacagtgatgttaccgtctcgccgtgattcccgga

SEQ ID NO: 11304 - DNA, 1898 bp, Zea mays
ccgtttgaaatacggttgttcacaccgttcggatttgttccgacgacgtctcgcccaatccaaaactttgcatataaataacaagtacaaattcgttcgagtccaaagtattcgccaaatcaaaatcatgtcacgattactgtctaccccgtatacgtccctaagaaaatttgggatctaaaatatctgtgatttttcggttaaagaaattaaaaatctaaaaaaatggaaaatatcccagaatttttttcccaaccgtgcttatctgttccctgtgcgcgtcgtcatcttgttctagccgccgctcatcctgaagaaaaaaaaacgcacgattctcccttatcctttctcctcgcgcgacggcctgcagcggccttatctccagcagctagcgcctcagctcctgctcgatcttcttccatggcgcgcgcctgctactggcgctcggcctcctgcccatcccctgcgtttttcccctgctgaagcttttccatggcgtcctgttttctgcgcgcgtttctcggcgcccggctccctgctcgagctccccaaccatggccgccctcaaccccatggtcgagctcgcccagctccctgctccggtgactagcgctcagcgtccggatccctggatgcttgccctgctcgccgccattccgctggatcctgcgtgctccagccatggcgccctcccttgcttctctctccctctgccatcctccagctcgcccagcccctgctcctgctcgccatggctgccgcgccctcccagccgcagagttaccgcgcgcgtgagcttctctgttggccatcgctgttccctggtgcggtcgcctatgccgcgcgctctctctccagcgcccacccccagctcggccctccacctccctctcgtctggataccggtgctgctcgccctgagctcctgccttggccgtcgcagcttcaaatccgtggacgtcgcccatggaagctcgccgaactgtgtccatatctttcctgcgtcggtcgtggtcttcaagccccgacgcgcgtgtccctgctcccagatccaaggccggtcgtcgtgtatgctcgcctcggctgtgtggccatgctcctgtcccagtcaccgccggtgaaggtccgtcctgcagcagcaccctagtggtcgtcgacttggagctctgcgatgactccatgcccgagctcgccctcaactctacagcaccgccgagctcggtccggtcctttgctgcagctcgtccccatggccgccgcagtcctgccgagatccctgtcgttcgcgcgctgctcctccctcgccatgccgcgcggatccctctccttcctaccctgctcggattgtgccgcgcttgctgtcgcgttcggcctgctccggatccgaagttggtcgcctcggtgtgaaatcgtcgtcgcgtccgggttttgtcacgtctccctactcgtcgtcgaacttgggttccctgctcagcctttagcgctagcgcgtcgccgtgaggttaccgtctcgccgtgattccctggtggtccgtgtctctgcatgttcaaatcgtcaacctcgtgcaccacctgctctctaaatgggaaaccaacagtcttctccctgctcctctgcccgcagccgcgttcctctaccggccatcagttgccgctgaaccactgtcggattaattttcagcttccctcgcgcggctctctggagataagctcttcatcgactgtcgctcccaatcttcagttcgccgactgactgtcgtgttccttattttccctcgtcggtcgacctcgtcgcgactttgttcgtccatcgtgctggtcgctatcccatactgtacctattagctcggatcctgcccagctcgttgtcgcgtcgtttgccgtcgagtcgtcaaaca

SEQ ID NO: 11305 - DNA, 1899 bp, Zea mays
tagacgagttaagcgtcgactaaataccgacgccaaaattcgtctaattcggtctatttgcatcctgtccgaagcaaagcaaaccactgtaattattactgacaacaagtaattggtgaatgatttagttcgctaaatcattagactgaaaggtgtagccgtataacgtgtcaatcccgtatacatcgctaagaaaattaggatccaaaaacatgtactaatgtgttgttgttaaaggaaaacaaataatacgtatggaatgggcgaatgcaaattattcaaaattattatagtataaattctaatagagttgtgtctgtgcctagaagatcaaaactagaatatttgtgcgttaaaaatccaaatagtagaagagaagagataatctttagatatataaaaaaaaagaagaaaaattatatttccattgctacaagtgctcggttctggaaaacttaatttcccttcaaccattctttactacgtaataatcttctccgtgttctgctcttatccccccacgtgttcatcctcatctcctgctgccgcttaactggagatctttcatctccttgccgcttgccgttctcagatttttttgctgcctttcagatttgtttttctggctaatgtattatcctataggatcccacggcttccaaatttcagaattgtttttctggccgatgtactatccgctaggatctttagcgttcaccgcttatggtcttgtatttatcccgatacaagtctgttcggcagccatagattttttcacgcttgcctgcgctcgctcgtggctgtcgctccgctcatctatggcggctgccgtcgagctcccttgcgcgctggtcgcctctccctgccccagtccgtctccaagctccagccacgcccctggttctagccatggcactccttcaagctcggttcttctctctgcgcaggatcctctcccatggcgagctgctggcgctgttccctctgcgtccgtcgctctgccctctgctcagattccatcggaccgcgcccctctgctctgttgccgcgagcagccgcgcccagctctactcctctctcccttgccacggagctcctgtgtgcgcgctgttcctgctcgccgagcggttatttgccctgcgcaccgtgctccctgctctctctgtgcggctccccaagtccggtgcccagctgtgctcgcgagtttctcctccgcgcgtcctgcttgctctctgccttttccatggcgtcctgttttctgcgcgcgtttctcggcgcccgacttcctctgctcggactgcggcatccctgctcggagctccctgatgccgagcccatctcccagtccatggccgcgcgcagctgcttgtgctttgtgcgcgcgccgtgcttctctgccggtgcccaatcctccctgctcgtgctgtcgtcgaagcttttggatacgcgcgcccagctgaccttcctgtgtcgcgccccgactttgcccaacgccccgtcgagctcctctgtcgagcgccgtggagcctgcgcgctcggttctgtccagttcgcgtactgctcgcctttgcgtcgcgcgcgtagcgttctgttgttcctgcgcgtgctgccgcgaagctcctgttcagttcgccttcgtcgcgtttgtcgtcgagttgttgaacccgtcatctccggctcgatccccacctcaccagctcgctccagacttcaattgaaggtcgtcgtcgatccgtgcgtcatcaagaaattccaagagtcaagtgaagacggagccagcaacgtgatattcactaacggtgtgattggtagcctgttcgatcgagtacgtgcatcagcacacgcagcatcttttactttgaagctgtttggttacctgtgccaaaaaaaaaaaaaaaa

SEQ ID NO: 11306 - DNA, 2711 bp, Zea mays
tttgaattcggcacgaggggcccatccacgcagcccaaaccagtttagagttcgaactccgttgggttcgtctcgttttggtcccacgttctcgcagctgacgccgccccgttcgcctccgtcgccgccgccatcgccaccgccgaaccatggagaccacggagccgtcgcgtggcaccaagcgccctctcaccgccactgcaggcgatgacgacgatgctggcctggagcgcaagccgcggttccctaaggggaagaaggccaagtaccgcgacgtcggtgcggagggaggcccctctggcaacgctgtggacctcgacagcatgctgaatccggagcttgcggcggagcggcgggcgcggcagcgccacgtccagctcaaggagggagacgacgcgaagggaggtgccgctgaggtgaagggcttcgaagtccgctacaacgacagtgttaactttgttgacgatggtatacggatagagccgtttaacttggagcgagaaagggaagaagggtatttcgatgagaatgggaactttgtggagtatgcaagaggcaatgagattaaggatgcttggttggacagtgtggaagttgacccaacatatgctgcaaaggttcagaacaaaggcaaagagaaagtagacgagtttgaggacctctcttccgatgacattgggaggctaaaaaggcagatagcaaacttgcttgagccaggagaaacgataatgcaagccttgaaaaggttgaagggtacatccacggataaacgtggaaagatggctgaggggactaaacgtatatttgatgaattgactgaagctgccatgaagctaatggagaacggcgattataatgtttactcagatgatcgtgagacctttgaacgcgaggctgctgggtatgaacgtttggcacgtgctcgacttggtttgccagaagttgatggtgtctctgaagaccaaaaatataatcagacaccatcatctgcactggaaattgaccaaccatcatctgtactggaaatggaacttggtccctcgactgccaatgtatatacagccactgctgcaatcaatgatgatgacagtaacctggacatgtttggtgatgatgacaacgatgataccaaacatagttctgatgccaatactgtaggttcaggtttgaaacctggaacctcagatgtgaagaaagccgataatggaagtgtggactcagactatgtatacgatccttcttcaggttactactatagcagcagcacaggctattactatgaccctaactctggatattatggttctgcatctacgggaacctggtattcatacgatgagcaaactggaacatacaaagaaattcaggatgaacaaactggcacggttaaagaagagctgggagatgccatcaaggagtaaccgagttgctacggcccttctcgttcttgattgctgatgcaactgaggtagttcagaccgcccagtgttctttaaagcgaggcagcgagctgtagcttcagtttctcggtaggcgctttgggccacgactcgctaaactgccttgatagatgttttatgaagaaattaagaggaaaccagtcagatcatactataggttgtaaaccagaaagtgatcgactgcaactgtacaattgcaatattaccgttctcggcagaggcttgttttattagctactattcctgctatttctgtagaaatatgcaataacacccaattcctatgtgaagatgtgtttgaacttaacagatgagaacgttatgtttggtgtgattatgtctaaggctcgagagcgttcagattggtaaactaaatcgggcaacctgtgatcgttggagtctaagaccggcgcggggacagtcaggcagagaaaaggttcggaggttggagacgcttcagggttgttcaatcttactgtactctacaacctcttcccgaaaaggtgggaacaatattttagaccgacaacgtcttctcgggaacacggttaggccctgtttacctgtttcgacgccaaattctctcccctgtaaaaactacacttatttctgtaaatttcctgtaatattttttttttgtgaaatttctgtctcaaacaagcctatggatagttttttagctatacattggcgaagtatttgttttaaagttccaacatgtattcttttctttcttttgggaatgggctgcggccctgtattccggagctcagtaccacagaccacacacaataacacgagccagcttcagtaatcgtagattacttggatgactgcctatagcattcctatctttcttactagtggatgccgcacgccctgggcgtgatatcaaattcgtatgtgatatgcgataataaacataaatatatacatatgatttattttaagtgtacggataatataatcaatgtagcattgtagaatgcatacatgtcatcatacgaaatgcattagtagcatattacacaaagatgttgaaagtatcagttgtaggcgaaggcaacagaaccagcaatgtcgttctgcaacggtagaaatggatccttttgttctgtaaaaggtaatcaagcacagatggttaggtagttgtctttgtgtcgcggaactgtatcgtcgatgcagtcaattttttgatgaaggtaagaaggaaaatggcaacacagtagccagcaacgaaacgctagacgg

SEQ ID NO: 11307 - DNA, 3084 bp, Zea mays
ctcccatagccagattttcagaaaagctggctagaaaaaagctgaaccaaacagcccctatgcaagcgctattgtcactcatttgcacgtgatgagatatggaggaggattttgctcgtgttttgctcccaactcgtgtcggaggtacatgtgtcttgagttgccgcttacagaaccaagatgaacaactgacgagcgagcgagcgagatcacaaacgaattaggcacacatggttctaccaaagaaagaagatgtgggatcacatgacctaaatcctatgcacgttttgtgcccaagtttcatgtgcggaaaaggaagaagaacaagaagaaggattggtcccgatactgaccatgttagattctgagagggtatcaaaggtttcagaacgtgttcggtgtatggcatgactgctatgtctctgcaaatggaatacaagtattgatcacgaccggagtttccatggtcgctgttttgttttgttttttcgctagcaataatgtcttgagtagaaaaagaagcacaagccacgcacaaggtgacaaggaccgatatcgttcatgtgacaaaatcctagctcatgttttttctgcatcttttctgtcgcagggatgcctactaaaaccctgtagctagcctatgcccaacccacggcagacaaagacggcttagcaggacgatacgctatcagaatcaccacatcagactgcccgagaaacggagacggatgagtcgtctgacagatctgcacttcattcgccgccgctgcagactcatgaacacacacatggattcatttcagacgttgtggccatgccaattgccatccatgtgagacagaggcatgccagaggttttggctccacgttttgctgtcctgtgcaggaccctccctttgagtaataactaatttcctatatattaaagccggtagaaaacggccccagttaggctatccacgtcgttaagaatctgtgcaccgctcgatttcgaatcaacgtttcatgtgtgttgttgtaacagttgtggagcgggacagaaaaggacacgtcgttcgcctctagataattccagtcgcgacgccgcccgcgccggcatctcactttctttctcgctgcgtccgccatgctctcgctttccttctctctgctttgcttttgtgtcgtcgatgtcgaaaactccttccagaccaagcttcgtctgctgtcggcttgcaccagtcctcacggcccacgtcgagggagacgaagggataggaggcggaggcggaggttgcaaaaaatggtcgggagcatgcaggcggtggacccagcgggccggataagcgcgttgctcgcattgcgccagctcctcgccatgctctagccgctggccctgctccgccctttcattggcgcgcgtggccggggcgtccgatgttgcggcctccgcgttggggctagcgggaaaaggggaaggcggcggcgtcagtggttctacgggtgccggccgtctcgcccatggtcgccacacgaaggaagatagccacgcgccggacgcaggaggccgggcgggtgtacgagctgatccccaggtagtgaacatgttccatctcttgctattctgttcctctctgctagttgttaggtctattgtttatgacattgtcgtcactcatcaggtttctatgtgatgtgttctacttctacactgtacattttctaccttttttatgttctactaggctattcaggtgaccagtactattaactaaataaactctatggttagtagcttcctgacagccttgcttgaattccaagcgatgttgttttgtttactttagttgcttacttacaaaataagatatacatgccccctactccttttgctacgtaggatgcagacctggacatgccatgcgcccatgccttcttggtggttggtttgttcttcagatgtagaaagctacccgaaatccattgaactttggcagtctttttcatggtttcctgctcctatttctatggcggtctcgtcttgtttgtcagtcaagcaacaaccatgtggcacagattaataattcaattcaaggaaatataagtaccgttgtatgccattctccagtcaattctatagcacggagggtgcttggttcgtttatccgaaatttgtcaggctcagctcaggctccgctcgaagcactgacctacatgatgattggtgccacacgtcatgccacaacctttgtgtttgtccttcctgcttccttatttgttacatttggatctttgttattgttgtttacagatgatccaacattttaaaacgttgcacggattgttggatttttgtttcaggtctccacggattgttggattggtcttggcctcttcagtattcttgcagcatgcatgtgggtagtatcatggaactggtatgtaataaccaaaaagatgttagcaattcctaaactatctagacacattggttattttcatgcttctatgtctaatcaaaactacaacggtgacctttcattggttcttaactatgtttacttgcccaaagaaaaacaaaaactcttgcccaaacaaaaaaaaaaaaaaaactttagaaagtcattgtgaactttcttcgaatgtatcattattttatggtcattaaaaccaatattttattactttggtaaatgtgtatatccacttagttctatatatatatataatgttcctatgtctataataacaatcttttaaatgtgtagccacaatggtcaaaaactcgcacaaggcgtgagtaatctatttacacgtaaaaaaattcaaaccattatagcttttttactgtaactacgtcatttatttatatgccaaaaaaaacttcaacccaggcacacttcacgtttcatttggtgtgtgcttttgctgctttttccttacacataaaagtgttcttctctgatatctgtagttgtagatagattattgttttataactttctgttagttattgttctatcacgacctgttacctatctaatgtcctgccacaacatcgccattaatgtgtttttcagacttaagttatgaggtgtttgttct

SEQ ID NO: 11308 - DNA, 1035 bp, Zea mays
gtgacactcgtgcaggccggcgggaattcaggtagtgatccctacagcaatggggatgattgtaagaccttctcgcgtatcacattatctgatgctcgacggggacttgatcagtatatacaagagacctcatcagggcaatccttgaagtctgacttggagatgtatctcgaggaagcagttttccgtcaaaaagaaggaaatcgggataattttgacattctgggatggtggaagtcctttgccgccaagtatcctatactttcacaaatggctcgtgatattttagctatccctgtatctatcatccctttggacagtgaagcccgtacactaaatgagtatctcagtactatggatccttcaacggttcagggattagtgtgtgcacaagattggttacgggatgacccagaaagttgttgctggttcaggtggttcatggagatgatggagtaccgcgtggtgacgaacttattgtggtgccaaaataggtgaacacgttggaggctttgcgcttctttcagtttatttccaatataaatttatcttatcccctgttgagcatgagcatgcatgagatattctagcgagaaaaacgttgacacaaaaggctttttacaagaaaagttgaaagaagctggttatgcatacttctttgatgtttgtctgtatgcatggttaataaaagttaaaaagcacaaatcgtgcatttaagatgttaaataatatacgatagctttaaggatcttcagcacttgttagagtgatacttaccttatgtcttaagcagagaatagttccagcaacctggaagtagtatgcattggcagttcaagaaaatgataagttttgccatggagattatgtataaactaagttcaatggctgtaatagcatttgtaatgatagaactgtcagtttgtactggatggcccttattgatgaaggggacttgcaaaagtgcaaattaccaaaggttttattaggtgtttgaaaaaaaaaaaaaaaaaaaaaaaaaactcgagggggggg

SEQ ID NO: 11309 - DNA, 2517 bp, Zea mays
gcacgagaccattacctagaacatcctaaaaaaaaagtcgcaacccacgctggctctctcccggctccgaactgctaagccccccgccggatcgggttgcgggtcgccatccccgacccagatccaccacagctcgccgccggtcgccgccgccgcagagtgggtgatagtgtacgtggtaacatgctggagccaacagcaatggaagtggtcgttgctggctcagtgagcaatgcagtggtgcctgcgcctgtggttcacaacccacgggcacgcaagctgcggtctgcagtttggcaggacttcacgaaggagcgtcgtgccgatggtaactgtgtggctgtctgtaaccactgcaagaagcagctcacggcaactagccggtcaggcacaacgcacctccgcaaccatctcgcaatctgcaccaccacctccacacggcgtgctggtaagcgccggaagcttgttgtgcgccgtattctccacaacaaatcctccatcgatgggcgctcgggtgagggtcacgcctcaggtgaggacaatgataatgaggtcacacactttgatcaagaactcagccgccgagaccttgtgcacatgattgtccagcatggctaccggttttcgattgtggatgatgtgggcttccaaaagtttgttaagaacctccagcctcagtttaggatggtgtcgtatgaaacagtgagggctgatagcatggaaatatatgaaggtgagaaacttaagctacatgatgttctctttaagatcccctgcagggttagcatatcagttgacatgtggcggtcaaatacacagatggaatacatgtgcttgacttgccactacattgatcatgccaatgatgagtggaaagtcaggaaaaaaattctcaactttgtgcatatggaggcaccttttacacttgatcagatggttaatatcattgtagagaagttgcatagttggggtattgacagaaagctagctgctgttgtgctagacaactgcagcagcggtgaaattgttgctagagagcttcacagagttttccaggctcggaggcttctattgaatggggatttgttccaagtacgctcttgtgcacatattctaaatctcactgtccaagaaagctgggaacgggcatctgatataactgatagagttcgcaagatgattaactatgtcaagtttgaaagattccaaaagtttcaggatattgcaaaggtattgcgtatggatcaaaagctgctagttattgattctcctgataactggccgtctacgtacttaatgtttgactctgcatgctactatcaagatgtgtttgtgcgcctgacagaacaggaaggtcattatgatgtttttctgtctgctaatgactgggctgatgtgaaagccctcactgaaatactggacgtagtctatcatgctatggagaagtttcctgtagaaaacccgactgcaaacctctatttcaatgagatgtgtgagatccacgtgcttttgaaaacctggtgcaagagtccatctactgttgttgccaaagttgctggccagatgctttctaagtttgaaggttactgggatctcactaggcctgtaatggcatttgcatctattcttgatccccgttacaagatgaagtccctcgaatacttttttcggctcatttattctgatgagcaatttacagcaaagacaatgatagatgtcatccagaatacctttcacaatctgtataatgattataaacatcagtcatcagactcatggaagaatccatctgttctctgttactctagaaacagtaattcttgcatgggctctgtgtacagcaatggggatgattctaagaccttctcgcgtatcacattatctgatgctcgacggggacttgatcagtatatacaagagacctcatcagggcaatccttgaagtctgacttggagatgtatctcgaggaagcagtttttcgtcaaaaagaaggaaatcaggataattttgacattctgggatggtggaagtcctttgccgccaagtatcctgtactttcacaaatggctcgtgatattttagctatccctgtatctatcatccctttggacagtgaagcccgtacactaaatgagtatctcagtactatggatccttcaacggttcagggattagtgtgtgcacaagattggttacgagaagacccagaagttgttgctggttcaggtggtcatggagatgatggagtaccgcgtggtgatgaacttattgtggtgccaaaatagagaataataccagcaacctggaagtagtatgcattggcagttcaagaaaatgataagtttagccatggaaattatgtataaattaagttcattggctgtaatagcatttgtaatgatagaactgccagtttgtactggatggccattactgatgaaggggacctgcaaaagtgcaaattaccaaaggttttattagctgtgttgaaaaaaaaaaaaaaaaaacggcacgag

SEQ ID NO: 11310 - DNA, 1201 bp, Zea mays
cattgggtacctcgacgttgggccccaccatcgcttcttcttaaaagatccccacgccttccaagagtcccgactccggacccctaaaaccctagtcgggcttcatacgccgccaccgcgccgcttcctccctcgccatggccctctttgctgccgcacgccgcgccgcggcctcctccgtgcccgttctcctccgtgcctccgcctcctcggggtcccaccgcagcgccgtcctgctccggcccctcgctgccgccgtggcgccgccgaagccccgcgcgatgccgttctcctcggcgcccgcgacgagacccagctccgacgccgagctactcagcgtcatcgactccgagatcaagtacgccgaggactgcgatgaccacgacagggttgaggagtttccagaaaatttccctttcaaaatcagcgacgagaaggggacgaatgcagttacccttaaaagaacatatcagggtgagcagattgaggttgtggttcacatgcccagccttgtcactggagatgagcctgatcatgaccgtgatggtgaggatgaggacacggcgggagatgacaatgacgaagatgaaggccagaagcctgaacagtcaagcattcctctcacagtcactatatccaagggtgacggtcctgttcttgaattcacctgcactgcctatcctgacgaggtcatcatcgactccatgtctgtgacacaacaatcaggggatgatgaacgtgacatgattgcatatgagggtcctgatttcaatgaccttgatgagaacctgcagagggaattccacaggtacctggatctgcgtggcatttcacccaggaccacaaatttcttgcacctgtacatgatcaacaaggacagccgtgagtacctgctctggctgagaaagctgaaggatttcttcaagcagtaggtgtgaagacctgaagatcagctttatctctcttttgttcctgctagggccttctccgttattccaattccatgtggattgaagtgtattaaaatggattttgacttgttatggatttaaatcaacttaataccacccaatccacatggattattggtgaaacaaacaagccctagtcgaaaatgttgttaagttggtagtttgtcagacccgaaatcttttaggtgggtttcgaatggaaacactagacaaaataaaaaaaaaaaaaa

SEQ ID NO: 11311 - DNA, 1293 bp, Zea mays
cattgggtacctcgaggccggccgggaccatcgcttcttcttaaacattgggcgccccccgcccggccggggactccggaccctaaaaccctagtcgggcttcatacgccgccaccgcgccgcttcctccctcgccatggccctctttgctgccgcacgccgcgccgcgtcctcctccgtgcccgtcctcctccgtgcctccgcctcctcggggtcccaccgcagcgccgtcctgctccggcccctcgctgccgccgtggcgccgccgaagccccgcgcgatgccgttctcctcggcgcccgcgacgagacccagctccgacgccgagctactcagcgtcatcgactccgagatcaagtacgccgaggactgcgatgaccacgacagggttgaggagattccagaaaatttccctttcaaaatcagcgacgagaaggggacgaatgcagttacccttaaaagaacatatcagggtgagcagattgaggttgtggttcacatgcccagccttgtcactggagatgagcctgatcatgaccgtgatggtgaggatgaggacacggcgggagatgacaatgacgaagatgaaggccagaagcctgaacagtcaagcattcctctcacagtcactatatccaagggtgacggtcctgttcttgaattcacctgcactgcctatcctgacgaggtcatcatcgactccatgtctgtgacacaacaatcaggggatgatgaacgtgacatgattgcatatgagggtcctgatttcaatgaccttgatgagaacctgcagagggaattccacaggtacctggatctgcgtggcatttcacccaggaccacaaatttcttgcacctgtacatgatcaacaaggacagccgtgagtacctgctctggctgagaaagctgaaggatttcttcaagcagtaggtgtgaagacctgaagatcagctttatctctcttttgttcctgctagggccttctcggttattccaattccatgtggattgaagtgtattaaaatggattttgacttgttatggatttaaatcaacttaataccacccaatccacatggattattggtgaaacaaacaagccctagtcgagattcttgttaagttggtagtttgtcagacccgaaatagagttttttgggtttcgaatggaaacactagacaaaataaaggatttagtatttttttcctataaatttccaagatttatttaactgatgacaaaaaaaaaaaaaaaagcgcggcgggcccaaagctttcatgaagttaatttg

SEQ ID NO: 11312 - DNA, 2303 bp, Zea mays
ccggccgggctgtcagccgagccaagttccgaatgggggtggcttggcttggctggctacaagtcactcaaattgaaataagactgaaacggacaaaggcaaacacagcaagcaaagcaggaatcggaggtagacgacgaccaccacggggataacaaccaaacctcccaaataccatccacgaacgaaagggaaggtcgtttaggcggcgcgccgaggccgtggctatggaccccaacggcggcggcgacaccatcctcggcgatcccctccttcccctctcgcagtccagcaagcagcagcaggatcctctcgccggcgtctccgactaccttgggcggtccgtgcaccgcggaagctccgggggatggagatccgcgctcttcgtcgtgggcgtcgagatcgccggtagcttcgcctacttcggcatctctgccaacctaatcacgtacctgactggtccgctgggacagtccaacgcctccgctgccgcctccgtcaacgcctggtccggcacggcctgcatcatgcccctgctcggcgccttcctcgccgacgcctacctgggccgctaccgatccgtcatcatcgcctgcaccctctacgtcctggggtatggtatgctgacgctgtcggcgacggtgccggcgctgcagccgtcgcacatgccctgcagggaggatggcgtctcgtcgtcgtcatgccaacccgggtggccgcaggtggccttcttctacgtgcccctgtacctgatcgccatcgcgcagggcgccgacaagccgtgcgggctggcgttcgcggcggaccagttcgacgcggagcaccagggggagcgcgcctcccgcgggtccctattcaactggtggttcttctgcatggccatcggcatctccgtgtcagtctccgtggtgggctacatccaggagtacgtcgggtgggggctcggcttcggcgtcccctgcgccatcgtgctctgcgccttcctcgtcttcctgttgggcaccccgacgtaccgcctgtacgcacccacgccggaagccaagtccccgttccgccgcctggcacgcggcctggccgccaacgccaacaaaacaggaggcctctccgcctcgcattcggaggaggaggaagcggcagcagacgcgcggtgcgtgctgcgcctgctgcccatctgggcggcgagcctggcgtacggcgtggtgtacgcgcagattatgacgctgttcaacaagcaggggcgcaccctggaccgccacatcggggacggccttgagctgcctccggcggcgctgcagacgctgggccccgcgagcatcctgctgttcgtgcctgtttacgaccgcgcggtggtgccggcgctgcggtgggcgacgggcaacccgtcggggctgagcatgctgcagcgcgtgggcgcgggcatggcggtgtcgctggcgggcgtggcggtggccgcgctggtggaggcgcggcggctggcgatggcgcgggagcacgggttggtggacgacccgtcggcgacggtgcccatgagctgggcgtggatcgtgccgcagtacgccatgatgggggtggcggacgtgctggccgtggtgggcctgcaggagctcttctacgaccagatgcccgacgggctccgcagcctggggctggcgctctacctcagcgtcatgggcatcgggggattcatcagcagtctgctcatctccctcatcgacggcgtcaccggcagcggtggcggggacagctggttcgccgacaacctcaaccgcgcgcacgtcgactacttctactggctgctggcggggctcagcgccgtcgaactcgcgctcttcctctactttgcgcgctcctacgtctacaagcacaagcccaattaatcctgctagtgcagtctgtacagatgaatggaaagcagatgcaggcatgcagcccgtcgtcttcatgttttacttgtccttgtaaaacaaggcaaactcagctcaaagtcaaattcagattctagcccccaataattttcgtcggccgccgcccggctcgctatccggacatggtggccgctcatcgcgcttcttctgctcttgcagctcgctgctgcagtctctgtttcttcttcttgctccaggttgcatcgtggccatgcatgacgaggactccttccttgtcgtagactggctggatagggagctcggtagacggcgaacatttgcgctgtgaacggttggagaactgtttttccctaaaatgtgttaggatttatgggctaggcccaattaagaaattcaattaaatcttaggaaaatctc

SEQ ID NO: 11313 - DNA, 2410 bp, Zea mays
  misc_feature (1324)..(1324): n is a, c, g, or t
atttactagtctgcaggagcttctggtgtctagaagctggaaaaaaaagctgcggacctggtctctccctcgcccacttatgtgccattaaagcccaatacatgagctacaatgtggcccagcctcagaaggcccaataggtggtcactctactacccgaagccgcgggctcaaccctaactgacccagagcgatcggagctgacgacgatggccgggaaggcggcggccgcgacggcggcgaggtgggcggaggggtacccgtggaaggagaagctggcaaagtacaagggtgagctcgggaagggggtgtggggatactgggagctcggcgcgtggaagccgctcggcatcagcgctcgcaagcgcgcccgcctccgcaaggaggtgctcctcgccggcgaggactggagctacgatcctccccgcggggagatgcgtaccaagcgcaagggccacaagtgcgaccgcatctccgccgagaagcgagcaaatactgttgagcttttaaatttgtgtgcttagtttgctcactgggtcaactgattgacgcctcgttttcatttccgtctctcaggcgagcaaatactgttgagctgatgaagaagatgccccagatgctgctcgactacaaggtttgcgtctgcgtcatcttagtttgtcttatgttacccgttgtaggacgtttacattgcaatccagtgtgcttcgtttccgtttctcaggtcagcaaatacatcttgggctgctgttagagattcttgtgtggaagtgaaaccatgccaatttgaagccgtgatggcttagatgtattgttgtagctggtattttggattgctcaggatctagcaaacttcatgataattaacatgagtttttttggttgaagactagttatccttacataatagcctcccacattaagtttttattgtgctgacactatttaggctctgtttgaatgcactagagctaatggttagctgctaaaattacttggagacacctaaacagcccagctaatagttcaactattagttcgagtcatccaaacaccccaactaatagttcagctaactattagttgcaccctcaactacccattagttatatccagtttaatccagctaatagttagccggctatttattagccagctaatttcactagcattttttcagacagctaactattagctctagtgcattcaaataggaccttagtctatagtgcagtaatctctcagtgatttttctcaaacttcaaccttcacagtaccgaaatctaaatttcatttcggttccttttatcatggtagataacanaaaaggagtaaacactcacagtcattctgttctattctgactctaattgagaacctgttaaggtccttttcggcttatatcggggtaatgaggcctatcgggcctattcttgtataagcaacatcataatctacataagaatattattcctttgtaatgttctagttcagtggcttgtatatattgagatcatgctgagcctagttggcttatcttttgtataatgtcgaaactaatggtttgcttatctgcttgatcgatgctaaacatagtcatattttgaatcttgatcactgatctagacaagccacaggccttaggcacagttgttttagctttgttgcagcaagccagaaggctatcttggtatttcccctggaaaattccttcaactgctatattttggctggaatgctagcttatgctggattgcaggtagaggtgtatttgggcaacaattagatttgggattatcatcacggcattagcattagcataatttagttatcatgtattgtacaccaaatatatttgggatcttgattggaccaaatatattttgggacctagatttaagtctaatctttattttaaagaggcttgtgttggtgggctggttcagtgatatcataatttaacaacagataagcatttgcaaggatcatatgtataatcttattctgcatcgagctacttgtttcaatcggatcaacagctaacatatcattatgaaatcagtggaaccaaagtcttactgctgcacctgtaattgtgccctagcagtccttataatcctaacacctacaatcaactttctagttcaaagcattcaaatgaatgttctttgtgagtcaaacacaaggctgagatgaaacactgtagtattttctaaaaaaaattaagatactaattgtaacataccatctgccgatggcgcactaggtatatgtatatgtttaaactcaatccaagatttccataaagcctacaatacagcttataaaataaacataaaatacctaagggctaggtttgggtggatatgaaaatggaggggatccatgggggagggatccccttgttatt

SEQ ID NO: 11314 - DNA, 997 bp, Zea mays
aactcggcgccccggcctcagaaggcccaataggtggtcactctactacccgaagccgcgggctcaaccctaactgacccagagcgatcggagctgacgacgatggccgggaaggcggcggccgcgacggcggcgaggtgggcggaggggtacccgtggaaggagaagctggcaaagtacaagggtgagctcgggaagggggtgtggggatactgggagctcggcgcgtggaagccgctcggcatcagcgctcgcaagcgcgcccgcctccgcaaggaggtgctcctcgccggcgaggactggagctacgatcctccccgcggggagatgcgtaccaagcgcaagggccacaagtgcgaccgcatctccgccgagaagcgagcaaatactgttgagctgatgaagaagatgccccagatgctgctcgactacaagaaacgtaggtgggagaagaagatgaaagcggaggagagcggcaagaattgataccacgcggctcgtccagggtgcttctcttcctaaataaggtccaaactttatccaggaggtttgcaggacggctagattctgacgcgtcatttccttgtggattccttctctcctgtgatgcgactttggacgcactatcctgattgtgatgctttccaacacttgtgccactggatcgtgatttcagtgagccccaacttctgcagcactagtattttgttgagacaaatcagctataagcatgccatctgcccaataaacttgttcatcatgtaagatcaatgctgttagtttttgtccgagtttgtgcttgcgtttgattacacttacctgcagaagaatgattgtctgaaaagtttgtccttgtgtaataagtgttgaatgttggaaatcctaaccctctcaaggattgggagattaatatatagaattagttggatgggctaggcccattacaataaaaacaaacaaaaaacaaaagggcggcagctcgcgatctagaactagt

SEQ ID NO: 11315 - DNA, 680 bp, Zea mays
tcggaagcgagcaaatactgttgagctgatgaagaagatgccccaagtgcgaccgcatctccgccgagaagcgagcaaatactgttgagctgatgaagaagatgccccagatgctgctcgactacaagaaacgtaggtgggagaagaagatgaaagtggaggagagcggcaagaattgataccacgcggctcgtccagggtgcttctcttcctaaataaggtccaaactttatccaggaggtttgcaggacggctagattctgacgcgtcattcccttggtggattccttctctcctgtgatgcgactttggacgcactatcctgattgtgatgctttccaacacttgtgccactggatcgtgatttcagtgagccccaacttctgcagcactagtattttgttgagacaaatcagctataagcatgccatctgcccaataaacttgttcatcatgtaagatcaatgctgttagtttttgtccgagtttgtgcttgcgtttgcttatacttacctgcagaagaatggttgtctgaaaagtttgtccttctgtaataagtgttgaatgttggaaatcctaaccctctcggggttgggagattaatatatagacttagttggatgggccagcccccttcccaaaaaaaaaaaaaaaaaaaaaaaaaaaaaaaaaaaagagaa

SEQ ID NO: 11316 - DNA, 2162 bp, Zea mays
gcacgagaccattacctagaacatcctaatcgaaaaaccagtgttcaaaaactctgaaaattcccacctctccctccctctctcgcgcgtccgcgcccgcgcccgcggcctcgttcaatccgccagcgctcccccgccccccggtggtagcgggctctacggcagcgctcctctccggttcccctgcgctccgcgtcttcatctgtggcggccgacgctccgtcggtgtctcgtcggacggagcgagcggagctagggttccgtttcatgctcaggatcggcgagatctagggtctcgatttcagggtgattgtactggatagctgctgctgatattgcaagacaatgaaagctcatcagcagcaaggtaatgcatctggcacaggagcaaagaccaaatctggttttgataagatacaaagcctgaaagctggtgcacatatcaacaaatcatcaggcaatgtggctgcaaagcgtagaaaggtctctccttttgaatcacataccaaaagcaagatagcatcaaagactggcagtcttatggaagcgccagcaagtgatgctaagttgtctgctcggccacctaatcactctggaaagatcaaacttcaacttttcccattatatgaaaccattcaagagattatgcagcaagaaaaacacaatccttaccttgaattgactttggctcctcgaaagaagatgtcctcaattttacatcatctgaatacaaaatggggcagttctcagtgtgcaaaaggcgagctcatgctcttccctaatgatactagactggacactataggtggcagtgcaaaatggactcttaaggattcttgcacagctgctgatgtgcatgttgcagttggctgcccttcaacatttcgtttaaggtatggttggtttggacctgatttgaaccaacaaagtagtgaaccatccttggcatcagcgtactctgaagacaagattattggcagcaggcctcctgatcttgttttcaatgaacaaaaacatatggctggttcagatgaatttgcaaatcattttgtgacaccctccattgtggataaaataaatacatcacaaatggcggagaatccaagcaaggtggcacaactttcatggcttgactccatatctaatattagttttggagcactgttatctgaagctgcgccttctcaagacaccaaacaaccaccttcacaaaatagcatttgtctccagcagatccctgccacatgtgattcatttgacgctgctattgcttcactgattgcccgtcagcaaccaagtaaccaaccaaaggtgttaaatccatccctttgggaagccgaagaaacttgccatgcatttcccttccagaatcaaactccacatgcatcaagttcagttcctggcaacagctttgctgctatgacctcatcagtcttgtgtgccattccagaaactggcacagatgatcagcaatgtgctacggatggtaggaaagaggaactaaacagtcaaacatcagtagagggcgatggtattaatgcaaagccagagatttcaatgcaggagtcagctggtgacccagagcgtgaagcatcttgccccagactcttgggtggaaccgacagtataggactaagctctttgctcactgacagcctggatgcgttccagaaattctctgttttctgaagctcagaaatccataaagaacgacgggcttatacaatatgaactaagcggaggtatatattaaccaggtttctgtttcgtgaacagaactaattgttttgggcttcctaagttatttctgtagataaaaccccccatatctgtattgtgaagttttttttattatctctagtttactactgttcttgtttatttgtcgcggtttagtttaaaaatgtactagctgacgacaaatattcgagaacggaggtagtacttggaagaaatatgtattctgaagttgaaatttctttcgctttattttatcttaaggtagcaagtgcctagcctatagtgaggctctgccaactgggctgtcacccagttatatttgtcattgcatcttgctgttaattgaacatttgttctttggaacattgatcggctgtggtattatagtacaaaaaaaaaaaaaaaactggccgttttgctgt

SEQ ID NO: 11317 - DNA, 1832 bp, Zea mays
gcacgagaccattaccgaccctcgaggccggccgggaaggagtgaggaaccagatccttgcttgcattggcggagcagcatcatgccttccacgacagcgcagcagaagccccacgtcgtgctggtgccgttcccggcgcacggccacatcgcgccgcacgtgcagctggcgcgcgccctccgcgcccgcggcgtccacgccacgctcgtccacaccgagctgtaccaccgccgcctgctgcgcaccaagcagcagcaggccacgggcggcgacgacgccctggacccggacgagggcttctccgtcgaggtcatcccggacgggctatcgctggaggacccaccgcgcacgctgcgtgcgtaccacgaggcgatggagcgcaactgcctcgagccgttcaaggcgctgctgcgggacctgctgctgccgcccaccggcgtgccgccggtcagctgcgtcgtggccgacaccccgatgccgttcgcggccgtggcggcgcgcgaggttggcgtcccggacgtgcagttcttcacggcgtccgcgtgcggcctcatgggctacctccagttccaggagctcttggcgagggaggtcatccctcttagacccacctacgagaccgacggctccctcgacgccccgctggactgggtgcccgggatgaaggccgtgcgcctaagggacctgccgacgttctgccacaccacggacgccgacgactggcttgtgcacttccacgtccaccagatgaagacggccgccgcctccaaggccgtcgtcctcaacactctctacgacatggagaaggacgtcgtcgacgcgctcgcgccgcacttgccgcccatctacaccgtcggcccgctcgcaagcgtcgtcaaagcgtccttgcccgctccgcgcggcgccggcgacgacaccagcgtccccgccgccggctcggtgaggagcagcgccatgcttggcgtgttacaggaagacagggagtgcatggcgtggctcgacgacggcaaggcggcgcgctccgtcgtgtacttgagcttcggcagccacgccagcatgagcgacgcgcggctcaaggagatcgcgtccgggctagcacgctgtggctctccctacctctgggtcctcaggccagaaatggccgccgcggtcgaggtcggcgagaacggcctcgtcgtgccgtggtgcgcgcaggaggcggtgctgagccacccggccgtggggctgttcgtcacccactgtgggtggaactccattctggagagcgtcgtcgccggcgtgccggtgcttggatgccccgtgctgtctgagcagaccacgaactgccgccaggtgtgcaccgcgtggggcatcggcgccgagctgccgcaggaagctggcagcgacgaggttgcggcgctcgtgagggagatgatgaccgggaggaaggggaaggacgcaagggagaagacgctgcagtggaagaggctggctcaagtcagtgcacaaccaggggggctatcttacaataatattggtcggatggtggagaatatcctactcaaacacatctgacttcaaatcatggtcatgtttttgtcatagcgactgaggggagaaagatcgtcaataaccaacagctcaaccgtatctccctgatcctatagcactattaaattaaattctgtacctagcattaaaatatctcataccatatagtccaatataaataaatcagttcatattccaccaaaaaaaaaaaaaaaaaaggcggcccaggctcgcgcgacgctgaccgaccagatacggcattttccggtgtatgtgtaggtgtcaaatggccttaatggct

SEQ ID NO: 11318 - DNA, 1588 bp, Zea mays
gatttctatgttcttttcttacaagtgaacagccgttgcccgtcggccgccgcccctccctccgcgccctcccgaccaccgctccttccccgccttccacctgcgctgtccgccagtcctcctccacctcgctccggcacgcagggcccacaagaagcgccccttccagaagttaatccgccccggtttgactagggtttgtcccgtctcctaatcgatcagattggcaggtaactgccgttgccgccgcgatgaagaggtacggactgcagctccgcacgaagccgccatcgtcctcgtcgtcacgcgcgccgccacctcccgcccggcccctggcggccttcgccgacgacgatgacgatgatgtggaggcagaaatcctccgccaggcggccaagaagcgctccctccagaaggttgaggagcagcaaaagaaggccatggaggaggatccctcggtgtacgcctacgacgagctgtacgacgaaatgaaagagaaggaagcccgccctaagatgcaggataaggtcgtccgcgagtcaaagtatattgcacaacttaaggaaaaagcagagctacgcaaacgagaacaagatataatatacgagaggaagcttcagaaagagagaagcaaggaggaccacctttttggggacaaggataaatttgtaacatcagcctacaggaagaaacttgaggagcagcaaaagtggcttgaagaagaaagagtgaggcagcttcgagaagaaaaggaagatgtaactaaaaagaaagacctgagtgatttttactttgggcttgtgaagaatgttgctttcggtgcacagacacatgataacacaaaatctggtcaccctctaaaggcggacaataaacctgaggatacaaatactagtagccttgatgctgaagcctctgaaccttctccaaagcgtagaagagaatccagtatagaatcagagaggactaagagtatggatatggaagagccgtcggcaagtcgaatgagggattcaacagttgctgcatctactgagaaaaatgctgctgatgtttcatcacatgctaaagagatcccacaaaacattcagccagcaaaggttactgatgatcactacaagagaagtgatggcgcacttgctgctgctagagcgcgagcactggcccgaaagaaagcgaaggaccagcaattgtgaagtacaaggcagaaaagtttaccgatccttgaggtacaatttcatgttttattcaataggatcgtgtaaagatgtcatctgaaatgatctgatagctcccttgcactttaagaagcattttttattgtggttgatgtgtatctatgttgtaaaatgacctcatcagatgccatcttctgccagtaactttggtgttttgacacgtcaactggtttgaacttatatggccgtgcaatagactgttttgcactgtagaatgtactgagtttgaaatagaaagtgtgatagtgagatatactgctcagaacatttcatgaaaaaaaaaaaaaaaaatgcagatgtgttatttttatcaagccaatcttaatggatagatgtattttgttgtttgc

SEQ ID NO: 11319 - DNA, 1012 bp, Zea mays
actcctatgggcggtcgggaccctcgacgccggccgggactgtcgctagtcacggaacggaactcatcccgctgtgcgcttcgtttcgtggcggcgaacggccggtcgagcgccgccgcccttggctgggtcttcactcagtccttcgccggcgacgagcgtccacctggtgtctactgaactgagcagacagtagcaagagccactatgctgttcttctcctacttcaaggagctcgtggggaaggaggtgacggtggaactcaagaatgacctggcgatccgcgggacgctccactcggtagaccagtacctcaacatcaagctggaaaacacccgcgttgtcgaccaggacaagtatccccacatgctgtcagtgcggaactgcttcatccggggctcggtggtgcggtacgtgctgctcccgcaggacggcgtggacgtggacatcctgcacgacgccaccaggagggaggcgcgcggaggctgatcggcatcggcatcggcccccctcacctgtgctgcttctcccccggggaggagattgatctgccttgccctgatctcgtctggttgtacgaaacatatgctgatctgagtggccccaactcccccagcacacacttgatccaccacccacccagctccctgcctggtacttgcatgttccttgctgtgtgtgtgtgtgttcagcacacacttgatccaccacccacccagctccctgcctggtacttgcatgttccttgctgtgtgtgtgtgtgttcagcacacacttgatccaccacccacccagctccctgcctggtacttgcatgttccttgctgtttgtgtgtgtgtctgtcagtcagtaatgctgtttgaccaagagggttagcgtaaccgaacaagccctaacggagtaacggacgctgtagcggttgatgaatcacaagagtcccaatgtaagcggggttgaatcccaagaatcccaagggatgtcaatggcgaattacccgtcaggggatggctc

SEQ ID NO: 11320 - DNA, 1477 bp, Zea mays
  misc_feature (1426)..(1437): n is a, c, g, or t
  misc_feature (1440)..(1447): n is a, c, g, or t
gcaagccacaaacccgcaccacggcaccagcgggcagcggccaccctagtcagccagtcggaacgaagccgcgcctcgcgccctcccctcgcgaccaccactgcttccagttctggtgcagtgtggaagagcgcccagtgggagagattcagagagaggcggcgatggcgcggcatttcgtgctgaacaccggcgccaaggtcccctatgttgggctcggcacatggcagtctgaccccggcgtcgtcggcaacgccgtctacgccgccgtcaaggcgggttaccgacacatcgattgtgccagagtttacggaaatgagaaggagattggtttggcgctgaagaagctatttgaagagggtgtagtgaagcgagaagatatgtttatcacctctaagttgtggaatgatcatcatgctcctgaagatgtgcctgaggcactaaatcacagcctgaatgatttgcagcttgagtacctggatctttatcttatccattggccatttagagtcaagaagggagcaaataccagtcctgaaaatttcgttacacctgacatccctgctacttggggggcaatggaaaagttatatgatgctggcaaagctcgtgccattggtgtgagtaacttttcctcaaagaaattgggtgacttgcttgctgtagctcgtgtacctccagccgttgatcaggtggaatgtcatcctggttggcagcaaactaagctccatagcttttgtcagtcaactggtgttcaactgcttactcaccactaggttcacctggtacaacttggatgaatggtaatgtccttaaagaaccaataatcatctcaatagctgagaaactcggaaaaactcctgcacaagtggctctgcgctggaacattcagatgggtcacagtgttcttccaaaaagcacgaatgaagaaaggataaagcaaaaccttgatgtttatgattggtcgattccagatgacttgctcgcaaagttctctgagattaagcaggataggctacttagaggcaacttcattgttaatcctgagagcgcttacaagacccatgaggagctctgggacggtgaactctaggaaggacaccgttgttttatcgtgagcagggagcagcgttccattagggtctgccatatcattttatctcctaatttgcgctttatctgaaatgaaggttcagtgctcggaagctctgatgccatcctttatcgcgaactggttcgggaatttgtcagcggtctacttgtcctacgggatgtgtgctgctgcagcaacagctgcagcctagtgtcgcttgattttctggtaactgtgaccaaagcagttagttcgccaggcattatttttgtcactatttttgtacgctccactgattctcacttgatgaacgtgctaacttgcgtgtcctannnnnnnnnnnngannnnnnnnaaaaaaactcgagggggggcccggtacccc

SEQ ID NO: 11321 - DNA, 1620 bp, Zea mays
attgggacctcgagccggcgaagccacttggcgcacgcgctgacgcgcacccgcaccagcctctagtcggccagtcgggacgaagcctctcgaacgagcgaggccacgaggtgcccgccgcgcccagccggcctcgccgaccgggcccgccggcccctatataggcaggcgccacttcctcctcgcaaccaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggcgggttaccgacatatcgattgtgccagagtttacggcaacgaaaaggagattggtttggcgctgaagaagctatttgaagagggtgtagtgaagcgagaagatctgtttatcacctctaagctatggaatgatcatcatgctcctgaagatgtgcctgaggcactaaatgacagcctgaatgatttgcagcttgagtacctggatctttatcttatccattggccatttagagtcaagaagggaacaaataccagccctgaaaattttgttacacctgacttccctgctacttggggggcaatggaaaagttatatgatgctggcaaagctcgcgctattggtgtgagtaacttctcctcaaagaaattgggtgacttgcttgctgtagctcgtgtacctccagctgttgatcaggtggaatgtcatcctggttggcagcaaactaagctccatagcttttgtcagtcaactggtgttcatctaactgcttactcaccactaggttcacctggtacaacttggatgaatggtaatgtccttaaagaaccaataatcatctcaatagctgagaaactcgggaaaacttctgcacaagtggctctgcgctggaacattcagatgggtcacagtgttcttccaaagagcacgaatgaagaaaggataaagcaaaaccttgatgtttatgattggtcaattccagatgacttgcttgcaaagttctctgagattaagcaggctaggctacttagaggcaacttcattgtgaatccagagagcgtttacaagacccatgaggagctctgggatggtgaactttaggaaggacgccgttgtccgtcctgactcctgagcagggagcaagcagcgttccattagggcccgtcagatcatttcacctccaaagttgctcttttgaaatgaaggttcagtgctcggaagctctggtgccatcctgtatcacgaactattgagaaatttgtcggtgattttactttgtgctacgggatgtgctgctgcagtctatcctagtgtcagttgatttttctggtaaaactgtgaccaaataagttaattcgccaggcatcattactattggaatttcatcgttttatctcctcactattttttatgctccatgtattctctatgatgagaccatgttgagtagttcactcatataatcacataaaacactgttttacattatcaacagagtaagctgctgaacgtgctaagtgccg

SEQ ID NO: 11322 - DNA, 5291 bp, Zea mays
ctcgtaattgcttactagtagtattgtttatgctttagctgtgtgactggagctattcaactctcactcacccatgtcatcccgaggacctgcgttctgtcagttgaacatacatgtcgcaattttttcggtgctcaaatgtttcggtgctactacggttgggccccgtgtgctcatggattacctgtcagatccatcgtacgttaggcaacttaataagctcttcctctgtcgtgcaccctcatcgttcttgaatggcagctaaaacgtcgtttcggagttagctttattgctcagtgattattggttatgcttgctagcctgacggaagacatgtgcgtgccaacccctacgccacgcctttttttttcttcgtttctggaaggaagtctcattcttggctgctgcatttccttttcctttcctttttcttttttgttgttgctgaaatggttgtaaccttgggcctgggggcgttgcgctgttctcctcagcctccagctcgtaacggccaaacagacatgacgtgccagagacctaacgctgatggtgactgactgctacggtggttctttcacatgaactgccaccatattatacctgtaggtcttctctaatgcatgcggcagttccggtcggcgtgtgcccgcgtcttttgccttcgatgtgcgagtgctatcgattttttttttgacagacgtgacctggctgttcatgtgaaaggtactcccagcccaagctgttgtgttgtgtcctccctaagcaacgtgaccctctcctttaatttcttgctgatgcaaactgcgatggttttcgctccttgtttactccaacttttttttttgttttcctcaggtattcggacggcgggtgctgctcttgtccccactccacccccctctttttttttttctaccaaacgtgctttttgcttgttaagcaaccgcggcctattccctcgagatcttaatgagcggagcggatcagcggagggtgtgtgatcgtgaagccatgccgctccttttccttttgctggagcggtggccgccgatcgagtaaggcgtcgcggtcgcggcggcaggttggaggcagcgtttgcgttgatgcctgatggcaggctggctggaccagtggagaaaataataataattaaaaaaaggacgcatctgtccctcgcagcacctgatctgtctacatttctacaacagacaacacaaccacggaaggggcgtgctgcatccatggccatgcatgatccatgcatggtgtgtgatgtgatggagaccgtgggactcatgccgtctgcgctcacagcctccggactgggcaacgacgatacgataccatcaaattcgttggcagccccactgataccacgtgattaaccagctaaatttaatcattccaacgtgtacatttctgctctaatacggtgactatctccagtagactccctgtcctactatacaaacagtataatctccagtgctacgcgtaccggagatggatggcctgtatagtctaccgtctcctactctcctaccaaaacataagtctcaccaaaaaaaaaaaaggaccaaccgacggatctgcaaagcaaacacggtcccgtcctgaatggccccacgtcctggatgattctcctggtagtacgctggttaggctccccaccaacacgccgacgaaggccgaacccccgccttggtcaaacgaaccacgtggtgggctagagagtggagacccaataggaagcacggatcccaaacgtggaccagcgaccgacgcacgcaccgacgaaaaatggcccacgacctaacgaaactatttacacaaatctcccaaaatgtatcgaccgaggcagcagtagtatcgtcaccaaggaagagggccgaagggcggaggaaggcgggtataaaatttggcgggttctcggttccgccggcgaagcgtttacttcttcggccgcgatctcgaggagggagggagcgagcgagcgggaagaaagaggggggcgcgcgcgcgcccatgttttgacctcgcccggcgtcgtctcggcagcgatctagatctgaggtcagttccctcccctcccctgatctccgcgctcgtcactccttaacccactcctcggccacagatccaggcgtgtctgtcactagggcttgggatttcatttcttcatccgttggtaagggagggagcactggtttgcctagactagatgcatgcccgttttgttccgcaggatcgtttcttactttctttgttgtggttcctgcgccctgaacacgacgagtacttgattctggcatggatgtgctcccgatccacaaagctggattcgtttgctgcgtttagatccactccgtttgaattgacgttgtctccgccattattcatgcggtggagcaacatgtcttccccccttttttttctgttatagcagtttattttcagaagtttctggcttctgggttctaccgaacctatgccacatgttaatttaatcctggagttttatcttttttattatcccgtatatcttgatatctccacgggaaaacggagactggaaggggaaaagagagagagagagagaggcaatcttaagaatcgaattgatttattattctatgatttttttttgcaggttctgaggttcttgattgaccgcccgcccggcctgtcactgcaatggtcgccaagatgttgccatgctcatggatctcggcgtgcgtgctcgtgctgctcttgagcctgcacccgcgtgtccatgccttctacctccccggcaccttcatgcacacctactcccctggagaggtgatctcggccaaggtcaactcgctcacctctatcgagaccgagctgcccttcagctactacagcctgccatactgcaagcctctggatggcgtcaagaagagtgccgagaaccttggtgagatcctcatgggtgaccagatcgacaactctccataccgcttccaagttaatgtcaatgagtcagtattcctttgcaccacggacccgctcaccaaggagcaggccgagctgctcaagaggagggcacgagatctgtaccaggtcaacatggtcctggacaatttacccggtcatgcggttcaccgagcagaacggcgtgataatccagtggactgggttcccggttgggtacaacccgatagggagcaatgaggattatatcattaaccacctcaagttcagagtcttggtccatcagtaccaggcgcagggcgatgttgtggtcacgagtgaggatggtgttgcaatggtagagtctgatcgcaagagtgggttccagattgttgggtttgaggtcgtgccttgcagcgtaagacgtgatcctgagtccatgtccaagctcaagatgtatgacaaggtcgactctgtgaattgcccgttggagcttgagaaatctcaggcgatccgtgagaatgagcggatcacatttacctatgaggttgagtatgtcaagagcaacatcaagtggccgtccaggtgggatgcgtatctgaagatggatggtgccaaggtccactggttctcgatcatgaactcgatgatggttgtcttcttcctggctggtattgtgtttgtcatattcttgaggacggttcgaagggatctaacaaggtatgaggagatggacaaggaggcacaagctcagatgaacgaggagctctcaggatggaaacttgttgttggggatgtcttcagagagcccagctttccaaagttgctgtgcgttatggtcgctgatggtatccagatcactggtatggcagttgttacaattgtgtttgctgccctgggatttctctcacctgcttccaggggaatgctcctgaccggaatgatcattctctacctcttccttggtatcattgctggatacgttggtgtccgtgtctggaggactatcaagggaacctcggaagggtggaaatctgttgcttggctgactgcatgcttcttccccgggattgtgttcatcatcctcactgtgcttaactccattctgtggggcaagaagagcactggagctctacccatctcactgttcttcaccctcctggccctgtggttctgcatctctgtgccactcacacttattggaggcttgctaggcacacgtgctgcaagcatcgactaccctgtccgaaccaaccagatcccacgagagatccctgagcgcaagttcccctcatggttgcttgtgctcggtgcgggaacattgccatttggtactctcttcattgagctcttcttcatcctttccagcatttggttgggaagattctactatgtgtttggcttcctgttcattgtcctcttcctgctggtcatagtctgtggtgaggtttctctggtcctgacctacatgcacctttgcgtggaggactggaaatggtggtggaaggccttctttgcttctggctctgtcgcattctatgtgttcctctactctattaactacctggtgttcgatctcaggagcctgagcggaccagtttctgccacactctaccttggctattccctgatcatggcccttgcaatcatgctctccactggcgccattggtttcctgctctccttctacttcgtccactacctcttctcgtctgttaagattgattagaggtgtgccccgctgcctctttctgcaatagagtcatctgatcatggtaatagttaccctcttagaaatactacacaataaatcaaatggaaaaaatggatacatggcaacgcccatggcttttggtcatgattaattcaatcatttagcgcagcacagtcactcaagttgaaacttaattcttaggaatgattgtaagttcttcagctatgtttattgcactttgtaataccattcagttttgcttgctctgggcatttgtgagcagcctttggttttggaacacttgagatctattcaatatgaaaatgaagctattcatttacagttcgttactaaaaaaacaagataaaaaaaaaaaattaagacaatattgtagccgtccacaacactgttggtgcacagttctttcgaggtctctctgccatcaacgtcgatccgccccaccctcctccccatgccgtcgaggacctcctaccccttagctccacgattacggggatccgaggccgccatcaacgccctcctccccacaccatcgatggcgcgcgcaggcaacaccgcccatgatcctcggctgatcctcgccatcaacgcgtaggcaacaccatcgatgaacaccgcc

SEQ ID NO: 11323 - DNA, 1524 bp, Zea mays
  misc_feature (941)..(941): n is a, c, g, or t
gggtacctcgaggccggccggggaccattctcccaaatgtatcgaccgaggcagcagtagtatcgtcaccaaggaagagggccgaagggcggaggaaggcgggtataaaatttggcgggttgccggcccggccggggaagcgtttacttcttcggccgcgatctcgaggagggagggagggagcgggaagaaagaggggggcgcgcgcgcgcccatgttttgacctcgcccggcgtcgtctcggcagcgatctagatctgaggttgtgaggttcttgattgcgcggtcacaagacctgtcactgcaatggtcgccaagatgttgccatgctcatggatctcggcgtgcgtgctcgtgctgctcttgagcctgcacccgcgtgtccatgccttctacctccccggcaccttcatgcacacctactcccctggagaggtgatctcggccaaggtcaactcgctcacctctatcgagaccgagctgcccttcagctactacagcctgccatactgcaagcctctggatggcgtcaagaagagtgctgagaaccttggtgagatcctcatgggtgaccagatcgacaactctccataccgcttccaagttaatgtcaatgagtcagtattcctttgcaccacggacccgctcaccaaggagcaggccgagctgctcaagaggagggcacgagatctgtaccaggtcaacatggtcctggacaatttaccggtcatgcggttcaccgagcagaacggcgtgataatccagtggactgggttcccggttgggtacaacccgatagggagcaatgaggattatatcattaaccacctcaagttcagagtcttggtccatcagtaccaggcgcagggcgatgttgtggtcacgagtgaggatggtgttgcaatggtagagtctgatcgcaagagtgggttccagattgnttggggtttgaggtcgtgccttgcagcgtaagacgtgatcctgagtccatgtccaagctcaagatgtatgacaaggccgactctgtgaattgcccgttggagcttgagaaatctcaggcgaatccgtgagaatgagcggaatcacatttacctatgaggttgagtatgtcaagagcaaacatcaactggtcgtcgaggtgggatgcatatctgaagatggatggtgccaaggtccactggttctcgatcatgaactcgatgatggttgtcttcttcccggctggtatcgtgtttgtcatattcttgaggacggttcgaagggatcttacaaggtataaggatatggacaagaaggcacaagctcagatgaacgaggagctcttaggatggaaacttgttattggggatgtcttcagagagcccagctgttatggtcgcttataacaccctgaatttggagtataaaatttcttttcttatatccaccaaattcgggtgtttctttttctttctttccttttcttttgcctaaatggtggagaaatattttgttttgtatctatgtgtaagtgtgtaagcatag

SEQ ID NO: 11324 - DNA, 793 bp, Zea mays
aattttttcttctagtggagtttgtatctaccaatgagattctagggctacaaataatctttaatcattattttacaagcctctttactatgtaactaggttattatatggacttactaatggaagttcctaacatacaatacattcccaacacaaaactcaaaacatttacgagtagcgtacattgaattatggagggtcaaagatgttagaaagaaaaaagatgaaaaagaaaaggaaaaaagataatatggacttttatttgcgaaggcacagccgccgccattacttcatcttcctcgcagcgccggcgccccatcctgcggccctcgtgatcgggctctcagcgacggcgtcagcggcttccccttccgcctctcgccagtcgcctcgcaccctcgcctccggccctccacacaccggcctgcgaccttgcgtgcctgcctctctctctctcctccttccggtggaacggcgccaggctgcgccgcgcgcgccttgagggtagcgggagccaacagccgctgctccaccaaggcggtcgcgccgctttgggagcgcttatgccccaaagcgaagcgtcacccgtccgcttagcgcgctgaagcgcgcgcttagtgccgcttcttggaaccctaacggctgtacctggcaaaaagagggcaattattgtgtgtgcaacagagcacatgcagaaagatctgattcaagtgtggaaactttgtgagacggctatcttttttttcaaagtcagcgtcttttcgggtaggttatagcgaaaaaaaaaaaaaaa

SEQ ID NO: 11325 - DNA, 2159 bp, Zea mays
ctggccgggtgatgttctgtggcagaggccggccgggccccttggtctagaaccccaggcattactccctgtgagtacccttggtgaccatgatttttggccaggtcaatttgtcctagaaaaactgactgtagaagatgctgcaagatgtccgcgaacggcaatagtgagtgatgtggatgcactggagcgaacagtaaatgtaaaatggattggtccagcacatagtgacattgtcagctatggaagtgaccctgcagtggagactgtaagtgtttatgagctagtagagcacccagatttctccttctgcactggcgaggtcgttatcaggtcagctatgaacatagacaagtctgaagcagatcccacaaatgggtcattggcaagcaaagaatcattggttacctcctctggcttcttatcatgcaccggaaatgtacttgggtacaaggacaatggaattgaagtgcaatgggctaatggtgttatatccaaggtgcaacattttgagataattggattggacaagcttcttgataatagttctgtagaatcaatgaatgaggaacatacaattggtgattcattagacgaggctgagcaggaggaattgaaccatgagattgctctggagtctactgaagactgcactggctccttgtgcaaagccactgcttttctatttcccaagacagcttttgacttcctgacaaatgtggctgctagtttgtttggtattcatggttctccatctccaagctcagttttggtagatcctcgatatgaaattgtgaagatggcagaaatgcagccatgtgcagaagaaacaccaaaagaagaacagatagtgaagtttgtggcgcagattgacaagccaattctctcttcagaagatgccatctcaaaaagattcgatgtagtcactgactgtttggatcatcattttgtgaaggaaaatggccatgaaagtgttacaagaggttggttgaagaaggtgcgactggaatggaacatcctgcaaaatgacctaccagatggtattcatgtgagagtttatgaggaaaggatggatcttctgagggcttgcatcgttggggcacctggaacaccttaccatgacaatctttttttcttcgatattttctttcctcctgattacccccatgaaccaccttctgttcactatcactctggtggtctccgcctgaatccaaatctgtatgagtcgggaaaagtgtgcctcagcctcctgaagacatggacaggcactggtaacgaagtgtggaatgctgaaagctcaactgttcttcagctgctgttatcgcttcaggcccttgttctcaacgaaaaaccttacttcaacgaggcgggatacgacaaatttgtgggcaaggctgatggagagaagaactccatcacgtacaatgagaatgccttccttctgtcatgcaaatccatgatgtatgttttacgcaagcctccaaagcattttgagacgttggtcaaggagcatttcacctgccgtgccccgcacatcgtggatgcctgcgaggcttatcttgggggcgatctcgtcggacacgcgcacgacaaagcatacgtagcagaggacggcaacaagaactgctcaaccggtttcaagataatgcttggtaagcttctgccgaagcttgttactgccttctgtgaggccggtatcaccagcgacccgtaaaaccagcgcaagcctgctctctgctgcatcagcaatggaattgggacccttctttatattgcgcgtgtatattcgatgcttgtgtattccaaataaaatggcgcctggtttgtgtgttacttgtgcctgtcttgtaaatgtgaaacagtattcacagatgattgctgaactgatatgcttggtcttgtaaatgcggaacggtatgtacgcatgattgctggtgtttatgttgctaagctgaaggcagctaaacactcaagtgtttgggtttgggctgtcttctgcggtcagtgtgaaataaaatgtaaatgtgtgttgttcaatcgttttggactattggcatagcagctgtggattaaaatatacccgcccctgcggccatgtgaaatcgaaggcatgaaatccaaaaaaaaaaaaaaaaagggcggccccgactagtagc

SEQ ID NO: 11326 - DNA, 3351 bp, Zea mays
  misc_feature (1308)..(1308): n is a, c, g, or t
  misc_feature (1470)..(1470): n is a, c, g, or t
  misc_feature (1631)..(1631): n is a, c, g, or t
  misc_feature (2372)..(2372): n is a, c, g, or t
cagggcgatgcctattatgaatgttatataaatgttaaaattatctgtttctttcagctgaatgctttttctgatgaactgttatacttcaaaggggtgtaatggaggcatgtagtgatgacatccatatatcttgtaggcagtagaaaatatgatacattgggttccagtaataaaaaccaaaaaaatgttactcccctctttcgaactgcaagttgtttgtgctttttatagatacattgtttttactacattcctagacaccgtgaatatctagatgtatagcaaaaattatgtacctaaaaggtcaaaatgactttttttttgaaatggaggaattacatcttaaagctgcaatgagaaagagaagatttagcctttgcaatgtctagctctgcggttggtggtccaatcacggttcaatgcatgttctcttgtaccctgcaagcatgcttgtgcatatggtcgtactatagactgcactgtttacagagtgaaatttgaaataagatatgatgatgagtaagctgatggaggatctgagcaggcgttcattgctagtgggagtgaagattcacaggtctacatatggcatagagccactggtgatctcattgagactctcgctggtcactcgggcacagtcaactgcgtaagttggaatcctgtgaatccccacatgctcgcatcagcgagcgacgatcacacagttcgtatatggggggcaaaggtcagtcttaagcgcaaggatgttgggagcagcaattgcaacagtaacgggttccaccactcgaatggaaatgcacatggcaatggtttcgctcaccagtgcaacgggaacagcaccaaatgatttgccaaggcaatgtacccccatggatggttgactggcatctgtaaatccccctttacttccctcctagaacaagagtcgccgccgaaatagtaaaagaaaagaaaagcaaaaaagaaagctgcagcacaaagtgtgggcaacctgctgggtttcgtgcgccatctttcccttgttctatcatgacagccatcacatttatttcttaattcaagatgggatggaattatgatattactttgcgtctttgatatcttgatttatcctccctgattgattgtaacttcattttgatggtggtgatggttaactctgattgctgtctaaacaaccggacggaacttatcataaatttaagtaaaatcagtcatctagttcaagggatcaaaaaaaaaaaaaaactgccatattattccctataagaaaatatctagtgtaaatggaaatttagatgntttctcatatcaaatatctaagactatcttcaggagcttatccatacctatcatacctatactcatatggatgaaatgttggccacagtctaaacccatcttacctatatccatattcaaatactattatgtgatcgttatagtttacaatataagatagtnttttgggtgaggatatggatgaactgttggccacagtctaaacccatcttacctatacccatattcaaatactactctgcgatcgttgcggtttagaatataaaatagtattttgggtgagtatatggataaactgttggccacagtctaacgagtgtttncaccattggtcttctttaaaaataatatattgaccttttaagacttgtattttaagatatggaaccccttcgaatataaaacttgcatttcaagatggaggttagggaataatgaaaccccccccatccgcaatttttacagggaaaggtaacttcctctatgcattgttataaggaaagtttacgattatagatggctaaacatactgtctaagagcatctccaggagactagatataaaccctatctaaatttagagtactgagagctataaaaaagatagataagtttttaatggtggatgtatccaacaaactcagcaaatatagataatgacctgtaaaatctcaactacccaacacatactattcatttttgttagcgcatgaagtttcgtcgacggacgacgtattttggcacatcaagtaaatcaatgttccagcgcatgggctctttctgaattggtcgccgtcacgcacaacaccatctcatcgtgcgccagacacaacacttggacggtgtcatcacgacatcaaatgtgacatcgactatagaagcatcgtcccttgatcctccctagccgagcttagattatttttcccattgatcctagcaatatggagcagacacgcttgtctggaaagatatgcatatccctgtgtaaccatcacaagtatcattatgtaactagatgcatccacttccagataaccttggcaaaagtcggtcgactaggagtancagtggacaatttgccttaaaaaagtgaacactgacagcatctttggacatcaatataatacatcaaacgtatatgcactgcaaagtagttcaaacatatatatgaacatgtaactgcatatgtaaacatataactttgcaccgcacaaaagaaactagcggaccctgttggcagtcagattacgcacatatgcgcagcaaattctggtaacagagaaatctggtaacttccaatcgagttatctgcctgactgcctctagttccaccctgcctgggagaattgaggaacacgacgcatctctgcaggtctagtcgacgtcccaacgtttccactcaccgttgaacgggcttgctacggtctgaacatggacaaatgtcggcaatgaaagcgtgcggcggcagggttgaacacggtgttaataatttcagaatatcgcgggcgcaggagcgagagggcacgagagtgggaaggcgcatgggagggcgcgagagcgcggggagggcaggagagcacgacagcgagcttggattccgcgggagggcagaagaatgcgcgggagatcgcgcgagagggtgcgcgggcgggtgatggcgagtcagcgtacctcgacaaaaatggctagcgatggggacgcgatggcgagggagatggagtagcgaggttgatggcgacactgttggatctgattttcggggacatttttattttttctaccgagcacaggtgcttaaacgaggctattggagctgctctaacgccatcttcagcaacccatccataaatattgctttgtactatagattgcactgtttgtagagtggagattgaaatatagagtctgctggagatagtctaactcggcatggtctcttaaaagcaaaactcaacaaggtcggattaggtacatggatggcaacaggtttaaaacccgtgagtagatggatcgcaaactagcaccccgcgagtttaatattaaa

SEQ ID NO: 11327 - DNA, 1938 bp, Zea mays
  misc_feature (11)..(11): n is a, c, g, or t
  misc_feature (932)..(932): n is a, c, g, or t
  misc_feature (939)..(939): n is a, c, g, or t
gggtacctcgnagccggccgggctatggttggttccaagggtgttattaagaaggaggaatttgttaggataatcagcaaaactctgtatagtcttggatatgagaaaagtggagcagttctggaagaggaatcagggattactttacataaccctatggtgaatcttttcagagagcaggtgattgatgggaattgggataatgcggttgttaccttgaataagattggccttcaagatgtaaacatcatgaaatctgcggcatttttgatattggagcagaaattctttgaacttctaagaaatgacaatgtcatgggcgctatgaagactttacgacgtgagatcacaccccttggtgtgaatagaaaaagagtgcatgaactgtcgacttgtatgatttcttgttctccacagcagttgttccttgggttttcaaaacttggcattgattcttctagttcaaggtttaagcttctagaggaattgcaaaaggtgctccctccaactgttatggtgccagagaggaggttagaaaatttagttgagcaagcacttactgtacaaagagatgcttgctacttccataattctgttgatgggttgtcactttacattgatcatcattgcgggaaagatcagctaccatctcgcacgttacaggttttgcatgcacatcatgatgaagtgtggtttgtccaattttcaaacaatgggaagtatttagcctcagcgtcaaatgataaatctgcaattatatgggaggttaatgaagatggagagctattactgaggcatacattgagtggtcatcaaaagtcagtgatgatggttgcatggagttcagatgattgccagctcctcacatgtgggcaggaggaagccatcagacgctgggatgttaaatctggcaaatgtcttcatgtttatgnacatccnggcattgcctcgaggccggccgcgtggtttcgagatggaaagcaaatattgtctggtctagctgatcaaaccttttgcatttgggatttagatggtaaggaagtagattgctggaaagggcagagatcggcaacaacatctgattttgctgtagcaaaagatggaaatcttataataagctacctagaacatcctaatcgaaaactatttgatagggagacaaaacatgagagaataattgaagagggtagtacaattacttcattttctctatcagaagatggtgatttcctgcttgtaaatcttgtaagtgaagagattcatttgtggaacataagaaatgatcctgttcgagtcaaccgatacaatggccataagcacagccggtttgtgataaggtcttgttttggcggatctgagcaggcgttcattgctagtgggagtgaagattcacaggtctacatatggcatagagccactggtgatctcattgagactctcgctggtcactcgggcacagtcaactgcgtaagttggaatcctgtgaatccccacatgctcgcatcagcgagcgacgatcacacagttcgtatatggggggcaaaggtcagtcttaagcgcaaggatgttgggagcagcaattgcaacagtaacgggttccaccactcgaatggaaatgcacatggcaatggtttcgctcaccagtgcaacgggaacagcaccaaatgatttgccaaggcaatgtacccccatggatggttgactggcatctgtaaatccccctttacttccctcctagaacaagagtcgccgccgaaatagtaaaagaaaagaaaagcaaaaaagaaagctgcagcacaaagtgtgggcaacctgctgggtttcgtgcgccatctttcccttgttctatcatgacagccatcacatttatttcttaattcaagatgggatggaattatgatattactttgcgtctttgatatcttgatttatcctccc

SEQ ID NO: 11328 - DNA, 2031 bp, Zea mays
  misc_feature (8)..(8): n is a, c, g, or t
  misc_feature (2002)..(2002): n is a, c, g, or t
ggggaaanagttatggttggttccaaggtgttattaagaaggccgaatttgttaggataatcaccaaaactctgtatagtcttggatatgaaaaaagtggagcagttctggaggaggaatcagggattattttacataaccctatggtgaaacttttcagagaacaggtgattgatggaaattgggataatgcggtggttaccatgaatacaattggccttcaagatgaaaacatcttgaaatctgcggcatttttgatattggagcaaaaattctttgaacttctaaaaaatgacaatgtcatgggtgctatgaagactttacgatgtgagatcacaccccttggtgttaatagaaaaagagtgcatgaactgtcgacttgtatgatttcttgttcttcacagcagttgttccttggtttttcaaagcttggaattgattcttctagttcacggttgaagcttctagaggaattgcagaaggtgcttcctccagctgttatggtgccagagaggaggttagaaaatttagttgagcaagcacttactgtgcaaagagatgcttgctatttccataattctgttgatgggttgtcactttacattgatcatcactgtgggaaagatcagataccatcttgcacgctacaggttttgcgtgcacatcacgatgaagtgtggtttattcaattctcaaataatggaaagtatttagcctcagcgtcaaatgataaatctgcaattatatgggaggttgatgaggatggagagctattactgaggcatacattgagtggccatcaaaagtcagtgatgatggttgcatggagccctgatgattgtcagctcctcacatgtgggcaggaagaaaccatccgacgctgggatgttaaatctggcaaatgtcttcatgtttacgagaagtctgccactggtttgatatcatgtgcttggttcccagatggaaagcaattatctggtttagctgatcaaaacttttgcatttgggatttagatggtaaggaagtagattgctggaaagggcagggatcaacaggaacatctgattttgctgtagcaaaagatggaaaccttataataagcatgagcaagcagaacacaattcttctatttgatagggagacaaaacaggagagaataattgaagagggtagtacaattacttcattttgtctatcagaagacggtgatttcctgcttgtaaatcttgtaagcgaagagattcatttgtggaacataagaaatgatcctgttcgtgtcaaccggtacaatggtcataagcgcacccggtttgtgataaggtcttgttttggcggatttgagcaggcgttcattgctagtgggagtgaagattcacaggtctacatatggcatagagccactggcgatctcattgagactcttgctggtcactcgggcacagtcaactgcgtcagttggaatcctgcgaatccccacatgctcgcctcagcgagcgacgatcacacagttcgtatatggggggcaaagaagtccagtcttaagcgcaaggatgttgggagcagcaattgcaacagtaacggttctcgctcgaatggcaatgcacataacaacgttttcgttcaaaagtgcaacgggaacaacaccaaatgatttgccagggcaatgtatccccatggatggttgactggcgtctgtaaatccccctgtcctttacttccctcgtggaagaagaatcgccaccgccatagttaagacaacaacaacaaagctgcagcacaaagtgtggggaacctgctaggtttcgtgcgctatctttcccttgttccttcatgactgtcatcacatgtatttcttaattcaagctgggatggaattatggtattactttgcatctttgatatcttgatttgccctctctgattgattgtaaaaaaaaaaaaaaaatgatggttgttaactcctcttatctcgagggggggcccggtacccaattcgtgttnaacacaataaagttggaactggaggggtg

SEQ ID NO: 11329 - DNA, 1469 bp, Zea mays
agaacttgagctttccgcatcctccgaccgagacgaggcagaaaccttcctcgatctccccttccccttccctcgctgtaattccatctccgtctccatctcgttcccaccacgccgctccctgtcgcggtgtcgccattgccccggcttccaagcaaaatcccgcttgcctcgccccaagcattcctgctttcacccggccgccactcttccccagtccccgccactcaaggaaggcggaggattttatctagtcttgcagcgcggccgtctccgtcccgccttctgcgcctcctgtggcgtttggagcatcttccaattttaagctgacactacttgaacttaatgcggctctacgcacctgcgctctgtctgctgcgatcaagcacacatccccaccctaatcagttccgtgcaggattcacgcagagcatggcctcctggaagtgctcgcactcgccgtcaagcccgtaccttgcgaagtcgggtttagtcgattcttctcttaacaggaatgtaaagtcttctcagccacaaagtataaaatactttgtcagcttaatgggccagcagttccgttgcggattgtcaaccagggagggtagcctaagtgtaaagcttgacattccttcacacgaaaaatcaaggataggctggaactggaaaaacatgcatcaaaagataggaggtgtagctggtggactctgctttggtttctcggttactggagtagcaagtgccgaggttcctatcattagagtcaaagacaatgccgagacttcgtcatcatctaccagttcaactcatggaaaggaagtgtacacagattattctgtcacaggtattcctggagatggaaggtgtttattccgctccgtggtgcatggtgcatgcattagatcagggagaccaatacctaacgaagatcttcagagaaaactagctgatgaattgagagcaacggtcgcagatgaatttgtcaagaggcggaaagagaccgaatggttcgttgagggggattttgatacatatgtatcccatattagggagccacatgtgtggggaggcgagccagaattgttcatggcgtcccatgttcttcagatgccaataacggtttacatgcgcgacgaggatgctggcggtctgatagcaatcgcagagtatggccagcagtatggtaaagaagacccaatccaagtcctgtatcatggttttggccattacgacgctctacagatcccagcaaaggttggatcgaagaggaaactgtagacgctgcgcgccgcgagcttgaggtacgctccttgttccagtgtttatacaaccttgtcgaacactcatgctatatgcatgcgagtgtggaagaagacaagcttaacatgaaatggcgttaactcgccgccatgcataaatgttatttacatgattcatgtacttccccaggagcagatgagttggaacacttc

SEQ ID NO: 11330 - DNA, 1602 bp, Zea mays
  misc_feature (142)..(142): n is a, c, g, or t
  misc_feature (1043)..(1043): n is a, c, g, or t
gtatgttccaaaatgttcctggggccttttagaacttacccaaacgctgaaaccactcaaggttattttcttccaaattatgccctactcacttagttttgagttgtttctcacttgagtcttccatgtttattctcatgancctgtgaccatacacttagcaaaatagttacttcatattgttatgatgagcatcaaacaccaaaaaacatataaatgacttaaagcccattctcctttcacttctggttcctcaacgggctacggctaatgcggcaccaacattgaacgaccaaaaacagtgttagatggtctagatctagatttagatgatgaaatagagagaagaaggtaaaggagaatacttcgcctgcgtagctggattactggggtcgcctgtgaggaaccaccgaatatcaaaactgatttagtctaaaacaaattatacttttgggatagagagaatatttgacacactggttaaccttaagtacttgacgcactggttaaccttaggcccaaccgcccaagcatccacataagaattttgtagaaacgtaagggccaggatagcccagcaaccctcgaacgggcccggcccatgtgaatcgtaccgtggcgcaaccccgcttgtccgtccgtgctctcgttgggtagtaggttggcgaatcctccagaacttgagctttccgcatcctccgaccgagacgaggcagaaaccttcctcgatctccccttccccttccctcgctgtaattccatctccgtctccatctcgttcccaccacgccgctccctgtcgcggtgtcgccattgccccggctccaagcaaaatcccgcttgcctcgccccaagcattcctgctttcacccggccgccactcttccccagtccccgccactcaaggaaggcggaggattttatctagtcttgcagcgcggccgtctccgtcccgccgtctgcgcctcctgtggcgtttggggcatcttccaattccaaggattcactcagagcatggcctcctgttaagctgacactaggtnttaggtatttctcatttgggctcaccatgttatgaaagagcggaggtattgcgcactgctcgttagtagcaattatactgtgtatgcataatgcatctcgttcgttagcttgtcatatcgcgtctgcgacgactgacgaagccatggattcgcgctgtggattcatgccatcgaataacggttcaccctgtaaaagggttcacccgagaatgtgatgttatctgaatgactggatccggcggacacctctttcggcgatccgtggcttcccttgcgccccatgttttctcaagatttgcgttagttgactactctagtctagactgagggcaagtaaagaataaaaccatatgtgttgcgttgtttagtactttagtaggcaaccaccatataagaaggcaggatttgcgttgctcagtgtggcttcctgaatgtgaagcgagtcgtgcagtcgacaacgttgctgtttctgttgtcattgtcttggtgacgccgatatcctgcgctcttgtggataatttcaaggttcaagacacactatataaattgttgttgccgg

SEQ ID NO: 11331 - DNA, 2836 bp, Zea mays
cgagttctctgcttttgagtagcttgatgagtcttcggtgaatcaaataacaagacaagacacagattcagacttattttccaagcagtcctatgaacatattctctctaggacagcaatactcattccaagaataaacacaaatagagctaacaatttcccacaaaagtaagcatgttacatacgatgacaatctctccaagacaacagaccacaatcacgggaacaaactggcaggtacaagttacacacagtcacccccacactattttgtgttgagttaccattccattgctgaagaggagagcaatcactggctctcttcatcttcgtcttccgcatcctcctgggcttccttgtccgagtcgctgccgttgtcatcgcccccggtggggcttgtgctgttctggtaatgcgcctgctgcggggcatgctggtgcctgctgcccttgatgcggtaccgaacgcggtgattgctgctggtggcgacctcggcggtcacgcccgctctccgcgtgccgttgccgtccgtagggatcgggacggccatgggcgtgggcgtggcggtggccgcgccgcccgtggccttggagagctccatctgcatcttgaggaagaactgcacgcgctgctcctccagctgccgggcggagtccaggcgctcccgctccatccggagttcctggtccctcttggcgctctccacgcgctcgtacacctcccctagccgccggatcgcctgcgccagctcgcgcagaccctgcgcgcggctgacgctgctctccgcgccgttgtccgcggcggcggcggcgggctcctccacgcgctgcctcttgccgttcgccaccgcggacggcgggaacccgtcggaggagtcggacgacgccgacggctggagcagcggcgacggcatcctccactttgcccccgcggaggagtggaggggcgtgcgggtgcgctgcgggaagttgatgcgcggagggaccatgggcccggcgctccgggctgccgccgccgccgccgcagcagcagcagccgaggaggaagaagaattgggcttgagcagcacgggagcgagcaggtcgtcgaggcggtcgaagtagcgccagtcggagtcgtgcttggccttctcgaccttgtacttcttcttgagcgtgtcgatgcggttcttgcactggacgtcggatttgggcgccttggagtagctgtcgcgagaggagacgacctcggcgacctcctgccactgcgggtggcggaggctgccccggcccagcgccacgaagcgctccccccaggcgtcgatgagcgtggaggtggcgccgtcgctccatgcgtcctcgcggccgccgccgccgccgccggaggaaggcgagtgcttgcggagggggatagcgacggcgacgtggccgggcggcgccgcggcgaccgtgacggggtcggccacggggagcggagacggagacggagagcgcgacggggacggcgagggcgaccgggaggccccgccgtcgtcgtccatggccggagatctggcgaccggcggcggggaaggaggggggcgagggtttccttggggatatttccgggatggatgggcaacgcggaattgttccgattattttctgcgcttccggttccggtgttgtggccgtcgcgtccggcggcgagggggaggccagcgagtcgtcgcctggacggagcgggatggctgcctggctgctgccttccttgctgggcctaaatgggccaggccgaacgagagatagagagacgggcctcctcttcaactccgggctaggtccaccgccgggggaaacgggccatctgtcagaaacacttgttggatggacgtagccaccacgccaccgcccgcccccggtctcctccctcccagcgccgccgtggatggccggaggagccaccacgccggccggcatcaggcgcctcgtcagggtcagcctgcctccacttatcctcctctttttctacgggtaacccgcgtttgttttgtttttccaaccagtccagggcagccgctccgctaaactttgcactttcgaggctgtgggtacttttaagattggggtagtgctgagttaaggcagacccttgggactatctttagccaccgtgttaatggtggtctatcttagtttagtggatggatttgttgagtaagaccactggattcggtgaaggccggcgccgctccggagctccagcgggaagggtcctgatttgccatgtgttttgaagacgagagctctcggcacctatggccgaggaccggaccctcgagagcggccccgaccctcatggtgaaccacccaaacctctagcctaagggggtcctgtgctccatgtgctacgtgttggacaacactgtgggagacggacctcctccgcaatgacgggcccaggatttagagtgtgggtattcgaaaaattttctaggatgattatttttaaagactaaagtttttcgattggcatacatacgtaatttgcggcctatctctactactctttatgtttgtatcgtaggcgtccacattcaggatggtgcacggttctgccccgttgctgacatgtcgcgcgtgtccccccccccccacacccccaccaacgtcgttgttctattcctctctcccgcaatccccgctctctctctctctctcccgtaatcctcgtcctctctcgccagcgtcgtcctctctcgccagatcgccgcccggccatcccacgccacgcgtcgcggcccagccattgatggattctgcccagccattgatggattccacgccgcgtctcgagatcaagcgcgcgccgtcgatgg

SEQ ID NO: 11332 - DNA, 1308 bp, Zea mays
cctgccgggattattctgtctaaatcatagttccatgctattgtgttggagtgaattgagtgtgagttcgtcttcagagattgagtgctgttaacaattggtatcagaggcgttcgatccttggagttttctacctcgatctgtcttcctcaacttcactgcatcgacatgtcgctcgacacgaagctcatcctcgacgccatcggcaagctgttcgacgacttcgatgctcgttgggagcgtcgtatctctgagacccagtccacacgggagcaacgggttgtccccatcaagccctgcatcgacacctccgagcagatccctgctgcgcacttcgatacgggggtggtcaccgacaactggggtggattgtttgatgccgaggtggttgccgatgattggggtgggctgttcgagcagtctgcgtaccttgtggaggagcgcaacttcgatttctccactgctcttccgtacgcgcctgcgccccgcgctaccttctccagcaccgacgacgaggcttcctccaccgagccgagcttcgactccacggcggtccgaaccatgtccgacactgtggctactcttcgatgccacgctgacgtgctcgccaaggccacacccacgctcttcgcttcgagggcaccgaggctgtcgttcaagtaccagctgccacaaggaaacctctactcgatcaccttcgatgacgacatcaacatcgaaggttgcctccccacgcgcacacggtacgacgacttccaggcgctcgcgtcactcgggaaccacaactcgcaggtctgctccgtcgggaacatgccctgcgaggacgacctcctcttctccgatgccgctgaccacctcttcagcgtggagctcgtcaccgaccaaaacacggagttccgcgatatcaatggcgaccatgtcgacatcaacatcgatattctcgtctccatctcctcggccaacgtcgactactacgacgacgaccacgccttccgcaacctgacgctcgcgagcggcacggcgttgcaggggggggggggctccgacggcgaggggaagcgtgtcaacatggccagtgctttcctgagaatggccaagcccagcagaccactgctctccactgcgtacgacctctccactatgctcaccgacgtgccctgcatcggctccttggtgactacggcgagcaagatttcttctgcctcgtttgatgctcaagtggtgttcgatgaaatgcagcaaaggtttcgacccacgatactgatcgacgtctcctgtatcgacatgggcacaaacattctgggcttt

SEQ ID NO: 11333 - DNA, 2399 bp, Zea mays
aacgctactgctgctctcgccccgccgcgttggcgcgcccaacacacaagaagaaactgacggaggagcggagcggagccgagccacggccagtgccaggagcgaaaataaaaaggggtaggagttcctcctccccaacctcacaagtaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacaatgtggtcgtcaatgtgctcaacagcttagacgagcccctgctcatcacttgggatgggatccagcagcgcaagaattgctggcaggatggggttctcggcaccacctgccccataccgccaggttggaactggacctacaacttccaggtcaaggaccagattggcagcttcttctacttcccaccccttggtatgcagcgtgccgcgggggggttcggaggtatcactgtcaacaaccgcgcggtcatctcggtcccattcgacacgcccgatggggacatcacgctcttcatcggggactggtacaagatgaaccacacgcacctgaggaagatgctcgacgacggcaaggaactggggatgccagacggtgttttgatgaatggcaaggggccatataggtataatgactcgctagtgccagatggcattgagcacgagactatcaaagttgagccaggaaaaacataccgtttccgtgtccacaatgttggtgtctccacaagcttgaacttacggattcagaatcacaacatggcccttgttgaaacagaaggttcatacacgatgaagcagaatttcactaatctcgacatccacgtgggccagtcttactcatttctggtcactatggatcagaacgcaagcagtgattattacatcgtggccagtgctaggtttgtgaacgaatcgctttggaccagagtcaccggtgttgcaattttgcaatattcaaattcaaagggaaaagcatctggtcctcttcctgatccaccaaatgatgagtatgacaaaactttctcaatgaaccaggcacgttccatcaggatgaacgtgagcactggtgctgctcgtccgaatcctcaaggatcatttcactatgggtctatcaatgtgagccaagtttacaagctgaggaatgaaccacctgttatcatcaatgggaagaaacggactacactgagtggtatctcttattccccacccgacactcctctaaggttggcagatctgtacgacaagaaggatgtctacacacttgacttccctacaatgccaattgatggaccgccagtgatcagaacatctgtcattaactccacatacaagaactttttggaaattgtatttcagaacaatgactcaactgtccagacctaccacattgatggatatgcattctgggttgtaggaatggactatggcgagtggactgagaatagccgtgggacttacaacaagtgggatggtgtttctcgttgcacgactcaggtgtttccgggagcatggactgctgtgatgctgtcacttgacagcccaggattttggaatgtacggacagaaaacctggacacgtggtatctgggtcaggagacttacatcagggtggtggatccaaatggaggctataatgttactgagatggtggctccagacaacatgctctactgtggcctcctcaaggataaacagaaggctcagaagcctcatggttcgaggtcatcagcctctgcagcaaaactgaactatcatgtgctcgcggctttggtctctttggtggtagccttggtgttgggccattgacaagaactgcctccagcttgtggtcagctgctgtttgcaggttgattaggcgtttgacagaaatactgttgagtaggtcagtcgaattcgtaggttccattcatgatttgtctggcaattgagaaaaaaaaatgctgtgccattgcgcatcttcgtccatcggaattgattaacatgctgaagaactgtgcagtagcttgagattgagcacaaatttgaagttgtcggcagctggcacccacaagcaaggcgtgtgctgtgctgcctgagtgtgttttcttgatcagtgaatttgtcgagagttggatattgttggttgtatcccatgcatcccattgcaattagtctctttatattcagtgttgtaggcaagtctttccttcgcaagtaaaaaaaaaaaaaaaagaaaaaaaaaaaaaaaaaaaactcgaggga

SEQ ID NO: 11334 - DNA, 3045 bp, Zea mays
  misc_feature (2460)..(2460): n is a, c, g, or t
  misc_feature (2491)..(2491): n is a, c, g, or t
tgcatgcctgcagtcgaactgaagaagttcagagcagttagtgtagtctgaaatttcagactagaaatagtaactggcagagactgaatctcagtgttggtgctcagtttagagtccctgtgcagccaatccctgtggttttgaattgagagttttgtagcaaaatgggagatcatgtataggtgcataaattcctttaagtcatctggacctggtactacataaacttaggagaaaaggggtcgcaaaatggctctgtcagacgttaatggctgttgattggttcagataaggaagttcgagctcagagtaatgtaccccacttgtgggtactctagatttgactataggtctttttagcctatacaaactacagtaaccgggaaaagctatgtttactgaataatcttggggcaatgaagtgggcatgttgtgttaagaataaagagaaaaggggagctgaacttgaggtttcagtcgagtaaaacagcaggagcagtttcagaataatctgatggaagtatctccatccaccaaattgatatagggaattctaggatatgccagcccaaaagagacttatgagaaaggaaagtttattgtcaaaaattcaccaccccgaggatagatgcaggaagggtgtaaagcctatctcttggatgattcagctgcttcactgttgatgaggtgtcatacatgcagtaaaggtgtgctggactttttccctgagcttccaccttgcgtggtaaacatgcaggtgtgtgttggggattgttaattcgcattttccctctgaaatatgttagggactgccggcccaatagcccatggtgcagcccaactatctgatgtcttgtgctacaaaggagcaaggaaacatagcagcagggaattattcagagaacagactcttggttattatgcttcttcttccttagcgtcttcctcttgtacccagatccacatttcctgtgcttctagattcttctagtgtctttctctagtatctgatcacctgcttgctgtctatcctatattctgtctcaaatcatagtttgtgttggagtgaattgagtgtgagttcgtcctcgagattgagtgctgttaacaattggtatcagaggagtcgattctcggttagctccaatggatcccgctgccctcaagttcctcctcgacgagatcaacagaaggttcgacgaggcagatgcccgtgtcaaccggctcttcgacaagctgcagcagcccgcccaccttctggggtcattgccctccgcgtcattcgatctcccagccaccccgctcagcgtcgaccacttctccgacgcatccgccagcgtgccggccacccccgctgcggctgttgaggccgtcgtcattgtcgacaactggggcgggtgcttcgatgacagagagcagtactgtacggcgccatccgtcgtcgccgacaactggggagggttcttcggtggcgaggatctcgatctgccaggaagcacttccttcccctgcaacagcgaatcgggcgccgtccctaccaaggcgctcgtcacctccaccgaccccgacgcgccgcttggctcgggcgccgacagcatccccacccatgtcggcgaagggcccctcgagccagcccatggcgatgtggccgtaggcggtctcgttgagttgggcgcagtcccagttccggtggaggccacaacccgacgccgaaccccgacgctcagcttcgctgggaactactcgcaacacgccctcaccatctggaggccctccttcatgcagcagatccgcttcgacgcccacaccccgctccgggaggcctgggagatcgacgcgcacatgcagtccgcggtcaggggcccgggcgccttcaatgtctacggccgagcaggcgagcaccctgctccctggacggatccaccaggacctctcgatcgagctccagcagcaggcaccttccagatcgagctccagcagcaggcgcaggcgcgcagcgatcaatcagcgagcaggacgagcggcaggggagaagcactcgagtcgagagcagatcaggatgtgtgtgaagatcgaccgcacgacgcccagacttccgctgtcgaggaggccatggccgcgggcgcgggagaccccgggcagctcgaccaactcttgctgctcgacccctacgccgaggacgacatcaccaactactgcgtcgagttccataatgctgtcgtcactaccatctactcctccatcatcatcaagccggagacgggcagcagtagcagctcttccttcgcgtgttcgaccaattgtcccagccaggcactgcacaacattggtaagcccagtctggtagccgtggtgactattgcaggcacaccttcatctactttgattgatgctcaagtggtgctcggtgaaatgcaaccaagggaacatagcactttgatgacagccaccattgagttncgcttcattttatggtattttttcattctgnacctggttgctttacaacaaagtccaccatggccacaacccgttaaatcactggtagtagtcgaatacatcctgccaaagcctccttggttagcatttgatctaggcaatttgttcagaattcattacacctgcagtactagaagtgcttccttacagtatacattgcaattgtcacctgacgttgggaatattcagaaccaatgtttggatttgtgtttagtaaatttaatcactgggtcagcactgaacgtcatggttcagcagctgcttgtttctgttggctcccctagcaatgctcttgtgctcaagattccaattcagggtgttgtggatgcacttcataggaaaacacttcagggcacaggtctgaatgaagagcaaatgagacaggctagcgtcgcagacaatggtcatcgtcagctaaacaagataattgttgacttggatcaagataacattactgctaagaatttatgcattgcattttacacagagaagcacattcagattccatgcttggggcggtgaacacgaaagtactttcttccatga

SEQ ID NO: 11335 - DNA, 2432 bp, Zea mays
ggcgtggtcaatcgcgggatagcattgggacagttctctgtgttgatgatgatggaatcttgagggttggttttccaggagcttctaggggatggagagctgatcctgcagaaatgaagggttgaagaatataaggttggtaactgggttcggattcgtccttcactaacggttgctgtgcatggcatggagtccattactcctggaagtgttgggattgtatactccatcagaccagatagcagtcttttattgggactttgctatttgtccaatccatggctgtgtgaaccggaggaggttgaacatgttgacccattcaagattggggaccaagtatgtgtaaagaggtctgttgcagagcccagatatgcatggggcggtgagactcatcacagtgttgggaaaataattgacatcgagagtgatggcctgctcatcattgatattcctaatcgggctgcaccatggcaggcagatccatcggacatggaaaagattgagaacttcaaggttggcgattggattagagtcaaagtgacagttccctcacccaaatatggatgggaggatgtgactcgaaatagtattgggataattcatagtctacaagatgatggagatgtgggtgttgctttctgctttagaagcaagctttttctttgctcagttgcagatatcgagaaggcacaaccatttgaagtaggggaaaaagttcatgtgtcaccttccatatctgagccacgcctcggctggttaaatgaaactgcagctactattggagccatatcaaggattgacatggatgggactttaaatatcaaggtttctggccgaaaaagcttatggaaggttgctcctggtgacgctgagaggctttcagcttttgaggttggagattgggtccgcccaaaaccaagtattgggagcagacctacttatgactggaatagtgttgggagaataaacattgcagtagtccatagcattcaggactctggttacttggagttagctggctgtttcaggaatgggaagtggctaacccataacacagacattgagaaagtgcagacattaaaaattggtcagcatgttcggttccgtgctggaatttcagagcctagatggggatggagagatgcgaaccctgattctagaggcatcatcgctggtgtacatgctgatggagaagtaagggtcgccttctttggtgtgccgggattgtggagaggcgatcctgcagatcttgaaattgagaatatcttcgaggttggagagtgggttaggctgaggaacgatgtggagcagtggagatcactcaagcctggtagcattggtgtggtgcatggggtgggatatcaaggtgatgcttgggatggaaccattcatgtcgctttttgtggtgagcaggaaaggtggattgggccttctagccagcttgaaggagttagcaagtttgttgttgggcagcgtgttcgaatcagaggctgtatccgccagccaagatttggttggtccaatcatagtcattcaagcatagggacaatctcatctattgacgcagatgggaaactgaggattcatacaccagctggtgccagggcttggttgacagacccagcagaggtggaaaaagtggaggacgaggaggaagtctgtattggggactgggtgaaggttaaggactcagttggaaccccagtgtatcaatggggtgatgtgaaccacagcagtataggggtggtccaccgggctgatgatggagagctctggattgctttctgcttctgtgagaggctgtggttatgcaaagcatgggaggtggaaaaggtgaggcccttcagacaaggtgacaaagtacggatacgatctggtcttgtatcccccagatggggctgggggatggagacctacgcgagcaaaggcgaggttgtgggtgtggatgcaaacggaaagctgaggataaagtttcggtggagggatagactttggattggggacccggctgatgtcgttcttgatgatgcccatttattgacggaggcttctaatggcttttgacctttttgttcataggcttgtggtattcttttgaccccatatctcatttcttgcacccatccattttgcagcatttcaaatttagcaaaatctcaacctgcagtggagttgcaagttgcacatagttatcatcgcataggcatgcatggcagggtgtatttcttgttgataaccggggaatgagaagacagcgatagtgaaatactcctagagttgataaccaccacctaggtttttttccctttggtctacatgtataattatgccgcctgataccttttgggtttcagtgtaccatatataccagtgtacaggttcggacctgaacattaatttgattgatagtggtctactggtcttgttgtttt

SEQ ID NO: 11336 - DNA, 2718 bp, Zea mays
cgcaccacaacaagcatagagacaccaagcgtcaaacttgtcaagcagctagcaaccaacccaagaaagacaccatacccatggctcgcgctagcgtcgtcttcgtcgttgctgctctcctcttcgtcgccatggttgtggcaccgatggccgaggcaaagtccgctgatgccccctccgccgatgcccccgcccccgctgctgacgcacctgccgatggcacctagcggaccggcaggtgcacctggtccccagggcttggttgatagacccagcagaggtggaagaagtggaggaggaggaagtctgtgttggggattgggtgaaggttaaggactccgttggaaccccagtttatcaatggggtgatgtgaaccacagcagcataggggtggtccaccgggctgatgatggagagctctggattgctttctgcttctgcgagaggctatggttatgcaaagcatgggaggtggaaaaagtgaggcccttcagacaaggtgacaaagtaaggatacgacctggtcttgtatcccccagatggggttgggggatggagacctacgcgagcaaaggcgaggttgtaggtgtggatgcaaatggaaagctgaggataaagtttcggtggagggatagactttggattggggaccctgctgatattgttcttgatgatgtccacttattgacggaggcttctaatggcttggctttttgttcataggcttgtggtattcttttgataccatatctgatatattgcacccatccattttgcagcatttcaaatttagcaaaatcttaacctgcagtggacttgcaagttgcacataactatcatcgcatcggcatgccagggtgtatttcatgttgataaccggggaatgagaagacaacgatagtgtagagctggtaaccatcacctagttttttcttctttggtttacatgtataattatgcctcctgacacctttttgggtttcagtgtatcatataccagtgtacaggttcggacctgaacattaatttaattgatagtggtcttgtatgtttacctgattggcggatgggccgactcggtgtggactgaagatcaacggattcgacgtatttctgacacttattagataaaacatctttgagcccacctgacaatacaaacccaatagtcttgtgataaaacatctttcggcccacctcacaccacaaacccaatggtcttgtgcaatgataatagtgcaatacatattaaccaaattggtagatgttttattgaaatgtctaattttttgtacagcatatcctttagttaaatcttatggccaccaccgccgcacctgttccacactgaccacaccacaccatacatcctgcaagtgcaccactggcgtcaaaccccgggcttgtcgtgccctcaaggcgggttcagtattcgatcacgccccaaaccagcttattgaatctactattctttcaatatatttgcggccaaaagacaataaacctaaattgagacatggattaagggcatgtttggttcgtggctaactatgccacactttgcctaaagtgagtcgtccgaattgaaaaactaaccttaagcagaaaagtgaagcaaactgtggcaaccgaagctgcgatccaaacatgccctaagcctcacactgcagactgcccccaccaacgtcacgggcgttctcctgtagtgcgtgcaacaaacaaccatatccgcttcaagaggactgagagctaagcctttgctcaatccaactgtcgctatacacaatgcattttctggaagaaaagagtttgcacccaagcaccactactttggtctatactatgaacaactctgtctggtctggtctggcttttggtagtgcctgtggcagtagttgagatcaggctaccaaccgcattttcatttgcaaaaagaggcatgtttgttcgacttttgtactttattattattatatatctaaactctgcaatatttttcatgagatctggtacaagttttgaagctttaaacccccacattcacatgccaaacgagacatccaatgggcgtcctccagataaaggtatccaattacatcctgcaaatgcaaagtgcaaacacgtgagacttactcgttagtgtaggcttcgctttcctctccaggcagctggatgtacgcgcaacttatacagatattcagtcgctcttaatggaggcaaacatgaaagcagagtggagcagcacgctggccggttggaagacaatgaacacagcacagactgcgttgcgttgccgttgcgttacttttgcagccaaaagcatgatcacagcccgattagccatcccaagcaacctggactggccatgcatccgaaacaggccctcgctttacttgaggctctgatctgttctgggacgacctttgatcttttctttcgtccttttggtgcgtagtactgttattttaccccctttctgttgcgctaatgcaaacagatggcctgcgcacatgcacgcccaagcggatgatagaggagtaccttaccttgcacaccaaccaaatgctctggaactggtggagcgtcgtctagcgcgcaatatatatgtgggggttttcaggtttgacgtacatctgcggttggaacgggctggcatgtgcagaagttcccaggctgcttctgtccggctccctgatgtttggccaccaacttctgca

SEQ ID NO: 11337 - DNA, 3424 bp, Zea mays
tgtgtaaagaggtctgttgcagagcccagatatgcatggggtggtgagactcatcacagtgttgggaaaataattgacatcgagagtgatggtctgctcatcattgatattcctaatcgggctgcgccatggcaagcagatccatcggacatggaaaagattgagaactttaaggtatgaacttcttaatgttcgtgttaatgcttttattgattttctttggatccttatctttcatttctatttgcaggttggcgattggattagagtcaaagcaacagttccttcacccaagtatggttgggaggatgtgactcgtaatagtattgggattgttcatagtctacaagatgatggggatgttggtgttgctttctgcttcagaagcaggctttttctttgctcagttgcagatgtcgagaaggcacagccatttgaagtaggggagaaggttcatgtgtcaccttccatatccgagccacgcctcggatggttaaatgaaactgcagctactattggagccatatcaaggattgacatggatgggactttaaatatcaaggtttctggccgaaaaggcttgtggaaggttgctcctggtgacgctgagaagctttcagcatttgaagttggagattgggtccgcctgaaaccaagtattgggagcaggcctacctatgactggaatagtgttgggagaataagcattgcagtagtccatagcattcaggactctggttacttggagttggcaggttgtttcaggaatgggaaatggttaacccacaatacagacattgagaaagtgcagaccttaaaaattggtcagcatgttcgattccgtgctggaatttcagagcctagatggggatggagagatgcaaaccctgattctagaggcgtcatcgctggtgtacatgctgatggagaggtaagggttgccttctttggtgtgcctggattgtggagaggcgaccctgcagatcttgaaattgagaatatctttgaggttggagagtgggttaggctgacgaacgatgtggaacaatggagatcgctcaaacctggtagcattggtgtggtgcatggggtgggatatcaaggtgatgcttgggatggaaccattcatgttgctttttgtggtgagcaggaaaggtggattgggccttctagccagcttgaaggagttagcaagtttgttgttgggcagcgtgttcgaatcagaggctgtatccgccagccaagatttggttggtccaaccataatcattcaagtatagggacaatctcatctattgacgcagatgggaagctgaggattcatacaccagctggtgccagggcttggttgatagacccagcagaggtggaagaagtggaggaggaggaagtctgtgttggggattgggtaaaggttaaggactccgttggaaccccagtttatcaatggggtgatgtgaaccacagcagcataggggtggtccaccgggctgatgatggagagctctggattgctttctgcttctgcgagaggctatggttatgcaaagcatgggaggtggaaaaagtgaggcccttcagacaaggtgacaaagtaaggatacgacctggtcttgtatcccccagatggggttgggggatggagacctacgcgagcaaaggcgaggttgtaggtgtggatgcaaatggaaagctgaggataaagtttcggtggagggatagactttggattggggaccctgctgatattgttcttgatgatgtccacttattgacggaggcttctaatggcttggctttttgttcataggcttgtggtattctttcgataccatatctgatatattgcacccatccattttgcagcatttcaaatttagcaaaatcttaacctgcagtggacttgcaagttgcacataactatcatcgcatcggcatgccagggtgtatttcatgttgataaccggggaatgagaagacaacgatagtgtagagctggtaaccatcacctagttttttcttctttggtttacatgtataattatgcctcctgacacctttttgggtttcagtgtatcatataccagtgtacaggttcggacctgaacattaatttaattgatagtggtcttgtatgtttacataaaaaaaaaaaaaaaaaactcggtgtggactgaagctcaacggactcgacgtttttcagacatttactagataaaacatctttcaacccacctgacaatacaaacccaatagtcttgtgataaaacatctttcggcccacctcacaccacaaacccaatggtcttgtgcaatgataatagtgcaatacatattaaccaaattggtagatgttttattgaaatgtctaaatttttttacagcatatcctttagttaaatcttatggccaccaccgacgcacaaccacactgaccacaccacaccatacatcctgcaggtgcaccactggcgtcaaaccccgggcttgtcgtgccctcagggcgggtcagtattcgatcacgccccagaccagctttattgaatctactattctttcaatatattttcgtccaaaagacaataaacataaattgagacatggattaagcctcgcactgcagactgcccccaccaacgtcacgggcgttctcctgtagtgcgtgcaacaaacaaccatatccgcttcaagaggactgagagctaagcctttgctcaatccaactgtcgctatacacaatgcattttctggaagaaaagagtttgcacccaagcaccactactttggtctatactatgaacaactctgtctggtctggtctggcttttggtagtgcctgtggcagtagttgagatcaggctaccaaccgcattttcatttgcaaaaagaggcatgtttgttcgacttttgtactttattattattatatatctaaactctgcaatatttttcatgagatctggtacaagttttgaagctttaaaccccacattcacatgccaaacgagacatccaatgggcgtcctccagataaaggtatccaattacatcctgcaaagtgcaaacacgtgagacttactcgttagtgtaggcttcgctttcctctccaggcagctggatgtacgcgcaacttatacagatattcagtcgctcttaatggaggcaaacatgaaagcagagtggagcagcacgctggccggttggaagacaatgaacacagcacagactgcgttgcgttccgttacttttgcagccaaaagaatgatcacagcctgattagccatcccaagcaacctgggctggccatgcatccgaaacaggccctcgctttacttgaggctctgatctgttctgggacgacctttgatcttttctttcgtccttttggtgcgtaatactgttattttacccccccccccccccc

SEQ ID NO: 11338 - DNA, 4921 bp, Zea mays
cgcccttgatggcgtgttcatcgcgggatagcattgggacagttctctgtgttgatgatgatggaatcttgagggttggttttccaggagcttctaggggatggagagctgatcctgcagaaattgaaagggttgaagaatataaggttggtaactgggttcggattcgtccttcactaacggttgctgtgcatggcatggagtccattactcctggaagtgttgggattgtatactccatcagaccagatagcagtcttttattgggactttgctatttgtccaatccatggctgtgtgaaccggaggaggttgaacatgttgacccattcaaggtagtttttgaactatcacataatataatgtctatttgtaatttatagttctgttcaattatttgaactatctactattcaatactttgttccaaattatagttcactttgactttgtcttaatttgaacctctttttttgactaagtttatgaaaaacacacaaataccaacaatcttgaattagtttcattacattctccatgaaatatattttaatagtgtatttatttgaacttgtaggtgttaatattattttctaaaatcttggtcaaagctagcaatttttgacttaggacaaaaccaaagtaaactataatttggagcggagggagtatataatctatttcttcttgtgtttacaatcccttacatctaaggctccctttgtactgttgtggtgtttatttgactaccttatggttatataaacataaagatcaatttttactgtctattttacaattctaactagattcagtagggctatacagcaatggaaactcacctttcgtatatttgtgctttcgtggaattttggtgcctgtttgttttttcttagttatgttcttgtttttgcaaaacgaaattccagattggggaccaagtatgtgtaaagaggtctgttgcagagcccagatatgcatggggcggtgagactcatcacagtgttgggaaaataattgacatcgagagtgatggcctgctcatcattgatattcctaatcgggctgcaccatggcaggcagatccatcggacatggaaaagattgagaacttcaaggtataaactttttaatattcatgttaatgccttaatcgattttctttggatcattaccttccatttatatttgcaggttggcgattggattagagtcaaagtgacagttccctcacccaaatatggatgggaggatgtgactcgaaatagtattgggataattcatagtctacaagatgatggagatgtgggtgttgctttctgctttagaagcaagctttttctttgctcagttgcagatatcgagaaggcacaaccatttgaagtaggggaaaaagttcatgtgtcaccttccatatctgagccacgcctcggctggttaaatgaaactgcagctactattggagccatatcaaggattgacatggatgggactttaaatatcaaggtttctggccgaaaaagcttatggaaggttgctcctggtgacgctgagaggctttcagcttttgaggttggagattgggtccgcccaaaaccaagtattgggagcagacctacttatgactggaatagtgttgggagaataaacattgcagtagtccatagcattcaggactctggttacttggagttagctggctgtttcaggcatgggaagtggctaacccataacacagacattgagaaagtgcagaccgtaaaaattggtcagcatgttcggttccgtgctggaatttcagagcctagatggggatggagagatgcgaaccctgattctagaggcgtcatcgctggtgtacatgctgatggagaggtaagggtcgccttctttggtgtgccgggattgtggagaggcgaccctgcagatcttgaaattgagaatatcttcgaggttggagagtgggttaggctgacgaacgatgtggagcagtggagatctctcaagcctggtagcattggtgtggtgcatggggtgggatatcaaggtgatgcttgggatggaaccattcatgtcgctttttgtggtgagcaggaaaggtggattgggccttctagccagcttgaaggagttagcaagtttgttgttgggcagcgtgttcgaatcagaggctgtatccgccagccaagatttggttggtccaatcatagtcattcaagcatagggacaatctcatctattgacgcagatgggaaactgaggattcatacaccagctggtgccagggcttggttgacagacccagcagaggtggaaaaagtggaggacgaggaggaagtctgtattggggactgggtgaaggttaaggactcagttggaaccccagtgtatcaatggggtgatgtgaaccacagcagtataggggtggtccaccgggctgatgatggagagctctggattgctttctgcttctgtgagaggctgtggttatgcaaagcatgggaggtggaaaaggtgaggcccttcagacaaggtgacaaagtacggatacgatctggtcttgtatcccccagatggggctgggggatggagacctacgcgagcaaaggcgaggttgtgggtgtggatgcaaacggaaagctgaggataaagtttcggtggagggatagactttggattggggacccggctgatgtcgttcttgatgatgcccatttattgacggaggcttctaatggcttttgacctttttgttcataggcttgtggtattcttttgaccccatatctcatttcttgcacccatccattttgcagcatttcaaatttagcaaaatctcaacctgcagtggagttgcaagttgcacatagttatcatcgcataggcatgcatggcagggtgtatttcttgttgataaccggggaatgagaagacagcgatagtgaaatactcctagagttgataaccaccacctaggtttttttccctttggtctacatgtataattatgccgcctgataccttttgggtttcagtgtaccatatataccagtgtacaggttcggacctgaacattaatttgattgatagtggtctactggtcttgtatgtgctgactcgttgtgcaccgagtggctggcaatgccgcgtgtaccaggagttactgcaagctgctcagtggcatacgagtatgatgacgtatatggtacaaactgcactgctgtgtatgcgtggcaccagtgttggtgtggtaatggatcgtgatctaaataatttcacaaaatggttgggctctaaataaagtttagtttaaaaatgaatagaaatagagtctgatcctttaatcttatagtataaaatttagagctcactggtaccctaatggcacctccacaactgttacctctaatgccacctccacaaaataaatgaggaatctccacaaaatgaggaattaatggcctgtctatttcaccttaaagattatataatcttgattataatctgaattatataatctagattataatttatcgtatgcaactgtttggtagtgtagattatacaagtatataagggtggtatggatcgtgatctaaatatttctttacaatttgttgtatataagggtggtatggatcgtgatctaaatatttctttacaatttgttaggtctctatatttattttattttaaaaataaatataaataaagccttatcttaattcgatttgatccatgcttatcattcctacgagtacatttttttttttttttttattttacgccacaaagaaaattgtattattctagcaaataatgaattggcagtttgatcatgaatgttattcatccacaagaagctacaacagaggcatgcacatgtatgtttcttgtgaacattttatcgagcagctagagcacactcaaactatggtaggcagcatctacgccgtggactactgtggcgatgccggcattcggtagttcgcgccatgcgccacagttgatgacgccccatgacacagttgacgagcccgtgccgccgttctctagttcacgaccgtggctgatggtgcgtgtcgcaagcatggggtcgaggtcgcgccctgcaccggcggtgttattggcgaggtcacgtccgccgctcatgcacgccatggatagaagtgcgacctcctctgcccgcaacatgaagctctgcagccgcgctgccaccgtggatcagccgtcgtcgtgaacgggttgttcatggacatgctgccggcgggtaggattggagaagcgatgcgatgggtggatggaatgtgctggggtttcgggtttagcatgttcgtgaagaaaagtgaatgacagacgttgtaatttctagtaacataaccataggcagtggatcttttaccaaaaataatctccaataaactcatcttaaataaattatgggattatcataatctgaccttgaaattatataatctatccacataatatggttgtttgtttgccacttgaattatttgcactagattatataatttacctagattccgagcccacaccaaatccggaatatgacgcttggattggcaaggacaataacctctctcaattctgttgccgtctctttcgtgacttatcctgtcgcaagtctcatttgcagagatagtcattttgtttgtgtggtatactggtgccaggatcgaatacatgtttgcctctcaatccttagcttatatcatcagcacacgcatggcgcttgccacgtcaaccaaggggtgtcctcaatcatatcatcgagtacttcaccgcagcggtggatctagctgccacgattaggatgtgccagaaaaaatataaaaaagaaaaaaaaacagggatcaacaagacttaaaccttaattgtcaaattaaaaacatagtac

SEQ ID NO: 11339 - DNA, 3352 bp, Zea mays
gtatatattaattattagcttatgagtaatgaggtggtgatgaatcaacccattctattccacaaaccaaataaaaaagtgaggaataagaaaaagatggatcactttattcctcaaaccaaacccactctaagttttttttaaagacggctacagagaattgtttatccaagcagacatgtcgagccggtaggtatacagtctctgctggtctcacgtggccacgttgctcggttccgcatccgcgattccgcgaggcaaagcaacgagccgctttcggtgttctactgccgcgtagcagcggcagcggcaccgacggcatcccaaaaggcagcgacgtctgggtcggacttggaggccccggggatcggtggccaggctgagctcctcccagagtcccagtacgcctccggagtccggatccgcggagccaggctgagctgctcccgtggtctactctccagtacgcggctcggcagggaccgggagcgaggacgagcgtcctgcgtcgacgggatcggcgtgccaggggagcgctgaaatctgcgcttccgtctccggacggccgatgccaggccttgctcgggagaggtgagctctccgcttccttctccggttcaacaatggcgtcttttcttcccatacgcataattgctcccgtgctgccgctgctctggtttggattgccttcccaagtatacattcggtgttcgcttgttgaaattcggagatcccgaacgaacgtaaagctgtagtaaattgaattcctctcgatttacgcacctatacaagctacaagtcgttaatggtgtcctgcaggagaagatcatgacatacatttgagttctggtttgcctcgtaggtagcaaacgaaacatggagctgaggcggctgctgctgcttgcgctcatctgcctgcgtgctccccgtttggcttcggctcagcagccggatgaggcgacggtcatagttaagggctccactaggattgcggaaacggatgacaactacgtctgtgctacaattgattggtggccgccggagaagtgcaactacaatcagtgcccatggggccaggcgtcaattcttaatctggtatatgctttatgtttgttttccttctcttgttattggtgtgttagtgttacacaatgctgtttggactaattttccatgccgtccattcaggatctggatcacccgtttctggctcaggccattcaaggtaggccctttgagttacattcagtggctgccggttacatatttgtcatccctcgtggctttagataaggacctagtaggctggtagattgttggttgatttgctccatgcctcagacagtcttctttcttacaacaaaatggtgattataactgcagcatttgaccatttgaggattaggctgggaggctccttgcaagaccgagttgtttatgatgtgggaacagaaagtccatgctccccatttacaaatgtatccaatgccttgtttggtttctcagttggttgccttggtatggataggtgggacaaactgaatgacctattcgagagaacagggtgagacttctagttttttaagattttttttgttaccactactgtgagaatataaattagccagcgtaacttctgcagatgttccaaaaccgtgatatgacattcccatttatgtgttttggattttgtcagtgtctgtgattttattggttcagttggttattgataaaaataactaaaagctatccatttctacacatcttgaggaatgctaaattggtagcacatatgtaagatatgataaaattctacctgtcaatgtaacatgtgcattgcatgtttgtacacagacatctgcatatagattgaattttcattctttttgtatatggatcggaaaatgtttcaattgcctgttgtttgtttatctgatatgaggtttctgcacgctaagtgcaactagctaatgggtgagcaaacatctatctgcagagcaattgtcacatttggtgtgaatgcactctacgggaggtataatgttcgacgttccatctgggcaggcaaatggaattccactaatgcatatgattttgtaaaatacacaatctcaaagggatacccagttggctcttgggaatttggtaaaactatctttttgctactgaaacattctgtctcatttcttatattccaagatagaagttctccaagtttatgatgcatgaaatatggggtgacagaaacagtttgtttgagaactacatttttacacaggctcttgttttgttaggcaatgagctgagtgggcatggaatcggagcaaaagttgatgctaaactttatggaaaagatgtaattgaatttaaatccatccttcggcaattgtataaggcaccactgtcccagccactcctgttagccccgggagggttctttgatcaacagtggtattctcagctacttgagacttcaggtcatgggcttgttaatgccttatctcaccatgtatataatcttggtggaggtatgtgatttattgttttgaatgtaatcctatctgagtaatcatgtctcactgttccaaaaccattgcatgtgcctactaaaattccatgatgatacagatgcttacataggtagaactactctaagtttattatgatggaatctgaataaatagctgaacatttgtaggctctacctattaaaagtttatgattataaaaatatttttgtaatgtaaacaaaattgtgatcctgcaaaataagtaagtacaccataatttgatttgataccaagagtgaaagaaaggctgcatatcagatagcaaggccttccttaaatagcaaggcctttcttaggagatgtagtattgatcacttctatccagacagaaatatatgctgctatgttaaccaggcatgttcaatttatcattagcaatgccaatatatgtaatcaatacacaatatgcatcaacaatgacccttcactgtcagggaatgatgttcatcttataaggaagatcttagacccaaagtacttggatcgtgctgaagatacttacagagacatgcaacttaccatccaaaggcatggaacatgggcttctgcttgggtcagtgaaagtggcggtgtattcaacaatggtggtcaactggtgtcaaatacattcatcaacagtatctggttagttcgcttttttaattccacgtgtgacatgtgtatactctggtgttggtgttgagtatgatgtctgagtttgtgatggagtctttttttatgaatacaggtatctagatcagcttgggatggcatctaagtacaacacaaaagtgttctgcagg

SEQ ID NO: 11340 - DNA, 2891 bp, Zea mays
  misc_feature (2876)..(2876): n is a, c, g, or t
gaaaatgatcctagttctttctacattctccctttgctacggcaacgaacgaatagtgcaggaacgaaactagttggatagtgctcgtctcttccaggtatctgtttctttctttcaacatggacaatcagtaatgccttgacttaaaacttaaaatggatagagtatgaaagtaatttttttgacaataccacatatatattcctaacccaacacatagaaaaatacaatttgtaccaaagtgaaataaatgattgaccaagcagaccggccagcagcccagcaagctcatgccaacagttggtagaaggaaaaggaatgggactgattgctgatcttcatggaaagtggaaacgatgagttagatggtacagtgcataggaatatgtatggtacctaatagttgtgtttagtttgtggaatcactctatgcttaatgaagtgatgcatcataagtttatttcatcaattttggtggaatcaactcactccttatgtatatattaattattagcttatagaggaatgatgtggtgatggatcaactcattctatttcatagaccaaataaaaaagtgaggagtgagaagaagatgaatcacttcatttctcaaaccaaacccactctaagttttttttaaagacggctacagagaattgtttatccaagcagacatgtcgagccggtaggtatacagtctctgctagtctcctcgtggccgcgttgcccggccgggccccatccgcgattccgcgaggcaaagcaacgagccgctttcggtgttctactgccgcgtagcagcggcagcggcaccgacggcatcccaaaaggcagcgacgtctgggtcggacttggaggccccggggatcggtggccaggctgagctcctcccagagtcccagtacgcctccggagtccggatccgcggagccaggctgagctgctcccgtggtctactctccagtacgcggctcggcagggaccgggagcgaggacgagcgtcctgcgtcgacgggatcggcgtgccaggggagcgctgaaatctgcgcttccgtctccggacggccgatgccaggccttgctcgggagaggtagcaaacgaaacatggagctgaggcggctgctgctgcttgcgctcatctgcctgcgtgctccccgtttggcttcggctcagcagccggatgaggcgacggtcatagttaagggctccactaggattgcggaaacggatgacaactacgtctgtgctacaattgattggtggccgccggagaagtgcaactacaatcagtgcccatggggccaggcgtcaattcttaatctggatctggatcacccgtttctggctcaggccattcaagcatttgaccatttgaggattaggctgggaggctccttgcaagaccgagttgtttatgatgtgggaacagaaagtccatgctccccatttacaaatgtatccaatgccttgtttggtttctcagttggttgccttggtatggataggtgggacaaactgaatgacctattcgagagaacaggagcaattgtcacatttggtgtgaatgcactctacgggaggtataatgttcgacgttccatctgggcaggcaaatggaattccactaatgcatatgattttgtaaaatacacaatctcaaagggatacccagttggctcttgggaatttggcaatgagctgagtgggcatggaatcggagcaaaagttgatgctaaactttatggaaaagatgtaattgaatttaaatccatccttcggcaattgtataaggcaccactgtcccagccactcctgttagccccgggagggttctttgatcaacagtggtattctcagctacttgagacttcaggtcatggtgttgttaatgccttatctcaccatgtatataatcttggtggagggaatgatgttcatcttataaggaagatcttagacccaaagtacttggatcgtgctgaagatacttacagagacatgcaacttaccatccaaaggcatggaacatgggcttctgcttgggtcagtgaaagtggcggtgtattcaacaatggtggtcaactggtgtcaaatacattcatcaacagtatctggtatctagatcagcttgggatggcatctaagtacaacacaaaagtgttctgcagacagactctcatcggtggcaactatggactgctcgacacgcaaacttttctgccaaatcctgattactacagcgctctactatggcatcggcttatgggcaatggagttctttcagttgatataaacgcaccgcgtcaaatacgcgcttatgctcattgtaggaaacaacagcaaggcatcacgattctgttgatcaacctgagcaacactactggatacaacgtcactctccagaacgacatcaacgtcagcttgggcaaaagacctgaccttgagaagcgcagttctttcacgcacaggctcaggaaagcagtctcatggctggggaggaaaccagcaagcaacaccaggaggcgggaggagtaccatctgaccgccaaggacggcgatctccagagcaaaacgatgctgctcaacggggccccgttggaacttggagacgctggcagcattccagctatggatccggtgctcgtcgccgttgatttgccggtgcagctagcaccaacatccatcgccttcgtagtcctacccaagtttgaggccaaggcttgttcttgacacatgagctcttgaaatcagtttttttttgtgtgtgccttgaaatgttccatagacctatttcgtgaaagaaatcatacaacgcggcacaaaaacggcaaagcgttgttgtgtgagcaaaaaaaaaaaaaaaaaaaaaaattnaaaaaaaaaaaaaaa

SEQ ID NO: 11341 - DNA, 1520 bp, Zea mays
gagaaaagtaataaggtcgccgccgtcctctcctcgccggtacttcactgagggcgaagaaaaaagtggcagtatattctgccactcacccaagagccaagatcatggcgtcatcttcctgcgtccgcctccatcacctgccgtccacctttcgccggtcgtccgcccctggcgccccaaccaacctccagttccgcgcggcgagctgccggtggcggcggcgggttctcgttcccggcgcggcatctcctcccctacgcctctgcgccacgggttccccgcagccgcctcttggcagtgacagcaacgctccgttgtcccgcggaacccgggaggagggcgaggaagtggaggagcagcggcagcctccgcccccgccgcggctcaagatcgccgtggtcgggttcggcaacttcgggcagttcctggcgcgcacgctggtggcgcaggggcacacggtcctggcgcactcccggtccgaccactccgccgcggcggcagccatgggcgcgcgcttcttcccggacgcgcacgacctgtgcgagtgccacccggacgtggtggtcctagccacctcgatcctgtcggccgagtccgtggtccggtcgctgccgctgcaccggctccgccgcgacacgctcttcgtggacgtgctgtccgtgaaggagttcccgaagcggctcctcctgggcgcgctcccggaggagatggacatcatctgcacgcacccgatgttcgggccggagtcggcgcccagcggctggacgggcctcccgttcgtgttcgacagggtgcgcgtgggggactcgtgcccggcgcgccgcgcccgcgccgaggcgttcctcggcgtgttcgcgcgggaagggtgccggatggtggagatgtcctgcgccgagcacgacgcgcacgccgccgagacgcagttcctgacgcacaccgtcgggaggatgctggcggcgctggagctccgcgcgacgcccgtcgacaccagggggtacgagacgctgctccggctggtggacaacacgtgccgcgacagcttcgacctctacaacgccctcttcatgtacaacgacaactccaccgagctgctccaccgcctcgactgggccctgggcgccgtcaagaggaggctcttcgacggcctccacggcgtgctccggaggcagctgttcggcgtcgaggacggggagggcccggcggagcgcacggagctgctggcggtggtgccgggtggtggtccgcctgacaccgacgaccagggcggtgacggacgcgacggcgacggtgacggcgacgagtcgggagagcagaagaatgattgatggcacggcactgcacgagacaccggtgtggcataaatgcacgtcgattcgatctgtcgcggcgcgcgccttgcatgcttgtttgatcttatcctgacggccacgcatggctttcgatcttgctgtcttccttcctaataataactgtgacatgacaagaatatcatcaaaaaaaaaaaaaaaaaacggcacgag

SEQ ID NO: 11342 - DNA, 2565 bp, Zea mays
  misc_feature (36)..(36): n is a, c, g, or t
gctgatgattagctagggagatgagcagacactggntgcctggcgggccactggaattacgtgacaataggagaatggatggagatcttgccatgcaaatttctaagcaactgggtccacgctctcgccctcgagacccgcccaattttgagtcgcttccgagcagacgtcctccttggataaggggataggcgcgaggaagagcggcctatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtagtacaccgattctcgcgcctccatccaatagtgcgattgcattgccagcaacagcaattctgctaatgatctgccagcctcggttgtatgtgtcattgttccgtttcatggagagtgaagttttagcagcatttgctgtagctgtagtttcaaaggtttgcatttgcgattgctatgccacttgtgcaatctcctagcttgcaacgttcttgatccgctcgcgcgcggttttacttgtggcactgcgcaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaagatcgtcaagatcgacaacaacctccgggtgctcatgatcaagggggccgtgccagggaagcccgggaacctcctccgcataacgccggccaagatcgtcggcaagaacatccccaagaactagacttcttttttcaggggggtgaatgttgagtgtttgtgtttgttaccctgctacaaactggatgtaatcctttgccaatttccagtttttgaacacatgcaacttcagattagtaaaactataacctgtacaatttggatgcttgggtgagagagtaataggcaggtaatgcaagatgcccttctggttcctgaattccgctaaacaatagttgattaattctatggccatagatcatacaaatagttaaatacaaatggtcgcagatcatgcagatatgtactgatctgagtcaggaaacgcaaccaaaacggaaccaggaaatgcgacaaacaagaaaaactgcagacgtaaccttgtgcaacaggggggcagaaaggagaactttgacataatcgtaaagcttccactatagccaactgaacgaatacatttgctaccacatcaccctcagagaagatacaaagaagacggattgtttgggccacccttcaatacggattatttgatcataataataagccatccatgcttctactctaagagcacaaaacctaacacggaagaagaaacagtggccaccaaatcagctagttccacgaccacaattgtagatatttagctgcccaaaatagtctgtacaaatggatcactcctcaacctgcacataaagaacatacgaccaaagaagttagcaatcgtacagaaactgctatgacctgctacaacctcaatcaaatcgataggggtgcccaggagaatgaagaagcaaattgaagcaaacaacatctacttccttgtaaatgcaagttgtttacgaaattaccatgtgcagtgtcatcaaaggtttcattaatcacttccaaaatcttcaaaatgaatgccctcagatattgtatctagccgcctatttcctatttctattgataataaggaaaccattagataaattgagaatttcagtactgcatcaagagcaacgttgagggaagggcagtggttaaccagtatgttctccagcagtagattctgggaagttatttgcatcggaagggatgaaaggggatcgaccataattctctaatatttctgcaaatgaaagacagaagatgttttatgttgcatacacaatataaatctctatctctactactataatgtgtgagtttcgtcatgcgtccgcaagcgcccgcctccgaaatactactataatgtgagtttcatgtccgcaag

SEQ ID NO: 11343 - DNA, 1185 bp, Zea mays
ggaccattacctagaacatcctaatcaaaaaattttgagtcgcttccgagcagacgtcctccttggataaggggataggcgccacgagagagcggcctatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaagatcgtcaagatcgacaacaacctccgggtgctcatgatcaagggggccgtgccagggaagcccgggaacctcctccgcataacgccggccaagatcgtcggcaagaacatccccaagaactagacttcttttttcaggggggtgaatgttgagtgtttgtgtttgttaccctgctacaaactggatgtaatcctttgccaatttccagtttttgaacacatgcaacttcagattagtaaaactataacctgtacaatttggatgcttgggtgagagagtaataggcaggtaatgcaagatgcacttctggttcctgaaaaaaaaaaaaaaaaaaaaaaaaa

SEQ ID NO: 11344 - DNA, 1358 bp, Zea mays
  misc_feature (1296)..(1298): n is a, c, g, or t
  misc_feature (1300)..(1300): n is a, c, g, or t
  misc_feature (1302)..(1307): n is a, c, g, or t
  misc_feature (1315)..(1317): n is a, c, g, or t
  misc_feature (1320)..(1320): n is a, c, g, or t
  misc_feature (1323)..(1335): n is a, c, g, or t
  misc_feature (1337)..(1338): n is a, c, g, or t
aaagtctcagtgcgctctgcctcgccacttcgccagtcgtcactcgtcaccaccgtcccgcccccgcgccgtcccacccttgctcccactcgttgcgccgcgccgcgcgatgcaggcccgcgtcgtcgtcttccccgtcaagggccgcgcctggtgcttcgccctcccgcgcgcctccgccgcagcgcccgctgctgatggcgccctcccgcgcccgaccctgagggacctctggcgcggcatctcctccgggtcccgcacggcgccggagaaggccgaggcggtcgtcgacttcgtcgctgacaagatgaacagggcgtgggtcgggttcgggagcgcgccggaggggtcgatgaagagccggatccacagcttcgggctgaagctgctgtcccgggtgaggccgtcggaggtgctcctgaagtccgtcaccaaggacgtgagcgcgctcgagatcgtgcatccggcgagcataaattctcgtcttgtgcgtcgacgtttgcggcatattgctgttaggggtgcatcagttcacaagaaatttctgtatggctcggtttgtttgcttccagttactagtgttttcatggtactaccgttaccaaacattccattcttttgggtgctatttcgtgcttattctcattggagagctctacagggaagtgagaggctcgagttactagtttctgactgctcagataagtggaaagttcttgaggagaagattaattcagtaaaggatggcaaacccagtgaaaatgcaaggaattctccttggaagctgcggccatcagaaaagcttgacaggtttcttgagggtagaaacttggatgaaggtttggattgtgataccattttgagtatatgccaggagtacgatttggacaagatcgatgttctcaagtacagggatcttccgtagccacatccagattgtttctctgaggtttatacgtttaaattcttctgctagtgagatcaagatgaagggtacaagagttgcatgaacccactaaccattggcggtcaaatgagttcttttaaatagcttcagattttcttgttatgtaccaaaccggtctgccactagtgcaatgatctcagaaacaaagaggacatcttatgaaactatagaagcccagggcagttgttccccccgtgcaaatagagattgctagctgccaactttcccccgtcagccatcacaaattttagttgggatcaatgaacgacaaatgcaaagagcagggttgaaaattgagattggccatccgtatatgcttctctcaaaannnanannnnnnaaaaaaannnaanaannnnnnnnnnnnnannacccccaaaaaaaaaaaaaa

SEQ ID NO: 11345 - DNA, 1843 bp, Zea mays
  misc_feature (1266)..(1266): n is a, c, g, or t
  misc_feature (1268)..(1268): n is a, c, g, or t
  misc_feature (1281)..(1281): n is a, c, g, or t
  misc_feature (1331)..(1331): n is a, c, g, or t
  misc_feature (1333)..(1333): n is a, c, g, or t
  misc_feature (1335)..(1335): n is a, c, g, or t
  misc_feature (1337)..(1337): n is a, c, g, or t
  misc_feature (1724)..(1724): n is a, c, g, or t
acgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccgccccccgatggagctgttcgcgcgcgccaaggtggtgcggctcaagagccaccacgacaagttcctgtacgcggacgaggacgaggcgcacgtgacgcaggagcgggacgggtcgtcggcgaacgcgcggtgggccgtggagccggcgccgcacaacccgggcgccatccgcctgcggagccggtacggccactacctcaccgcctccggggagccgttcctgctggggatgacgggccggaaggtgacgcagacggcgcccgccgcgccccgccccgccaacgcgtccgtggactgggagcccgtgcgggacggcttccaggcgcgcctccgcaccagggcgggccacttcctccgcgccaacggggggctcccgccctggaggaactccgtcacccacgacgtgccccaccgcaccgccacgcatgaactgggtgctctgggacgtcgaggtcgtgcagctcctcacgccggcgccgcccgaccgcgccggctccgcgcccctcgccaagttgccggactcgccgcccgcgccggagctcgccaacccgccgcagccgcatcaccgtccctccaagtcctacgccgcgccaccgccaccgcccacgctggagcccgaggcgccgccgcccaggctctccaagctcgagtcctccgattcattctctgcccccttgcacaaggtagagggacgtgccatccattatcacattgcagatgatctgggcaatgtgcaagatggcacagtgggacactcctttacattcaatggcagcaacttggaggagcttgcccacaagttgcaggaagagactggcctggataatatcatcatatgcacacgcagccctatcaacgggaagctcactcctctccgtctgcaactgccaccaaacaatgcagctatgcatattgtgctcgtccaggagtcctcaaaggtggctagatcatttgcacggccgtacggttcataaatcacaaacatttggcgaagacacggggggccttgagttctggtggattgtgcttgtgcgtgtcgctcgaagcccgtacatcattggatcaggtcatgccggttgtgcggncncgctgggtgtcanaagcaacctagcttaaacctcattcgtgcacatgtaaaaggagcaccccncncncncaccacccacacacacacacacagtatagttaaaaccagcggagattcatcgcgtgatatgtggagagatgtgttccattgattaatttatactagttgagattctggccctgtatcttatatcattggttttgtattagttggtcaatagaatttgtactccgtgctgcgagccggctggttcttcccccagatgggtttctggcaggatggcggtacagtctagctcagtacaattactttacttgacaccgttcgtccacgtcagcgaaaaaacaacgtttccgtctgctcccgtcgctacagccacggagccacctggagagatcctttacagcctgagttatctttagcagcatttcggtgcaaagtttttattgataatcnatagccaccacaacaatacatcaaccttttcttttacaacctttgagttaaaataaaacacatcaaccttttcttttacaacctttgagttaaaataaaacacgaggctacgcgattaa

SEQ ID NO: 11346 - DNA, 1300 bp, Zea mays
atgcagattcccaagtggagttgcggcggctggttatcatttatcatcaccttcgcctcacaccttccggccgcccattccgatccgatccccggccggccacctaccaccggtcagccccatcaatctctgaggcagcgtcagccatcaggcctccctcgtcgatctccccgccgccgccgctgctaataccagataatggaggccggcgccgccgctgctgccactgccatctaccctctgcaccgatgcaaaaccatacacctggtgaggcatgcccaaggtgtccacaacgtggaaggcgacacggatcacagcgcctacatgaaacccgacttcttcgacgcgcgcatcactcccttgggctggaaccaggttgacctcctgcgagagcatgtgaaggaatctgggcttgcggaaaagattgagctggttatttgttctcctttgtcgaggaccatgcagactgcagtgggagtttttggtggcgaaagctgcagtaatggtgtgagtgtgcctccactgatggtggagaatgctggacgtccggcagtttcaagtttgaactgcccaccatttcttgctgttgaggcctgcagggagcgcttgggtgtccatccttgtgacaagaggaggagcatcacagagtaccgtgctctcttccctgccattgatttttcgctgatagagagtgacgaagatgttctctgggtaccagatgtcagagaaacctttgagtcactcgcagaaaggggtatgaagttcattgactggctatggacaagagaagagagagagatagccatcgtcacccatagcggtttattaagccataccttgcgcatgtacagcaaagagtgccatccaacagtaacacaagaagtgagcaagtactttgcaaactgcgagctccggtctttggtactggttgacaggagtatgcttggttcagatggccccagttacaacaactaccctggcaaaatgaaaatcccagccggacttgatctgcccagcgatgacaagaagcaacctcttcagaaccagagcggctgagcaggcctgtcttggggcttgtttggtgttcaccaccactgattccttttcttttgtcatcctattttgaaacttccctagctgtattcagtccattttttgtgaactattctgagagtactattctgaacttccccatttgtggttgttgagcaccatttgtggtactggacatggccggacggtccaacctgtggacggtccgtgattagatcagatcatacgtaattaacccttttcggcg

SEQ ID NO: 11347 - DNA, 1962 bp, Zea mays
atacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggtgccgttcccggcgcagggccacctgaaccagctgctgcacctgtccctgctcctggcatcgcgggggcttcctgtccacttcgccgcgccggagccgcacctccgggaggcccgcgcgcgcctgcacggctgggggcccgaccccgcgtcggtgtgcttccgcgcgctggacgtgcccgcgcacgactccccctccccggacccatcctccccgttcccggcgcacatgcagcccctgttcgaggccttctgcaccggcgcgcgggcctcgctagccgcgctcctggcggagctggccgcgtcgcaccgccgcgtcgtcgtcctctacgaccgcatggcggccttcgcggcggccgaggccgcgcgcttacccaacgccgaggccctcggcgtgcactgcctcgccgcctcctacaacgtcgggtgggcggacccggggcacgccctcctgcgccgccacggcctcgtgttccacccgcccgacgcttgcgccacgccggagttcgtcgcgctcgccaggcggatgggccaggagcgccggcgcgcgcccggagccggcatggtcgtcaacacctgccgcgcgctcgagggcgacttcctcgacgcactccgggggatcccgtcctccgacggcccaaggctgttcgccgtcgggcctctcagcccggtgctccccctccccggcgcgagcgggactcggcacgagtgcctgggctggctcgacgcgcagccgccctcgtcggtgctctacgtgtcgttcggtacgacgtcgtcgctccgcccggagcaggtgcgcgagctggccgccgcgctgcgggacagcggggcgcgcttcgtgtgggcgctgcgggacgccgaccgcgcgggcatgcgcggcggagagggggatactacgaccgaggccctccacgccgccgcggcgtccgagctcggccccgacggcgctggcgtggtggtcaccgggtgggcgccgcagctggagatcctggcgcacggcgccaccgcggcgttcatgagccactgcggctggaactccaccgtggagagcatcagccacgggaagcccatcctggcgtggcccatgcatagcgaccagccctgggacgccgagctcgtgtgcaagtacctccgcgccggcgtcctggtgcgcccgtgggagcggcgccatgacgtgacccccgcggccgacatccgcgacgctatcgacagggtcatggcctcggaggaaggggctgagatccggcggcgggccggggcgctcggggaggccgttcgcggcgccgtggccgagggcgggtcgtctaggcaggacctggaggagctcgtcgcgtacgtgacgaggtgattccgtcgcgatggcccatgcggcgactgtgccgcgtggcggcgctgctgcctgcattaacgatttgtttccatggactatattagttgaaatgaaatccgaaggttttaggccaggctatggtttcatttgagggttggccaggccatcttcagtagtctatctatctattttataaacttgtgaacaaaacaaaaaaaaaaagtgttttgtccccgtaaaggcgtagaactctcccagcagccctgatggttcccggctcatgaaaagagacaatcgaagcgatttgccagcagtggctgggcgccgtacgaccacgccaccacgaccagcactgccactccaccatatccaacaaaatgcccaggggtaccgagctcga

SEQ ID NO: 11348 - DNA, 1057 bp, Zea mays
  misc_feature (16)..(16): n is a, c, g, or t
gccggccgggctgcgnagcatcaccattcttcatccctcgttgtcatctcacagcttgggctagagaccaaacaaaccaaagggaagcatggcagcaggcctgcaagtgtttggccagccggcgtctactgatgttgccagggttctgacgtgcctgtttgagaagaaattggagtttgagcttgtccgcattgatacatttaagacacatcacaggcttcctgagttcatcaggctgcgggatccgaatgggcaagtgaccttcaagcatggcgacaaaacccttgttgattcaagggacatatgccggtacgtttgcaaccagtttccaaattacggaaacaagagcctctatggatctggtgctctagaacgggcatcgatagaacagtggctccaggcagaagcccagaactttggccctcccagctctgcgcttgtgtttcagctggcgttcgttccgcacctcagtcacctgggcgttcgtcaggaccctgctgttattgctgaaaacgaggacaaactgaagcaggttcttgatgtttacgacgaaatactctccaagaacgagtacctggctggtgatgagttcaccctggccgacctgtctcaccttccgaactcgcactacatcgtaaacaccgagagaggaaggaagctcttcaccaacaagaagaatgtggcgaaatggtatgacaggctctcgaagcgcgagacatgggtgcaggtcgtcaagatgcagaaggaacatcctggtgcgttcaagtaatggcttgtcttggggagttgtgagtatggcttcatcgtccgtgttggtctggctcatcagtgttaaaagcccatcagtgtcgtcaaccagaataatgtgaagcccaactgtgatgtatggtcttttttttttttaaaagcgcatttgtaaactattggctatttcttgcacgtgccaattcatcgtcacatataaaataaactgtatctttgaccttgtgtcatgtacgcaaaaaaaaaaaaagaaaaaaaaaaaaaaaaaacggcacgagaagccggcacgagaagc

SEQ ID NO: 11349 - DNA, 1011 bp, Zea mays
ctcgttgtcatctcacagcttgggctagagaccaaagaaaccaaagggaagcatggcagcaggcctgcaagtgtttggccagccggcgtctactgatgttgccagggttctgacgtgcctgtttgagaagaaattggagtttgagcttgtccgcattgatacatttaagacacatcacaggcttcctgagttcatcaggctgcgggatccgaatgggcaagtgaccttcaagcatggcgacaaaacccttgttgattcaagggacatatgccggtacgtttgcaaccagtttccaaattacggaaacaagagcctctatggatctggtgctctagaacgggcatcgatagaacagtggctccaggcagaagcccagaactttggccctcccagctctgcgcttgtgtttcagctggcgttcgttcctcatctcagtcacctgggcgttcgtcaggaccctgctgttatcgctgaaaacgaggacagactgaagcaggttcttgatgtttacgacgaaatactctccaagaacgagtacctggctggtgatgagttcaccctggccgacctgtctcaccttccgaactcgcactacatcgtaaacaccgagagaggaaggaagctcttcaccaacaagaagaatgtggcgaaatggtatgacaggctctcgaagcgcgagacatgggtgcaggtcgtcaagatgcagaaggaacatcctggtgcgttcaagtaatcgttgtgagtatggcttcatcgtccgtgttggtctggctcatcagtgttaaaagcccatcagtgtcgtcaaccagaataatgtgaagcccaactgtgatgtatggtcttttttttgttttaaaagcgcatttgtaaactattggctatttcttgcacgtgccaattcatcgtcacatataaaacaagctgtatctttgaccttgtgtcatgtacgcacaataaataagttttagtgatgttatcgagaaatatagtagaaagtatgttctaactgcc

SEQ ID NO: 11350 - DNA, 6884 bp, Zea mays
  misc_feature (4591)..(4591): n is a, c, g, or t
tagattataatctcaaactattatgatgtccgtatgttacaatgatacataaatatttgataaaatgttaacacataataattacatcaaataaatcatagactacactgtctcctctctcactggttgacgagtcggaaaccaatagtataacatgctcaatgttttatatggcagtacaaaagaatctgaatataacagatagagaccgaaaaagagatagaaagttaggacacacgagggtcgaaaattgcgctttaaaagtgaagataaattaggacgagatatcgagccagctcggctcgttcgagttcgagttgagtcgttaagctaacgagctgattcggatcggctcgttaagctaacgagccacaaagtcagctcggctcggctcgtttacgagctggagctggctcatttagctcatgagtcatagtagaaaataaacgatatgtatataataataaatttctaattaatttaacaatagaaaatagtaattatactcatagtttcacataccacatcaatataacactaaattaacataattcatcacttatcaatcacacacatgttcatcattttaacccacaattatatttgtatagaccaatgtaacatataagcatagttcatcaatcattagtttaactcatagaccatagacatcacacatatatataatatgttcatcaattattacataaataatgatatgtatatagtttcgttttgctgaaatgtggtaactcgtttagcttatgtgctggctcattaataaactaagctggtttattgaaaaccgagttaggatattagctcagctcataaaaaaatttaaatgagctgatttaagtcgaaccgagctgatcagagaccgagagagttaactaaccataagcattttgtggggccttaatatagacaacccactagcccggtaaacaattctttacgccgtacgtacgtgtcggtatcctggctacctgcctcacaccttgcatgactgacgcgtggcttggtatcaggtcagcaggcaggactgtccctgtgatccagtccagtactccaacgccgattctgccgagaaaagaaaacgttcacgcggtcatccattcgcctcggcggtccctgtccccaaattctgcaaatatataataatatatgcatggctcatctactgcaaatgcgaggctgtggtgctgtttgatacaaagttttttttaagttgtagaaaactactagttttgtaaaatactttagtttttaaatgccataaagtatttaaatgtaacaaaactttctaatattaaataccatggcgttgctaaaactttgttctttttttttgagttttgaacactctacttcgtttacatggttttgtaaatcaacagattctaaaaatgcagttttttataccacagtttttatacgctttcagaaattaatactgataggagtttttacaaaaggttaaataaatattaactagcaaaccgtacatataactaagtaatttgtttcaagatttatttaactatcaatatttgtttcaatgtatcttagaagcgaactccataatagtctttaaatcgtcgatcagattctgtaccatcactccaaatcatgtacatgatagaaatggatgtaagcatatggtgggaagtaagaaaatagacggaagattattctctctttaatattatgtatagatatagatataggtataattttttggtgaagacttctattataattggtataacattttaccaacggttagttagctagcttaaagggatatgcttctttggaaaaacaaaagagagagtattttccatgtacatttctgcatattttcccatttttggctcaaaataaaactactagtctacaattctagccacgttagggcttgtttgttttgctctcaatcaatgtgaattaagttagattggataagttttaattccaaacaagtcaaaatcttttataattttttccaatatcatccaatccacatgagataagaataaccgaacaagttcttagggcttgttcgttttgctctcaatccatgtggattgtgtaggattgagtgagttttaatcccaaaaaaagttaaaatattttataatttttccaatctcattcaatccatatgagataagaataaccgaacaagggcttaagatgtttggatgacctggatttggcgtgaaccactttgattaaaactaacaaattaaaagagacaatgtggaattacttgcacgtttctcctgaattatacaatcagaccttgaggtccacgagcttgctaacataggagtaaatttatttatttatttatttgcaccagcagctgagcaaattaatttccatgcgtcagagggagcacgcgtagatatccatcccgcccctgcgaaatgtaagcaagcatggtcaacagatccagagatttcccatatactaaactagtgccaccgccgccgcttacatggaagtagtgtaacttgacgtaaaaaaaacatgtctgaagaaggctgaaacctgaagaagtcttttccacgttctgcgcgagatcttagtaataaatgtacttgtgatttgttcagcaagaatatgccactacacagttccagttctaggtatcacttacgcggcttactgggactctaggagccgtacagagatgaggaactatgctcatccttttgttttctgtaaacttatccagtcaggtgtttgcatgctacttccatccaaatatcagtgaccccagaaacacaaccttgagctgccattcttcatcagtatccactatccaggcacatccaaccatgaccatttcctcacgaaaaaagaggaaggtttcagagccagttcagaacactgacacctgtaatctccggtctagtctacttcttgcggtaggagagaataggaccaagcaaacccgcaccttcctccacagttcatcacaagtaggccagtatagcagcagatgcagagctagacacatctctgcgcaacaaacacttggatcgcgcgaggcgagaggataagcgagaacgcaaaaaaagatctttgtctcttttaccgtcccagttgaccggccgcccaccaccactccggccgacacatcaacaaccactgtgaatgaatccgccatggccatacctgcgatggcgccaccactgtgctcggccgcactcgacttaaaaaaaacgagctcggagctgtcatgtcctactcctacctcctgatgccaccgagcgaataccacgcacaccaccacgagacagagggagaattctttccctcttttaatctagcaaacaaatgcaagcgcacaattggaacaagtaagctggtgaccaggaaagcaattcgagggagggggagaggaggaagatttttaaaagaaggagacgccagaaaggagacgacgagtgctcgattcttttcctcgctagaaaaagtggaagcgaaacaaagaaaagctgtgtgagagaaagagagagagagagagtagactagcagtactagttagtttatggtggcaataattgtttggcaggcattgggaatcccggcgccagtgtttccatcccgcagcgctgaattccaagagatctcgtctgcccctcgtcctcctctcttcgggccatcacggcggcggcagcggcggctcggctcgtttgcggtgtgccgcaagttgtgcaactgaactgcgctttgcccgcccccggcccttcctttttgggcgcatataaacgagcaacgtctcgcctttggggtcggcggggccgccgctttttagttgcgctctcccctcctctcccccgcaccctgcctgccttttccattggagcgcacaaagccggacggcaccaccatttaaagaaggccaaccaagcacacggcacggcgaagaagagaccaccacctcacactccattcacggcaggatcgatcgctatagctgctgcgcccccctgcacccttgcgtcttctgccgctgctgcgctgcggctccggcacaggtgcgtttcttgatttactgggctcatggagttcggtagcgtgatccggaaaacaccccgatttggtgccggccggcggccgggccgctgcgctcgtgcgttagtgctttttttttccgttcgtttgcgtgacctagtggaacgaagggagcttggcggtcgctcgggctgccgtggaattcgatgtggaaagcgagctcctcacggatagcgcctgggggccaccgtctttcgtgtaatcatcgttgcttgatttggtttcttccttttcgttcgagtcttcccgtgctgcttctctagtgtacgaccagttcgatctattgtctgcagcggtctccatcttgaggtgtctgtgtccagtgtccaccgaaggtgctggagggtttggactctctgccttcttgttagcttctgttggtattgtacagtccctagagaaggctagttttcaaaaggttattttgctaatctcctcttcgatttgtcaagactgaaggcatgattaaaaccttgtgtcgtcaactttggatagttcntttcagttttggtgctttgttgcggtgaaaaatctcatgttcaattcccctgagaagtcccacaactcgctcctacgtcctaccatgatgttagtactatctttacaaacagaaacatgcactcgtgtttgtaaattcatctatgtctctatgatgtgcttttgatataattaacttgtactgaatgtaagactcttgctctgtgtactatagtgttctgctgctgacatggttgaattattttttcgtatatgtaagtgctaatgatagtccatctagttgtgccagctttggttagccacttcttgtaagacccatgtgagtacctagttattgaggacatttgactgcaataaaaaacaaactgactgtgcattggatggtattcttcttcttgtgaagtgattactggttcttctctttgaaaagttggttctcgctcaccagctggaagtttattttgaattggattgcattgtgattattttactactttgtgagctgtcgaatctgtagttcttaatataatgatatttagctcttctacgtgtttgataaaaaattctctagctcttttttattgttcccgaggaccagattcaccaatgtttcttgtttcatgtctaatgtggaagtctctcagaactgagtacttttgtttgaagaaagatttgttcagtcaagctttgcaaattaccatcatagtttggatgacatccatggttactttgatgagtttatggagccctggttgccgagcttatctgggttctctgacaatggaactgtaatatttgcaacaaaactttcctcatcttggaagaaagtttcaagagggcttgacaacttttaagtgtcctgtgaagcttgatgacgtgttcgtgagggcgaagtgggagagcaaaattacttctggcatgcagatgtcaacagatcctaaccactacggggtatttccacattcattctgcaaccaacatgtggtttcatttcagacgagttcagttactagtgtatcaggagccataccagtttgtctagacacttccagtggaatgaatggcaatatggcgatgttgaacactacaacttcaacgattgtatccactggttcaccaaacatgagtgctgagtcttcttgcccgaacctcaagtatactgcaccgttggctgtggagtggtcctatccggagctgcaattgttgaatgatggcctcaacaagtatgcaaatgaaccaggaatcatgaagtacataaagatagcagccacgttaccagacaagacagtaagagatgttgccatgagatgccaatggatggcagcgagaaaagaagctacaagacgacggaaacctgaagaacattatcttggaaaaaagataaaagatagaaaggataaaatggctgagccgtcatcatggggtaccaatcctcctgttcagactgagatgagatcttcctcttctatgcctcctaacgccaaacacaatgggtttctctctgcagactctcaaattgatcatggaatgctaaatatattggaagaaaatgctaagctactcaatcaaatagaagtaaatattttaacatcacaggcccataacaatattgaacttttccatcacgcaagaaggaacatcaatggtcttttacaaagcatgagccaaattcccggaataatgagcaagatgcccccattgcctatttcggtggatgaaaggctagctagctgcatactccctcgtgctcctatggctcaagttcttggcagcagtcatttgaaagaagaacgaagagtatggtaggccactgctagacagggaagcagctcaattttcagcagcagtttgaccaaaaatatctgaagagccatgtgcttgggagtctgcatggagaagcataggtgaaagaacgatctggcttttctgatgtctcaaagctacagaagcaacatgatccacttcaccacatggccttaaagaacgctgtctagcttgccttgtcaggatgctctgtattagtgatcaacaaatttgagatagggagagttttccgtaatctgcagttttactcaccttggttgcacatatcgattctttttgggttttgtcctggtgatcgatgttaacagaagtgtagcgtagaaattgaactttgatatgaataattagcaggaaaagcgtagcctttttgtcagttaaaaaaaaaaaaaaaaaaaaaaggggggccccgtaccctagttctagtatgatgcatatgcaagcctggttctctaaacgtgtgattgattgcc

SEQ ID NO: 11351 - DNA, 2594 bp, Zea mays
cgatggcgccaccactgtgctcggccgcactcgacttaaaaaaaacgagctcggagctgtcatgtcctactcctacctcctgatgccaccgagcgaataccacgcacaccaccacgagacagagggagaattctttccctcttttaatctagcaaacaaatgcaagcgcacaattggaacaagtaagctggtgaccaggaaagcaattcgagggagggggagaggaggaagatttttaaaagaaggagacgccagaaaggagacgacgagtgctcgattcttttcctcgctagaaaaagtggaagcgaaacaaagaaaagctgtgtgagagaaagagagagagagagagtagactagcagtactagttagtttatggtggcaataattgtttggcaggcattgggccgcccggcgccagtgtttccatcccgcagcgctgaattccaagagatctcgtctgcccctcgtcctcctctcttcgggccatcacggcggcggcagcggcggctcggctcgtttgcggtgtgccgcaagttgtgcaactgaactgcgctttgcccgcccccggcccttcctttttgggcgcatataaacgagcaacgtctcgcctttggggtcggcggggccgccgctttttagttgcgctctcccctcctctcccccgcaccctgcctgccttttccattggagcgcacaaagccggacggcaccaccatttaaagaaggccaaccaagcacacggcacggccacgaggagaccaccacctcacactccattcacggcaggatcgatcgctatagctgctgcgcccccctgcacccttgcgtcttctgccgctgctgcgctgcggctccggcacagaactgagtacttttgtttgaagaaagatttgttcagtcaagctttgcaaattaccatcatagtttggatgacatccatggttactttgatgagtttatggagccctggttgccgagcttatctgggttctctgacaatggaactgtaatatttgcaacaaaactttcctcatcttggaagaaagtttcaagagggcttgacaacttataagtgtcctgtgaagcctgatgacgtgttcgtgagggcgaagtgggagagcaaaattacttctggcatgcagatgtcaacagatcctaatcactacggggtatttccacattcattctgcaaccaacatgtggtttcatttcagacgagttcagttactagtgtatcaggagccataccagtttgtctagacacttccagtggaatgaatggcaatatggcgatgttgaacactacaacttcaacgattgtatccactggttcaccaaacatgagtgctgagttttcttgccagaacctcaagtatactgcaccgttggctgtggagtggtcctatccggagctgcaattgttgaatgatggcctcaacaagtatgcaaatgaaccaggaatcatgaagtacataaagatagcagccacgttaccagacaagacagtaagagatgttgccatgagatgccaatggatggcagcgagaaaagaagctacaagacgacggaaacctgaagaacattatcttggaaaaaagataaaagatagaaaggataaaatggctgagccgtcatcatggggtaccaatcctcctgttcagactgagatgagatgttcctcttctatgcctgctaacgccaaacacaatggatttctctctggagactctcaaattgatcatgaaatgctaaatatattggaagaaaatgctcgactactcaatcaaatagaagtaaatattttaacatctcaggctcataacaacattaatcttttccatcacataagaaggaatattaatggtcttctacaaagcatgtgccagattcccggaataatgagcaagatgcccccattgcctgtttctgtggatgaaaggctagctagctacatactccctcgtgctcatacggcacaagttcttggcagcagtcatttgaaagaagaaccaagagtgtggtaggccactgctagacagacagcagcttaatttgcagcgacagtttgatactgtagaaaaaatatctgaagagccatgtgcttgggaatctgcatggagaagcataggtgaaaagaaggatctggcttttctgatgtctgaaagctatagaagcaatacgatccacttttcaccacatggccttaaaaaacgctgtccagcttatgagtttgagatagggagagtttccgtaatctgcagttttcctcaccttggttgcacatatcgattcttttttcgggttttgtcctggcgatcgatgttaacggaagcgtagcatagaaactaagcttggtatgaataattagcaggaaaagcttagcctttttgccagttactacaaaggtaactaaccttctgtgtgtatctagttttctagtataatgcatatgcaagcctggtcctctaaattgcaacctctctcctcatgtatgtgctgcgtctctttacaaccgcaagaaattagcagaattctaatcaaagggcctgtttggctatcgagggtcccagtaaaaaaaaaaaaaaaaaaaaaa

SEQ ID NO: 11352 - DNA, 1274 bp, Zea mays
tttctccatataaataaaaaataaatttaatatcaaagtgaacacatagtctacatatcaaatatcagatattaaactgctaagaatagactacacttcttagcctttctccggcaatgagcggtcaaagccaccgaggtgggactaaaaagaagccgcgctccgctcaagcacggcgctcgttctttgataccgatcgtcggtgctatacccaagccgcggtagaaacgggctcgttaaggcccatcaatagctagcccaccaaagaatccctcgggcttcggttcggctgtggaagtcactcactcactcatcgtctgattcggctcctcctcgccgcccgggctcctacacggctacacttttggcttcgtctggaacggtcatgtctgaggctgatcgatgcggcctccctgtcccgccgttgcactgccaacgctcctctcccgcctccgcgcgtgcaggtccgcctcccacgcgctccagtgccacgccctcctcctcacctcgggccacctcgccgcgtccccgctgcgcctctccaacctcctcctcctcgccctcgcgtccgtccccagcgccgccgcgctcgcggacgtcgtcttcgcgcgactcccgctgcccgccgcccgcgacccattcgcctggaacacagccatccgcctccatgccccggcgcgcccccgcgccgcgctgctctacttcgcgcggatgcgccgttgcggcgtgcggcccgacgcctacacgttccccgcggtcctcaaggcctgcggctgcgcgcctggctgcagggccggactcctagttcacgccgaggccgtgaggagggggctggccgcggacctcttcacggtgaacgcgctcatcagcttctactgtaggatcctggacatccgctcgggcaggaaggtgttcgacgaggcaggcggcgtttcgcgggatctcgtctcgtggaactccatggtcgctgggtacgtcgggtgcggggagatggggctcgcgcaggagatgttcgacgaaatgccgcagaaggacgcgttctcgtgggcgaccttgatcgacgggtatgggaagcaaggcggtgctggtgtggaccgtgcacgcgagttgtttgatcaaatgcctgagagggatttggtgtgctggaactcaatgatcgatggttatgccaggcatggtaggatggatgaggcgaggtcactgttcgaggaaatgccggagcggaatgtgatctcgtggagcattgtcattgatgggcatgtcagttgtggaga

SEQ ID NO: 11353 - DNA, 3303 bp, Zea mays
tgaagatgctccggctgagcttctttctccgcttgcgtgctctctccctatatatctagcggtatactatctatgtcgcctcaagatatcgaggtcttcgtcgtgtccttctccaacaacgaacatgtatgtcctcctcttcccttcccctcccgctctacgaaaccttagaagtgggggacgcgcgggatgagagtctctgatttgctgcctatggtatccgtgcgttcataaaaatattatgcgaagagcgaagacaataaataaaaaatcttgaaatatttttggtggataatttacatggatattgttgtgagcgtcgcaatgcacgagtaaccgactagtaaagtcatgatactccccctcattttggatggagactaaacactcacttaaagagtgagagctctatcatttgtcaaactgtacattatatagaaaatgggcaaccacgctacggcccataaggcccgccacgccacggcccatacaagatagagaggacaccactcgttcgccggccgcgcccgcactcgctccacactgacccgcagacagcttcaatcatcgccttccagcctcttcggctcttcttgtcatcttcgatccatccgcagttcttcctgcattccccatttgcgcgttcttccatctcccagattgatctccttcccgacttgggctttcccggtgggaaagcagctgtacctaggccgcgagccacccgcccctcctgctcttcggcaaacgcggagaaagtgggcaggcaataaagtatccgcggcgccggcacgacctcctgctccgctccgtttggttcgccttcttccagcagcgaggagtggcgcagacctagaggccaagaaccagatcggcgggtccatgaagcccgacgtgaggaaagatgccggctgtggcgtgaccgcattcggcgtctcctgcttcgacatcaagtctttcgtcgcctccctcgcgctgctcacgctcgtcatggcgctctggcagctccacccctaccagccgctcctctccgcctcccgtccgtcttccatctgccccctgctcccccggccgaccatctcagcttcctcccgcgccgcttccaccgccgccgcatttccctccgccaactccagtaccaacgctgccagcaccaaggcggcctcttcggctgctcccgccgttacgacgacgaagccggctgcgtccgtgctgccagctgcccggccgcgggaccccaacaagcgggagttccgttcctacggcagcgcggcggctctgttcgttcagatgggcgcgtaccggggcggcccgcgtacgttcgccgtcattgggttggcctccaagccagcacacgtctatgacaccccctacttcaagtgcgagtgggtgccgaaccaggagccatcgtcgccggcgccgcctcgggccgtccgtaccaaggcctacaagatgcttccggactggggctacggccgtatctacaccgtcgtcgtcgttaactgcacattccccaccaaccccaacgccgacaaccgcggcgggaagctcttcatccaagcatactactccaccgcctcccgccggtacgagcgcttcgtggcgctcgaggaggtgccgggttcctacgacgagtcccggttccggccgcccttcccctacgagtacctctactgcggttcttcgctctacgggaatctgagcgcggctcgcatgcgggagtggctagcttaccacgcgcatttcttcggccccaagtcgcacttcgtgctccacgacgccggtggtgtcagcacggaggtcagggcggtgctggatccgtggatccgggctggacgggtcaccgtccaggacatccgggcgcaggcggagtacgatggctactactacaaccagttcttggtggtgaacgattgcctccaccgctatcggcacgccgcaaattggaccttcttcttcgatgtcgatgagtacatctacctcccagacggccggacgctgcaggaggtgctggggcagctggagccctacacgcagttcaccattgagcagaaccccatgtccagcaaactctgcgtggaagatccaacaatggaatactcaaggtgcgctatcctcaccaaatgttgattgttgcttcaattgtttatgccatcactgtttctgtcggaatctttcctagattcacgcaatatataatactgtactaatctttgttacaagtagtgtaggagtactcctttcctcccaaatgttttgttgagatttagacatcttatttgacgcttaatcttattcatattttttgtataaatactttttatttttatgacttaatttattattagagataccttaataatgacttatttattttattgtttgtaaaaaaatgaatgagacaatagtcaaatatgatatataaaagtaaaaacgtcaactctttggatggagtatttctgaagagtgcaggcatctccagtcattgtcaatttgttacttgccggagccacttgcttcaatttgctactgacatgagtcaacatctactagtttttgttttacctggcccattcaaaaggatgtttgttacgttcctgaattaaactttgcatatggctagagtaaaagattcctctctagggttcggccatataattaaatggtccattttgttctttttttaacacccgtatgttccagagatgctatcaggaatttttaagtcagactgagaactcgacctgtgagggttagagatcactcgggtattacaataaaaagacctcacacaggtcgaaccaactcagttggagcccctttcacgatacaagtcagactagtaggtgattgtaatcattattacaaaacacaacatttttttagttttttttcgtctagttgggttaatgtttactggtctgcagaaaaatctacagttgtgacaatgatgaattgttggaaacaaaatcactgtattaatctttttgttggaataggttcagtcaatacctctctttgctctttctggcttcagaacacaactgacaagtatatgagacatagcagaagtaacgaaactttctactatactgatcttatagcttcacactacaagcttacacttgcgttcacaaccaagaacttctaacttgattgtcacaaccaagcactacgcggtttcaaaggcaacaaggcgagctaggtacaccttattgcataggcaacggggcataactagacccccaaggctagctgggtccacctggacgcttagacgacgccttgaagcataaacactac

SEQ ID NO: 11354 - DNA, 2119 bp, Zea mays
ttatttagcccatgtcactcgcacacacactgacacacatacaggctacagcttcaatcatcgccttccagcctcttcggctcttcttgtcatcttcgatccatccgcagttcttcctgcattccccatttgcgcgttcttccatctcccagattgatctccttcccgacttgggcttttccgggtggaaaagcagctgtacctaggccgcgagccacccgcccctcctgctcttcggcaaacgcggagaaagtgggcaggcaataaagtatccgcggcgccggcacgacctcctgctccgctccgtttggttcgccttcttccagcagcgaggagtggcgcagacctagaggccaagaaccagatcggcgggtccatgaagcccgacgtgaggaaagatgccggctgtggcgtgaccgcattcggcgtctcctgcttcgacatcaagtctttcgtcgcctcccttgcgctgctcacgctcgtcatggcgctctggcagctccacccctaccagccgctcctctccgcctcccgtccgtcttccatctgcccactgctcccccggccgaccatctcagcttcctcccgcgccgcttccaccgccgccgcgggccgtccgtaccaaggcctacaagatgcttccggactggggctacggccgcatctacaccgtcgtcgtcgttaactgcacattccccaccaaccccaacgccgacaaccgcggcgggaagctcttcatccaagcatactactccaccgcctcccgccggtacgagcgcttcgtggcgctcgaggaggtgccgggttcctacgacgagtcccggttccggccgcccttcccctacgagtacctctactgcggttcttcgctctacgggaatctgagcgcggctcgcatgcgggagtggctagcttaccacgcgcatttcttcggccccaagtcgcacttcgtgctccacgacgccggtggtgtcagcacggaggtcagggcggtgctggatccgtggatccgggctggacgggtcaccgtccaggacatccgggcgcaggcggagtacgatggctactactacaaccagttcttggtggtgaacgattgcctccaccgctatcggcacgccgcaaattggaccttcttcttcgatgtcgatgagtacatctacctcccagacggccggacgctgcaggaggtgctggggcagctggagccctacacgcagttcaccattgagcagaaccccatgtccagcaaactctgcgtggaagatccaacaatggaatactcaaggaaatggggtttcgagaagctcgtcttccgtaattcgatcaccagagtcaggcgagaccgcaaatatgcgatccgagctcggaacgcgtactccacaggtgtacacatgtcccagaatgtcatcggtaggacaacccacaagacggagagcttgatcctatactaccactatcacaactcgatcaacgtcatgggggagccctgcagggaattcgtgccgagacccaacaatggaagcaaggtgatgtttgaggggataccgtatgtctacgatgacaacatggagcgcgtggcaggggagatcaaacgcttcgaggaggagacacttgggaccgtccgtacataggatcggcgcaaaagcatcgcatcgctggtgcatatacagctctgtaccttgagctcgtgcccatccgttcgttccccgtgactctcgtcttgtgcactttgagctgccattccaacaagcagaatggaagaatctgtctcggggtcgaattagtgtaaagtttcagtttagctttgaatctgtcatctgtgtggagggcaatgcctttatgctgtgttttccgttcttgtctctatgatgttgtatgtatctcattgtagatttgtctagactgactgttgggctttattagatttttctgaatgtcgtatagggcgcagtgtgaagcgtctgaatatttgacttgttaaccaccctctggagtctgtatttgttcctgcacaaactggagcgtcagttcccatgttttctgttatgtacacctaccagaatagtggacagctcagccaatggtgaagcagttttttaccaaaaaaaaaaaaaaa

SEQ ID NO: 11355 - DNA, 994 bp, Zea mays
cccctcgggcccacccacccacaacaaccacactcttgcaccgagctagcagccaagatggcgaccaaacacctggctctttgcctccttgttctctttagcataggcatgggcatggccaccgctgctgcaaaccgcaaactgggttatggccccgggggaggaggtggcggtggtggtagcggtggcggtggaggcggtggttacggaggaccaggctatgggtccggatcagggtatggtgagggcggtggcagcggaggtgctgctggagggtatggacatggtggtggcggcggcggcggtggtggtgagggtgcgggagctggtggctctgggtatgggtccgggcaaggatctggctacggagctggcagcggtgctgccggtggatatgggagtggcggaggtggtggaggtggcggtggccagggtggtggttccggatatggccatggaggtggtgaaggatacggctctgggtctggctttggtggtggtgctgccggcggcggcggtggacatggtggcggtggtggtggtggccaaggtgggtctggctatggctctggttcaggatatggatcaggtgaaggatacggacaaggtggtgctcatggaggaggctatggaagcggtggtggcggtggtggcggcggtggtcaaggtggtggtggctctggctatggatctggatccggctccggttatggaggcggcaacgacaacggacattattaggctctttttaagagctagatacatgttatacaaatatgtcaccagacatgagtctgtcttgttgcatgggatgctagctgtgtccatcgtgtgtgtaacaccgcaaggcttgtgatttgtcctgtaaactgcttgccgctttacattactggcaacaactaagtgataaataaaaatcatctatggaattatagtatgaacacttgagataaaaacactggcaaaaaaaaagggcggccgccaccgcggtgga

SEQ ID NO: 11356 - DNA, 1075 bp, Zea mays
ccggccgggctctgttataatatcattggtatcctcgaggccggccggaacacagcacgcaagcacacacaacaaccacacttgcaccgagctagcagccaagatggcgaccaaacacttggctctttgcctccttgttctccttagcataggcatgggcatggccaccgctgctgcaaaccgcaaactgggttatggccccgggggaggaggtggcggtggtggtagcggtggaggcggtggttacggaggaccaggctatgggtccggatcagggtatggtgagggcggtggcagcggaggtgctgctggagggtatggacatggtggcggcggcggtggcggtggtggtgagggcgcgggagctggtggctctgggtacgggtccgggcaaggatctggctacggagctggcagcggtgctgccggtggatatgggagtggcggaggtggtggaggtggaggtggcggtggccagggtggtggttccggatatggccatggaggtggtgaaggatacggctctgggtctggctttggtggtggtgctgctggcggcggcggtggacatggtggcggtggtggcggcggccaaggtgggtctggctatggctctggctctggctctggctcgggatatggatcaggtgaaggatacggacaaggtggtgctcatggaggaggctatggaagcggtggtggcggtggaggtggcggtggtcaaggtggtggtggctctggctatgggtctggatccggctccggttatggaggtggcaacgacaacggacattactaggctctttttcagagctaggaacatgttatacaaatatgtcaccagacatgagtaggtcttgctgcatgggatgctagttgtgtccatcgtgtgtgtaacaccgcaaggcttgtaatttgtcctgtaaactgcttgctgctttacattactggcaacaactaagtgataaataaaaatcatctatggaattatagtatgaacacttgagaaaaaaaaaaaaagaagaggaaacacgacgcggccgcaaaaaaaaaaaaaaaaagaggggcgcggtcc

SEQ ID NO: 11357 - DNA, 3262 bp, Zea mays
ctgcaggtaccacacgcctgggtgaccccacatgtcactcggacatgaatgaatgcaggaggagtactcggcaccaacctcatgtcctgggctgggcccctcgctagcgcttaggctatccgcaacccttactcctaaaattttccccctatatcactttttcccctattttctcccctatttttttatctcccgcaacggttctccctaaatacttcccctatatctcactaccactataaaatatcattttctgtaccaactatcaattttttatctactaacaattattcgaggacccatagcatagtatttgaggatgaatagtgacacactatatctagagagagagaaagggaccggcgcgtagggggcgtcgtaggggcaccgttgcggcggtagagtgccccctacgcgccgcatgcaaggggagggggctgaatggggcagcgttgcgcatagccttacactattctgcggtcagacgaagagaaggccgcatctaccaccgccagtcgcgacccccgtggctccatccatccgcgggcccgcgcggcatctaccaccggcgcggggccaccgaggacttggacttgcgttcgccttgcatttgcacgtgacgtgaacgcgacgtcgctcgctcgaccactgcaccaccgtggctcggtcgacagtgtatacaactgctctccatttggaggcagcagattgaatgatcatttcatcctcgcagtcgcagacatacattgtcccgttctctcgcggcgggcgcctgacgatctcgtcctccgcgtccgccctccttgttgcccacgcacgcctgaaggcgacggcggcgctggctgcgcggaggaagcccgagcggacattccggtttgctcgcaggccggattgcaaggcccccctctcccaaattgcaaggtaagtctccgtccgtgccctgattcggccggcaaccggtactaactcacgccgccgctgccttcagtttcagcgagttctttctttatgcattgcgcccgtggtctgcaatcctgcttaacactgttacaattgcacaccaatttgtttttccaggatagtcaggaagctaattaacagtgttccaaagatggtccaccgcgagccggccgaggcggcggcggcggcagcagcaggaggcgagaccagcatctctacgcagcctccctcatcatcccagcaggctgcgccaccaccggccgtgttagtgtacaaggtcgggtatcctccccggaggagcctcgccacggagttcaccagcacgctgagggagaccttcttccacgacagcccgctgaagcagtgcaaggaccagtccgtgtccacgaagctccagatgggcctgcagctcttgttcccggtcttgggttggggcaggacctacagcctgagcatgttcaagggcgatctcgttgccgggctgacaattgcgagcctctgcattccccaggatattggctactcgaagctcgcgtatttggatccggagtacgggctctactctagcttcgtccccccgttgatatacgctgcgatgggtagctccaaggacatagcgatcgggccagtcgcagtggtctctcttctgctaggttcgcttctgcagaaggaggctgaccacgacaaggacagggaggaatacctgcgccttgcgtttacggcaaccttcttcgctggcatcactcaagcagctctgggattcctgaggctaggtttcctcatcgacttcctgtcgcacgccgccatcgttgggttcatggggggagcggccgtcactattgccctgcatcagctcaagtatgtgctcggcatcaggagcttcaccaaggaaaccgatatagtctccgtcatggagtctgtctggggttcagttcgtcatggatggaactggcagacagttgcgattgccttcacgttccttgcttttcttctgcttgccaagtacattgggaaaaggaacaagaagtatttctgggtgcctgctatcgctcctgtaacttcggttattcttgccacccttttcgtgtacctctttcgcgctgacaagcaaggtgttcagattgtgaacaagatcaaaaagggcgtcaacccgtcatctgtgcacaagatctacttcaccggtccattcgtcgcgaaagggttcaagatcggcgctgtttgcggcatgatcggcttaacagaagccgttgccatcggaaggacgttcgccgccatgaaggactaccagctagatgggaacaaggagatggtagcacttgggacgatgaacatcgtaggctcaatgacgtcttgctacatcgcaacaggctctttctctcgctcggcggtcaacttcatggccgggtgccggacgccagtgtccaacgtggtcatgtccacggttgtgctcctcaccttgctgctcatcacgccgctgttcaagtacaccccgaacgcgatcctgggctcgatcatcatctctgccgtcatcggcctcgtcgactacgaggcggcgatcctcatctggaaagtcgacaagatggacttcgtcgcctgcatgggggccttcttcggcgtggttttcaagtctgtcgagataggcctcttgattgctgtgtcaatctcgtttgccaaaatacttgtccaagtaacaagacccaggactgtgctgctgggaaaccttccaggcaccacgatctacaggaacacggagcagtatccgcatgcgaggcatgttcctggggtggtcatagtcagggtggattctgccatttacttctccaactccaactatgtccgagagcgaatccttaggtggttgacggacgaagaagatagagtcagcgcagaggggctccctagaatcagtttcttggtagtagagatgtcacctgttatagatatcgatacgagtggtatccatgcccttgaagacctgtacaagaatctccaaaagcgaggcattcagcttctcttatcaaaccctggctctgccgtgattgaaaagctccagtcgtccaaactcaccgagcacatcggaaatggtcatatcttcctcacggtcgcagacgccgtgcgtttctgcacttccaagtcgatgcaggagccttgaactgaaatggatttgtttgcgtccacattctgttctctaatctctactgtatacgttatgtatcatgtattcatgtaatcagaataatatacatatgcaagtttacgaatgaaaaaaaaaaattcgaaaaaaaaaaaaaaaaaagcggcc

SEQ ID NO: 11358 - DNA, 874 bp, Zea mays
ccggccggggcaccaccgtggctgctcggtcgagagcctgcacaactgctctccatttggaggcagcagattgaatgatcatttcatcctcgcagtcgcagacatacattgtcccgttctctcgcggcgggcgcctgacgatctcgtcctccgcgtccgccctcctcgttgcccacgcacgcctgaaggcgacggcggcgctggctgcgcggaggaagcccgagcggacattccgtttgctcgcaggccggattgcaaggccccctctcccaaattgcaaggatagtcaggaagctaattaacagtgttcgaaagatggtccaccgcgagccggccgaggcggcggcggcggcagcagcaggaggcgagaccagcatctctacgcagcctccctcatcatcccagcaggctgcgccaccaccggccgtgttagtgtacaaggtcgggtatcctccccggaggagcctggccacggagttcaccagcacgctgagggagaccttcttccacgacagcccgctgaagcagtgcaaggaccagtccgtgtccacgaagctccagatgggcctgcagctcttgttcccggtcttgggttggggcaggacctacagcctgagcatgttcaagggcgatctcgttgccgggctgacaattgcgagcctctgcattccccaggatattggctactcgaagctcgcgtatttggatccggagtacgggctctactctagcttcgtccccccgttgatatacgctgcgatgggtagctccaaggacatagcgatcgggccagtcgcagtggtctctcttctgctaggttcgcttctgcagaaggaggctgaccacgacagggacagggagggatacctgcgcc

SEQ ID NO: 11359 - DNA, 2583 bp, Zea mays
gccggccggtccgggaattggacaccccaggccgcccggcaaaaccaaaaccctccatccattctacacgcgccgccgcactcctgtacacgccccgccgccaccgcctccaccaccacagcgcgcaggaatccctcgttctctgagggtttcaggcgtcgtatgtaagagaagatggcgctctcagtatccatggagggcatcgaggcgcgggcgcgggatctcggggtggacctctccgctgtcgatctggactccatcaccctcccggccggcgaggacttcggcatcgtcagtgatgacgaggaggtacttcgtggtgaggatcttccagaacttgaaatgggtttgtccaacattattgtcgtggacaatctgccagttgttcctccagaaaagtttgagaagcttgagaatgtcatacgcaagatctacagccaaattggagcgataaaagaaaatggtctatggatgcctgtaaacccagagacaaagaagacatacggttactgtttcattgagtatagtacccctcaggaagctgagctggctagggaaaaaaccaatgggtacaaactcgacaagtctcacatctttgcagtcaatttgctcgatgatttcgagaagtacatgaaagttcctgacacatggacccctgctgaaattaagccatacactgctggagaaaatcttctgaagtggctaactgatgaaaaggcccgagatcaatttgtcattcgtgctggcacactaactgaagtttattggaatgatgcaagaaagctagcacctgagcttgtttttcaaaagcagtactggacagatagtttcattcagtggtcccctctgggaacctacatggcaacggttcataggcagggatcacaggtgtggggcggtgaaaatggcttcgagcgtttgatgcgttttgctcattccatggtgaaactgattgacttctctcctggtgagaggtatttggtcacatacagcagccatgagcccagcaaccctagagacacacatagagttgtcctgaatatatttgatgtaaggactgggaaagtgatgcgagactttaagggaagcgctgatgattttactactggcgggaatattggggtttctggtgtttcatggcctattttcaggtggggtggtggaaaggatgacaaatattttgcgaggcttgggaagaatataatatctgtatacgaaacagatacattctcccttcttgataagaagtctctgaaggtagaaaatgtagtggacttcagctggtctcccactgatcctatcatatctctgttcgtgcctgaaatgggtggtggaaatcagcctgcgagggtgagtctagtgcaaatccctggcaaagaggagctgcgacagaaaaaccttttcagtgtcagtgattgtaagatgtattggcaaaacagtggagaatatcttgctgttcaagttgatagatacacaaaaacaaaaaagagcacctacactgggtttgagctgtttagaattaaggagagggatatcccaattgaggtccttgaactcgagaacaagaacgacaagatcattgcatttgcatgggaacctaaaggacatcgctttgctatcatccatggtgatggccctaagcctgatgttagcttctacaccatgcgaacttccaataacactagccgtgtatccaagctcacaaccctcaaggccaagcaagctaatactctgtactggtctcctgctgggcgcttcatagttcttgctggactgaagggtttcaacgggcagctggaattctacaatgttgatgaactagagacaatggcaacaggagagcattttatggcaacagatatcatgtgggatccaactgggagatatctcgcgactgcagttacctcagttcatgaaatggagaatggctttcaaatatggtccttcagtggcaagcatctttacaaggtgtcaaaggatcatttctatcagtttatatggcgcccgagaccgccctcactactgacggccgagaaggaagaagagatctcaaggaacctgaagaagtatagcaagaagtacgaacaagaagaccaggatgcattcaatcagttgagcgagcaggaccgcaagaggcggacacagcttcaggaagaatgggactcatgggttgccaagtggaagcagatgcatgaggaggagcgtgtttacaggagggagctcagggatggggaggccagcgacgacgaggaagagtatgaggccaaggaagttgaggtggaggaagtcgttgatgtccgtcaagaagttcttgcattcgacctagatcaggagtgaaaacacttatcatagaatctgttgatttctttcctgttggtgttaaagttcattggggtcgcattgcataataggccctagtgatcaagtgcgcaatttactgatcgttgtactgcttatttgtacacttgctgcttgaattgttggatcatgtgtttagatatcaaattttgctgctggattactaaaaaaaaaaaaaaaaaaaaattagttctcccgcgttcacaggtcggcgcccgtcttctt

SEQ ID NO: 11360 - DNA, 2162 bp, Zea mays
ctcgaggccggccgggccggaaaaacaaaaccctccatccattctacacgcgccgccgcactcctgtacacgccccgccgccaccgcctccaccaccacagcgcgcaggaatccctcgttctcgcagagggtttcaggcgtcgtatgtaagagaagatggcgctctcagtatccatggagggcatcgaggcgcgggcacgggatctcggggtggacctctccgctgtcgatctggactccatcaccctcccggccggcgaggacttcggcatcgtcagtgatgacgaggaggtacttcgtggtgaggatcttccagaacttgaaatgggtttgtccaacattattgtcgtggacaatctgccagttgttcctccagaaaagtttgagaagcttgagaatgtcatacgcaagatctacagccaaattggagcgataaaagaaaatggtctatggatgcctgtaaacccagagacaaagaagacatacggttactgtttcattgagtatagtacccctcaggaagctgagctggctagggaaaaaaccaatgggtacaaactcgacaagtctcacatctttgcagtcaatttgctcgatgatttcgagaagtacatgaaagttcctgacacatggacccctgctgaaattaagccatacactgctggagaaaatcttctgaagtggctaactgatgaaaaggcccgagatcaatttgtcattcgtgctggcacactaactgaagtttattggaatgatgcaagaaagctagcacctgagcttgtttttcaaaagcagtactggacagatagtttcattcagtggtcccctctgggaacctacatggcaacggttcataggcagggatcacaggtgtggggcggtgaaaatggcttcgagcgtttgatgcgttttgctcattccatggtgaaactgattgacttctctcctggtgagaggtatttggtcacatacagcagccatgagcccagcaaccctagagacacacatagagttgtcctgaatatatttgatgtaaggactgggaaagtgatgcgagactttaagggaagcgctgatgattttactactggcgggaatattggggtttctggtgtttcatggcctattttcaggtggggtggtggaaaggatgacaaatattttgcgaggcttgggaagaatataatatctgtatacgaaacagatacattctcccttcttgataagaagtctttgaaggtagaaaatgtagtggacttcagctggtctcccactgatcctatcatatctctgttcgtgcctgaaatgggtggtggaaatcagcctgcgagggtgagtctagtgcaaatccctggcaaagaggagctgcgacagaaaaaccttttcagtgtcagtgattgtaagatgtattggcaaaacagtggagaatatcttgctgttcaagttgatagatacacaaaaacaaaaaagagcacctacactgggtttgagctgtttagaattaaggagagggatatcccaattgaggtccttgaactcgagaacaagaacgacaagatcattgcatttgcatgggaacctaaaggacatcgctttgctatcatccatggtgatggccctaagcctgatgttagcttctacaccatgcgaacagccaataacactagccgtgtatccaagctcacaaccctcaaggccaagcaagctaatactctgtactggtctcctgctgggcgcttcatagttcttgctggactgaagggtttcaacgggcagctggaattctacaatgttgatgaactagagacaatggcaacaggagagcattttatggcaacagatatcatgtgggatccaactgggagatatctcgcgactgcagttacctcagttcatgaaatggaggaagtcgttgatgtccgtcaagaagttcttgcattcgacctagatcaggagtgaaaacacttattatagaatctgttgatttctttcctgttggtgttaaagttcattggggtcgcattgcataataggccctagtgatcaagtgcgcaatttactgatcgttgtactgcttatttgtacacttgctgcttgaattgttggatcatgtgttcagatatcaaattttgctgctggattactaatctgtctggttctgc

SEQ ID NO: 11361 - DNA, 498 bp, Zea mays
tacggcggccagtacgcccatgccgccggccagtcctggatcaaaactcatgggtgattgcctgtcagttatccgaaagcattgatgctagcggagaatctgagcgcgttacagaaacatcccgcccgaggcctcgacgcgctgcccggtgatccagttgctgccatcggccagcaaggtggaaatcgccccgccaatgtcatccggcaagcccgcgcgaccgagtgcggtgttgttggcgaccatcgcgttcacgtccgggttgtcccgcaccgcgccgccgctgaagtcggtggcaatcgcgccgggggccagggtgttgacggtaatcccgcgtgcacccaactccttggcctggtagcgagtcagcacctccaccgcgcctttcatcgaggcgtaggccgagtaacccggcaggctgaagcgcgcgaggccgctggagatattgatgatgcggccgctctagaggatccaagcttacgtacgcgtgcatgcgac

SEQ ID NO: 11362 - DNA, 1289 bp, Zea mays
  misc_feature (686)..(686): n is a, c, g, or t
aataaatacccaaagtacatgggagttgtattttgagaaaatcatggagatatgattaccttcttgcactattagtatatcacattgcagatgtatgtattttatttttttatctagatctttccatgtgaagggcaagcctggtgcgttggtgacagctgtcccacttagtcgccaagttgtaagttattgaccatttccttatttattattagggtctcagatttatttgttcttaaaccgtaaaccggtaatcgctgtctattttagttgtcccacttcatttttatttttatccaagtgaggggcggcacatgtcagcgtcaaccagtaattgctgtctatttcaaggtggctcgatggtaggtcatccaccaatgaataatgttagctagcgacaacactaggagagtggaggtaaccaattttgggttgcccggtgactctgctacctcgggcaggtactgactgatctcattactcgcatgtctggacgatatccgatgactctagctaaaaatatacaaacgtttgcatgtctgccacactacacttaaatctctggtctcccggcaaaaacgaagatcaaactagcaattagaaattgtgcgttcacaaccattaaaatcacccgtagcccgtgaagttctcttctccccatagtttatttacttgtcttctatatntaaagggctaatgaaaccggccggaaagtcatcccgtgccattctaaatagaagcaatactgatggcccaaaacaagatgattgtggtggttctcctccttgccacctttcttgtggtggcaagatcgttgtgggttccagaagaaccctcaaatgcggatgacataagaggtgcttgcatcgaggagtgcaccaaagaaaataaggctcctggcgacaagaagacatgcgaagtgttgtgcaccaagctcacaaaaaagcctagcgaagaaggcaaacatgattgatgaagtagcactccgataatatataccctagtggatcagtggtcatctttgtagccatgtctgccacacgatggccttgattatattgtcttattgttttgtttttggtttccactagtatcctaattccttgttcatgtaacctaatgtcactcaaagcattttatatgcttcacttaattaaataaatacaaaggcaaaggcatgttctgttttgataaaaaaaaaaaaaaaaaggggccgccccatctataaaaagaatggtaaagattcttatagatagatatgttcaatgtgccggcctgatcaaatactg

SEQ ID NO: 11363 - DNA, 1589 bp, Zea mays
attaagaaaataggagcagcttcacctcggaagctcagactcagtaggatgcaacaagaacatgcccaaccttcagtaactctctctctctctctctctctctctctctctgtgatcgtacgaaacatttgtgctgctgtgtgactgcgttttggcagatggttggtgcgaaggggtgtgagagatgcagggactggcaggagcactactactgggagcatatggatgcgagcaagatccgcttcttcaggtgcatgacaggagactttgctcatcgcattagcgtgccagagaagttcgcaaagaacttcaaggggcagatcaccgaagagtttcacctgaaatcacctagcagcgctgagacatggcacgtcggtgtagagaagcatggcgacaaactattcctcgtgtcagggtgggagaatttcgccaaggctcatgagctggaggagaacgatctcctgctcttcgcttgctctggaaactcttcctttgaggtcctagtcttcggagcaagtggctgtgagaaagtgtcatccctgtttggcagtggacttggtccggacatgggcaaacaattcaatgatgtggtgcgtcgacatggtgtgcatcactctgtgactgtgagtgattctgaggataccgttgcgccgtcccagctggttcgatcccctcgtaacgccttgcctttgaaggaacccagtgggaaggctagaccaagtaaatatgaatcaccaaactccagcaacttcatcgtcaggcatgtggcaactggcaaagagggcactgatgatgagtatgctaactcaaactactactattcgttgtctgccaatcgactaggagacgaggaaaaggaagaaataataggtttggctcccatccgaccgaacaatcctgtatttgtgacccttctgaggaaaaaccatgttcagcgcagaaacaactgtctgatcatcccaagcaagtttgctgctgatcatcttggggaaagagcgcacaacatcatacttcgtaggccgaacaggaaggagaaatggcatgtcagctactatcactcacgccacacccggtgtttccagaacttagcgctgttcaagttcacgcgcgagaacaagcttcacgagggcgacatctgcgtcttcgaactgatgaaaggcgagaggagagtgacgatgaccgtccatgtcgtcagaaaggccaatggccggttcattctggtagtctgatctgacgcagtgcacctgtactgttgtagtttatgcagtgtgtagtgtgtaggggtactatgcaggggtagcattgcaaactggaagtgcctagtgatgcttgcaaggaatgcaactgcggttttgtgtcatgtaaggtagcttcctgatcagcagcatggcaagtagaacaaggtgtggcttgtgtgtaatatagaagtttctaggaaaatgttacactggcttatgcttttgtgcctgcttcagatctcccatctggtacagcagtgcttttgaacttcagaagtattatttcaaggaggaaaaagggattgttggttggtctacctgagttggatattaaataaattaaatgtaatt

SEQ ID NO: 11364 - DNA, 1473 bp, Zea mays
ctcgaaagaaaataggagcagcttcacctcggaagctcagactcagtaggatgcaacaagaacatgcccaaccttcaatggttggtgcgaaggggtgtgagagatgcagggactggcaggagcactactactgggagcatatggatgcgagcaagatccgcttcttcaggtgcatgacaggagactttgctcatcgcattagcgtgccagagaagttcgcaaagaacttcaaggggcagatcaccgaagagtttcacctgaaatcacctagcagcgctgagacatggcacgtcggtgtagagaagcatggcgacaaactattcctcgtgtcagggtgggagaatttcgccaaggctcatgagctggaggagaacgatctcctgctcttcgcttgctctggaaactcttcctttgaggtcctagtcttcggagcaagtggctgtgagaaagtgtcatccctgtttggcagtggacttggtccggacatgggcaaacaattcaatgatgtggtgcgtcgacatggtgtgcatcactctgtgactgtgagtgattctgaggataccgttgcgccgtcccagctggttcgatcccctcgtaacgccttgcctttgaaggaacccagtgggaaggctagaccaagtaaatatgaatcaccaaactccagcaacttcatcgtcaggcatgtggcaactggcaaagagggcactgatgatgagtatgctaactcaaactactactattcgttgtctgccaatcgactaggagacgaggaaaaggaagaaataataggtttggctcccatccgaccgaacaatcctgtatttgtgacccttctgaggaaaaaccatgttcagcgcagaaacaactgtctgatcatcccaagcaagtttgctgctgatcatcttggggaaagagcgcacaacatcatacttcgtaggccgaacaggaaggagaaatggcatgtcagctactatcactcacgccacacccggtgtttccagaacttagcgctgttcaagttcacgcgcgagaacaagcttcacgagggcgacatctgcgtcttcgaactgatgaaaggcgagaggagagtgacgatgaccgtccatgtcgtcagaaaggccaatggccggttcattctggtagtctgatctgacgcagtgcacctgtactgttgtagtttatgcagtgtgtagtgtgtaggggtactatgcaggggtagcattgcaaactggaagtgcctagtgatgcttgcaaggaatgcaactgcggttttgtgtcatgtaaggtagcttcctgatcagcagcatggcaagtagaacaaggtgtggcttgtgtgtaatatagaagtttctaggaaaatgttacactggcttatgcttttgtgcctgcttcagatctcccatctggtacagcagtgcttttgaacttcagaagtattatttcgaggaggaaaaagggattgttggttggtct

SEQ ID NO: 11365 - DNA, 1545 bp, Zea mays
ggggtccgaagaacagggctctttggctctcttctccaccggtcctaccccttacctcccaagatcacaatcctctgctccttatatattagccacaccgctcgttccccgccgcaccgggtgacacacaggcacaaagacaccgcccgtacacaggctcgttggcttggctgctgtgtgttgcgctcagccattcagacttgagagctactagctaactgctcgttgggtgtgggtgcgctcccggcctagaccgtggaggaaaggagtccagtccactcactaccccctctgctccgttcgggttccaggccagcacagccgagggttccgcacagcgataagcgcgaagcggaagagatggagcatatcgccaggttcttcttcggagtttctgggaatgtcattgcgctcttcctcttcctgtcgcctgttgtcaccttctggagggtcatcaggaagcggtcgacggaggacttctccggcgtgccctacaacatgacgctgctcaactgcctcctatcggcttggtacggcctgccgttcgtgtccccgaacaacatcctggtgtcgacgatcaacgggacggggtcggtgatcgaggccatctacgtggtgatcttcctcatcttcgcggtggaccggcgggccaggctcagcatgctgggcctcctgggcatcgtcgcctccatcttcaccaccgtggtgctcgtctcgctgctggccctccacggcaacgcccgcaaggtcttctgcggcctcgccgccaccatcttctccatctgcatgtacgcctcgccgctctccatcatgaggctggtgatcaagacgaagagcgtggagttcatgccgttcctgctctccctggccgtgttcctgtgcggcacctcctggttcatctacggcctcctcggccgcgaccccttcattattatcccgaacgggtgcgggagcttcctgggcctgatgcagctcatcctgtacgccatctaccggaaaaacaagggccccgccgcgccggccggcaagggagaggccgccgccgccgccgcggaggtggaggacaccaagaaggtggccgctgccgtggagctggccgatgccacgaccaacaaggcagcggacgccgtcggcggcgacggcaaggtcgccagccaggtgtaggcgggcaaggcttatttgctgtctgggactgggaggaacatcctaaacgaggctgccttagtttgtcggtggagcagattggtgttggtttctgtgggcttttacggttgttgttactctcatctccatctctcccaggaggctaccccaagcatgtagtagcttccattctgattctgggacggtgttgcacgttacagtgctctcaagctgtctctgcaaagtgtgtttttttttattccatttccctcctgctcttgttctccaactgcgcttacctgcccccgatttctctaaaaaatgcattaaactatctgagaaattcatccaactgcgaaaactgtgctgtgcgtgaccgccaaaaaaaaaaaaaaagcggcc

SEQ ID NO: 11366 - DNA, 2106 bp, Zea mays
agggctctttggttctcttctcaccggtcctaccccttacctcccagatacaatcctctgctccttatatattagccctcgcgcccccgcccgggggcaccgggtgacacacaggcacaaagacaccgcccgtacacaggctcgttggcttggctgctgtgtgctgcgctcagctgttcagacttgagagctactagctaactgctcgttgggtgtgggtgcgctcccggcctagaccgtggaggaaaggactccagtccactcactaccccccctctgctccgttcgggttccaggccgagggttccgcacagcgataagcgcgaagcggaagagatggagcatatcgccaggttcttcttcggagtttctgggaatgtcattgcgctcttcctcttcctgtcgcctgttgtcaccttctggagggtcatcaggaagcggtcgacggaggacttctccggcgtgccctacaacatgacgctgctcaactgcctcctatcggcttggtacggcctgccgttcgtgtccccgaacaacatcctggtgtcgacgatcaacgggacggggtcggtgatcgaggccatctacgtggtgatcttcctcatcttcgcggtggaccggcgggccaggctcagcatgctgggcctcctgggcatcgtcgcctccatcttcaccaccgtggtgctcgtctcgctgctggccctccacggcaacgcccgcaaggtcttctgcggcctcgccgccaccatcttctccatctgcatgtacgcctcgccgctctccatcatgaggctggtgatcaagacgaagagcgtggagttcatgccgttcctgctctccctggccgtgttcctgtgcggcacctcctggttcatctacggcctcctcggccgcgaccccttcattattgtacgcacacggttctctctctagtctagatcctgagccgcactcaccgcccggccgtacgcacgtgctatccgcgcatgttgtccgattggcactcggaaaccactgtagcagcactgtatcactagctgttgggactggacgtaactgcatctgatctggccagcacagtacccccgggctgggcgtcggttgccctttcgatgtcccgcccaagcccaaccaggcgcacgcccctgccgctgccgcagccgatgcacgggcatgggcgccggtagcgtctagcagcgtgggcgtggccacccacaggcagcgcacgccggtgctagctgccgatgggccgccgtgcccatgtccatgcagctggattggacccggcacaggcagaagcaacagcgcccgcgctctttcttgtcgcaatgctagttagcaaactgcacggtgcactccacttcagtacacaccaacgcgacagactgcgatgaaatatctaaggccgagtttttttttttttgcaaatctcatcatgtcggaatgattcatgcggtccaaacttcagcacacccccactgtcgctaaacccgcgctgtctgtgcatgcgtgcagatcccgaacgggtgcgggagcttcctgggcctgatgcagctcatcctgtacgccatctaccggaaaaacaagggccccgccgcgccggccggcaagggagaggccgccgccgccgccgcggaggtggaggacaccaagaaggtggccgctgccgtggagctggccgatgccacgaccaacaaggcagcggacgccgtcggcggcgacggcaaggtcgccagccaggtgtaggcgggcaaggcttatttgctgtctgggactgggaggaacatcctaaacgaggctgccttagtttgtcggtggagcagattggtgttggtttctgtgggcttttacggttgttgttactctcatctccatctctcccaggaggctaccccaagcatgtagtagcttccattctgattctgggacggtgttgcacgttacagtgctctcaagctgtctctgcaaagtgtgtttttttattccatttccctcctgctcttgttctccaactgcgcttacctgcccccgatttctctaaaaaatgtattaaactatctgagaaattcatccaaaaaaaaaaaaagtgctgtgcgtgagcaatgc

SEQ ID NO: 11367 - DNA, 1850 bp, Zea mays
gctgcaggccgggctctcgctcgtcgcgtttttatctccacccacctctctctctccgaaaccaaaaccgaccggcctcgctttcgccggttacccggtcaaacgcatcaaccgccggcacgtctccgatcggatcacgatggctgccccgtgcccccgccggtcaggccaggtcgcgtggtcacgtgcgacgcgcatgccgtcctcggccggcgccccagccccctcgccgtgtccttttattctcccccgcctcaccgcccgcatccccaattcacgcccccaccacgacttccgtgctcgccgccttctcggactaggggggttcggctcgagatctgatttcgggcgccggaggactacatggaggttagggagatggcgatggccgcggcggctgcggctgcggcgtccggcgggggaggcgtcaagctgccgccgcccaatcccaacctgccctacagggaggactgctggagcgacggcgagacggcagctctcgtctccgcctggggcagccgctacgtcgagctcaaccgcggtaacctgcgccagaagcagtggcaggaggtggcggacgccgtcaactcgcgccggggagcctccgcgcggcgccgcccgccgcgcaccgacatccagtgcaagaaccgcgtcgataccctcaagaagaagtacaaggccgagctcgcccgcaacgcgccgtccgcctggtcctacttccccgagctcgaccgcctcgtcggcccaaccctcagcgcctccgcctccaagagacccttggcgtctctgcctcctcaattcgctttgcccatgcatccaccagccgtgcggaggcccccgtcgccttcgccgtcatcgtcctccccgccgcagccgcctatggctttgcctctacccaattaccgccgtgggtccccgctccctgctgctgccctcatccagaaggaagccgcggctgctgcggctgctgcgtctgattcagaggactccgatgatgcggctggcggcaataatcacaaattgccccggtcgccttcgcgctcggtgtcgtcactctctgccagtaacaagaagcgctgcagagatgaggctggcagcagtgctgacaaaggtttcagagagttagcaagggcgatcgaagcttttgcggagatgtatgagcgtgtggagagtgctaagcaaaagcatgtggtggagatggagcgccagcgaattgaattcctgaagcaactggaggtgaaacgcatggagaatttcgttgatgcccatgtgaagctggctagagcaaagcgcacgaagaagactacagggggtgctgccgacggtgctggtggtatggagttggttgccaccgttgctgcgctgcctttcgtctccacctccaccttcctctgatattgaggaagagtttagagaaagagggagcaaaaaatggtggtccaaggaagcaagctaatccgaaagatagcaagtgaagcgtttggccgggcgtttgggtggtgcgaatttctgggtgatcaaaactggaatgtggattctgcagttggagatagcctttcttttagttgatgacttgaatctgtgccttttgttttcgcctgtctgtcgtgatctggttgtaaataagaaagtcttatgccgctagtcgcaggtcgaactttatcttctatcctaggccctctacttatctaggttgatagtgtaaggtgtctagatagagatctgacctaattgctattctgtcggatcgtttgatcgcgatggatgtcgttgttctgaaactttcctatttcctaatgaaatagggggcttcgccccttcgtcaaaaaaaaaaaaaaaaaaaactcgag

SEQ ID NO: 11368 - DNA, 948 bp, Zea mays
acgacttccgtgctcgccgccttctcggcctaggggggttcggctcgagatctgatttcgggcgccgcgagactacatggaggttagggagatggcgatagccgcctatggctttgcctctacccaattaccgccgtgggtccccgctccctgctgctgccctcatccagaaggaagccgcggctgctgcggctgctgcgtctgattcagagggaactccgatgatgcggctggcggcaataatcacaaattgccccggtcgccttcgcgctcggtgtcgtcactctctgccagtaacaagaagcgctgcagagatgaggctggcagcagtgctgacaaaggctcgagagagttagcaagggcgatcgaagcttttgcggagatgtatgagcgtgtggagagtgctaagcaaaagcatgtggtggagatggagcgccagcgaattgaattcctgaagcaactggaggtgaaacgcatggagaatttcgttgatgcccatgtgaagctggctagagcaaagcgcacgaagaagactacagggggtgctgccgacggtgctggtggtatggagttggttgccaccgttgctgcgctgcctttcgtctccacctccaccttcctctgatattgaggaagagtttagatcatcagtgtcgatctcagtgtgatggcatcctgtccagtgaaaggactgcttggcagtaaacactactgcccttggttactctaaagacggacatgttcttaggttcatcgcagtttgtaatccagtacatgattaattgaagactagaaattcctagcgtaaagctctgctgagagcgtttgtcctggctgttcgcctgattgttttattgactgtagctcagagtgtctgaccttatctggaaaaatatggtgacggaaaatggtcttggagtcaaaaaaaaaaataaaaaaacggccggg

SEQ ID NO: 11369 - DNA, 1272 bp, Zea mays
gctgttgcggacttgacgatgtacatagcgcgggagactccatttgtggggaaggtgccacggagtatcggtggagctgcagctcctgcgcgagaagtgggggctccttctcccgtctgatctttcagtatattcatggattacctgctccaggagtgcattatttgcatcgacctgtaccactgctccacgacttgggatttatggcccttccatagctcgggcaagacaaaggttatcttagtgagactatattttcttccatcttcatctcctttgtgttgtggacattccatccttttatttatcacagcaaacgtttctatactgtcctaatctggcgcagggtgcttgcttttttagttgcttcacaatttttaaggattattacattctattcgacccagctcccaggtccaaattatcattgtcgtgagggctcaaaactggcaactcttccaccacccaatagtgtacttgaagtgctcctgattaactttcctcgtggggtactttttggttgtggtgatttgatattttcatctcacatgattttcactctggttttcgttcgaacttaccaaaaatatggttcgaaaaggtttattaagttccttgcttggttcatggctataattcagagtctccttataattgcttctcgcaagcactactcggtcgatgttgttgttgcgtggtacactgtaaacttagtagtattctttgtcgacaacaagctgccagaaatgccggatcggacgagtggactacatttgcttccattaagctccaaagaaaaagagggcaggcagaaggaggagaaagacagtaaactgaaggacgagttccacaagttactgaatgggaaccatgcggatcctactgatcggcgacagcgggcacagatgaacgggaggcacgacgaagacatcaatcacgcgctctccgaggccactgccaacggcacgtaagggcccgtcggcatctgcttttcaccgggggctttgtccttggcgctcggaggagaatcctcgcgggggtcgagaaaacctgcctggtgtggtgccccgcccccccggccgcctttttctgaattctgaagctgtccgagattccagcgatccagccattcacatcatgcatcttcctgaaccgctgctgcgttgcgttgcgcaagaatcagaatctcgtggcgttcctcggtacagcttgcaccatacttcgtcgcaatgacatttatcagaaaggcacggggggaaatgatcttgtttc

SEQ ID NO: 11370 - DNA, 1717 bp, Zea mays
aaaaaaaaacaatttcaaacctcgcgtcggccgccgagcccatttcaaacccggacgccccctccccaagcgcaccgaggaagcagcaaggccagcggtggtccctttcccctccactgcagtctccagagtctagagacctccaccgtccactccaaagacgagcagcgggcaaacccaagcacccgcccaatccggttcgccttccttctcaccccgcccggactctgcggagagatctggcagcggtggctatgccattgggcgacgacgcggcggcggacttcgcgctgccggacgagctcctggcggcgctgccgcgggacccctacgagcagctggatctggcgcgccgcatcaccgcgctggcggtggcggggcgggtgtccgggctggagcgggaggcggggcgcctgcgcgcggaggccgcggggaaggaccgcgagagcgccgagctccgggagcgggtggcgctgctcgacgccgcgcttcaggagaccaacgccaggctccgcgccgcgctcgaggacaatattaagctcagcaaggagcgggactcgctggcgcagacgtccaagaagctggcacgcgacctgcacaagctggagtcattcaagaggcatctgatgcagtcattgcgtgatgatagttcatcaacacaggaaacagttgacattacaacgtgtgatcagccagtagcatcaaaagcatcatccagtgcagatggtggatctgtcagcaaccctgcaacgaatatatttactgagtcattggatgtgggaagcacaaaccgagatggtgctgcagcaaggcctccgatccagaaatactctctcacaacacacatcactccccgccttaccccagaggccactcctaaagtaatgtccacttctgcttctccaaggcgaatgtctaccacaggaacacccaagttgatgtctggttctacatcaccgtcaaaaactcgaatcgaatctcacatgtcaatgacaccatggtatccatcaagcaagcaatcctcggcggcaaactcgcctccacgaggacgttcaaacccaggtcgcactcctcgaatcgatggaaaggagttctttcgtcaggccaggagtcgtctatcctacgagcaatttggagcattcttagccaacatcaaagagctcaatgcccataagcagtcacgtgaggaaactctcaagaaagctgaagagatctttggtccagacaataaagatctgtacctgtctttccaaggcctgctgaaccgtagcatggtggcataaggcttcacaggtcgcttcgcaagtccaatggagttccctcttccgcaacgctaataggatacgcaagttgttgctggctttgcagagataatgaggttgctgcattggcaacttatctagctgtggatctgaaggcccagctgcaagttttggccccgtaataatccatatcggtggaacgagcggatctctctgaacgactgagtgtgcaaaccagcagtgtcgcttctgtaaaagtggtgtgtgtacttgccgaaagcggatgacaaattcattgcctaaatcagggtgcagtctgtcatgaagcgcgtccttgtaaaaccgtgaaaaaggtaaccatgagagtaacaaacttcatttcgtcgccaacaaagaaggtaacctcaggttaacctcaaaaaaaaaaaaaaaaaaaaaaaaaaaaaaaaaaaaaa

SEQ ID NO: 11371 - DNA, 1210 bp, Zea mays
tccccgccgaccccgccggccccgaaaatagaaaaagtctcctgcctccgcggccgtgccgagccggcatccccttccgtcccccacccccagcagcgatcgcgacgacccgagccggcaagggtgacaggcggctgacgagccccatgggagacaacaagtctccgctgagcctgagcccgatgggcgggcgcgaccgggaccgggagctcctcatcccggtctcgggcggcggctcggcgcccggcgacggggtcgaggacggggacagggcctcctccgcctccgccgcgctatcctcctccggccgcgaggctttccataaggttgtccgcagttgggcttcaaagaagttcatgactggatgtgtaattctcttccccatagcaataacgttctacatcacctggtggttcattcattttgttgatggattcttctctccaatctatgctcaactgggaatcaacatattcggtcttggctttgtcacatctgttactttcatatttttgatcggagtctttatgtcatcttggcttggggcatctgtccttagccttggcgagtggattattaagcgcatgcctcttgttcgtcatatctacaatgcatcgaagcaaattagtgctgcaatatcaccagatcagaacaaacaggcgttcaaggaagtggtcatcataaggcatcctcgtgttggagaatatgcgtttggtttcatcacatcgtcggtatccctccagagttattctggtcaagaagatctttactgcgtctatgtcccaacgaaccatctttacattggtgatatcttcatggtgaattcaaaggatgtcataaggccaaatctttctgtgcgtgaaggcatcgaaattgttgtatctggtggtatgtcgatgccccaaattctgtcaaccctcgacccacagatgatccttggggacagaactggaccaagcagaagctgaagctgctacgagcctgttgtgtacctttctactgattgctagtaacattttcatacaggctaccacgagtacggcaaactagactgtagattccgagcactagtatctgtatattaagttggtgtagttgactcacacggtttgattatttgctggactctggaccatggtttgtactttgtgctgcatccgatgcaagaaagaagcatctcatctctgtctgtgatatccaactgttgtaa

SEQ ID NO: 11372 - DNA, 1328 bp, Zea mays
ccccggggccggccggctccccagagtccatcaggtaaaaaaaaaatcaaaaatagaaaaagtctcttgcccccgcggccgtgccgagccggcatcccctcccccagcaacgatcgcgacgacccaaaccggcaagggtgaccagcggctggccgccgccgcggcagacgagtcccatgggagacaacaagtctccgctgagcctgagcccgatgggcgggcgcgaccgggaccgggagctcctcatcccggtctccggcggcggctcggcgcccggcgtcgatgacgaggacgctgacagggcctcctccgcctccgcggcgctctcctcctccggccgcgaggctttccataaggtcgtccgcagttgggcttcaaagaagttcatgactggatgtgtaattctcttccccatagcaataacgttctacatcacctggtggttcattcattttgttgatggattcttctctccaatatatgcacaactaggaatcaacatatttggtcttggcttcatcacatctgttactttcatatttttgatcggagtctttatgtcatcttgggttggggcatctgtccttagccttggcgagtggattattaagcgcatgccccttgttcgtcatatctacaatgcatcgaagcaaattagtgctgcaatatcaccagatcagaacaaacaggcattcaaggaagcggtcatcataaggcatcctcgtgttggagaatatgcgtttggtttcatcacatcgtcagtatccctccagagttattctggtcaagaagatctttactgcgtctatgtcccaacgaaccatctttacattggtgatatcttcatggtgaattcaaaggatgtcataaggccaaatctttctgtgcgtgaaggcatcgaaattgttgtatctggtggtatgtcgatgccccaaattctgtcaaccctcgacccgcagatgatccttggggacagaaccggaccaagcagaagctgaagctgctacgagccctttgtttacctttgtgctgatgattgttagtaacattttcatacaggctaccacgagtacggcaaactagactccgagcacaagtatctgtatattaagtaggtgtaggtgactcacacggtttgattatttgctggactctgtaccatggtttgtagtttgtactgcatccgatgcaagaaagaagcatctcacctgtctgtgatatatccaactgttgtcaaattactatcctctgtgtagtccttgattctcatctgacaacgttgaattgggttcttgacttgtcgatggttagctgcattcttttcttct

SEQ ID NO: 11373 - DNA, 1222 bp, Zea mays
tcaggtaaaaaaaaaaatcaaaaatagaaaaagtctcttgcccccgcggccgtgccgagccggcatcccctcccccagcaacgatcgcgacgacccaaaccggcaagggtgaccagcggctggccgccgccgcggcagacgagtcccatgggagacaacaagtctccgctgagcctgagcccgatgggcgggcgcgaccgggaccgggaccgggagctcctcatcccggtctccggcggcggctcggcgcccggcgtcgatgacgagggcgccgacagggcctcctccgcctccgcggcgctctcctcctccggccgcgaggctttccataaggtcgtccgcagttgggcttcaaagaagttcatgactggatgtgtaattctcttccccatagcaataacgttctacatcacctggtggttcattcattttgttgatggattcttctctccaatatatgcacaactaggaatcaacatatttggtcttggcttcatcacatctgttactttcatatttttgatcggagtctttatgtcatcttgggttggggcatctgtccttagccttggcgagtggattattaagcgcatgccccttgttcgtcatatctacaatgcatcgaagcaaattagtgctgcaatatcaccagatcagaacaaacaggcattcaaggaagcggtcatcataaggcatcctcgtgttggagaatatgcgtttggtttcatcacatcgtcagtatctctccagagttattccggtcaagaagatctttactgtgtctatgtcccaacgaaccatctttacattggcgatatcttcatggtgaattcaaaggatgtcataaggccaaacctttccgtgcgtgaaggcatcgaaatcgttgtgtctggtggtatgtcaatgccccagattctgtcaaccctcgacccggagatgatccttggtgacagaaccggaccaagcagaagctgaagctgccacgagccctttgtgtaacttttgtagtggtttgctagtaacattttcatacaggctaccaagagtacggcgaactgaacttggagcacaagtatctctgtattaagggttgagctgtgccttttttttgttttgaaaaagctgctgtgagttatgtgttatacaatagctgttgtgagttgtgaaaagaaaaaaaaatcatttggtggcacaaaaaaaaaaaaaaaaggcccctagggcc

SEQ ID NO: 11374 - DNA, 3033 bp, Zea mays
gtacccctcggagctgtccggggctcactccccgtctcacaaaacgccgcccttggatgagccaatcttcctctcgcacggcccactccttacccccaccgtcgacagccgccgccgccgccgccgccgccgtcgacagccaactccccgcgcccccaccgcctccgcgcaccgccccacacctgattgcgcgtccagaggtattcagagctctctgctgtcggagcaacgagggcagggatgagggaggtggtgacggtgcaggtcggcggtttcgcgaacttcgtcggctcccacttttggaacttccaggatgagctgctcgggctcgccgacgaccccggcgccgacccggtattcaggaccgccgcgctcgacatggacgtcctgtaccgcgccggcgagacacaccagagcgtcgccagctactgccctcgcttggtatcagtcggttctcgagggtctcttggctcgttaagttcctctggcactctaggttcgagcagtgcagctgcagatgagcccaacatcttcacatggtctggaaaggtaacaaaatcagtagcaaaacctcatgagcgaaacttgttcctacaaagtttatctgaagaagaacagaacccaagctctagcgatggccaaaacaatgctagtgttgaagataaggacctggtcgcaaatctggagaatggagtcaaattttggactgattattcaaaagttcagtatcaccctcagagcttatatgagttgtatggatcatggacagactttgacaggtttgataactatggaactgcaaaggaggtggtttcagaatggtcccaaatggaggaaatgaatgagaggctaaggttctttgttgaagaatgtgaccatatccaggtcttgtcttttttacagcaaactatcaataaacactctattcacacaatgggctgtgttcacttacatatttagtgaatttatagaatttttctctcttttttcgttgaggtcttgacctttgaaattattgatcttgatttactacagggtatccagtttcttgtggatgattctggaggctttgccagtgtagctgcacagtttttggagagtattgttgatgattacacaaatacccctgtaatgctgtattgtgtgcggaatccagactcctatgggtcttccagaaatcagcgtgaaaccatcataagatctttgcatgatgctgtatctttgtcgaaactttcatactactgcaatctgatggtaccaataggactgccttctttaagtatgcttctgattgcttataatcttttacgtagactgccatataacatgtgattctcttatccattctccattgtagcatgttcgtatgtgcagatccttataattctactgaatgtacagtaaactcataattggacttgtgattctttttagtaatttgaggcttcttatagcagtgcttggaccttagttttgcaaatgtttcatttcctgatctttgatcataagctaaataaacattcagatgttgcattcttcacctcaaataactcacacacctgctgttggtgaatgcaatgctcattctattataatccagccctatggtcagcatgcctatcactgtcacattgtttataccgaattttgtgtaggttttgtgaaagcttgttgatgtgtgttcctctaacattgtttttttttactttgactgttcaggttacttgtcacctttgctttctataaaagatgagaagcacttccactccagtgccatttgtgcagcagcaatgcattcattatctattccattcaggctacaacacgtgggcccggcctcagattcagcgcattcatctggtaagcttgatattggtgagcttgtgcacatattatctgatcaagggaggcagaacatgatcactgcgctggatgtagcaatgcctgccccttctttgacagatagaacagatttgaggaacatacagaggagcttgcattctctgacacctgaaatcagcgacgaggatgaagatccttacgctgttgaatccatggtggttcatggagtcctagatgcaggcgggaaaagggcttccatatctcaggtgaaggaatccatctgttcagcactggaaggcagggcgacgaaacccaagttctcccacctctcggtatcgccgtgccccctcccaatcccgctcccgttcccgtcaatcttcagcagcagcgtaggccagcagggcgagatcctcggcaccagccatgcagaaggagcccggccaaagggtccgcttgccgtcggctcggtaccgatggcagcgcgcctgaggtcgagcagcgccatagcgccattcatcgagaggaggtcggcgagcctccagaggctcggtgtcgccaggggcacactgggctcgcaggtcctccacgactggggcttcgggagggaggaggtcgaggacatggctgagcacctggcgaagatgctgcgcccgttctacccggaaatggacctgacgtcggattctgatgattaggtttcactgtcattgtgtctcgtattaccggatggtaagcagctgggttttagtctgtgggaactagaaactgtgatgcagatgcagctacgccatgctgcgatgcattcctctggtctgtgttgaagggatgcagagtactggaaacgagatctgagagagcctgggcgtgtgaccgtgtcattcagcgctccgcatgtgatgcacgtgcatttgggcgacgacgcggacgtccgccgccatgggcagttgttgttgtaacattgtgcaatgatccagccctgatgcagatgtccagatctgtgctacacttacctgcaaaccacacagctaatgaaactaaagaacattctttctggtctgagatgttttctttgttcgttttaacttggcgagcaccagaactgtaaacctggcagtttttctagtatgaaaaaaagcattatttggctcgccaaaccgcattgttcagttggatcttcatatcatcacagcc

SEQ ID NO: 11375 - DNA, 2437 bp, Zea mays
cttgtcttttttacagcaaactatcaataaacactctattcacacaatgggctgtgttcacttacatatttagtgaatttatagaatttttctcttctttttcgttgaggtcttgacctttgaaattattgatcttgatttactacagggtatccagtttcttgtggatgattctggaggctttgccagtgtagctgcacagtttttggagagtattgttgatgattacacaaatacccctgtaatgctgtattgtgtgcggaatccagactcctatgggtcttccagaaatcagtgtgaaaccatcataagatctttgcatgatgctgtatcgttgtcgaaactttcatactactgcaatctgatggtaccaataggactgccttctttaagtatgcttctgattgcttataatcttttacgtagactgccatataacatgtgattctcttatccattctccattgtagcatgttcgtatgtgcagatccttataattctactgaatgtacagtaaactcataattggacttgtgattctttttagtaatttgaggcttcttatagcagtgcttggaccttagttttgcaaatgtttcatttcctgatctttgatcataagctaaataaacattcagatgttgcattcttcacctcaaataactcacacacctactgttggcgaatgcaatgctcattctattataacccagccctatggtcagcatgcctatcactgtcacattgtttataccgaattttgtgtaggttttgtgaaagcttgttgatgtgtgttcctctaacattgtttttttactttgactgttcaggttacttgtcacctttgctttctataaaagatgagaagcacttccactccagtgccatttgtgcagcagcaatgcattcattatctattccattcaggctacaacacgtgggcccggcctcagattcagcgcattcatctggtaagcttgatattggtgagcttgtgcacatattatctgatcaagggaggcagaacatgatcactgcgctggatgtagcaatgcctgccccttctttgacaggtacgcagacaacaaatgtcttgtttggtcaccatgaataaaaaatgatctcgtttgctaactgtgtattcctggtttccagatagaacagatttgaggaacatacagaggagcttgcattctctgacccctgaaatcagcgacgaggatgaagatccttacgctgttgtgtccctggtggttcatggagtcctagatgcaggtttgatttcttgttccagttttatgtattactccgctagattttgcttaataaatacttcatcagcagacattttgcaatatccatgtcatggctaactttaggctgtacaaagtaaaagaaaaattggttaacctacatttcgtcgatacaggcgggaaaagggcttccatatctcaggtgaaggaatccatctgttcagcactggaaggcagggcgacgaaacccaagttctcccacctctcggtatcgcggtgccccctcccaatcccgctcccgttcccgtcaatcttcagcagcagtgttggccagcagggcgagatcctcggcaccagccacgcaggagcccggccaaagggtccgcttgccgtcggctcggtgccgatggcagcgcgcctgaggtcgagcagcgccatagcgccattcatcgagaggaggtcggcgagcctccagaggctcggtgtcgccaggggcacgctgggctcgcaggtcctccacgactggggcttcgggagggaggaggtcgaggacatggctgagcacctggcgaagatgttgcgcccgttttacccggaaatggacctgacgtcggattctgatgattaggtttcactgtcattgtgtctcgtattaccggatggtaagcagctgggttttagtctgtgggaactagaaattgtgatgcagatgcagctggcgtgagacgccgtgctgcgatgcattcctctggtctgtgttgaagggatgcagagtactggaaacgagatctgagagagcctgggcgtgtgaccgtgtcattcagcgctccgcatgtgatgcacatgcatttgggcgacgacgcggacgtccgccgccatgggcagttgttgttgtggtaacattgtgcaatgatccagccctgatgcagatgtccagatctgtgctgtacttacctgcaaaccacacagctaatgaaactaaagaacagtctttctggtctgagatgttttctttgttcgttttaacttcgcgagcaccagaactgtaaacctggcattttttctagtatgaaaaaatagcattatttggctcgacaaaccgcattgttcagttggatcttcatatcatcacagccagaacaagagggcaaatgcagcatttcttgcatggtgttggggttccc

SEQ ID NO: 11376 - DNA, 1343 bp, Zea mays
gccggccgggctccgggttaaaaatactactacacaaaaatcttccccactccccgtctcacaaaacgccgccgccgccgtcgacagccacctccccgcgcccccaccgcctccgcgcaccgccccacacctgattgcgcgcccagaggcattcagagctctctgctgtgggagcaacgagggcagggatgagggaggtggtgacggtgcaggtcggcggtttcgcgaacttcgtcggctcccacttttggaacttccaggatgagctgctcgggctcaccgacgaccccggcgccgacccggtattcaggaccgccgcgctcgacatggacgtcctgtaccgcgccggcgagacacaccagggcgtcgccagctactgccctcgcttggtatcagtcggttctcgagggtctcttggctcgttaagttcctctggcactctaggttcgagcagtgcagctgcagatgagcccaacatcttcacatggtctggaaaggtaacaaaatcagtagcaaaacctcatgagcgaaacttgttcctacaaagtttatctgaagaagaacagaacccaagctctagcgatggccaaagcaatgctagtgttgaagataaggacctggtcgcaaatctggagaatggagtcaaattttggactgattattcaaaagttcagtatcaccctcagagcttatatgagttgtatggatcatggacagactttgacaggtttgataactatggaactgcaaaggaggtggtttcagaatggtcccaaatggaggaaatgaatgagaggctaaggttctttgttgaagaatgtgaccatatccagggtatccagtttcttgtggatgattctggaggctttgccaatgtagctgcacagtttttggagagtattgttgatgattacacaaatacccctgtaatgctgtattgtgtgcggaatccagactcctatgggtcttccagaaatcagcgtgaaaccatcataagatctttgcatgatgctgtatcgttgtcgaaactttcatactactgcaatctgatggtaccaataggactgccttctttaagttacttgtcacctttgctttctataaaagatgagaagcacttccactccagtgccatttgtgcagcagcaatgcattcattatctattccattcaggctacaacacgtgggcccggcctcagattcagcgcattcatctggtaagcttgatattggtgagcttgtgcacatattatctgatcaagggaggcagaacatgatcactgcgctggatgtagcaatgcctgccccttctttgacagatagaaaagatttgaggacatac

SEQ ID NO: 11377 - DNA, 2841 bp, Zea mays
gcagcggcatatttcctccaggccaggcagccccaccgggcaccgggccaccacaccacgtgacatccgtttcgtacggcctcccccaaaaatctcaccgtctctctctcctaacgaagaggagagggggcagaagaaaacctcgcgcgggggaggcgcgagaggaatcgcgggggccggaggagcagcggccggtggaggtggcgcgcgcggtggccgtccgagatggagtacatatcccctgagagaaatctggaggggacttgtggagatcctgggccgttatttgccgaccaaggtggcagcttgttggaccacttgggttatcaagggggaggaattccacaacatgagtctccaacactggatcatggacttttggttgatccagctggtgcaattccgtatttatctacagattctccgcccttcatgaatgatcaaatcacttgcaatgttataaaatctgcttcagctagtccagaatcttgtacaaaacaacctcaagaacctcttaatgtagaatctgatgtacagaatgacgcagctgaacaaaatgttcacaatagtaactctgaagaacagatcacttctctgggctgtgatgtacagcagaacacagaagtaattgatgaactgttgcctccaaagcttcctgaaagcagtggtaatgatatatcaaactttcaaccggaaactacatattctgatgcctaccatggtgactctttgttaactgaaaatagttgtaatagttatcagcttaacaatagtggtgctcctgctgctgatattccaaactctcctgcacttcagatggaaaatgaggagatgggaaagttacatgagacttctcacaatgaaaacagtgggtcagaggatgatcaaatgaatggtaggaagccttgccccattagtggtcgagacaatgagaagtttaacacttcagctgtacctccctcttgggaacagacaaaacaaaaaaatcctggtaccagaaatggaagttcaactccagacgatcaatttgattctcctccagacaggtttgcaagattggaaagggacacaccatctccagatgggagagtatcccctgaaaggtttgcaagactggaaagggataccccacctccagacggggatatatctcgtccaggtgaaagttcacatgtccattctgagacgatggagatggagccagaatatcgcgccaatgatgataccccacctccagacgggaggatgtctcctccagttgaaagttcacatgtccattctaagaagatggagtcacaacaccgtgccaaagatgttggtgagttagctcgttttgaaagcccacaggtaagacatcggtcccgatcttctgaaaaacatgaccccagccgcaaaagaacctcttcaggggagttgtctccacatgcgcgtcagaattctcctgtagaaaggaaaagacggagagagtctcgacatggtgatgggtcacctcgacagagatctgcatctccccgaagaagatctacaccccctcgaagaagatctatatcccctcgaagatcctcacacaagaggagggaatcaccaagaaggggagactcacctaggaggaggcactcacctaggaggagggagtcaccaaggaagagagactcaccaaggaggagagactcaccaaggaggagggattcaccaaagaggaggagggactccccaaggaggagggataggtcaaaatcaaggtcaccttcaagaaaacatgacacttctagacataaaaaagaacatgacagatctcggtccaggtctccccactcaagggatcatcacagacgatctccaaggcattcaccaagacgcagatcacccccagccagtcatcgccatcattcaccaagaagacattggtcaccacctgccaacaggaagactggattgggtaagcctggaaagaatctctttattgcaggatttagctatgccaccactgagcgagatttggagaagaaattttgcaagtttggacgtgtaacaagtgcacgtgttgttcgtgataaacgaactggagattcccgtggctttggattcttatccttggataaggatgaggatgctgatgcagcaatccgtgcttgtgacgagactgagtggaatggaaggatcattcttgtggagaagtcaaaagcacctgcatggtgaatcttccgctttgggggcgcacacgccattgttcgagagggatttcattgcttcacctttcacagattttaccattcagaaaaaaagaaactaccggtatgacatactcggtacatgtcaaagttcacccgaacctggcttttgatgctgtactaggagtaagagtattaaataatgcacttccttgctgatagttgttgaaagaataagatgtaacgttgcaccttagcttgtttcagggccctgctgctgataagagggacttacgacttagtggtacttttagtgtctgcaacctctacacgtgaaatgtgatacgtgcctgttcgtgagctgtcagttctcttcttcaccttcatctcgcgcccactgaatactgatggcatgaacggattccgggagactcaagctttatggtgttgttgcgactcaagggttatgttagcagttcaataatctgcatattagcttttcaatgttgtgcatcctctgaatgagggtttggaaaatgtcctatatagtttgtgttttggattccagatgttgtttaattatggtcacgacacgatacctatgccccatctgttgactgttggtgatgttttttttcctgatgacatgtcttttcatcctgtgttcttg

SEQ ID NO: 11378 - DNA, 1122 bp, Zea mays
accgggccaccacaccacgtgacatccgtttcgtacggcctcccccaaaaatctcagcccgtctctctctcctaaagaagaggagagggggcagaagaaaacctcgcgcgggggaggcgcgagaggaatcgcgggggccggaggagcagcggccggtggaggtggcgcgcgcggtggccgtccgagaaggcattcaccaagacgcagatcacccccagccagtcatcgccatcattcaccaagaagacattggtcaccacctgccaacaggaagactggattgggtaagcctggaaagaatctcttcattgcaggatttagctatgccaccactgagcgagatttggagaagaaattttgcaagtttggacgtgtaacaagtgcacgtgttgttcgtgataaacgaactggagattcccgtggctttggattcttatccttggataaggatgaggatgctgatgcagcaatccgtgcttgtgacgagactgagtggaatggaaggatcattcttgtggagaagtcaaaggcacctgcatggtgaatcttccgctttgggggcgcacacgccattgttcgagagggatttaattgcttcacctttcacagattttaccattcagaaaaaaagaaactaccggtatgacatactcggtacatgtcaaagttcacccgaacctggcttttgatgctgtactaggaggccctgctgctgataagaagagggacttacgacttagtggtacttttagtgtctgcaacctctacacgtgaaatgtgatacgtgcctgttcgtgagctgtcagttctcttcttcaccttcgtctcgcgcccactgaatactgatggcatgaacggattccgggagactcaagctttatggtgttgttgcgactcaagggttatgttagcagttcaataatctgcatattagcttttcaatgttgtgcatcctctgaatgagggtttggaaaatgtcctatatagtttgtgttttggattccagatgttgtttaattatggtcacgacacgacacctatgccccatctgttgactgttggtgatgtttttttttcctggtcctgatgacatgtctttcccgcccccggtcttgaatctag

SEQ ID NO: 11379 - DNA, 2478 bp, Zea mays
tcgatcaccatacgttcgcgtaattcaattcgcccgcccccgccaggtccgcgggggaacaaggtattgaaattcatctttacagatcggaggaagagtaggttattcagcccgagactcgagatgatcgatcttgaaatgagaagagaaggacccacccaataaataaactattccaatgactttgttcgcttcccctgaggcaacggctgtactcggcacacagacctggcttatgagcaggatttttcagccaagccaagtgcgtatggttgctacctgtattctgataggccacttaatgacactggctcccagttattgacttatgaagaatggcttctcgatggaagagaaacaataataggaaaataggaagctgcaatcagaaccggctaactagacaaaaggagagagattggctcagttcagtaggaggaatttctaccgattattgagtggtttgtttcctttcccctgaaaggtaaaatggtttatttgcacctgtagtgggacacctctcccagctcccagccagggttcaagcaggaaactatgttaaggagctgatccgaatacagatacaaggcccccactcatcacaacgaacggtgagctttcccactagccttcacaggagcagcacaatcatggccaaaaacaaaaaaaaagatatcgtagtacgagaaaaccaatggcatttctctattctaagtctaagtctaagtagtttcttcttttctttttagaggacctggccaactctaattccaatgctgcaatcctattggtttactgaatgagggtgggtagaccgaaacgctgaagtgttgttatttacttccttcgataacatagattgttcactcttatgccccatgcataaaaatggcttgtgctttagaataaaagaatagaaaaaaagtaggtggatcgggatcgctattacgagtattcgagttcttgttttcctttccttggaaagggaattatttcatgagaagtgcaccggtagaaattggactaaatatgatcttgatccatagctcgtccactttcttgataaacgactcgatgcattgcattttctcttccttgccgctgagacatatcaaaaagatctattactaaaaggagattgggatcatcctgtggttaccggatgatgggaataactaagcagaaattaggaaatgagcacgaaatgtctataaatgaattttctcattatttgttatttttgggtcttttcgttgcattcacttacaacaagaaacaaccaccagcgtttggtgcagcacttgcattttggtgcattcttctttctttccttggtcttttgttctgtcatatttcaaataacttatctaattacaacgtattaaccgctaatgcaccttttttttatcaaatctcagggacatggtctaatcatgagggtagtattttcttatggtgttggatcctaagtttttatggattccttttttgttaccggtaccggggtcgaccccaaagccataatgtctcaaaacgcagaggctatagagaaacttttattttttcctttgtctcgaacttcgtgaagaactccattctatctctccaacaaaaaagtggagctgcgccccagttgtacactcccttcgttcggagaacccttgttgattctgaacttcgttcgcaaagtaagcgtccttttaacgggccagccctttttaatgcgccgcttgacccagttttgaaaatgagctttgctcttctgggcgctgggcgctcccgtggttcgcgagaaggaaaaaggactaatcttttgttacatctggcacgagatgaaaaagagagagcttcgtctatcgatgaacagcagattgacggagctcttggcattgctttgtttttctctcctttcctatcagcgagttccgatccttttgttcgaaatttcttcgttcgtaccgaaccgcttgcagaatcaaatcctgttccacaagatcctatatcagctatacatcctccttgcatttatgccggagacgtcgccagtgctatgggctttgggttatgtagatcaaaaatgatgaatgggattgtggcactccactcgccgccaatgcggaaggatgccgccgaaaagaatggaacgctgcttcgctctgctggatgcgtcggatcccatataagaagctcgctctttacccgatcattcaaacattttgtgggcggcgcgcctgctctattgttgcgtagcaatagaagcctgcttcggcggcgctttttcgccttctcttcgctctggacaggagcgctaatggacacggggagggagcaggcgaagcgtgttgtcgttcgtaatggaaagaaagacaccactacttcgcctctttgttggaccgccggcgcgaacacagtggtctctgaccaggaccaagaaccaattcgaatttggatcttgacatgttggttgttttaaccgta

SEQ ID NO: 11380 - DNA, 585 bp, Zea mays
gaattcggcacgaggcaccagcatcctcaagcaatggtggcaggagcactccaagtggccataccccacggaagacgataaggctaagctcgtcgaagagaccggcctgcagctgaagcaaatcaacaactggttcatcaaccagaggaagaggaactggcacaacaactcccagacgtcaaccctcaaatcgaagcgtaaaaggtgatggaggagagctagctgcaccgtatataccgtgtatgtaacgcacacctgctgacacacatgtacacatgtataccataccaacacgctaatcaaacggagctctgcatggcgactgtactcacggaaataaagaggaccatatcgaccggttcaactgtatatctagccattagtctgaccactggcatatttgtttgctgcggctgatactttgagctgatgatgtgtggctcacagcatactttattcttgttcttattgtgttgacatagtttgtcccccataatcttgaggattaacaaaaaaaagaagaaactcggggggggggccgggacccagttgggcctatgggggaggggattacgcgcgctgact

SEQ ID NO: 11381 - DNA, 1101 bp, Zea mays
cggggagaaaccaatagtggcaattattgttcggaggccatcgccgctggtgggcggtggcttccccttcccctgtattagcagcgaggaggcagcagctgaagctctcgtctctgcctctccggacctccggtgaactccaacagagaccacctcctccatccgtcggtcatccatctgtgattccttttgcgtgtgcaagttgttaaatcggcacacggcctccgcttttggagtggagaggggcatatacggtttactggtgcgcccggggccgccgcttttcccgctggcctctccccggccgtcccattggagcgcgcaaagctgggcggcaccatttaaagaagcaaactgcactccaccattaccagcaccaaggcaccaccaccaagcgcaccgccacgccacacgatctataacgcgcaggcaggcgaggatcagaccggccggggcttgccttctccgttggggttcctgcttgccgcggcgcgagaacagatatattggatcggatttgtgccgggttcttggagcagtaggcaccaaactggtccaggttgggcaaaaatgcagtttaaccagtagctaacggagctctctcatcttgtactgtggcatttcttaagttgtctgggagctgaatctccaaggctggaagatccaacatctgttctcgaaaatttactgtacctgcagatggcagacgatcctaacatgaattttggggcattctcccagtcactctgcaaccagcatgtagtttcatttcagacaagcgtagccactagcggctcaggaggcatgccaacatacctggattgttccactgggatggatgccagcgtggggatgctgaccacaccttcagtggttgtttccactggttcatccaatatgccagcagattccgggcagagcctcaaatatggagggccactggctgcggattggacacagctcgagcttgaaattctgagagatggcatggagaaatatgttcatgaacaaggcatcatgaagtatataaagatagcagcatcgttaccgaacaagacagtaagagatgtcgcaatgaggtgccagtgggtagggaagaaa

SEQ ID NO: 11382 - DNA, 2209 bp, Zea mays
ggtagtagttgccgcctccaacaaattttattccagccggatggcaccatttaaagaagcaaactgcactctaccaccaccagcaccaaccaccattccaccaagcacgccgccacgccacacgatctaacgcacaggcaggtgaggaccagaccggccggaccttgccttctccgttgggggtctctgcttgctgcggcgcgagagcagagattagatcggatttggggctgggttcttggagcagtaggcaccaaacttgtctggttgggggagctgagcttccttctacgctggaagatccaaaatctgttctcgaaaatttactgcgcctacagatggcagatgatcctaatatgaatttcagggaattctcccagtcactctgcaaccaggatgtagtttcctttcagacaagcgtagccactaccactagcggttcaggagacatgccaacatatctggattgttccactgggatggatgccggtgtggggatgctgcccacaccttcagcggttgtttccactggttcatctaatatgccagcagattcagggcagaacctcaaatatggtgggccgctggctgcggattggacacaggttgagcttgaaattctgaaagatggcatggagaaatatgttcatgaacaaggcatcatgaagtacataaagatagcagcatcgttaccgaacaagacagtaagagatgtcgcaatgaggtgccagtgggtagggaagaaagtccatacaagacgaaggaagccccaaggaccccctactgggagaaatacaaaagaaagaaaggataaatttgtagagtctgcactgtggggagcaaatcatccaattcgaagaggtatgagagcctcttcatttatgctgcataatgttcaaaacaatatgtttctatgtggaggttggtaggtcacttgactacttgagtatcaggtctaattgtttgcttccatgtatcttctttgtttcttgttatctgccgttaactgtctcgtgcaattatcaaatattatgatctggcatttggtttttgcatttgagaggataaatactgctgccaatactggagtgactgaactatttcactttatattgactccattgctaagtttatcgcagtttctagtgtcaagtaacagaaagggataaaaaaaagtcgacacttcggatgtttactgttcaagaacatgaatgagaagagctttggcctctgagatagatcgtccagtgcagcatctactggaggaaaacaattggcttcttaatcaaatcgaaacaaatattcagaaatttcagcctcataacaacattgttctcttccatcgggcaagaaggagcatcaatgatcttctacagatcacgacccaactgtttggactttttaggacaaagatgcctccactaagcgtgtcagtggatgaaaatcttgctagcttcgtgcttcctggcattacaacggatcaagctcttggaagcaacctttgaaggaggagccaagaggatcactgccaagtgccaacacgtttcagtttaggcagactttgggactttattgctagatggacgggacggagcatgtggagaaactactgcacaccaggtggatggagatcaatagggtcgccattcaccaagggcccctgctttctctatctgaaagctaaaggagaggtgactgaaaccgttcagccgtcctgccctgcaactagccttaaacattggtggctaaacatcgagggtcttaggaactgcagttttttggccttgctgcacttgtaaataactaggattcttttttggtttctccttcagacggtagggtgggtaaatagatgcagcggaggaagctcccgagaagggactcgctacataacaagtaggaacctttttgcctgtcgctacttgttgcgcgtcctgctcctgcatgtgaacgtaatccgtggcatctgccactctggcaacgaaacagagaagagaaactgccgaatagaaaaaaactttgtgcaacacgcgactgacaaagttaaaagacttaaaagaattctaaaaggatggaatattaatgaagaaggttccaataggaggaaaatcaacaccctgaaaatgattctgaagagattggacattaaaaatgagtctgagaatctctctgatagagagaaaaatgaaaagatggagtatgaactgca

SEQ ID NO: 11383 - DNA, 2678 bp, Zea mays
  misc_feature (704)..(704): n is a, c, g, or t
tatgtgtttatacagagagagacatgtatagaagtatagatacagtataaaggtatagatgtacttaagactgtcttagtcatgttgaaaaggaaaaggtccatgcatttgggccgctctctttattctcgactagttagctacgattctcgctgtctaccacgaacccctaatctgattagacggcacgatattccgaagcgcgctaaagcagttccccactaacaagagacgatcatatacttttatcagcttcttttacgtaaagtatttctgtttcgaatactttatgctatagcccataatgttgactgttgcggcgtagcacagttccttttaactaatgctgtcctccacatataattgcgtgcactttcaaattaatacatatcttattcaacccactgtatatatataagagcatctacaacctatataaatgtcatgtatcttaaaggttattaagacggtaaatataaaaaaatataagagacaatatcttggtgaagtaacgtctatattatggttctctaagtatggttctatttatacaactcatataaatgagtcgtaactgaataagatataagacttagatatattagattgtatgaatgtgattcttaggtgtatctagtgattggagaaccaaaacgtagtattacatgccctaaaggtaattaataaggatttcagataactanagggtctacagcatatataatggatatacggttttggcaatttgtaaatgaaacagcgtttgagcgcggtgctaatcgataggttgaactagatgtacctcgcatgatgtctttgcctgcatgccagaaaagttattagtcagaggcatcaagtagggttccttctatctgaggtactgcgctcccggccggggtgctcagcatgttgccttgatggttgtcccatgtctggcctgctggtccctgaccaatgacccctcacccccttgtccaactgtatgcaacatatatatatattatatgcaacaaactaaaattcttcatgttcacttaattaatttattctaattaatctcttgtgtggaacccacaggcaccatagttgtgagcaaccagcatccactcaaggcattgcttatcctaatcttcttgtaaaaaaatatgtgtacataccataccattcttacgaaggcacgtagttggtaggaaaaaaattctcttacatcctagatgcaaacaccatcttttacagctcctcacatctatcactatttacttggaggtccacaaaatcaaaatttgcaacttaagcctttaataatttgtttttcttctatttatatgaaccaccagatggcggatgtaagggactgtaaaagtgattctttgcatcccagatacaaagaatttttttccccagttggtgcatgcacgcaccagcaaatacatcaacaaagaggtgactacttgcatagcatgtactggtacaagtcagtggctttatttagcctgcctttagcttatggggaggctagctatctagttaatcaaacaggctgaacgaaccagcaagtctaatgatgacaagaccctgaaaattccacagggaaagctctgaccaacccctttagcctgccttttgtttttttttaataaacagcattcccgcaaaagggactccactgagattcattgacagggaagcaaaatatatgacaatccttggggccagccacgccggcccgccccccactaagcctgaggagtgcatgccctcctcctctcctcttggttcttgcagacaactcgcacctgcaggttgttcctttgtgtccaaaccaagtaaaggcggcaggctcctcacattctcctgccatatctgctgcccgctgctccccccctctctcttcaagctagccagtagctggctgaatggtcctcgcgcgagccatggtgatggagcacaggaagaagtcgaattatcttgttgccctcgtcttggcttcgctcttgctctccgccatggcaggagggcatcggaagaagcttctgaacaaagacgacgcatcagaatcaatggagacattggaatccacgcagcagctgcaggaagacgacgaaatggctgtggtggtccacgagagaattctcaggcaggcgaagatgaacgactacgggagctacgactcttcgccgaccatggctaagcctcacttcaaggacatacctaactagccagccccactagctactatatacattgaggtgttgcttgctagtcgagtcgcctctcctccgtcctcatacacaagcatacttgcctaataaattccatgtatcatcaccatgcatatatgtgagaatatatgtactgccgcttgatgtatatgtgcacagtgcacacactacctacatgtttatatatgtgcatgttcgtcgtcgtccatttcgaaatcgagtatatttgtgttgtataattgactaatatgaaagtttactagtggtggacgacctaaagtttttatcaaaggatgatatgatcctaaattttgctgcggtaaagtatatttagcaattcggtaaatagttgtaatacttgttcctatttcactatgcaactactttctgttcatatgtgtaatagacttggcctaaataaaaaaatcctggaattcgtataaaaaaaaaaaaaaa

SEQ ID NO: 11384 - DNA, 808 bp, Zea mays
gaagccagaggagtgcatgccctcctcctcctctcctcttggttcttgcagacaactcgcacctgcaggttgttcctttgtgtccaaaccaaggaaaggcggcaggctcctcacattctcctgccatatctgctgcccgctgctcccccctctctcttcaagctagcttgtagctggctgcatgctcctcgcgcgagccgtggtgatggagcacaggaagaagtcgaattatcttgttgccctcgtcttggcttcgctcttgctctccgccatggcaggagggcatcggaagaagcttctgaacaaagacgacgcatcagaatcaatggagccatcggaatccacgcagcagctgcaggaagacgacgaaatggctgtggtggtccacgagagaattctcaggcaggcgaagatgaacgactacgggagctacgactcttcgccgaccatggctaagcctcatttcaaggacatacctaactagccagcccactatatacattgagaggtcgatatatgttgcttgctagtcgagtcgcccctcctcctcatacacaagcatacttgcctaataaattccatgtatcatcaccatgcatatatatatgtgagaatatatgtattgccgcttgatgtatatgtgcacagtgcacacactacctacatgtttatatatgtgcatgttcgtcgtcgtccatttcgaaatcgagtatatttgtgttgtataattgactaatatgaaagtttactagtggtggacaacctaaagttttatcaaaaaaaaaaaaaaaaaaaaactcgacctgca

SEQ ID NO: 11385 - DNA, 2992 bp, Zea mays
  misc_feature (2054)..(2054): n is a, c, g, or t
aattagataccaaacctagactatagtcacggaaataggtagatgatgccgctaacagtaacacagagtaaaagactccaattttcccacggctactgaatcacggatgcttaaatctccccaatccgtatctctgtcggcctcaacagcgcggctgcctgtaaccactccaggtctccagcgaagcaggctcaggcgcaacgcaacaacacaaggcggcggttatggcctctgctgctgcgacggctacgatggggacggggaaggtggtttgcgtcaccggcgcatcagggtacatcgcgtcctggattgtcaggctcctactcgaccgcggctacaccgtccgcgccaccgtgcgagacaccgctgacccaaagaaaacattgcacctgactgcgttggatggtgctaaggataggctgcacttatttaaagctagcctgctagaagagggttctttcgatgctgcagttcatggatgcgacactgtatttcatactgcctctcccttttatcacaatgtcaaggatgctaaggcagagttacttgacccagcagttaagggaacactcaatgttctcggttcatgcaagaaagcttctattaaaaaggtggttgtaacatcatctatggctgctgtagcctacaacaggaggccaaggactcctgaggtcacagttgacgagacatggttttctgatccacaaatttgtgaaacaaatcagcaatggtatattttgtccaagacgctggcagaggaggctgcttggaagttctcaagggataatggacttgaaatcgttactataaacccagcgatggttattggtcccctgctgcagcctacactaaataccagtgctgaagcaatcctgaagttaatcaatgggtcatcgtctacatatcccaatttttgctttggatgggttaatgtcaaggatgttgccctggcccatatccttgcatacgaggttccctcatcaaatggaaggtactgcatggtggaaagagttgttcactactcagaactggtgaacattatccgcaacatgtatcctacccttcctcttccggacaagtgtgcagatgacaagccgtttgtcccaccctaccaagtatcaaaggagaagataaaaagcataggcatcgagttgattccactggagacgagcgtcaaggagaccatcgaaagcttgaaagagaaggggttcgctagtttttgactcgagcaagctgtgaaacataagtgttactgtactacgtgatgttgcattgtatacatgcatcggacttcgcagttcccaagctattttggtagctttggtctgtaagattacctaaaataaactgagccacgttgccacgctgtagcttttggacatgttatgctttgatcggattgagacacgtgatatatgatcgttgcttacaaaaaaaaaaaaaaaaaaaaacaatacaaacacaaactccctccgtctcgaggtgtcacgttttagtttaaatataaactagcgggtgacaaatattaaagaattttttttatttatcatgtttgtcacgttttagtttaaatataaactagcgggtgacaaatattaaagaatttttttatttatcatgttttagtttaaaaataaactagtgggtgacaaatattaaaaaacggaagtagtatttgactaatgcttcatttcttttcagtggccacacaaaaaaacaccgagcaaacctagagatggctcctagagatggcaattgggctctatgcaagatcattgggtttaggtcttagttttgtgccagatcatgcccatttaggtcatagctacccaacgggttgtctgtaggtaatggatcacctgggctggtagtagatctcgatctaaatgtttttttacaaattgttagaaaaaataatagaaatagagtcacatcctaatctgatctgattattacattttatagtataaaatttagatcatattgttacccttatttgtacgtggaacaagaacttgttaccaacaaaaatttaaaacctgggtgagaagtgnaggaacaaagctcattggtctctatgcaagagcattgggtctagtcaagagaactagtctgatggacgctataatcacgggaaaactccagtggtatagagttggccagtatcggagcttaggcttgaggccaacagccaggcgacagttttgaacgcctaaattctctgaacaagtgcgatccaagagtctctcaaaaggtccaaaggaacacataaatcctctagcagtgtattcgagaaggcactagggaaaagataccaacgatcatcaatggctctctcgaacaaatttctacggtgacttagcggaccttctgcttttctacttgagcaaaaagggaaattgaccttattcttgtcaacccagttggtccaagtgttggagagcttgcttcttttctctttcttattttcttccctgcctcattgcactcacatgacttgtagccagtggagcacaccatggttccttccttaccaatctttttcatgccactgacactgttatctaggtcaagttgggcttgttcactcttgccattcaacaaaatcatgtccttggtgaggcaatgcacttcttgcttaagcacaggttgatatttcatttggaaaggttgatcacattccaaaccctaatttggggacccaaaagtgaaattgaaaatctagcaataacttgccaaaagtccaaatagcaaagctgtagggttttaaaaactgagaaactttcgtgtttggagattttcaagttttgttgagaaattcaaagtaatgtgtaaagttcagatttggttcagtttttggttttctgaaaaacagtgagattgagctaactttggactcttgtatctcctaatccatgggtctttggtagaagatctctatatcacacttgaatacaaatgttaggggagaaatccttataagagaaaggcg

SEQ ID NO: 11386 - DNA, 1332 bp, Zea mays
gtaagaaatgggtcccccgtgcccgcccggcctggccaccaaagaagcaaaagtcttccaggttctcccacccacacggccacacgcccacacccactgctcctctaatctcacatgctcatgcatcctcctaatgtaacctgaagctttaagaaaacaaagtgctcccggaagactccaagctgcagctaccggccttcctctcccccattccaattccgagaacaggggcggcggagtcaaccaggtacgatgtgctcggtagcgaggctggcgtttgtgcttgcactggccatagccgcctcatcaattacggttgcggagagcagagattttaatatctttgctcagggcagcttgcctgatgcaaccaagggatcgtcaggtctagctgcaaccagtggaaagttgtgtcagttatgcgagcagtactcatccgaggcgctcctctatctcacacaaaacgagacccagactgagattcttagcattctacaccatgaatgtgccagccttgccccactcaagcagcagtgcatcacgctggttgactactacgtaccccttttcttcttggaggtctccatggttacccctgagaagttctgcgagtcgatgcatctctgcaagaaggggatgaagattagcctacccacccgggagggtacttgtggtttgtgccaccatgttgttgttgagattcttatcatgcttaaagaccccaacatgcagctggaagtaatcgacctactcaccaaaacatgcagcaaggcgcagaactatgaacagcagtgcaagcggctggtcctcaagtatattccactgattctggtgaagggccagaaattccttgagacaacggatgtctgctctgtgatacatgcatgcaaagcaggcacacaagcatcaatggaagccatgcctctgtctgccatgttgtgaaggtgatgcgaatcagaataaggcttatttgcctaggagatcaaattggggagaaacgatgaaaagtcagatgactgttttaagctctcttcctctattgctgaaacactattgatcggtgaaaattcgtctgtgtaaaattcttgtgtaaatttgggggtatatccagtgtttctctgaagtatacagcaactgcagctacaccaatctcttcggcattgggttgagaagttctaagcagtaattgcattttactgtatcatctatttgtttgtaactactgagagttattaattccttgtttctctgttgctctgacaaaaaaaaaaaaaaaaaagagaaatactaaaactgtaaacaaaaaaaaaaaataataaaaacatttatagt

SEQ ID NO: 11387 - DNA, 1014 bp, Zea mays
  misc_feature (949)..(949): n is a, c, g, or t
ccgggaaacactcagttcaaccgtacctcgtaagaaaagattatgcctttctagcacctcctggccaccaaagaagcaaaaatcttccaggttcccacccacacggccacacccactgttctacatgctcatgcatcctcctaatgtaacctgaagctttaagaaaacaaagtgctcccggaagactccaagctgcagctaccggccttcctctcccccattccaattccgagaacaggggcggcggagtcaaccaggtacgatgtgctcggtagcgaggctggcgtttgtgcttgcactggccatagccgcctcgtcaattgaggttgcggagagcagagattttaatatctttgctcagggcagcttgcctgatgcaaccaagggatcgtctggtctagctgcaaccagtggaaagttgtgtcagttatgcgagcagtactcatccgaggcgctcctctatctcacacaaaacgagacccagactgagattcttagcattctacaccatgaatgtgccagccttgcccctctcaaacagcagtgcatcacgctggttgactactacgtaccccttttcttcttggaggtctccatggttacccctgagaagttctgcgagtcgatgcatctctgcaagaaggggatgaagattagcctacccacccgggagggtacttgtggtttgtgccaccatgttgttgttgaaattcttatcatgcttaaagaccccaacatgcagctggaagtaatcgacctactcaccaaaacatgcagcaaggcgcagaactatgaacagcagtgcaagcggctggtcctcaagtatattccacttattctggtgaagggccagaaattccttgagacaacggatgtctgctctgtgatacatgcatgcaaagcaggcacacaagcatcaatggaagccatgcctctgtctgccatgttngtgaaggtgatgcgaatcagaatagggcttatttgcctaggagatcaaattggggagaaacgatg

SEQ ID NO: 11388 - DNA, 1104 bp, Zea mays
  misc_feature (35)..(35): n is a, c, g, or t
aggcacgcatccccatgcctcgaccaaactgagcntagtcggcttttctaattttagctgtttattccaatctgcctaaagatatatgaagttaggctgttgctgatgcctgcaccctgcagaactgtatcttaagttaggttgttgctgatgcctgcaccctgcaggtttgtgcaaaatactccatatacagaacagggggtctctttctttgaaatctgatgtttgctacctctgttatcttctgttcataacattcttcttttcatccctcagtgcaagcggctggtcctcaagtatattccacttattctggtgaagggccagaaattccttgagacaacggatgtctgctctgtgatacatgcatgcaaagcaggcacacaagcatcaatggaagccatgcctctgtctgccatgttgtgaaggtgatgcgaatcagaataaggcttatttgcctaggagatcaaattggggagaaacgatgaaaagtcagatgactgttttaagctctcttcctctattgctgaaacactattgatcggtgaaaattcggctgtgtaaaaatcttgtgtaaatttgggggtatatccattgtttctctgaagtatacagcaactgcagctacatcaatctcttcggcattgggttgagaagttctaagcagtaattgcattttactgtatcatctatttgtttgtaactactgggagttattaattccttgtttctctgttgctctgtcaaattctctgtaacattagagttatactaaaacattaagtttgctttcgaaataataaaaacatttatatacagagatggtttatttcaaaaaaaaaaaaaaaataagtgcagcgattagaaacgttgagcaatttcactcataaacttgcacaacctatttttggcatttctacatagattttaccatgcatacatagcggggtttgtgtttaagttgtcttttgtagtgtaccagcataatctatatttaggccttattcagttattttcatactacatggtttggatgtaattggaaaaaagaagaatttgacaaaaaataagaattttgacttggttgaaatttagacccaaagg

SEQ ID NO: 11389 - DNA, 1103 bp, Zea mays
  misc_feature (1069)..(1069): n is a, c, g, or t
  misc_feature (1072)..(1073): n is a, c, g, or t
  misc_feature (1076)..(1077): n is a, c, g, or t
  misc_feature (1079)..(1079): n is a, c, g, or t
  misc_feature (1084)..(1084): n is a, c, g, or t
  misc_feature (1089)..(1091): n is a, c, g, or t
  misc_feature (1097)..(1097): n is a, c, g, or t
aacccaccccctcccgcccgcttccccgccactcccctcccgtccctatggcggccgttaccacagccactgccgccgcgtcctcctcctccttcctccaccgccgaagccccgcctgcctgcgcgccacgctccgcgccgcgccgcggcactgccgcaactccagctccaggctcgcctgccgcgccgccgaggtgtccggggccgagtcgtcctcggccgcggcggagggcgcgggaggaggcgggggcgcgtcgtgggtgcccgtggtgccgctcgccgcgctgccgcgcggagagcgccgcgtgatcgtgcaggacggggaggagatcctgctgctctggtacaagaaccaggtcttcgccatcgagaaccggtcgccagcggagggcgcctacaccgagggcctcctcaacgccaagctcacgcaggacgggtgcattgtttgtccatcaacagacagcacgtttgaccttcgcaccggggagataaaagaatggtatccgaaaaaccctgtcctacgggctcttacgccagccttgaggaaactattcacctaccgcgtgaaaacagacgaagaaaacatatacatcagcttcagcggagccgacggtgcggggtcagcggagattatattcagcgggaaagctcagcctggtgtgactgcatcggatgtcaatgtggaagaggtgaggatggtcgtcgacgaggatgtcggaggcttcggcttcaccagtgacaacgagctgatcaacggaaaagccgccataatcggcttcctcctgctgatcgatttcgagcttctaactggcaagggccttctcaaggggacggggttcttggacttcatctacgcagtttcgggagctttcaactgagagtcatatgtgtgtttgttgttcgttccttggtatcaagaatgccatcgaggtgtacttgactacccttagaagcctaggttttgtcagcgtgcgattcagtcagctgtgcttgtatttgaacatcaccatgcttgtctgtgaagtgaggaagggacacgagaaagtcacaaagtattaagaacaccccntgnnaanntncaatnaaggnnnaaaaanaaaaaa

SEQ ID NO: 11390 - DNA, 2254 bp, Zea mays
  misc_feature (5)..(5): n is a, c, g, or t
gggtnacccgccggcccggccgggatttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaagttccccctgctctcgaaatgcatgctcctgcaagcgctgtgcgccgacgccggcgacgtcgtcgtcgagctcccggggttcccgggcggcgccgaggcgttcgaggcctgcgccaagtactgctacggcatcaccatcacggtgagcgcgcgcaacctggtcccgctgcggtgcgcggcggcgcacctcggcatgtcggaggccgccgacaggggcaacctcgcggccaagctcgacgcgttcctcgcctcctgcctcctgcgccgctggaaggacgcgctgggcgtgctccactccacgcgccaccacgccccgctctgcgaggacctgggcctcacgtcccgctgcgtcgacgccgtggccgccctcgtcgccagcccggacaccgccccgccgccgaggtccacgtcggcgtcgccgtggtgggcgcacgacgtcgccgagctcggggtcgacctcttctggcggatcatggtcgccgtcaaggccaccggcgccgtccacgagaagaccgtcggcgacgcgctcaaggcgtacgcgcgccggtggctgcccaacgtcgccaaggaccagccgctcgaccgcgacgccgcggacgtgaagcaggtcgccacgaggcaccgcctcctgctcgagaagatcgtcagcctgctccccgcggagagggacgccgtctcctgcggcttcctgctcaagctgctcaaggccgccaacatcctgggcgcgtccaaggcgtccagggcggagctggtgaggagggtggcgtggcagctggaggaggccagcgtctccgacctgctcatcccgtcgctgtcctgcgtcagcgacacgctgtacgatgtgggcgccgtgtcggccatcctcgacgagttcgcgctgcggtgcgccgcgctcccgccggcgccggcgctggctctgtccgggagcctcgacgacagcccggcgcactcgggcggccaccggcggtcccgttcggcggagagcgtgagcttcgacggcacgcgacgctccttgtcggccgcacccgtgtcgcagggcggtctggtgcaggtgggcaagttggtggacgggttcttgattgaggtcgcaaaggaccccaacatgccgatggacaagctgctcgccattgccgaggccgtgccagacagcgcccggccggagcacgatggcatgtacaaagtcgtcgacacatacctcaaggcgcatccggagatgagcaaaagcgcgagaaagcggctgtgccgggtgctcaactgccggaagctgtcggagaaggcgtgcgcgcacgcggcgcagaacgagctcctcccgctgcgcgtggtggtgcaggtgctgttcttcgagcacgcgcgcgccgcggcgctggcgtcgggcgggcacgccgtggccgcggcggcggacctgccgagcaacatccgggcgctgctgtccaagtccgggtcgtccgaggacgacgaggcggaccgcgtcgacgagcagcggctccgggcgctggccgccggcgcgtcccccggcgacgactggagcgtggagggcctccgtcgcgcggcgtccaagatcgccacgctgcggatgaagctggcggaggacgaggacgaggaccgtgacgccgacgagttcgcgcgcaaggccgggctaccgcgcagcgcgtcgctgcggttcagggcgttctgcgccatccccgccgggaagccgaggcggatgctcagcaagctgtggccgctgggcagaagcggcgttagccactagtagcagacagtgttagctcctgtgatctcctgtttctctctctctctctctctttttccctgagggtgatttgtctgtctcttctacgagttcctcctctctccctctctctctctttttgttacgctttcaaggcaaattgtaccttgcatgtagttgtaatctcaacgggcacaataaaagatagaaattgcacaggc

SEQ ID NO: 11391 - DNA, 8431 bp, Zea mays
  misc_feature (564)..(564): n is a, c, g, or t
  misc_feature (4732)..(4732): n is a, c, g, or t
tgtctgacttcgttctcatatacccttcagagctccagctttgcgctcctccgttgcgtcgatgacaaaaacaatgtgccctttaattcgaggcttgatgatgcgttcaacgaaaccatcaaccgcctcagcgcgagtggattgaccttgcccccctcattgataggcgatatacctagagcaaccagtggtgatatacctggaacacccgattcttccacaagcgtgcttctcaacgcatgtgctccaactgcatctgcatctgggtgattgagcatgagggggtcacctcctcttaacaaaacagcggtgctgacgcaattctatacccagctgattggagttgaacggccactgacttggtccttctctgtggatgacgtctattgtaatgctactcgtgtggttgttggagatgatctagtaataccgccgttctcggaagatgtagctagggccgctgttttctccatgaatcgtgccagtgcaccagtgtctgatggcttcggtgctggattctatcactggcctggagcgtgtcaaccgtgcggcaaattgtcctcntgtccaagcatgctagaccagtgaaatgaagccctcgaacttcagaccaatatcacttcaaaactgtcctatgaagatactctcaaagatcctaactacaaacgtgacaccttatgtaattcaaaggttagttaggcaccaagtttcaacatacaaacgaacgactacactagcgtctcactgagagtaaggcaagcatcgtactatcgaaagtcattcgtctaagaaacgattatatattaacacaactatatagaaatagcataaatgattttaacttataaataccatggtactcatagtttccaaaccctaaagatgttataaacccatgattcacaaactatctaacaaactgtagtcattatatcaaccatatatcctagaaatcataactaatagcaatatgcgcaccaatcaaaactaattaatcaaaaaccatacaacgcaatatacgtaacaaacgaatcagtgagacaccataccttggtcttcaagatatacatatgaaatcaaagttttccaactcgaatacgaagtttggagcacctctcgacggtatggatgaagatggaaatgagggaaacaaatgtctgggtgtagctctcggccaggaaagctccgatttataggacttcctagctcgacgccaagatctgtggcgccgagctaggagccacatgagcactacgtcagccctcgccatccagcgagtcacatacctcggtgcaacagtctatggaatggcgccgagcaaaggatccaaaatcggaattaagtcgtccagttgtctaaatgtgaatatttttcggaaaaatggctaagataccaaaaaaacgagggctgggccagatatcttatcacgttgtgcttgtgcatcaagctaagatcattcaaatcatctctacagtttcaaggctaattgcttatgtgagggcaaacattaggttttgtcaaaaactatctagttccaagctttctttcgcatatgctcatttatgatctttttgcatttcactaagtacacactacacaagcatgtaatgatatactatcaggttatgcttgcgcccagtggcggatccaggattggatcaagagcaagactactaagctatggctatattttttaaaataaaaaacaatctaattaatgtttaatacttcattcgtcttaaaataaaatttattttactttttaagttgattcattaaataattaatatatttattttatatatatgtctagatttatcataatccgctttaacatagacataaaattcaaaggctaaaactaaaaaaggctaatattttgcgacgagggagtaagacataagaagcaagatacaatttaaacattcaaaaaacatgtccatcctatccctagaaacataatatttaattttatcaactaacctactaacctagctactggggactgctagcaaataaatcatcaaaccaaaatacaaataatgaaaatgggaaattactatatattaaagtgcggcgcaaaggtcaacaaccatgcggccacgtcgtttagaaatccatacgtcgttcgatggcagatcactggctaacgtactggtcctagaaacgtcgatcccgtggagacaaaagaatatatgaaattctgattccaatctaaacggccagaactagcagcattgttcctcatttctcgaagcgtcgccatcgactggataactctcagccaccgtcgtggttctccgcctggaaccgatgatcgagttggagaagcacacgacgagggagccggagtgagcatggagggcgcaccacaggcgactctgcgccgccaccgtgagcactgctctgtcgcctaccatcgatgtcggccatggcagtcgttgctccgcagcctaccatcgacgtcgaccatggtagtcgttgctccgccgcctaccattgacgccggccatggcagtcgttgctccgccacatcttgctgcatactcccgttgatgggaacgctcgacctcccggtgctcccgctcccgtccttggtgagcgtggagggcgcatcacccgtggctacgacaacagtaggtcaaggcaagtggaggtggaggcattggcgcggtagtcaataggttattcattttgttgagattgcctgattgcaacaaagttgcatccagttaaattggcaatgtggtacaacaacgagctttaattaagctgtgcatcctatggccatcatcaacattacatatgatttacctttttcctcctcctcttcttttttttaaaaaaaacttcaccaactcaagatccacactgtttcatgagtacagaaagtcattggcttccaggggtagcgtggtcagccccaaaagatttgtgattacaactcaaatatgagcttcaacatgctctcctgaagctcgaagcagcaaaaggcttcaacaacacagtaaaaggtactcactccacaaatgtaagacatatttaggagggagggaaatgactgatgtccctcaatcaatcaccaagaatacaaagacgcagttatcgtcttccgttcatgcagatgccataatcgctaagtactgaaaaacctcaaacattatattgatgctaaacatgcttgccaccaaaataaaaatgcttacaaatattaacgacgagggagggttgattatgccataaatgtttacatttatggacaattttgaatgctgaagacacacatctgtggaaggaagctggagggagtagcaagatggatatatcaattattattttcaaatggttgttggattctatgtatgctcatgtatttcttcttttgccagtgcaacccgagagtgaattattgtatatatttacttgcagcaaatttggatattatgggttgtgcaatctgttgaccctgcttggctacttttgttcagcgggtggaatgcatttttttctttggagagagacgaactacggggattgagttcttcatgtgcgaatagattgcaattcataacagttcattgctaactggtttagcatcgtctattcagacctggcttcaagttacttagaaaccttacagtagaggagatcacagtgaccagtaattgtacaacctttttcttttttaatccctgttcgatttatttcaaacccagtttgcactatgtatttcgctgaagaatatgaagttattttcatcagagttaacaaatgatgaaaaagttgtgatcaccgctattccatctccttttatttgcttcaactctgtgcgcatgttcaaatcactatatgtgaacatatgtaaatatagtggcacaaccctttattttagataaacatggttgtttcatacccaactaaaggatttagtcagttgtttatcttttgcatatctatggtacttattctatatatatatattgattgcttagacatatatagtattttttacattttatattaggatttcctatgcgcgcgaagcgcgcgctagatattagtaaccttacaaccttactagttacctagcacactgcacacaattcagtagacaacactcaggcctcaacgatcccctacggcctgtggttcggcagcagccagcaactctagactccagtcctccacgcatcgtccagtcgtccgaccggtggggatggactgagcggcggcgctgagatctcatacgtacttcaagaagggagtgactcgtacacaacacgccgcttaaaggaattcgtatagcatatctgcatatgtatgttcgtatacataggcatacagttagatgtaaaagcttaattaattcgtatatacagttaatatagtaaaatagcattagtaagtttcctcaacttgttatataattcattaccatagggatttgctactcatcaactaaacatagggtgaagtaaatacaaaaaacaaacataggatggagtcactatggtatgtgtaaccaaacacatgattttttgctttactctaaaccaaacaaaaaatagagcaactctattttaactaccaaacacaaaaaaccgttctatccttataatttagaacagagtcgtttcattcaactagactctggaaccaaatgatacctaagatagtgagacacagtaccctagtgagatagccggcgactggacttgggcgcatgaggtantgactgcggactacaaaagactgaaggagggatagttgagctggacacagtcccctattgttagtgggccacgaccggggctgcaacccaggcagctctggacgcacatctgcctatgcttgcggcaatgcgcgcgataccaactattattatttgctactcaagatactatatatagagagaatatatatttagatgagatataaattaactaatctaaaaatagaggtggaatttttttaaaaaaataactagaagtgggaggattattttaaaatatgatatttcaaaaaataataatttcaccattatttttgtattagtttgtatgatttgcatcaataaattagtttacctgatatactcattgtttaaatatacctgacaaaaaccatatacctataaaaaatgtcgagaagacgatgcttgagttaggcgagatatttgcaatgtcagcatgattttcctgggacccacttcttcaatttgatgagagagcttaacgacattccgcccccacctcctccacctcatcagtcgagcctccgtgcacgacgcattcgccttgatctccgatccctaccttcattaggagagagaggagaggagaggagaggggcagggagatggagagagcggcccccgtgaggagctcccacacctcgacggctggcctgctcgcgtggcctcaccccgatggcgccgggtcgctgccagcacgccggcctaaccaggtgacccgctcttctgttcctccgccacccgccccgcgcggcgcgctgcttgtgatcgtcgttgatctcttgtggtccctctctcgccctgcagccgacggaggaattcaggaatgtggtgtttggggggcagctcacggagggggccgacggcctcaacaagacgaagaggtgagatagcttccacgccttcatggccggatcggatttctctctccgctcctgtgattcggaatcggatctcaagtcgttcaatgcgattggtaaccgcatgcatgatccccatgtgtggctgcttattcattacggttggtcctgctctgatcattccaggaagacgggctcctcgcccaaggggaaggagacaacagggaccgggatatccaaggccgagagcgccgtcgcaactgcctcccgtgatcgtcaggtgcacaactttggatctgcagtctgtggggtggaacattttgtttggcattgatctcctgcacaaagtactcgttgtctatgctgggggtctggggatagttctttttgtttcacgtggcgtgtcggcaggatcaatgaagaacgtctatcagatttgttgcataaagtgccgggacaggtatccggttttgtcgatgttcaataatgctatagatcttagcatccggatactagaattagagttttcagtgttctcaagccctcttagcagatttttattcaacaaagcagaaatgcaaacctgatcgattaaaacaggacctagagattctgcattgtcaccacatgactgatctggttgattagagattcagttaaccagttaacctcttatgctgttctgtgttgttcttagatactactagtaaaaaacgtaggtctcttcgtgaagaaaaattggtgcaaaacaggagtcttatgttattcttcattcttaaatagtatagtaaacaatatgtaataatgtaagtatcgtgattgatgggggaaatgtaggtctgattgtgaaacacgtacaatacatgtaatgcaaaagttgcagttccagccatcatatcgtcgtgatcaactatggtcttggttttttcatggaaggatgatcaactttataattagctacttcacgtaacatactaaaaacttggtcagtagagttcacagctggagatcttttgatgctattaggataattgtattagcctacttttctacaggtgtctatgccgtaatttgttggaactataattatgcacttgatattgtctgctagagaacaggaaaaaacaaacattttccttctaaatggcatacgtattacttcaaagaaatgaagaaaaaatgatcataccattctgtgtgatatggtgagacaatgagcttttataatctgcaggctagccagatcaccttttcccaggacgggaccgttcctaccaggaaggcaacctcagtggctggggtggcaaggcagcgtgagcttagccataccgtcgagagtgagggggacagtaagatgaagaggcaggtgtccagtacgaaatccaaggagctcagtggtcacgacatctttgccgatcacgaagatcccaagcccaacaggtcaaggagatcagactatggcagctctgctgctcagtcaccagtgaaaaatgcaaatgtactgcctgagccattctggtagctcttaatacacatcgtggtggctccaaactctactgaacaactgtcgttatctttgttaacaggtgagctccttctcgtttggaggccgacattgacagcacagtgaaaacagcaaagaagaaagggtccagcaacttgtctactgatctgaacggcaagaccatgcccaagaaggattcagcgtctgcagagaaacagcctccgaaccgtgcgaggccgaaaggaatgagtggcagcagcaattttgcagacgggaaggcctcaacctcaacaaccggagatcatgaaggccgtcgtacccggcagcctcctggcggcgacagcagcattttgctgggctagcgtgcatatgaatcttgccctatgccgccgccgcacgggtggttggtccgtcagtctgtggtcttgttttcgtggtcaggccatgtgtcccatctccggtccttcagatgatctggttcgcatctgtcttgtgtatggttttgatatgtgttggttgtgacatgccccatggaacaaccctatcgctatgctgttttgttgtgtacaatggatgacgtgtgctgccgttttgttgtgtgtacaatggatatgtctggttgttgaataagaagaaattggtatatggtacccatagaaaaacgcagaccaccagaaaagcagcaaacgtagcaaacccattaatgaactcatccaaggttgcatgatagggcccataactaacggatgttttcatttttttatttcttgacatagagcgatatatcaagtgtcagaaaattaattatccaaaaaaagtgtcagaaaaatattaattcatctaccatagtcttatactgaattgtttaaacaagacatggaaaatgcactgtggccatgtttgcaaacacaatagttttctagtcacacaatataataatgtggtatttaaacataccaaactctgtattttaaaccatgattttattaataccacaatattttagaagtctaaaaaactttgatctcaatcaaagttttgttggcgtgtgggaagcgacgacgataatcttaccctttctcttcctctcatatgccgcaaccaaaatactgtgcctctaaacattgttatggcacttggtaaactatgcctttataactgtagtggtggatttaactctagtatactctttctgcctagagaagactgcacttcttgctctataataggtcctaagagacaagagtagtggtggatttaactctagtatactctttctgcctagagaagactgcacttcttgctctctaaaag

SEQ ID NO: 11392 - DNA, 1277 bp, Zea mays
ctcgaggccccggccccggcccccagtcgagcctccgtgcacgacgcattcgccttgatctccgatccctaccttcattaggagagagagaggacaggagaggagaggggcagggagatggagagagcggcccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccggcatatccaaggccgagagcgccgccgccgccgctcgcaactgcctcccgtgatcgtcaggctagccagatcaccttttcccaggacgggaccgttcctaccaggaaggcaacttcagtggctggggtggcaaggcagcgtgagcttagccataccgtcgagagtgagggggacagtaagatgaagaggcaggtgtccagtacgaaatccaaggagctcagtggtcacgacatctttgccgatcacgaagatcccaagcccaacaggtcaaggagatcagactatggcagctctgctgctcagtcaccagtgaaaaatgcaaatgtgagctccttctcgtttggagaggccgacattgacagcacagtgaaaacagcaaagaagaaagggtccagcaacttgtctactgatctgaacggcaagaccatgcccaagaaggattcagcgtctgcagagaaacagcctccgaaccgtgcgaggccgaaaggaatgagtggcagcagcaattttgcagacgggaaggcctcaacctcaacaaccggagatcatgaaggccgtcgtacccggcagcctcctggcggcgacagcagcattttgctgggctagcgtgcatatgaatcttgccctatgccgccgccgcacgggtggttggtccgtcagtctgtggtcttgttttcgtggtcaggccatgtgtcccatctccggtccttcagatgatctggttcgcatctgtcttgtgtatggttttgatatgtgttggttgtgacatgccccatggaacaaccctatcgctatgctgttttgttgtgtacaatggatgacgtgtgctgccgttttgttgtgtgtacaatggatatgtctggttgttgaataagaagaaattggtatatggtaacaaaaaataatgccgggcccgctcgcgatctagaac

SEQ ID NO: 11393 - DNA, 1137 bp, Zea mays
gcacgagccacctcctccacctcatcagtcgagcctccgtgcacgacgcattcgccttgatctccgatccctaccttcattaggagagagaggagaggagaggagaggggcagggagatggagagagcggcccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgtcgcaactgcctcccgtgatcgtcaggctagccagatcaccttttcccaggacgggaccgttcctaccaggaaggcaacctcagtggctggggtggcaaggcagcgtgagcttagccataccgtcgagagtgagggggacagtaagatgaagaggcaggtgtccagtacgaaatccaaggagctcagtggtcacgacatctttgccgatcacgaagatcccaagcccaacaggtcaaggagatcagactatggcagctctgctgctcagtcaccagtgaaaaatgcaaatgtgagctccttctcgtttggagaggccgacattgacagcacagtgaaaacagcaaagaagaaagggtccagcaacttgtctactgatctgaacggcaagaccatgcccaagaaggattcagcgtctgcagagaaacagcctccgaaccgtgcgaggccgaaaggaatgagtggcagcagcaattttgcagacgggaaggcctcaacctcaacaaccggagatcatgaaggccgtcgtacccggcagcctcctggcggcgacagcagcattttgctgggctagcgggcatatgaatcttgcctataccgcccccccacgggtggttggtccgtcagtatgtggtcttgtttttgtggtcaggccatgtgtcccatctcctgtccttcaaatgatttggttcgcatctgtcttgtgtatgggtttgaaatgtgttggttgtgacatgccccatggaacaaccccatcgctatgctgttt

SEQ ID NO: 11394 - DNA, 2961 bp, Zea mays
tttgcgtgtgatatcccaactaccgccgctcaggccgggatggggcgagagaatggaaataaataaggcctttttgtttgtgtgggattgcatccggaatcgttccagataatcaaagtttatataaattagagaagtaatccgattaggaatcgttccgacccaccaatccagcacaaacgaataaagcctaaagagaaaaagggaaaatggaggttagctaatacacaataacaataattaaaaaggctaagcacctttaacccgtacagggtactattgcttggagctgcgatgcgatgacgagacggcgataatgcatgtggtgtggtcgcccgctgcttgccgccgttgcccccactgcatgcaggcagctaggtggctagcaaatagcgtgcgtcgccatgggcatggccattgctgccaggtctatggagttcgttgtcgcatcgtcggattattgtacttgatcgcgctctctctctctctagctagagcttccccgcacctcaagctacctgtgtgctttatctccttaaatttcatccaacccatccattagcccacgcacggcacgggggccttgcccttccccttagcttgcttcaaccccacgtactttatcactagctagtagagtgccggcccgcgcgctgtccggcccctcactcatctctctctctctctctctgtctcccattcgatcttgctcggagctagctagcgagaccagcaagcagatcgaccactgctgccggttgctgctttttttccccccggacggaccttttatttagttacaaagctatagttttttcttattcagctccacttttattaattaaaaagatgcgcagtctgttacctctggcgtaagtctcaagcatcgaactgcctagctgctgtccccctagctgagagctgagctgctgagatagcgagcgccacccgtcgcttttcatttataatcgcccgccagcaggccgtctcatcatcattgttgccatccgcggcgccggcggctctgcatgcgcgcgccctgcggaaactgatccatgatctgatcccacggcaccagcagcaacggccgaccgccgggccggccggccggcgcgcacgcacggtgggcgcgcgcgcggtgccaaataaagagcttagagccgccggccgggatctatggggcgcgaggcggcagccacgaggccgcccaagctgcggaggggcctgtggtcgccggaggaggacgagaagctgtacaatcacatcatccgatatggcgtcggctgctggagctcagtcccaaagctcgctggtacgagtacgacccatgatttgtaatgtaaaaagggttcgtcagaaataatatatataaacgctgcgttaatttgcttgatatttgatctcctgctagctgttgccttttgcattgtgatcgtcgatattatttagtcagagaatgttttttttttgtgtgtgtgtaagtaaggcttggagagatgcggcaagagctgcaggctgagatggatcaactacctgcggcctgacctcaagaggggcagcttctcccagcaggaggaggatctcatcgtcagcctccacaagatactaggcaacaggtaatttaactggtaatagcaagcaacagttaacacgcatgcatatggcatggcagcatgcagaggctgccacacttgtgctgatctgttacacagacaaacaatgccaataatctcactcagagctcctagcttacatgccagccacataacacacatcatgtgcttgtgcctgatccatcaggtggtcccagatcgcgtcgcagctgccggggaggacggacaacgagatcaaaaacttctggaactcgtgcatcaagaagaagctccggcagcagggcatcgaccccgccacccacaagccgctcaacgacgacgacaacgctgctgctgctgctgctgcggacaacgacgccgccgtggcgccgcaccaccatcgtcgtcatcaggacgaccactgcggcgccgccaatattgataataataataataacaacaacaacaacaacaatcggcagctcccctcagccgacgaccactgcttcgccgggggctgcgacgaccctctcgcgccacactccccgaccgccagcttcgacccactgtccgtcaccaacgtccccacggcaatgcagcagggctcctacggctcgttccgctccgacaacgaccacctctgcgactacggcggcggcggcgtcgacgtggtctcggacgccgccacggcgtacagcgccccctacacaggcggcggcggcggcggagacagctccagcaacagcaacggcaccggcacctgggcctgcagcggcggcgagccgatgccgccgcacgtggccatgttcggccgcgatgccgccgaggcggcggcgtaccatcagttcgtcgacccggccaagtacagcccctggcagcaccacccggcggcgaggctccatgatcacaacgtcggcggcgctactgcgggcttcccgatacggtccatgtcgcgggacctgccgggttcctgcttcgacctcgcccgcagcgcgctggaggacgagttcagcgtcgacttcctctgacgtacgactacgccgacgcgcgacgtacggccaggaggtcgttggtgcatgtcgtcgtccaacactcactcgacactcgatcgacagacacacacagatacacttttcattcactactactgctactattacctcagtcctcagagatcacccaaaaaacaagacacactctccttgtgtctgcaggcatattcgttcgttattccccacttcttttcatgtggtccggtcatactttatttggacccatcgatcaagttggttaattaacacgttggtggtatgttatactgtgtttataataagggttttatctgtattattatataacacctcaattt

SEQ ID NO: 11395 - DNA, 1051 bp, Zea mays
ctcgaggccggccgggccggggtcgggtgatgagttgcatagttcagatgatcaaccctcgtggttctgattacatttaagtaattacgcctccccgccggccggccgggccggaaccaatccataactcgaaaccttttcttgtgctctgtctgtgtgtttccaaagcaaacgaaagaggtcgaggatgtcttgcagctgcggatcaagctgcaactgcggatcaagctgcaactgcggcaagatgtaccctgacctggaggagaagagcggcgggggcgctcaggccagcgccgccgccgtcgtcctcggcgttgcccctgagacgaagaaggcggcgcagttcgaggcggcgggcgagtctggcgaggccgcccacggctgcagctgcggtgacagctgcaagtgcagcccctgcaactgctgatcctgctgcgttgtttcgtttgcggcatgcatggatgtcaccttttttttactgtctgctttgtgcttgtggcgtgtcaagaataaaggatggagccatcgtctggtctgactctggctctccgccatgcatgcttggtgtcggttctgttgtgcttgtgttggtgcatgtaatcgtatggcatcgttacacaccatgcatctctgatctctttgcgccagtgtgtgtgactatgtccctgtaacgattggctcagtgattgaatatatatacaatactgttttactaaaaaaaaaaaaaaaaaaggacccagggcccggcccccataaagccacccattcccgtaacttggccggttccacacccgttttcggcctgcttttaaaatgcccctaactccggggggggtccccaagcacattttttttgtgacaggtcctttttattaattaataaaagggccttattccaacgaacggtggttccagttttggacccggttccccccttggaaacttataaaaattcctccccccgaaaatggatcttttttttcgaccatgtgtttccccccgccccctccctgttcttcgctggtgggcgtataatttctcgttcccgtct

SEQ ID NO: 11396 - DNA, 655 bp, Zea mays
gcgtccggacgcgtgggcggacgcgtgggcggacgcgtgggctcgaaaccttttcttgtgctctgtctgtgtgtttccaaagcaaacgaaagagctcgaggatgtcttgcagctgcggatcaagctgcaactgcggatcaagctgcaagtgcggcaagatgtaccctgacctggaggagaagagcggcgggggcgctcaggccagcgccgccgccgccgtcctcggcgttgcccctgagacgaagaaggcggcgcagttcgaggcggcgggcgagtccggcgaggccgcccacggctgcagctgcggtgacagctgcaagtgcagcccgtgcaactgctgatcctgctgcgttgtttcgtttgcggcatgcatgcctgtcactttttttacgtactgtctgctttgtgcttgtggcgtgtcaagaataaaggatggagccatcgtctggtctggctctggctctccgccaggcatgcttggtgtcggttctgttgtgcttgtgttggtgcatgtaatcgtatggcatcgttacacaccatgcatctctgatctctgtgcgctagtgtgtgtgactatgtccctgtaacgattggctcaatatatacaatactgttttactaagtaagtatgattacctcttattttaaggggggg

SEQ ID NO: 11397 - DNA, 1007 bp, Zea mays
taccctcgaggccggccgggatacgccttttctgctgccgctgcatcttccactcgcgtcaagaaacgaaacccagctgcaccagcaacttctgccagcagacccaacgaccgaagctttttttttctttcttttcatcgccgccgctcggggttcaaggttcagcgcgtccccgaatgacgggcacgtacgaggcctccgaccgtcctcctcctcccaactccgccggctaccggaccgacaaagtccggcgaaagcggctgacggcgcagaagaggaaagagatcaaggaggcgttcgacctcttcgacatcgacggctccggcaccatcgatgcaagggagctgaacgtcgcgatgagagcccttggattcgagatgacaccggagcaaatcgggcagatgatcgcggaggtggacaaggacggcagcggcaccatcgacttcgacgagttcgtgcacatgatgacggacaagatgggcgagcgggacgcccgggacgagctccacaaggcgttccgcatcatcgaccaggacgccaacggaaagatctcggacatggacatccagcggctggccatcgagaccggcgagcacttcacgctggacgaggtccgggagatgatagaggccgccgacgaggacggcgacggcgagatcgacctggaggagttcatgaagatgatgaagcggacagactttggctctgggttctagtagtcacagacaagccaatcccaacatacattgatacataccatcggtgaaaaatacatatcacctagctactacgctacatatgactggagtattgggatttatttgagaaataatggcgtacacacaccacacatcattgtgcactaactactctagtacgtcctagctacgggttgtgtatttatttacacgtaatgaaacacatactactatttgtactgtcgtttttcagtaaaaaccagtaaaaatcgatatttttattggtggctattttggaatagccagtgg

SEQ ID NO: 11398 - DNA, 970 bp, Zea mays
  misc_feature (916)..(916): n is a, c, g, or t
cattgggaccctcgaggccggccgggtgcgatgattataaaataattcctcgttctgaatgctacgccatggcatgacagacacgtttacacccatagaatatgagcactcgatattcggtttggacctgctgacatagaggagttagttcgtaaagcattacagctaaattgtactgcgaagcccattaaccaccccacatatgatgatccaaacaatggcaaagcccccgctctatccagactaaagatgctgctgatgctgccatttcaaaaatcaattctggtttggttgttggtggaaggcccctgtactgcagcaaagggttacttgaggttccaaaaccttcagcgaatcttgttgggcacctctcctcatatgttaagattggtcaaaagcagcgcgacgagcagaagaaggctgtagcaacctcgcattgttcccagcccaacacgatcgagtacgacttggccttggactggatgcttcttcgggaaaagcaagaccagagcttcagagtacttcacaagaagcacagagaagccaggaaagggttcgcaagcctggtcggcaaaggatccaaggcagagtagcaggccggttccaacctttcagagcttggcgcggtatgactgccgactggcaggaagagagggtcgtgcgcgcagaaggttctctttttgcagtagccatcgagtagttcgttgggtcaattcgtgttaatttctgttaggaaaggaaaaggtgttaataagtgttatgataggaaagaaaatgcacgtcagctttgacaggtcagagcagcctaggtaggcatcaatatgttgctgcgactgcgatgttttaatttgacttggaacctcttatgttgggcgacaagtttgccctctgggggagagatactgtttcgtctctngttaccatctcatctgtttcgtcaaaaaaaaaaaaaaaaaaaaaaaactcgaga

SEQ ID NO: 11399 - DNA, 2305 bp, Zea mays
ttcccgaggaaatgggccggaccgccagaggtagaagctgtccgaaccaccccgtacagatgagatgagatgagatgagtttgggctgttcgcctgtggctgcctttgttccgtctgtgtctgtctatgatgggacgggacacctagggttcggataccggcaccggctcaactgacgacggactatcgccagtggcgatcaccctccctgtcccctgaccgcggcgtcccctgctcgcgccgcaccggtggcgacaaggcaccccttgcctgctcccctagacgcgagcgagcgagccaacacctgtcggcacaagaatggatgggaatgctgagacgatccaattctcatggggcaagcgtcgagggaaaggtggtgctaagatggatacacagttctttgggtccttcacattggacaatgtgaagtattcactgtttgactgtgtctatctatttaagcatggtgatcctgaaccgtacattggaaaaatagtgaagatctgggagaaagataatgataaaaaagtaaaaattctttggtttttccaccctgatgaggttcagaactatttaagtggccctgtgatgggaaaggagatttttcttgcctgtggtgaaggtgctgggcttgcagatatcaacccgctggaagctgtcgctggaaaatgcactgttatatgtacttcaaaggataagaggaatcgtcaaccatcccctcaggaactacaaattgctgattatatcttctatagggtctttgatgttaaaagtctaacactttctgatcagttaccagataaaattgctgcatttacagttgatcttcttctgaatccaaaagatgagctagtcatacctgcaaatgttctggtgaatccaaatgtggatgagggtatggttgccacagttcctacacccccttcagcagttaaattggaggatcgaagtcaggctgctgcacttccccttacgcagacaggccaggtggatgaaaatctgcctgccacagttccccttccccaatcagaggtcaaggaggaacagaaaccagtcattgccattcccatttcccagactgtggtcaagaaagaggataagaaatcactttctgacattcccctttcccattcagcagtcaaggaggatgagacaccagttgcttcaattggccctccacagtctgcagttatggagaacattcccaaacatacacagttacaggatgctcatgctggggagaggccaccaaaaaagttgaaattatcccaagaaactacagagcaggacatagatccaacgaatactgaacaaagacctttggagctacagccaaagaatattgacagaagcaaatggtttaacattgaatggaatgacagactaaagatggctgatgataaggggacacttgtctatattcaaaatctcgatattcggtttggacctgctgacatagaggagttagttcgtaaagcattacagctaaattgtactgcgaagcccattaaccaccccacatatgatgatccaaacaatggcaaagcatatgctatattcagaactaaagatgctgctgatgctgccatttcaaaaatcaattctggtttggttgttggtggaaggcccctgtactgcagcaaagggttacttgaggttccaaaaccttcagcgaatcttgttgggcacctctcctcatatgttaagattggtcaaaagcagcgcgacgagcagaagaaggctgtagcaacctcgcattgttcccagcccaacacgatcgagtacgacttggccttggactggatgcttcttcgggaaaagcaagaccagagcttcagagtacttcacaagaagcacagagaagccaggaaagggttcgcaagcctggtcggcaaaggatccaaggcagagtagcaggccggttgcccggttccaacctttcagagcttggcgcggtatgactgccgactggcaggaagagagggtcgtgcgcgcagaggttctctttttgcagtagccatcgagtagttcgttgggtcaattcgtgttaatttctgttaggaaaggaaaaatgtgttaataagtgttaggatagaaaatgcacgtcagctttgacaggtcagagcagcctaggtaggcatcaatatgttgctgcgactgcgatgttttaatttgacttggaacctcttatgttgggcgacaagtttgccctatgggggagagagacactgtttcgtctctgttaccatctcatctgatttcactttcagtcaagcgcccccatatcgttctacaaaaaaaaaaa

SEQ ID NO: 11400 - DNA, 3796 bp, Zea mays
gctaatttgttactcgaacatatttattattgattatatttggtttgtactgttgtgatttaaatgaacatatctactaagatgttggtacccatgcgagtggcggctatgggataattttacacctattatgttgggtagcgggtatgtttagttgtgtgtgtgtgttttttttttctctagttagcaagggtatagacttatgtacccaatatgtgttttacccgctgccatcactaattttgattataaggaactagattgagagctctatctctggttctgtttattggcgagatatatcatatccactggtatgattgtgtaattaagcaatttccacttttaattgtgtcttcaaataatgtaagcggaggtatttatattgagacacaaaataagatgttatttaaaaaataatgaattcatggaattgtagtatagcagaagggccaatttcctgtattttattgaaaaatatactcgttccttgtgtgccattgatcccatatatcatatacataaaaattgtacttatatgctacgtggcatacaaaaatgagtataaaatctaatagcataccagaaatttttactagcagagtagttgggggatgaaatggaaatcggatcgaaccgcaaccacagccaataaaaaaaacggagtagctactagaatgaatgaacggtaacccacgcgtccggtcgatttgttgaggtcccctcctcctgtaggtgtccaacttgactacagccacctctcggctccattctgcccctcctccttctcagtcggcagccaccatgccaccgcacgcaaccaaggatcccgtcgccgcgcctgcagcagccacggcggcggcgctgtcgcgggccctggcggcggcgcgccctttcctgcgcggggaggaggcggaggtggacccggcgctgcctggcctcgccgccgtgctgcgcggcgcgggcgccggcgagtgctggcacaagcacggcacgttcctggcgcacctgctggacgtgcaccggatcctccgcctgtggggcgcgcccgacgccgtggcgcgctgcggcctctaccactccgcctactccaactcctacgtcaacctggccatcttccagcctgacaccgggcgcgcccacgtcgctgccgtggtcggcggacccgcggagcgccttgtccacctcttctgcgtcgtccccaggcagcagctcgtccacgacgacctgctcttccactactccgaccaggacctcgccgacgacctagccagctccgaggagtcggtccgggacgcccggcgcggcgtgttcgacgacgcccagccgtggcggcgcaagatccagcgcctcctcccggcggacggcatcacggtcaagcacatcaggtaggtacttaacatactaccgtgggcaagcattcattccattggggttgggttgggttggggattgcatcccccttcccacacctacctactctagctagtgtagtgtctgcaacatctatctctccagtctcaactagctagtgagctgcactgcaggacaggggaggatgtgtcactgtccaggcgcatcgcagcgacgttcctcctgatgaccatagccgacttcagcgaccagctgttcgactggcaggaccgcctcttcgacaacagcaacggccgcctcgagttcagcggcaacacctggacctccctctggcccggcaccggcaagcctggcctctgggtcacctctagctcccgcatggccgcgctctacaccctcatcgtccgcgaggaggagatacacatcacgcagcgagcgcgagatacacatggccgggacgaggacatggacctggtgatccccccggtgttcaacggctgcacccgattgctcaacgccgaggaccagaaggtggcacgagacctctactgggaggcggtatgcggcgaggaggcgtcggactggctcaaggtggagcagctcctccagcagagcattgccaagaacccgtttgtgggggaaccacacctggtgcttgcccaggtgtaccttaacatggagaggtacggcgaggcgcagatgcaggcagaggaaggtctgaggctgttgctggagtggggcagcagctgggacaagaggatgccatgggagggctgggtgtcctggggcagggcgatgctgaccaaggccaccgacaaggattggccgcatacctcattcgggatcctcagccttgggcttgtcaaatgatacatatattctcaccgtatgcatatgtatgtatttgtacgaaataataaacccaaggccagggggtcaagccaaacaataatttgatgtacttggaattcagatgtgttatcaaacacaacttgtctgccagtcctcttcagtcatagttaagttcatctgacatttaatttgggttgttcatatgtttggatatgttctgtgcgatctttacagcgtgttggagcttatagatgacaatctagattaagtcatgaagacttaaagttttggaatccaacatcgatctcaaacagactaaaaggagcaaaacaattaagaaggctaattatgcaggtttgagtgttaaaaatatgttgtatacaccttctactttgtatatggcacgttggttttgctctctaaccatgtttgtagagaaagtgtcatttggagcactgtttcaggtgaaacataagagctggagaaaatttgaaaagaggtatatttcctacacttagtcaattggattaagtgctaactatgtttgtctaagttgtagggaagctactaagaaaagccaaaaaggagttggagaagtttggctcttttgagccaaactttgactggtctagaaagcactgaacagtccgctgctatcaccaaacagtccggtgaagcgcctgaccgccctatgctgtgtacgaccgagtgcatcggtctcggaattttttataaaaattcccgaactgtatggagcattcaccggacagtctgatgtgttttctccgacggctacctctcttcggctgcggcgtccaaccgcctccggcccacgccgtctctcagaaagtccggtgccaccccctgaaaggaaaggtgtcaatcaaggattcaacgatcattgctatagtagagcactggacggtacgttgtccgcacaaacagtacaattttctcagcagtttctaaatggaaggtgcaatggctagggctcttttgaggttataaaaggatcccctaggcgcccataatcagtgtaccaaggctcccaagtgcaccaatactttgcaaaccattctcatctcactctctggtgtatttctctctagtttgtgtgttggcgctgttataagccaagagagagtagagatgtcctgttgcaagtatgagtgggcaagatcttgagcaagcgaaggtgttactgttcgggagtatcgtcgaaaagattgtaaacaactgcgacatcattgtaaccaaccccgacatagtggaaggctttgtctgtcgcattgatagatctgagcaaacggaggacaaagtaagatactccaaggcaaggtgtggcaaagtccaacgtggattaggcaaacatttcaggctcggtcgaaccacatgataaattcctgtgcctttgtgctctgctatgtgttgtgttttgtctctttgtctttattacttttgtatttgcacttcaatacttatctgtggtataagctatctttgaagtgcaggatattttgagacatgaacttcatttccgctgcaacctactcgacgtgatatcttccgc

SEQ ID NO: 11401 - DNA, 2173 bp, Zea mays
tccctagagacgttcgaggacacgagatgaggtccatgtacacgcgagggtgccgtggctagattttagaagcccagttttgctagtagatcccagtccgattttagaagtcatccgttcctagatcacaataaataatctgtgccatcgtaacaccaccccatgcatgcatcgtggaataattggggtgtgtcaccatcttatctatacgcaccgtcggtgcactggccgaactatagatggcttaggattatcgttgaaaatacgaattatctcgtatactttaatttaataataatgccaaacaaacatattgttggcattagagatttcaacgatgatagggcctcccgacttggggtaattaatgaagaatagtatgtactagtattctatggatatgatagatatattcgaattgatcaaattcagataaagaaaacgaacatgctaataagcacgtggaggagttgccatgtttgacttgaaaatgagtcgtggcactcaacaaatctcaagcaacttcctactagagaccgtttgtctatcgacaagtccacatgcaatgcaatgccctatccatctatatatggccggggaccggccgggccgacaacaacacccaatgccatcacgaatgtggaacctcaacaaagccctggtcacctcactactctgcatctcggcgttgtcgtcgtcgccatggccatgcacggcagccggtcagctgggcggcaagcccctggtcaccgccgtcaccaaggacgcgtccacctccctctacacggcgccgctcaaggacggccacccgctcgtcctcgacctcagtagcccggtcatctcgctggccacgtgcgccagctcctccaagaacaacaacggcacgctcaccgccacgctatccgccaacgccaccgacggccagaacccgctgttcccggtctccttctcggcggtggccacgtgcgcgccgtcgtcgaggctgcccgccggcgccgtcggcgtcgcggggctcgcgccctcctccagcagccagcagtcgctcccggcgcaggtggcgcgcacgcagaaggtcgccgacaaggtcgcgctgtgcctgcccagcgacggcaggtccacgtcgggcgacagcgtcggcgtggccatcttcggcggcggcccgctgttcttcgtcccgccggaccgcggcgacttcaccacgatgctggccggcacggcgccgctccacgccggagccggagccggtgcccccgggtactacgtctcctccaccggcatcgccgtggagcaggcccgcgtgggcggccccgccggggcgctcgtcgtggcgctgagctccacggtcccgtacacggcgctccggcccgacgtgtacgctccgttcgtcaaggcgttcgacgcggcggcggccgggcccaacttcccctggatgtccagggtcgccgcggtggcgccgttcgaccggtgctacgactccaccaagctcccgcagagtctgctcggctacgccgtgccgcagatcgacgtgatgctggagggcgggcagaacttcacggtgctcggcggcaactccatggtgcaggtgaacgccaacacggcttgcctcggcttcgtccaggcgccggggcaagcgccggcggccgtcatcggtgggttccagctggagaaccacctgctgctgctcgacgtggacaagaagcagctcggattcaccactttcctcaacgcaatcgggctttcctgcagcagcttcaatttcactcttgctagctagtgtgctgctgcatgtatacttaactgtaacaacttgtactgccgtgtattacaaataaataaataaagtgggaataaattgattggagtgttccagcttccaaaaaaaaaaaaaaaccagctgttatcgtaatcgatctggttgccactttgaccgtcctatgactcggatctaacgaatctaaagtcgtacacgccagaactgcagaacatccacgtatatatagtcgactgtaaggctgtatccagcagctctcaggccttctttgaaataagcgaaaatttcctgtttcatgtgaaaataagctgattcctataaaatttctttatgatttctataaaattcctatgttacaaaggaggtcttatccaatctcctactggatctgctgtatagctt

SEQ ID NO: 11402 - DNA, 1305 bp, Zea mays
ctcgaggggccggccgggaaaaagtgcggcgaacagactcaacatcaacacccaatgccatcacgaatgtggaacctcaacaaagccctggtcacctcactactctgcatctcggcgttgtcgtcgtcgccatggccatgcacggcagccggtcagctgggcggcaagcccctggtcaccgccgtcaccaaggacgcgtccacctccctctacacggcgccgctcaaggacggccacccgctcgtcctcgacctcagtagcccggtcatctcgctggccacgtgcgcctcctcctccaagaacaacaacggcacgctcaccgccacgctatccgccaacgccaccgacggccagaacccgctgttcccggtctccttctcggcggtggccacgtgcgcgccgtcgtcgaggctgcccgccggcgccgtcggcgtcgcggggctcgcgccctcctccagcagccagcagtcgctcccggcgcaggtggcgcgcacgcagaaggtcgccgacaaggtcgcgctgtgcctgcccagcgacggcaggtccacgtcgggcgacagcgtcggcgtggccatcttcggcggcggcccgctgttcttcgtcccgccggaccgcggcgacttcaccacgatgctggccggcacggcgccgctccacgccggagccggagccggtgcccccgggtactacgtctcctccaccggcatcgccgtggagcaggcccgcgtgggcggccccgccggggcgctcgtcgtggcgctgagctccacggtcccgtacacggcgctccggcccgacgtgtacgctccgttcgtcaaggcgttcgacgcggcggccgccgggcccaacttcccctggatgtccagggtcgccgcggtggcgccgttcgaccggtgctacgactccaccaagctcccgcagagtctgctcggctacgccgtgccgcagatcgacgtgatgctggagggcgggcagaacttcacggttgctcggcggcaactccatggtgcaggtgaacggcaacacggcctgcctcggcttcgtccaggcgccggggcaagcgccggcggccgtcatcggtgggttccagctggagaaccacctgctgctgctcgacgtggacaagaagcagcttggattcaccactttcctcaacgcaatcgggctttcctgcagcagcttcaatttcactcttgctagctagtgtgctgcatcggcatgtatacttaactgtaaacaacttgtactgccgtgtattacaaataaataaataaataaataataaagtgggaataaattgattgg

SEQ ID NO: 11403 - DNA, 1366 bp, Zea mays
  misc_feature (1332)..(1332): n is a, c, g, or t
atttacacacgtattctatggcacagaggagaaaatttcatagttttcttccttattttattgttttgatttttaattccatttccttgcctatggcccacccgtcgaaagaaaggatttgcggtgggccgtgacgcaactgctgacgaggcccaaatttgacaaaggaagcccggttattctgacgctttgccctttccctttctctgctccggcctccgagcacctagagtcgcgtccccaatctgcacagcggcgggatcccctacaggccgcagcagcacaccgcacaatggttcggtccacaaataccgcgccacgtgcacatctcagccagccctaccgcacaggatcccgtctcctcaccgccgcacaacaaatcgagccacccccgcagtgccccgaacaacgcagagaaaagaaaaccgctccaatccggaagctgaaaatagcagaagaatccagaggcgactccaggtttgtcggcgatgctgcgagcgggaggcaggcggctcctcgccccggggctccgtcggctcggcctgggcacaggcgcctccggcgaggcgggtcctgccgcggcggcggcgggggtgagggcgtaccacgagcgggtggtggaccactacaacaacccgcggaacgtaggttccttcgacaaggacgaccccaacgtcggcactgggttggtcggcgcgccggcctgcggcgacgtcatgaagctgcagatccgcgtcgacgagaactccggcaagatcgtcgacgcctgcttcaagacttttggctgcggctccgccatagcgtcctcgtccgtcgctactgaatgggtgaagggaaaaccaatggatgaagttttgacaatcaagaacacggagatcgcgaagcacttgtcccttccaccagtaaagctccattgcagcatgcttgccgaggatgcgattaaagctgctgtaaaagactacgaagccaagaagtcgaagatggggcagaagggtgaagacagcccttcagagaaggctgctgaagcatgaaaggttctgccgtgaagtatattgtgctgatacgtttctcagtccatgactatccgccgcatattgccaaagataaatgattctgtttgtgaggcgagggattgtgtgtaatgttcacgaagtgtggtagtgcggcatgtggctcaactgttttaaggatggtgacgactgatttcaaataaatttgctgccatcgtagaattagaagtactatgtggatttacaggagctgtttctggaatttgtagtatcatgttactttttttttcaagaatgttactgttggtattggcagacctgnggcggcaaccgacaatatagattgaagattgacg

SEQ ID NO: 11404 - DNA, 1666 bp, Zea mays
  misc_feature (1474)..(1474): n is a, c, g, or t
  misc_feature (1552)..(1552): n is a, c, g, or t
ggaagttttttggcttcacccttctaatacaaatgagaaaagcgcttttcacatgaagccattccaaaaaaaaatgctattggtatggcttcggtaaaaaaatagcgaagctagagcagaggctgcctccaagaagcccccaaggggggccttaatattatccacttcgttaatcatctgaacacgctaacattttatctttgctcctctggttttgtttgactttcagtaatcagaaatggtacatgtgcttattcctttggaggatctgacttattccatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatcaagaatactgagattgcaaagcacttgtcccttccaccagtaaagctccattgcagcatgcttgcggaggatgccattaaagctgctgtgaaagactacgaagccaagaaggcgaagatggggcaaaagagtgaagacagtccatcagagaaagctgctgaagcatgaaagtttctgccttttttaagtgtaattgagctgatatgtttctcagtccatgactccccgctgcttcagataaatgcttctgattgcgaggcgaggcgagggaccgcgtgtaatgttcacaaattctggtagtgcggcatgtgccttaactcttttgaggatggtgacaaccaatttcaaataaatttggtgccatcttagaattagaagtactatgtggatatcacatagtggaagtgttttctgtcaactacataattgaattacggccgtcgttgcacggaggctattttaaaatgttgtattgtatgtggtatggattcgcttacgggcctgaaactgttctattggaatcgataattttatttataggctggaatagtttctatccccaatccaacctaaccggactgggcctacaggggtttagatatgtgttaagtcagattggctgatgcaatgatccacgtactttcttcgttacccattatagacaatatccttcatggctactttcttgattatccatggtggacaaaggtgtacttcgctacctttcccggccgttctcttgtaaggtgtacttcgctacctttcccggccgttctcttgtgtccctcgccgccgctagagcatgccgccagactaatctattttatacactagccctaagagcaactccaatagttatataaattttagctctctaaatcatatatttaagaagttgctaaacaactttaggagtaaaaaaatgtgagttctccaatagttctctaaatatatgttgtaattttgttttgtatctatccacatcaaaaaaataagtcacaaatgtcatcaattaccttcattaactacataacgcagtcaacattnttgtttagggagttgctaaatggttgccaaatgtagagagaaaatgagtagagcaactccagtattctctaatagacntcctaaatcaacaatttaaggagttaacacaaaaattcatctccaacagttctctaaataaactttctaaatttaacaacttctcatctaactttatttcctctctacatttgg

SEQ ID NO: 11405 - DNA, 1465 bp, Zea mays
gtccatcttcataacaatcatatacacactataccacaacatggggacacaatgcgcgcgaaagcgcgcctaagtagtcattaaaacacgaactttaaccaaacagcacgggaaccacgcccaaacgaagagaaaagagaagaacctcaatccggaagcgaaaaggaccagaagaaaccagaggcgactccaggttcgtgggcgatgctgcgcgcgggagctaggcagctccttgccccggggctccggcggctcggtctgggcaccggcgccgccggtcaggtgggcccggccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatcaagaatactgagattgcaaagcacttgtcccttccaccagtaaagctccattgcagcatgcttgcggaggatgccattaaagctgctgtgaaagactacgaagccaagaaggcgaagatggggcaaaagagtgaagacagtccatcagagaaagctgctgaagcatgaaagtttctgccttttttaagtgtaattgagctgatatgtttctcagtccatgactccccgctgcttcagataaatgcttctgattgccgaggcgaggcgatggatggagatacatatcaactgtactgctaattttcatctgtattgctgtagaatcattgacaccctcatttcaatttgcctatttttggtgctttgaacctaattggctagttgggttgaattttagatatgtacagacagaccgaatgctggtgggtggtggctttcacatgagtaggctctttgaggacttgttcggttataccccaatccatatggattgagggggattgagcgggtttcaatccctagtaagtcaaaatccccctcaatccgtatcaatccccttcaatccatatggattgaaaataaccgaacaagccctgaaaggaataacagagacaagccttgcccctgcatggtacaaaggggttgcgttgaactcaggacctttagagctaatataatgtgtatgctgagtgttttgttatgatgctggttcttccttgttttcctggattgtaattgtccagcttatgccctttattatcattgttgtttttattaaggaggatgaccatgaagggtctagaagttacattttagtattgatcaaaatggtaaccttatagttagataagttcttatttgtatcagtagattcagatgcttgtag

SEQ ID NO: 11406 - DNA, 2553 bp, Zea mays
aaaaaaaaaaaaaaaaaaaaaaaaaaaaaaaaaagaaaaaggccgaaccaaagcacgagaccattacctagaacatccttcgcccgaaacggacatcccctggcccctgccgctccccacccatctccgatctgcgattccttccagccgacgcctccgcatccacctccccggagccaccagcggccagccactggccgtccaaccatcgtccccaagcggcgagttgcggggtgtggcgaagatgatcagcaggcagctcgtgctgacctacctctacctgctgatctacatctgcctctcttcgggcgtcatcctgttcaacaaatgggtcctttctccaaagtacttcaaattccctttccctatcacgcttacgatgattcacatggcattttctggaatcgtgacattcttccttgtccgagtttttaaggttgttgcacccgtcaagatgactttccatatatatgccacatgtgtgattccaattagtgcctttttcgcttcaagtctgtggtttggcaacacggcgtacttgtatatttccgtggccttcattcagatgctcaaggccttgatgcctgtagcaacatttataatggctgttttctgtggtactgacaaattaagatgggacctcttcttgaacatggtattggtcagtgttggtgttgtagtttcatcttatggtgagatccactttaatgtgattggaaccttgtaccaagtcactggtatctttgcggaagccctcaggctggtcctaactcaggtccttctccaaaagaagggcttaaccctgaatcccattacaagcttgtattacatagccccttgcagtttcatcttcctgtttattccatggtatttactggaaaagccagaaatggacgtgactcaaattcaattcaactattcaatatttttcctgaatgcactttctgcattcgcattgaacatatccatattcttagttattggaagaactggagctgtcaccattcgagttgctggtgttctgaaggactggatacttattgctctctcaactattatcttccctgaatccgttattacaagtctcaacataattggatacgcagttgcgctctctggtgttgtcctgtacaattatctgaagatgaaagatgtcagagcaaaccagcttccagcagataataattctgatagggctacaaaggacaagaagtcttctagtatgttcaggcctgacaattccatggacaacagtgatgggactgtagcaggaggcctggcatcagaagctgcagcagttgatgaggaagcccctttgatcccttctgcacgcctctcctacgttacacggacccaaacaggcagctccagtaacagataaccatggtgtacctgttctgtgggttgaccaccatatatttttgttccggtgaacctgaaagaggtgctggtatacgtgtggaaaagaatatggttaaggaagctcctgcaagtcgcacctcatctcataccatgacgacacctggatgtctcctctcgatgtacctttttcgctaggcgtgtatatttcggggagatacctagaggtggattagagaacttgaagagataggctataacttttgcttagtatttggagaaacacgttaggccatgtgttggctatagtatttccttaaccaaacatatggaaatggtgttaaacgttagatgttgtgaagcacttcataggctctaatttgagtgttagtgttgtttccttttcggttctttcattgttcccttaagtactagcggattaccaagtgtgcatccggcaaattttgcaattgtctggactctgatatgtttttaggagtacacctactgcaggctgccgtattgctgcataccctaattttgcaagtgaagttctactctggcgtgtgttcctttcatgtcacattccatgcatcgacattttaattggacttgtatattagtatattactagtacaatgttcgcattcggaaattgcggaagcttggtttgattaagctgctgagtattggaaacaagctgacgggttagtgtggcggatggaacaatgttcgcatgttgtgacgggttagtgtggcggaccatcctcaaaaataccgtaaaaataaacttagtatcaaagtgaacttatggttcatatatcatatattaaatagatattgaactgattaagaacaaataatatatttttattttagttaaaaggctgagaaagatatgaattaaactttttatagcttgctcgcattctctttcacgtagtgatgtggtactacgtgagagcgttgtgctacatgttacttgttatgaatcaatgcaatacaaagtagatcaaacatagagaaaacacaaatttatgttacttgttatgaatcaatacgatataaagtagatcaaacaaagagaagatataaatttaacgtgcaaaactcctccaaggcaaagggtaaaaaccatgggcgccggccaacaacaatcttactattttcgagtggttatagattgtaggagac

SEQ ID NO: 11407 - DNA, 2288 bp, Zea mays
aaacacttcatccaggctccagccatggaggcctcggcagcggtcgagtcgtcggccgccgtgtccgtcttcgaggtagtatccagcaagcagcggcggccgccggacacggcgaagctggtgctgaacagcccctgcccgcccagcctgcgggaggagctcgtcggcgtggtcggcaaggcgttccggccgcgcgcccacgccggggccgctgctggcgccggtggccgcccgccgccgcgccgcgcgtgggtcctcacggcgctgcagtgcgtcttcccggtgctgcagtgggggaggagctacaccctcgagtccttcaggagtgacgtcatggccggcctcactcttgccagccttggcatccctcagagcattggatacgccaatctagccaagctggaccctcagtacggtctttacacgagcgtcgtgccaccgctgatctacgctgtgatggggacatcgagggagatcgccatcgggccagtcgccgtcgtctcgctgctgctgtcctcgatgatccagaaggtcgtcgacccggccgccgacccggcgacctacaggtcgctcgtcttcacggtgactttcctcgccggggtcttccaggtctccttcggcctcttcaggctggggtttctcgtggatttcctgtcgcacgctgccatcgtggggttcatgggcggggcggccatcgtgatcgggatgcagcagctcaaggggctgcttggcctcgcccatttcaccaacagcaccgatgttgtttctgtcctcaaggctgtctgctctgcgctacgacatgacccgtggcacccgggcaacttcctcatcggatgctccttcctcatattcatcctcaccacacggttcatcgggaggaggtacaagaagctgttctggctgtcagcgatctcgcctctgctgtcggtcatcctgtccaccgctgcggtctacgcgacaagggctgacaggcacggcgtcaagatcatccagaaggtgcacgcgggcctaaacccaagctcggtgaagcagatacacctcaacgggccgcacacaacggagtgcgccaagatcgccgtcatctgcgcagtcatcgccctcacggaagctatcgccgttggccgatctttcgcctccgtaagagggtacagactcgacggcaacaaggagatgctggccatggggttctccaacgttgctgggtctctgtcctcgtgctatgtggcaacaggttcgttctcccgaacggcagtgaacttcagcgcgggggccaggtcgaccgtttcaaacatcgtcatgtccatcaccgtgttcgtcaccctggagctgttcatgaagctcctctactacacgcccatggcggtgctcgcctccatcatcctgtcggctcttccgggactgatcgacatcaaggaggcctgcagcatatggaagatcgacaagatggatttcctcacctgcctcggtgcgtttgttggcgtcctgtttgggtcggtggagattgggcttgcagttgcacttggcatttccttcgcaaagatcatcatacagtcgcttcggcctcaggtggagatccttggcaggctacaagggacagatatcttctgcagcgtcaggcagtaccctgtagcctgcctaactccgactgtactgcctatacgcgtcgacacatccttcctctgcttcatcaacgccacttccgtcaaagaaaggatcacagagtgggtttgggaaggagtggagacctcaaatggaaaagcgagggagaggatacaagcagttgtccttgatatgtcaagtgtggtaaacatcgacacttcaggactcactgcactggaagaaatacacaaggagttggtgtctcttggcttacagatggctatagccagtccgggatggaaggcagttcagaagatgaaagtgtcacaggtggtggacagggtaggacaggactggatcttcatgacagtaggtgaagcggtggaggcctgtctagctgctcataagggcacagctctcgcatgttgagtatgcgttaattactactattagtactcctaaggataatcccataagcgatgcggttatttgcatcctatgaaggtgttactggaaatgcttacgaaacagaaatgcatggtatgacttgactggagtggtcgtggcgagaaacaatcctgctctgggaaggacattccttgagctccacaaaaacatgtatggtgatatcttgatgatgtgtacctgtacttagtaagtaaacaagtctttttgttttaccgtttttt

SEQ ID NO: 11408 - DNA, 4712 bp, Zea mays
ataaatatatgaatttaattagttttgtgtaaattataattattaaaatggaattgaattccaacgaaacaaacgaggccttagctttttccgacgagcaatcgcaattctaagaacctagatttctagagaattcagcaatggagaaaatccaaatattgtgagccttacgtgcgaagaaagatctgaatagggtttaattagatctaggaagtgatggatttgatgttcacattaatctagacgattttcatgaaagcaattttcacagaagcgggttaagtagcgaagcgtttacctagaagctgattttgacggacagaatctgattttaatatgaaacaaacgccccttagtttgatacagacggagaagagggtatgaaaaattgaacggaggaagtactgttaatacatttgcagcatcacattcaattaatcatcgcaggcggcaggcgaagaaaaagtgcaaaaggcactccgcgaaacgcctcccactccggtgagcaacagatgactgatgatgcatgtggccttctttgtggcatggtccatagcaatccactaccagtctaccacacccggccaggcagcccatatatagcagcatgtcaaatttgctccggcgtccacaccacgcccccgccacggggcgagcatttcctcccccggccgggacggggctcatccacgctcggggacgggatggatgtcttcttcctctaaccgtacccacggcctcttgccagagaatcatcccatatcttcgtcccgtccgtccatatgcatgatccatcgtctcctaggctagggccggtgatgtttacacgagaggagggggagaggaattctagccagctgcgcatgtgatcgttgtcatgccaaccgtaccgcaagattctccgtccagccgccagaaccaagaaacccttttaaagccaagggagctccagctcccgagtttccccaaacacttcatccaggctccagccatggaggcctcggcagcggtcgagtcgtcggccgccgtgtctgtcttcgaggtagtatccagcaagcagcggcggccgccggacacggcgaagctggtgctgaatagccccagcccgcccagcctgcgggaggagctcgtcggcgtggtcggcaaggcgttccggccgcgcgcccacgccggggccgctgctggcgccggtggccgcccgccgccgcgccgcgcgtgggtcctcacggcgctgcagtgcgtgttcccggtgctgcagtgggggaggagctacaccctcgagtccttcaggagtgacgtcatggccggcctcactcttgccagccttggcatccctcaggtatgtattgtaggcggtcatgtcatgttcacacgcttgcttgctcaattcacgcgtcaggtttaattttagctctggttgctctcagaaactttactacacacgtcttcgcttgctgaatagtgatctcagcaagaaataacaaccaacaagctagaattgaattcaacacgtcttcaggtgaaaactgacaagtgtgtttcttgcactaaatctctaaagcaatgaaccctgagacaaaacatcagttatactactagtgaggaagccaccatatatctacttgaaagaccatacatatgtagattttgccttgaaattttctgatgtggatgtggatcgagtttttttttctctctctcgctcgtccttgtctaacccgtgactcctttggattggttgtcggacatgatattgtagagcattggatacgccaatctagccaagctggaccctcagtacggtctttgtaagtatcagtcacaataagcctatctctaagctagattgattattcaaaacaatttaccgtttctttctctagacgaccactcatttgttttgtactacgactacctctctttttttttctctccctggtggtggtgaaaagacacgagcgtcgtgccaccgctgatctacgctgtgatggggacatcgagggagatcgccatcgggccagtcgccgtcgtctcgctgctgctgtcctcgatgatccagaaggtcgtcgacccggccgccgacccggcgacctacaggtcgctcgtcttcacggtgactttcctcgccggggtcttccaggtctccttcggcctcttcaggtacgtgcggtctgcttgattagcaggcgtgtgttcctgcggatgaagcacgtactctgctcccacacgtgtcgtcgagattggtgtacgtacgtatggtcttgtttcttacctatacatgttgtcggttcgtcacgtcgtcccaggctggggtttctcgtggatttcctgtcgcacgctgccatcgtggggttcatgggcggggcggccatcgtgatcgggatgcagcagctcaaggggctgcttggcctcgcccatttcaccaacagcaccgatgttgtttctgtcctcaaggctgtctgctctgcgctacgacatgacccggtgagtgcctgtcgtcgtcgtcgtctctctctgcgccatgctcgaaaataccgggcatttttcccctttttgtaaatagtaaatgagcaactatatatggaccctcatgcatgccacgcccccacccccacaaagagagtcggacacaacgatcagtcactgtcgttacttggaacaatagtgttcgatcgtcttcaacctcgcactacggtacaggaaccttttatttttgggatagagggcatggccacttgcctgtctactgtttagtgttggatcactggaatccacccacctgaattcatcctcatgtcaacaccgccatcttgtgcttggctttactcatgtgtccgtctttcttgttctccgtatcatgtccgccggttctcatgttctcgatccacaactgcagtggcacccgggcaacttcctcatcggatgctccttcctcatattcatcctcaccacacggttcatcgtaagaaagactcaattcaattcaacagctcttctttttttactggctcatggtacatactacagatcggaccgtaaaacttaactgaacccacacgacgatgacaacttggatggcaggggaggaggtacaagaagctgttctggctgtcagcgatctcgcctctgctgtcggtcatcctgtccaccgctgcggtctacgcgacaagggctgacaggcacggcgtcaagatcatccagaaggtgcacgcgggcctaaacccaagctccgtgaagcagatacacctcaacgggccgcacacaacggagtgcgccaagatcgccgtcatctgcgcagtcatcgccctcacggtacccgtacttcccgcccggctgcagtaggcccgcccttcaccttggcgaaatgcggatgcgctgaaagacgaaaccttgcgttgcctctcctcccaggaagctatcgccgttggccgatctttcgcctccgtaagagggtacagactcgacggcaacaaggagatgctggccatggggttctccaacgttgctggttctctgtcctcgtgctatgtggcaacaggtgatccatatggttttctgactcattggccgtcgttgcaatctttcgggaagaagcaaggatgtctgacagatgtgtgttttttttttcgttcgtcaggttcgttctcccgaacggcagtgaacttcagcgcgggggccaggtcgaccgtttcaaacatcgtcatgtccatcaccgtgttcgtcaccctggagctgttcatgaagctcctctactacacgcccatggcggtgctcgcctccatcatcctgtcggctcttccgggactgatcgacatcaaggaggcctgcagcatatggaagatcgacaagatggatttcctcacctgcctcggtgcgtttgttggcgtcctgtttgggtcggtggagattgggcttgcagttgcacttggcatttccttcgcaaagatcatcatacagtcgcttcggcctcaggtggagatccttggcaggctacaagggacagatatcttctgcagcgtcaggcagtaccctgtagcctgcctaactccgactgtactgcctatacgcgtcgacacatccttcctctgcttcatcaacgccacttccgtcaaagaaaggatcacagagtgggtttgggaaggagtggagacctcaaatggaaaagcgagggagaggatacaagcagttgtccttgatatgtcaagtgtggtaaacatcgacacttcaggactcactgcactggaagaaatacacaaggagttggtgtctcttggcttacagatggctatagccagtccgggatggaaggcagttcagaagatgaaagtgtcacaggtggtggacagggtaggacaggactggatcttcatgacagtaggtgaagcggtggaggcctgtctagctgctcataagggcacagctctcgcatgttgagtatgcgttaattactactattagtactcctaaggataatcccataagcgatgcggttatttgcatcctatgaaggtgttactggaaatgcttacgaaacagaaatgcatggtatgacttgactggagtggtcgtggcgagaaacaatcctgctctgggaaggacattccttgagctccacaaaaacatgtatggtgatatcttgatgatgtgtacctgtacttagtaagtaaacaagtctttttgttttaccgttttttacaaaaaaaaaaaaaaaa

SEQ ID NO: 11409 - DNA, 2881 bp, Zea mays
acctaactagttgctacctagcctcgaccaggtggagcaatgggctccacggcggcggcgccctgccacatcgtggccgtgccgtacccgggccgtggtcacgtcaacgcgatgctgaacctatgccgcctcctggcagctcgagacggcgtcaccatcaccatcatcgtgaccgaggagtggctcagcctcctcggcgccccggcggcgctgccggacctcggcctgcgcgttcgctttgaggccattccaaacgtgatcccctccgagcacggccgcgccaacgacatggtcggcttcatggaggccgtgtacaccaagatggcgtcgccgttcgagcagcttctcgacaggctcgcgccgccggcgcccgcggctattgtggccgacatgttcgtgccgtggaccgtaggcgtcggcgagcggaggggcgtgcctgtgtgcatcatgtgcccgattagcgccaccatgttcgcggtgcagtacaacttccacctgctaccacccgcggcggccggcggcggcgcgtctccgggtaccaccggttgcgcaactcgtacaaacattgttcttctttggcatgtcaacatttctgcaaactcatctcgcgctctttatgcagatatcactggttcttgttttgttgaaaactacattcctggcacgaaatcaatcaggttcgccgatcttgcgcctacacacaccgatgcgttacttctagacaaaatccttgaagcccactcctctgtaaagaaagcacaatgtatcgtcttcaccaccttccaagagctcgagagcgacgccatcggcgctatgaggcaaaactgcccagtgtacgcagttgggccctgcgtccccttcatggcactgcaagagcacaaggccagcccagacggtgacgactacatggcgtggctggacgcacagcccgcgggctcggtgctctacgtctcgctcggcagcttcctctcggtgtccgccgcccagttcgacgagatcgccgctggcctggccgggagcaaggccaggttcctgtgggtgctccgcgacgccgacgcgtgctcccgcgtgcgaggcctgatccgcgatcccgacgccggcctcatcgtgccatggacgaaccagctgagggtgctgtgccacccttcggtcggggggttcttcacccactgcggcatgaactcgacgctcgaggcggtgtacgccggcgtgcccatgctcaccctgcccatcgcgttcgaccagccgaccaatagccggctcgtcaccgaggtgtggaagaatggcatcggcctcagggacatggcccgcgccgacggcgtcatcgggagaggtgagatagcctcggccgtggacaggctgatgcgccctgacgcggcggagttccaggacatgaggaagcgagtgacactgtggaaggacgcggctcgggctgcgtctgaagagggtggatcctcgtggaaagatgttacgtctttcatcaacttcgtttcacgttgagatctccgaatgtttacggagtcagctgtagtgaattgtgatcgattctcacggagttagtgtgatatctgaatgttagcagaatctttcggcaacaataaaaaaaaaaaaaaaaccaattgaaagtagctcttttaattgttcatatgaaagctcagaacattcgaaaacctcacaagtttcgttcttttaaattcacttcgtgaaatcatccgaaagaaggaaacgttccagtcaataacaatgtaacaaagcattttcttaaataaataaaaaactttgaaagtgggtcactgggttctttgaaacaattgctgcttcatttctctttcaaacaaatgtgcttcagtcaatcacgaagcattcatgtaattgtgaatagtcgatagtacaaaaatgacgaagcagtgtataaactcaaagcaaactcaaccaaattccttccattatctgtgagctagtaaaaaattatagacaaggtcgggaagggcagccagtggggcctgcctgcagagtacacgccgaaactgcttcttggcgtacttctggtagacagtcttcagcttcgcataactagcagcagcatgggagctgaccattctattcaggacttccctgatcatcattgtacaaaaaagctttatgagcaccacacccccatccatgccactcgaatcaacaatgaagttttaggcggtggccaacagatgtgtatataatcatgtaaaatattgttttaccttatagaaagctttaacataaaagatgtgataggagagttggagataaccctagaacctcagggattcgtagagtgcgggaggggaggagagcgcttgcatgatctgttgatcgtggaggatggtgtcaagctttggattgtagctgcaatccatagagacaaaatactatataagtcgcagttgcggacggactaaagccacaataaactacagcgaaaatggttacgacccttcaccacatccaaaataaaaagacttttaaatccgtgtctttagttcagcatcactggtcacttttgttcgtctctagtagtaaaaaaacgtataatctattactactagaaagagataaaactaagcggtgctggtgaacaagacttgttaggtgcatagactcggctagtaggggaaagaccggcccacaatattacattaagaagaaactcaatcggagctctgactaataaagatcacgaaagctagtccctcatatagcatgagggtatgcccttgtaagtcggatctttactcgtgctttaagcgctcccaacccctacattagagttcgcctccttatatacacacaaccaaaaaaaccaataagtgactttttaaaacttaatctgaaattctctcca

SEQ ID NO: 11410 - DNA, 1708 bp, Zea mays
taccctccggccccgccgccgggcaccgggccggtccaggtccaccccacccgagacagagaccaaccgccgctgccccatctccggattccgctcctaaaaccccgccagccagcggtgccgccgccggtgacatggacgacggcgacactcccagacgcaaatccgtcccagattggctgaacagcccgatctggtctgcgcctccgccgtctccacgccacagctcccttccccccacggcaccgtccccccctcagccgccaccatctcctctgccctctccccagccacggcgggatccgactcccatccctcctcccaacgccccacgcgacgccgatgtttcagacgacgaaggcaagggcgcgggcgccccgtcgtgcgcccacctcgtcgctgagttcaaagtcgcgctggataggaaggtggtggatctggcagagctccggaggctcgcatgccagggcgtgcccgacgccgctggtattcggcccatcgtctggaagcttctcttgggatatgtgccaactgatcgtgctctatggccgtatgaactggagaaaaagaggtcccaatactgtgatttcaaagatgaacttctggttaatccttcagaagttactcgaagaatggaggaaatgacagcttctgaaagagaggaacataatgctgaaggcaccggtgtgctaccaagggcggaaatcgttcgtgatgagcatcccctaagccttgggaaaactagtgtttggaaccaatacttccaggagtctgagattgtagagcagattgatagagatgttaagcgcactcatccggagatggaatttttcaatggggactcttcagattcgctgtctaatcaggagtcactaaagcgtatacttacaatatttgcaaaattgaatccgggtataagatatgtacaaggaatgaatgaggttttggcacctctctattatgttttcaagaatgaccctgaccaaagtcaagctgctttagcagagccagatgccttcttctgttttgtcgagctgcttagcgggttccgagacaacttttgcaagcaacttgacaacagcgtggttggcatacgctccacaattactacactgtcacagcttctgagaagacacgacgaggaactctggcggcatttagaagttgtaaccaaggtcaatccacagttctacgcattcagatggatcaccttgctgctaacgcaggagttccagttccgtgactgcctcagcctgtgggacacactgttgggcgacccagaggggcctcaggctacgttgttgcgggtctgctgcgcgatgctaattcttgtccggagaaggctcttggctggcgatttcactgcgaatctcaagcttctccagaactacccacccacaaacatcgaccacatcctacacattgctaacaagctgcgagggccgcttcctttctgaccagttggatcccttgcgtactttgttaccgtatacggttttgtgctagactatgtttatccagggaaagaaagctgcgttaagaactctttaaatgaacctacaaagcaacagttggttctaaaaaaaaaaaaaaaaaaaagaaacaaagaataaaaaataaaaattttaataatgggaaaaaaaaattaatagaaattaactagtgtttttaggggtaaaaataggaaactttttaaatgggggggggc

SEQ ID NO: 11411 - DNA, 2965 bp, Zea mays
aattcggcacgaggccacttcgcaattcgccagtcgccaccggcaccaccacacccaccctcgcggccgcggacagcagcagacgcggcgagcgaacgatccactgaccactggcgggcggcacggcagccatgtctgcgccgaagctggaccgcaacccgagcatccgcgaccgcgtcgaggacaccctccacgcgcaccgcaacgagctcgtcgccctcctgtccaagtacgtgaacaaggggaagggcatcctgcagccgcaccacatcctcgacgcgctcgacgaggtccagggctccgggggccgcgcgctagccgagggacccttcctcgacgtcctccgctccgcgcaggaggcgatcgtgctgccgccgttcgtggccatcgcggtgcgcccgcgcccgggagtttgggagtacgtccgcgtcaacgttcacgagctcagcgtcgagcagctcacagtctcggagtacctccgcttcaaggaggagcttgtcgacggccagcacaatgatccctacgttctcgagcttgacttcgagccgttcaatgtctcagtcccacgcccaaatcggtcatcatctattggaaacggtgtgcagttcctcaaccgacacttgtcctcaatcatgttccgcaacagggattgcttggagcccctgttggatttcctccgtggccaccggcacaaggggcatgttatgatgcttaatgatagaatacaaagctgggggaggcttcagtctgtgctgaccaaagctgaggagcacttgtcaaagctccctgctgacacaccatactcacaatttgcttataaatttcaagagtggggcctggagaaaggttggggtgatacagcagggcatgttttggaaatgatccatctccttctagatattattcaagcgccagacccatctacactagagaaattcttggggaggatccccatgatttttaacgttgttgtggtatcccctcatggatactttggtcaagctaatgtattaggcttgccagacacaggaggacagatcgtctatatactggaccaagtccgtgcactagaaaatgagatggttctccgtttaaagaaacaagggcttgatgtttccccaaagattctcattgttactcggctgataccagatgcaaaaggaacatcatgcaatcagcggcttgagagaattagtggaacacagcatacttacatattacgagttcccttcagaaatgaaaatgggatacttaagaaatggatatcaagatttgatgtgtggccatatctggaaacatttgctgaggatgctgctggtgaaattgctgctgaattacaaggtactccagacttcataattggaaactacagtgatggaaatcttgtggcatcgttgctatcttacaagatgggaattacccagtgcaacattgctcatgctctggaaaagactaagtatccagattcagacatattttggaagaatttcgatgagaagtaccatttctcctgtcagttcactgctgatataattgctatgaacaatgctgattttatcatcaccagcacataccaagaaattgctggaagcaaaaatactgttggacagtatgagagtcatactgcctttactctgcctggtctgtaccgagttgtccatgggatcgatgtcttcgatccaaagttcaatatagtctctcctggagctgacatgtccatatactttccacataccgagaaggccaagcgactcacctctcttcatggttcaatcgaaaatttgatttatgacccggagcaaaacgatgaacacattgggcatctggatgaccggtcaaagcccatcctcttctccatggcaagactcgacagggtgaagaacataacggggctggtcgaagcttttgctaagtgcgctaagctgagggagctggtaaaccttgtcgtcgttgccgggtacaatgatgtcaacaagtccaaggacagggaagagatcgcggagatagagaagatgcatgaactcatcaagacccacaacttgttcgggcagttccgctggatctctgcccagacaaacagggcccgtaacggcgagctctatcgctacatcgctgatacccatggtgctttcgtacagccggccttctatgaagcgttcggtctcaccgtcgttgaggccatgacctgtggacttcctactttcgcgacgctccatggagggccagctgagatcatagagcatggcgtctcgggcttccacattgacccgtaccaccccgagcaggctgctaatctgatggccgacttcttcgaccggtgcaagcaagacccagatcactgggtgaaaatatctggagcagggctgcagcgcatatacgagaagtacacatggaagatatactcagagaggttgatgacactggccggggtctacggtttctggaagtacgtgtcgaagctcgagaggcgggagacgaggcgctaccttgagatgttctacatactgaagttccgcgagctggcgaagaccgtgccgcttgcaattgaccaaccgcagtagcttgcgcaactgcgactgcgtagcacttggtacaagactgaaacctgaaggaccttcagtaatttaggcgcggcagacggtagccaataaaatgtgccggagctgaactggtttttattatgtacataatggcagtataacaaaattactgaaggcaggtgggttgcagttgtgtgttcgttactgtttactgtaatatgtcaagctgtcggctgcaatttctttgctggcaagccgcaggcactggtgaagtgctgataaatacatcatattctgttgacctgtgaaaaaaaaaaaaaaaggaagattccattgtactggctctgttgctcagcatctccttgtttgggaacattaacaaccagctctcacccctcaataaaatagtcgcatcatgtagctac

SEQ ID NO: 11412 - DNA, 2652 bp, Zea mays
gaaggggcggggaggcagagaaaatggggcatgaactgtccatgtcgcagaaactcagtctcgcctacgccgcgctcgtcggagggcttggttgagcgtatgtttagtgacaaaaaagcattgatcagagaagcttcaaatgtccaagtcatcctctttcaggggaacatttgcagaagaaggggaccatcttatgtcaaaaaaagaagggggctatctaagaattatatggtcaattacacctagcatccagttttacacaattggtccttgacattatctaagtcacctaattggacatgaaggcgaggggtccatcttccatattataaaggaactaggatgggtcgttaacttaatgctagagagagcaatggcaataatgagtattttttttctcagcaagcatgaggctcactgatgctggtgatggtcaggtttgatccatattatcttagttgagctagcataaccattttcattggagacactttgatattacttacgccttttatgctacaattattttagtataatgtaacacacatggaggatattgttcggttgatctccaaatatcttcatctgttaaaggaagtcagttagtggatatttaatgaggtaatggaaagggccatggtttacatatcacgagaagcaaatggtaagtcagaagacctgaaatatgtaactaacttggacaaattgcaagaggagactggtggtaggagcttacaaaagcaatcaaagccttagagggcttgatggaagcaaatagggactttgaagaactaaaactcctgaactgctagatgagttgtgcattgtggttcgttatagctgaagcacatttcatgaataaggttgaagccttatcgagtgtaaaccataaaaatcttatgaaccttgtgggttattgtgaagatgaaaacccttcatctggatgatggtcttcgagtatgtttcaaatggatcactattcgagcgattgcatggttactcggctgataccagatgcaaaaggaacatcatgcaatcaacggcttgagagaattagtggaacacaacatacttacattttacgagttcccttcagaaatgaaaacgggatacttaagaaatggatatcaagatatgatgtgtggccatatctggaaacatttgctgagcttcttttaatgaaaaaaatctgaggaaagtaccttatgacttcatggtacaatgtaaaatctgtgaatagttagttaggagacgatatttgataccccctcaatttcaaattgtaattcagtttttttttctagatttgtagttttactatgtaactcagtgaaaattatatacctagaaagcaagacaacttacaacttgtaatggagagagtacatattaagaaaaggtccaacactcaaaaggatgctgctggtgaaattgctgctgaattacaaggccctccccccctcctgttccgactctactgtgttggaactcttgtggcatcgttgctatcttacaagatgggaattacccattgcaacattgctcatgctctggaaaagactaagtatccagattcagacatattttggaagaattttgatgagaagtaccatttctcctgtcagttcactactgatataattgctatgaacaatgctgattttatcatcaccagcacataccaagaaattgctggaagcaaaaatattgttggacaatatgagagtcatattgcctttactccgagttgtccatgggatcgatgtcttcgatccaaagttcaatatagtctctcctggagctgacatgtccatatactttccacataccgagaaggccaagcgactcacctctccatggttcaatcgaaaatttgatttatgacccggagcaaaacgatgaacacattgggcatctggatgaccggtcaaagcccatcctcttctccatggcaagactcgacagggtgaaggacataacagggctggtcgaagcttttgctaagtgcgctaagctgagggagctggcaaaccttgttgtcgttgccgggtacaatgatgtcaagaagtccaaggacagggaagagatcgcggagatagagaagatgcatgaactcatcaagacccacaaattgttcaggcagttctgctggatctctgcccagacaaacagggcccgtaacgtaccgtggtattatgtgtttccgttgcaacgcacgggcactcagctagtgggatatatgaagagtggaagccagaaatcctcagccctggtcctgtacttcgtccacactcaactccctgttagacctgtctttgcatcgtcgattggtttaggtatatctggccgcgcttctgtcggtgatggggtcgcgcttcaagaagtccgggaagatgttcccagctggtgtcgtgtcccatgtatccctggtcatggtcggaggctactaccacggcatttttttttctgtttcttcatgcagttttgctcgcctttggtgtctttaagggactgcttcttttttactcctctgtggatgatttgttgactgtacccacaggttagttcgtcttctgggtaataacagatagcattcgagccaaaaaaaaaaaaaaaaaaactcgaggggggccccgccccgccccccccccc

SEQ ID NO: 11413 - DNA, 2837 bp, Zea mays
ttatggccggtcgcatctctcgccacttcgcaattcgccagtcgccaccggcaccaccacacccaccctcgcggccgcgaacaaacgacccactgaccactggcgggctgcacggcagccatgtctgcgccgaagctggaccgcaacccgagcatccgcgaccgcgtcgaggacaccctccacgcgcaccgcaacgagctcgtcgccctcctgtccaagtacgtgaacaaggggaagggcatcctgcagccgcaccacatcctcgacgcgctcgacgaggtccagggctccgggggccgcgcgctagccgagggacccttcctcgacgtcctccgctccgcgcaggaggcgatcgtgctgccgccgttcgtggccatcgcggtgcgcccgcgcccgggagtttgggagtacgtccgcgtcaacgttcacgagctcagcgtcgagcagctcacagtctcggagtacctccgcttcaaggaggagcttgtcgacggccagcacaatgatccctacgttctcgagcttgacttcgagccgttcaatgtctccgtcccacgcccaaatcggtcatcatctattggaaacggtgtgcagttcctcaaccgacacttgtcctcaatcatgttccgcaacagggattgcttggagcccctgttggatttcctccgtggccaccggcacaaggggcatgttatgatgcttaatgatagaatacaaagcttggggaggcttcagtctgtgctgaccaaagctgaggagcacttgtcaaagctccctgctgacacaccatactcacaatttgcttataaatttcaagagtggggcctggagaaaggttggggtgatacagcaggacatgttttggaaatgatccatctccttctagacatcattcaggcgccagacccatctaccctagagaaattcttggggaggatccccatgatttttaacgttgttgtggtatcccctcatggatactttggtcaagctaatgtattaggcttgccagacacaggaggacagatcgtctatatactggaccaagtccgtgcactagaaaatgagatggttctccgtttaaagaaacaagggcttgatgtttccccaaagattctcattgttactcggctgataccagatgcaaaaggaacatcatgcaatcagcggcttgagagaattagtggaacacaacatacttacatattacgagttcccttcagaaatgaaaatgggatacttaagaaatggatatcaagatttgatgtgtggccatatctggaaacatttgctgaggatgctgctggtgaaattgctgctgaattacaaggtactccagacttcataattggaaactacagtgatggaaatcttgtggcgtcattgctatcttacaagatgggaattacccagtgcaacattgctcatgctctggaaaagactaagtatccagattcagacatattttggaagaatttcgatgagaagtaccatttctcctgccagttcactgctgatataattgctatgaacaatgctgattttatcatcaccagcacataccaagaaattgctggaagcaaaaatactgttggacagtatgagagtcatactgcctttactctgcctggtctgtaccgagttgtccatgggatcgatgtcttcgatccaaagttcaatatagtctctcctggagctgacatgtccatatactttccacataccgagaaggccaagcgactcacctctcttcatggttcaatcgaaaatttgatttatgacccggagcaaaacgatgaacacattgggcatctggatgaccggtcaaagcccatcctcttctccatggcaagactcgacagggtgaagaacattacagggctggtcgaagcttttgctaagtgcgctaagctgagggagctggtaaaccttgtcgtcgttgccgggtacaatgatgtcaacaagtccaaggacagggaagagatcgcggagatagagaagatgcatgaactcatcaagacccacaacttgttcgggcagttccgctggatctctgcccagacaaacagggcccgtaacggcgagctctatcgctacatcgctgatacccatggtgctttcgtacagccggccttctatgaagcgttcggtctcaccgtcgttgaggccatgacctgtgggcttcctactttcgcgacgctccatggaggtccagctgagatcatagagcatggcgtctcgggcttccacattgacccgtaccaccccgaacaggctgctaatctgatggccgacttcttcgaccggtgcaagcaagacccagatcactgggtgaatatatctggagcagggctgcagcgcatatacgagaagtacacatggaagatatactcagagaggttgatgacactggccggggtctacggtttctggaagtacgtgtcgaagctcgagaggctggagacgaggcgctaccttgagatgttctacatactgaagttccgcgagctggcgaagaccgtgccgcttgcaattgaccaaccgcagtagtaatggcagtataacaaaattactgaaggcaggtgggttgcagttgtgtgttcgttactgtttactgtaatatgtcaagctgtcggctgcaatttctttgctggcaagccgcaggcactggtgaagtgctgataaatacatcatattctgttgacctgtgaagaagcttgttcaaggtagattccattgtactagctctgttgctcagcatctccttgtttgggaacattaacaaccagccctcgcccctcaaaaaaaaaaaaaaaaaaaaaaaaaaaaaaaaaaaa

SEQ ID NO: 11414 - DNA, 1733 bp, Zea mays
  misc_feature (2)..(2): n is a, c, g, or t
gnttagcgagttttcacctcatgcaattctgacatcaaacgaaacacatcatggttcaagacagaatctgagtgctaaaattgaaagcagccaatacagggttctaaagttggaaagagtagcttttggtgtctcatgtttgtaaataactccttcctcccatctgatctaaaacaatgcgcatcctttgccccccttttgatgagaaaaatacgaaccctaaaatctcagctccacaagggtccccgtccacaatggccaccggcggcggcgcgaacgagacggccgtcggcgccggggaggagaacgcgagcgcttccaggatccccacccgcaggttcttcgtggcgctgcacgtgggcgccggcttccacgctccggcgaacgagaaggcgtaccgcagggccatgaagcgcgcctgcctagccgctgcggccgttctccgcgagggcactggcacaagcctggacgccgttgctgctgccattcaagttttggaggatgatcccgtcacaaatgctggtcgtggttcaaatttgactgagagtggtcacgtggaatgcgatgcaagcatcatggatggaagtactggttcttttggagctgttggagctattagagatcagatgtaaagaatccaatccaagtcgctttgcacttggcaaaggaacaaatggcgggaccgtcattgcttggtcggataccccccatgtttctggttggtgagggagcatatcaatgggcaaaatctaaaggaatggacctagttgaatctacatcggaggctaatagttggttggtgactgagaatgcaagagcgcagtgggtgaaatacacatcattgcttgttaataccaaaaaatcactatatcatagtactggttctggttcagaacatcattcagttcaattggaagcacaaggaactgaatctgagaatattgctgatgcaaagaacatatttacagagtcattcatgggagacaatacagatcacataacggatactgttggggttatttgtgtagatagctacggaaatgtagcatcaggtgcatctagtggtggtattgccctgaaggtagatggccgggttgggttagcagctatgtttggctctgggtgctgggcctcgtccaaaggaccctttggtacaccattcgtagttgcttgttgtgcaactggagctggagaacacttgattagaggatttgctgcccgtgaaagttgcatctcatcgtcgttgtcacaatctggtcctgcttctgcgtgcactaaagttctccgctctgtggttcaaagcagcagcaagatgtctcatgatacaggcgctgggttgttgctagttcaggctgatgttgtaaagggaggggatttgtctgaactggaagccgctgagctggttgctgcctattcctccccatcgtttggtgttggttatttcggaagcaatatgaataatcctaaggttgtggtgcttaaagcaccggaagggccatgcaaaacgacggtcaaccagttcgctacctgcgtgaagtttgatagagaatcatctgaacaatgaagacgactcagttcatgcaaaagcacatgtaatattttacattatgatgaatccttgaaatgtttttttggattgtttgaacacatttgaatttgtagaaaattcgagaagaaacaattatttttagatgaaatctatgaatttttatatagataaaaaaaaaaaaaaa

SEQ ID NO: 11415 - DNA, 1673 bp, Zea mays
ttactcggtggcccagcccgccaaccccgttctcggctctcgcccagcctgaccggaacgaaacgctgaggcagcatcttccccgccgtcctccgccgcctcccattttcaccttggctgcagcctgcaacacaatcctacgcttccgacttcaacgcgcgcccctcccattttcacctagccctactcctttgtacataaaggaagatgggagcatatgcaacgactggtatgcagatgatagcaacacgcccttccatcccggcctacaggcaaatacttgggtcgacatcagcactatctgcatttggaaggtcaatctgttccagaactggctttgccatctcttctaaagccacatcagcaggaccactggtttcttcgaattgcaagagggttgttgtgagggcaatgtcgcagagaggtgcccaaggacttcccattgatctcacaggtaaaagagcatttatagctggagttgctgatgataatggttatggttgggcaattgctaaggctcttgctgctgctggtgctgagattcttgttggtacatgggtgcctgcgttgaacatatttgagacaagcttgagacgtggaaagtttgatgaatcacggaagctacctgatggatctcttatggagattgctaaagtatatccactggacgcagtttatgacacccctgaggatgttcctgaagatgttaaagcaaacaaaagatatgctggagcttcaaactggactgttaaggaagttgttgagactgtaaagaatgactttggtagcattgatatccttgtacactctctcgccaacggtcctgaggtaacaaagtcactgcttgagacatcaaggagaggataccttgctgcaatttcagcatctagttattcttatgtttctttacttcaacacttccttcccataatgaatccaggaggtgctagtatctctttgacctacatagcttctgaaaggataattcctggctacggtggtggtatgagttcagcaaaagcagctcttgagagtgatacaagagttcttgcatatgaagcaggtcgaaaaggcaaaatcagagtgaacaccatatcagcaggtccattgggaagccgagcagcaaaagccattggatttatcgagaagatgatagagtattcttatgttaatgcaccactgcaaaaggaattattggcagatgaagtggggaacacggcagcattcctggtgtctcctttggcatcagcaatcactggttcaactatttacgttgacaatgggctcaacacaatgggacttgcacttgacagccccactttatccacatgagcacatttcagcagaatgcggcgcagttaggtttgaattacgtgcaggcctgagcacggcagtctggttttttgaattaatctgtacgatgctagattttgcaggagatttcgttttttgttttcaataacttggactatcagttgcctgttagaaataagaactgtgataggctgcagtctcctggtcaatgcaatgcgctaatcctgaattgcggatttagattttgcaggaatcgagttggttttgctgtcagctgacagattttataatcaatttccgagatctggcgaaaacttagttatcctctctatcccttcagtttattcatgtggttcatt

SEQ ID NO: 11416 - DNA, 776 bp, Zea mays
tcgagcgcactgcttgagacatcaaggagaggataccttgctgcaatttcggcatctaggaggtgctagtatctctttgacctacatagcttctgaaaggataattcctggctacggtggtggtatgagttcagcaaaagcagctcttgagagtgatacaagagttcttgcatatgaagcaggtcgaaaaggcaaaatcagagtgaacaccatatcagcaggtccattgggaagccgagcagcaaaagccattggatttatcgagaagatgatagagtattcttatgttaatgcaccactgcaaaaggaattattggcagatgaagtggggaacacggcagcattcctggtgtctcctttggcatcagcaatcactggttcaactatttacgttgacaatgggctcaacacaatgggacttgcacttgacagccccactttatccacatgagcacatttcagcagaatgcggcgcagttaggtttgaattacgtgcaggcctgagcacggcagtctggttttttgaattaatctgtacgatgctagattttgcaggagatttcgttttttgttttcaataacttggactatcagttgcctgttagaaataagaactgtgataggctgcagtctcctggtcaatgcaatgcgctaatcctgaattgcggatttagattttgcaggaatcgagtttgttttgctgtcagctgaaagtttttataataaatttccgaggtctgggacgtcagggtaaaaaaaaaaaaaaaaaagcggcc

SEQ ID NO: 11417 - DNA, 2576 bp, Zea mays
gcacgagaccattacctagaacatcctaatcgaaaaaaagggacggcgtgcgtcgcgaactggtgctccggcgggcagaccacgcggtacgtgagttccaccacagagcacaggggcggaacacacgggcactagcggcggacgcgtgtggccggggatctagatctcccatctcctccaccacaccaccaccaacgcgcgcgcctcgcctcgtctccctccagtccaaaccgccgtcgaccgccttgcccccgactgtcgcggcgcccgcactcccacccgctgctgccggatcccctgcccctaccgtacggtctgcccgctttcaccgcccgcccgcccgccgccgccagcctagctggggtcgggtggagatccaccaggaaaagagggtgctctcttctcctcgtgcgggtgttgtaattttgtcaagccggaagggcagcagtacttgtagagttgttccaccatggccaatgatggagacgatggacaaagccaggattatctcttcaaaattgtcctgatcggggattcctctgttggtaaatcgaacttgctagcaagatttgcaaggaacgagttctacccaaactccaagtccactataggagtggagttccagacacaaaagttggtaatcgatgggaaggagattaaggctcagatatgggacactgctggacaagagcgctttcgagcagtgacatctgcttactaccgaggcgctgtgggagctcttctcgtctatgatattagcaggcgtcagactttcgacagtgttggtcgatggctcaatgaactacacaatcattctgatatgaatgtcgtcacgattctggtgggtaacaaaaccgatctgaagcatgcgcgtgaggtgagcaccgcggaaggacaagcactggccgaggctcagggcctcttcttcatggaaacctcagctttggattcgtcgaatgttgcagcagcttttcaaactgtggttaaggagatctacagcatactaagcaggaaggtgtttcagtcactagagcagaagaaaagcgagctgcagtcgctaagcagcgggaaagccgtggtgctgcagggtgaagccaaccaaacaagcagtggtgggaggtggtgctgttcctcgtgacctgacacgaggactgcagctatggagggcgatcggattgtgagacattcgggtgtgtaaccctgtagtccgatttgtgaaaagttgcttttcccccatgttcttgttctaaaggtaagctggcgtggctgcttgtacgaaagctggtgttttccgtcggaggaaatcaatgtatagttcgattgatccttgggaggtgtcgatgatacacatgattgtgtaaagagaaaaagcgcgaccaacttgactgttgcgtcattctataaaaaaaaaaaaaaaaaaaccgttctttcattctgaattactccgaacgtagacatctataagtaccagacaccgtgctatcaccagtcttaggatctgtctggcacggtaaagggactgttgggttttctcaagagaaaaatatacattaaattttgtcaacttcaacattggtggtctctatcctatgatgattaactaagttagctctgcttcctgaaacaaccgctgcataagttatacagaaaacaaatcatgacactagcgccattgtgctaaagaccatttcccaacttgtgctgtcatttgatggggagagagagagctgcaatgagtgcggctgttgagggagaaagacaaaaaggtagacaccatcatcgctggtgatcgtattacggatgaccagcatgctttgctacccaatgatgaggacataagatgccatcgtcctgcctgcgtgagcagtatcatcatctccaccgaatgattggagcctaacagaaaccatgaaaggcgactagaataggctctagggcccttttggaatgcagaaattttaacggaatcagtttattttcaaaaaaaaagagaagaattcccgtattttaaagttacaaagcaccgatcatccctataggtacggtgcagtcgtgcagatgcatcactgcaccacctctacgttctatatatctcatgcactgatgcacagcacgcacaccagttccagtcccatctcatctcatgaaacaaaacgtagcggatctgaaccttgtactactggcacgtctgacagtgatctggatggtttccagcagttgatagtaccttccatggtacactgccgtcaaatctccagttagcagaaccatcttttggtttcaaccaagctcgccactgtagtcccttcagctacccagtacatctttgtttcttttcactgtttcctcctcagcagacatttgggtgacaatacatctggtctgcattgggatgacaagtgatagtctagtgcctgattccgattccatcagatgaccagcagccctacaaatatagcccacccctaaacgtgcaatctaatgtcagccctacatcctttgagataaacctcacgtcaaactattaacagctctgtacaatatggcgtccatcttttcgctctacagttctcttc

SEQ ID NO: 11418 - DNA, 1718 bp, Zea mays
actggtatctgggccccatgtgctaactgcctgtaaaccctaatcccgaatccctcccggcctcctccgtctcgcgctcgattcgaatccgagctccctatcctgctcctgctgttcccgctgcaatggaggacaacgcggtcgaagagcccgagttgagcggtgcggcggagttcgcgccggcgctcgtcgccgcccacccacacggcaactccgtcgccgtcgccatcgggcccgagctccgcgtgtttgatctcagggctggtcatccagtttcattgtcagatgattgtggtggccattctcattcagacgcaataagagctatctgcttcagtgtgagtggagctttgtttgcttcagctggtgatgacaaacttgtgaaggtttggaagactgattcgtggcgttgcatccagactataacttcggagaagagggtcagtgcagttgttattagcaacgatgacctgtatgtatcttttgcagataaatttggtgttgtttggttagtcactttgcgggaagatagtgcagagcaggtttcagttgataacaaacctgtgtcaattcttggtcactattgcagtatcatcactagcatgaagttttcgccagatggacggttcattgctactgctgatagggacttcaaaatacgagtcacattattcccaaagaatcctctaaaaggggcccatgaaatacagagcttttgccttgggcatacagactttgtatcatgcatcaccttcactagcatatctgaaaaccagagtttccttatatcaggaggaggtgattcaactgttcgcctgtgggactatgtaaatggatgtctccttgatacatttcaagccaaagataagatgggagaactcttaggaccaaatgaaacagatgatagcagcctagccattacagacatatgtccgagtaatgatggctcattggttgctgtagctattcaaagtttcagtggcataatgcttttagcatgtgatttggtaggaaagaagctatctttcctaaaggtgattacaatggaaaagagttatattcctactagcctagcatccagctcggcctcggaactcctgtggactgtcatgggcgcatcaaacatgcccagccaggcttcctcccatctattgacccgtttaaggatcatcacgtgtttccaaaaggacagattatcttcttccgatgccggtcctgcaacccttgaagacggcgatgtaccccacggtgagaagctccttctggcactgcaaggaagcctcgacgtcgcgaagcaagaggaggtgctagcttcagtgctggctgcgctgaaggtttccatgcataagatgctggtgaagaagcactactcggaagagaggagggagcagaggaaaagaggtaggaacgacaagaagatgaagaactagctgaaaagaggatgaagaactagctcagcatgcggtatcgagttgctataacggttctcttttttgtttgtttgtttttttagagaaacaaaaacagatattactgtagtatcagaaaccgtaagagtaataaatttgccaggatttttcttttcttagtacgagcgtattgtaacagtaattcatgctgatccctccagtaaaactcccgcagcttttccgactcctcgtcctcgtccgtcgtgatccgtggctttaaacgtcactacaaccaaacggaataattgc

SEQ ID NO: 11419 - DNA, 2760 bp, Zea mays
attatttatttatttgggtcagtgctgatggccattatactttgtaggaccagaaagcttttccatgctaggtttaacctggttttattgaatttggtttagtaaccaataagcctaacgtgtagcttattttgtttataccattataatgacttggctagtttgcaaatacgccagtcttcctgtcttactggatatggtaattagtcataaaagctgaaatggacatttgaatatttgtggggttcaattgaagcataaaagttaaaacttggatagatttcgacacatttgtggggctcaaccatggtgtgtcttgcatgtctcagatgttcaacaacatttgccctctagcatgtgatttggtaggaaagaagctatctttcctaaaggtgattacaatggaaaagagttatattcctactagcctagcatccagcccgtcctcggaactcctgtggactgtcatgggcgcatcaaacatgcccagccaggcttcctcccatctattgacccgtttaaggatcatcacgtgtttccaaaaggacagattatcttcttccgatgccggtcctgcaacccttgaagacggcgatgtaccccacggtgagaagctccttctggcactgcaaggaagcctcgacgtcgcgaagcaagaggaggtgctagcttcagtgctggctgcgctgaaggtttccatgcataagatgctggtgaagaagcactactcggaagagaggagggagcagaggaaaagaggtaggaacgacaagaagatgaagaactagctgaaaagaggatgaagaactagctcagcatgcggtatcgagttgctataacggttctcttttttgtttgtttgtttttttagagaaacaaaaacagatattactgtagtatcagaaaccgtaagagtaataaatttgccaggatttttcttttcttaaaaaaaaaaaaaaaaaacagtaattcatgcttatcgctcccagtaaaactgcagcagcttttgcgtctccttgtcctcatccgtcgtgatccgtggctttaaacgtcactacaaccaaatggaataattgcaggagttgttgtgtgatcgttcctgcaaggaatcaaattgcggctgattgagctgcgccgagtgacttgattgcctgtctgtctgtttgtcgccatctcatctgactgatgccccccggaaggaaccaatgggggaagcacggagattattccggccccgttgtcgtctctctccggagtcctggcgcacgacatggtcgccgacgtgacgccggtgaggacaagcgtttctgtttccttttcgaaaagcttacgtgacgtgcccgatcacgatgtggtctcgccggccgagctggaacgaacggcctgcgcacgcccaatgcttgcggtggtgtcgggaggaataaaatattatgctcatgtacgtttatattattgtatgtatttcccgtccctccaacggcctgtttgtcgcctacgcttgaatttgaagagcatatgggtctttctttcatgtatttccatagtattgcatcaaactttacagcctttcatgcattttccggaggatttttggcatcatcggaagtcacgactttcatggaaatatgcctttcgtgggatgtggagcattgttcgtctcatccatgaacgaaacatgaacacaatatgaggagatgaaaagggtcgaacgacaagacaagttcgggagacgggaccctatcaactgagaacgagagatgcaaagcaaaggcaggcacgaaatatggtcaggtagattagagttctccgcaaccgcaagaaggtcaacagcatgatggctgccttttgccgccttctttctggcgaaacatggcaatagcccatccgttcacttctcaaatgcgtctctaaacaatgttatcttgtcctgctctgttcagccgtgcttgtcacagaagctacgtgccaggttttccatggctaccaaccctctgattggcccttcaaccaacatgacgaactgcagcttggatgtgtgctcgtgcgtgcttgctggatgacaggggaagttcagtccaaaccggatcagaacaaatgcgaaatatctgatgaacagtatggctgcccaagatctccagtgtccatacgtgacaaggcaaagctgaattcaccgtcacgttttgacgatccagagacctgcggttcaacgctttgccccaggcgccgccggattggcccgtgaagggaccatctgattatctatttcacaaaataaggtctttaaaaaataacagcgaaaataaataaaagtagtcgtcaaacctaaaatacactgccaaataatgttagttcaaatggtcatgttgatcatcaaatctaaaatcttactttatatagtcgtcgaaacattttccttacaatccccctctttttagtcattgatgtcaacacgatcaaagcaagcgaataatagacacctaaattaaagtgtaatctacttactagggtacaatgcagaggtaaggttatatggtgctaaaagatacaatttgaatatataggtataacttattttgctattgttgatatccccatcatccactttcgccttttcatggaccacttcccaatatagaattatcctctattttttcttataatacaatcttcccctttacaaccccctttcaaatatgacctgtacaaaatataaatgaaattgtagtttcagaatacaccagttgactcgaaacctgttct

SEQ ID NO: 11420 - DNA, 1845 bp, Zea mays
ccaaaagatgttattttttgatcgtcacaaggttggtgaattgaccggtttgttgacatctgatttgggttccttgaagagtgttgtaagtgataacatatccagagatcgtggactgagggcactctctgagatcattggtacactttgtatacttttcacactatcaactgagctagctccagttcttgggctccttatggtgtccgtctccgtgctagttgctattttcaagaggtcaactgttcccacttttaaatcttatggaatcgtgcaagcacgcatatcagactgtgcatcagagacattttcagctattcgtactgttcgatcatttggtggtgaaaaacgacaaatttctttgtttgacaatttggcacatgcttaccaaaataatggcacaaaacttggagtgctgaaatctgctaatgaatcattaactcgagtagtcgtctatgtctccctaatggcactttacattcttggcggtagaaaggtcaatgcgggcaaattatctgttggaaccatggtatcttttattggttacaccttcacattaacctttgctgttcaaggagctgttaatacccttggtgatctgcgtggcacattggcttccgtagagagataaattctattctttcagcgaaggacattgatgattcacttgcatatggtttagccaaagaacttgatggcaaagagtttgatgattccaatggagtgtatgaaaatggatctgttaacaaacatttcatgtcagagctgaaatcatccagtagctgtagtaatctagcctggtctggtgacattcgtctgaaagaagtccatttctcttatccattgagatctaatgtggagattttaaatggccttgaccttacaattgagtgtggaaaagtcacagcacttgtcgggcctagtggtgctgggaaaagcacagtggtacaacttctagcacggtattatgagccaactcaaggttccatcactgtcgcaggagaagacatccgtgtatttgacaaaagggaatggtctcgagtagtatctctagtcaatcaggatccggtcctattctccgtgtctgttggagaaaatattgcttatggtctcccagatgatgttgtctctaaggatgagataataaaagctgctaaagctgccaatgctcatgaattcatcatctctcttccacaggggtatgatactcttgttggagagcgaggtagtctcctaagtgggggacaaaggcagaggattgcaattgcacgagccctcttgaaaaatgctcctattctaatacttgatgaggctactagtgcactggacgcgacaagtgagcgactcgtgcaggaagctctcaatcacttgatgaagggaaggacttctctggtcattgctcacaggttgagtaccgtacagaatgcacatcgaattgctgtttgttcagagggcaggataactgaactggggacacaccgagaactggttgctaagggaggcagttatgcatcacttgtcgggacacagagacttgctttcgagtaatcacacgtcaactgcgaggaacggatcgactgcaatgtaggggattctatatattactctattttccttcagggcccatcggaacataggaattctcgtggaaatcagaatgaatttcatgggtaaaatatagaaaacagaagatgaaaaaaaaacccaccttctgaatgtggccttggttataggttgtttcttatccacagaagcaacacatgaatcagaaaacacatgtatgtatcgaactttataatatattaacctaaacaaaggacaacaaacttcttatcctcacttgcg

SEQ ID NO: 11421 - DNA, 6613 bp, Zea mays
  misc_feature (4320)..(4320): n is a, c, g, or t
  misc_feature (5297)..(5297): n is a, c, g, or t
gattgtaatcggcttgtattgtcaccttctgagttagcatctgactattaaatttcctttcttatttctcaggtcctggaagaaacaactggtgatagcaaaagatgctcggcgattggatgtgttgtgtcatcggatttatctcagtcacaagatcctcgtctccacaggtaagtacttggtattgcatgagattgttgatacagcattgaagaaactggaggctgaggtcggtcctatatctggagctccaaatatgagtcgtggaattgtcagtcgacttactgttggtgccgaagttcagaaactctgtgctcaagcaatagatgctatggaatcattgttctcgggtgtatctcctgctggttcaagaatcccgcgtatgttttgaaccctttatgtttgacattcacatatacaattcgaattgattaattgatccattcttccaatttcaggaccatgtatggtaccaccaaattttgtgaagtttgaagctataacccaaacatctgtcatggtatttttggatctggttcactatcctatgcttgcccaagaggcaacttcatttaatatatggcaccgaatggctgttactgaagcttacctgacaaatccgactggcataatacttcccccatcgaaaaaattacctgtcactgggcttgcaccggctacaagctatatctttaagattattgctttcaagaactcaatcgagttgggttcatgggaaattagaacgaagacaagctatcaaaaggatgatccaaggggttcaatgccaggtggtactagactaggacataatagtgagagcccgaaggcaaacagtgatggccagtctgatccttcctcagagggtgtggactcaaacaataatactgctgtttatgctgatctaaacaagtcccctgaaagtgattttgagtactgtgaaaatcctgagatcctagattcagataaagcgtctcgtcgcctcagcgaacacatcgatgacttgcaaaatatacagatggctgcagatagggtaacagaagtcactgagctggaagaatcgcctgggctctcagcctcagccttggatgaggaacccaacgcttgtgttcaagcagtgcttctcagggagccaaactcactaggacacaatcaaagaactgtagttcctagatcacagcatgcatctaatgtactggctggaaatgagttggtgattgttggacctcgatatgctggttctgtgccacccattgcaacaagaggtctggaaaacagcaaggagagcggtggaaggggcttcaaacccaaaccttgtaacaacattttccaaaatggctcttcaaagcctgaaagggaaccgggcaattcgtcaaacaaaagaacagctggtaaaacggcggaggaccttggtcacaaggatagttcatctgaagtgtcctacgagtactgtgtaagggtggtcaggtggctggagtgcgagggctacatcgagacaaacttcagggtgaagtttctcacatggtttagcctgcgtgccaccccgcaggagagaaagatagtcggtgtctatgtggatacccttattgaggaccctgtcagcctttctggccagctcgttgacagcttctcggaggcggtatatagcaaaaagcggacgccttctggtttctgcatggacctgtggcattgaagcaccacaagcacctaccgtttgctttgtagggagcacacattcgggcccattcttttgttgcagatcgttgcattgattcttcattggaaatttcgctgaagtatttgacttgcacatcttcattgaaacttaacttttcaatgacagtaggttaagttaatgggcaatttctttttttttttttccgttctttacatttgctccatagtaggttaccgtgctatcatctgtaccgtccatgttaaccttagagcatcaatgagccgcatcgttcggtcagcctggggcatagtggattttgtggcgtgtggctgctcgaaggatgattgtcaggctggaccaggaatgcgcctttctgtgggatgaagcagattcgtatggacgttgtcagtgaaatggttgtgctgtacctggggttttgcattttcttgctgactttgttgggaatgggaggaatgacgtttaagatgcagaatgtctgccttattaattaatcttatgttgactcatacttctctatcaactgcgtttatggttcgctggtgttctgtctgagggcctccggttttgtgttgcgcctgtttgaattccattccagtgcactgacactgtacatggccactgtagtttggttttcatcattgaatgcgtgcttgcggcttggtgtatgggctatggtgctgatgcccaccgaatgcacatcttcgtactacatgcgtggaaagctctaccatgatgttttgccaggcacaaaagaatttccattcctgatgaactgacaaacatgagagacagtagcagggtgcaacccctccccctgattcacacacacacacgaaaaaacttgttcttggtttacaggttgatggttaatctaagcgtcaaacataatggccaggcatgcataaaaagcttccaggctaagctggtggtataaatgtttacagaagatgtatagaacagcaacatattccagtgggaagcagttatatgtagacattgtggccctcgtctcatgcatgttacatggcaaatgatgctcctcccttcagtcttccctcgctcagaatgtcaaccaggtcattatccaaccgcaaatcctgcagtagtcacagcctttttaacacaccggagatggaaatgacgcgcggtgctgattagctagatttaccttgttgctcgctgaacggtgatgagcttgatccatggaatgagggagcgaggaagaagacgagggatactcggacggcgagacgacgcggtgcaggcggaccagctcgggcatgacgacggtttccaggtccggccggtccctgcgccgcatctcgcagcacttgagcgcgagctcggcgaacgcctgcgcctcgggcaccggccagccggccacgttgccgtccaggaggtcggggaacgtgccctcctccagcgcgtccgagacggcgtacgccagccccatgggctcccgggcggtgaccatctggaggaggatgacgccgagcgcgtacacgtcggacttggtgcacagcagccccgtcttctggtactccgggtcgatgtagcagaaggtgccggcggccgccgtctcccggtactgcgtggcggcgccgtccacgtccacggcgcgcgggatgatgcgcgccagcccgacgtcgccgatcttggccgcgaaggcggcgtccagcaggatgttgcccggcttgaggtcgcggtgcacgaacgcctcgggcctcatcttgtgcaggtacagcagcccgctcgcgatctccacggccaccctgaaccgcagccgccacggcagcggcgccgtgccgccgcggcagaagagccggtcctccaggctcccgttcggcatgtactcgtacaccaggcagccgtacaccgggcacgcccccaccaggcgcaccatgttcgggtgacggatgttgttcagcagctcaacctgccgacgccgccgccgccgacggtttctccataaaacaaacaaaaaatgcgaaacaaccaaatgcgtgcatgcgaatgcaatgcaacagaacagggctcgtagtagtttagtacgtacctcctgtcgaaactgcttcagtccctgcgtcacattagagtagaggatcttgacggccacgagagtgtcgtcaagcgtggccttgtagaccggcccataccctccttccccgatcttgagctcatcggcgaaatggttggtcgcgttcgcgatatcgtccgcggtgaatatcctgcactcgagcctggtaggcaggcactccagcatcctcttggtctcgatcggcctcggcagggccctgagcttcaggtcgagcttgcgagcctcttccggagtagccgacgacgacccgcccctgctgtcgtccctaggcgagcaaatcggcggccagcgcctcaagatcggatggatgatgtcctgcgagtcgtagtctgcgaactcctctccacgctgatgaggtagagtgtccaggctcgaaggcttatgcttcgggccgattgctgactgagaacacgcttctgcttctgcttctgcttctgccgccgccgccgcctccggtctgttcctgtgagagctttctggggtcctgcccatctccctctgctcctgacgttcaaagcattcnagtcacgaacgtttttcacgtcgaatccgaacatgtttctgttctggccatcgttttggaccgcttcagatcgattcagttcggattcgaacacaaacattttctttaacactgtgtagtactatagctagtaaatggtcatcaccgataatccctccgcgtggtagttccacggaagcgtatcagtatcgccatcctgctgctgctgctgcttacgttcaatcctaaagaggctcagttcggcttcatcctcgtcctgcaccaggaaaaaaaacacgtggaatggaagtgctgagaccatagcgttagatatataaatatatatggcgcgcggcaattcgattcagttcattcatcagtgcaattcttcacttgccgttggcgacagcgggctgtagccatgctgatcgacgtcgtttagagatccaccactggggcatgatgaagacgctgtctggtctgatgacatgaagctccctccgtcttccgtcggcggttcgtcggagctgccaccatgggtgggcgtcgaagcacgtactgggataggcctgggcgcgcggagtgttcagatttatgtagtacgcttgagaatttgcagcaagcctcagccagcagctgaagagaagacgatggttttctatatagaagacgagtaggaaaaattaaggacactcacctcgaaatgccgccgtgcccgttttctggcttgttgtgagccggttcacctgtgaatcaggtacgcgcgtacgttcaataattccatatgagcatttgcacagcaatctatgagacaagctaagagtgtgcatgcatgagaggaggagcacaggagttttcaccaactggcaggctgttcccaggcgggtgatcaggttccggatctcccctgctgccgcttgtctcgttcgcgtaggtggcgggcctgaaggacgagatcttccctttcgctatcacgtagaccgaacagaagctcggcncggacttcgtcacggatgtcggcacgtccagcttccatatcgtcctgggaaaagcagggggaaaacatggcgcacacactcgctcactcactcactcatcgaagctggacattgttttgcttcaagcacgcatgtatacatgatgccatgggaagggatgtttgagagatggagctgtgtgtacgtaccttgtaaaggcgttcctggatgctgagcccagcactaacttgtcgaccttgttggtggcgacgaaatcgacgatcgccttcgacacgtctgttccgtccaggataatttccctgcattgcaactgtagatattaaagtaagtcagacaaaaaggtaataaggttaccaatctccctaatttaagattcattcatcacatgcacggaacaaaacaaaaaaaactggtattgaacattgtgcatacccctctcctgctgcagaaacactggaaggggatcatcagatctttcgcctgaaggtccatctgggcgtgaagatcggccgggatgtcgtcctgcacgtgtgatatggcgaactgcttaccgcctgcacgtgcaagcacacacggcaatcagggagattcagcaacacgtctgaggtctgactgatcgaattgatcgatgggtcgacgaaattgatcaggaaattggtcacgtcacgtatataccggggccctggaggaaggtgggcttgcggcggacgtggacgaggaagaaggggcgggcgcgggagaggatgttgtcggcggcccacttgagcgcgtactggctgcccctgtcgccgtcgacggcgacggccgccctcccgtgctccctcgacggcagagggctgcagtgcctctctgcggcgtcggcggcgtccttgcgggcgtccttcttcttcgccggcgccacgatgggctgcgtggggaacgtgtacgacatctccgggcggtgcgcgctgctctcggggcggaggtggagcgcgagggcatggcgtcgatggcgtcaaccatcggccctgccctggtggtgccggtgggataagagacgagggcgcgggaatcgtggcacgccgcgagttcggcggggaaccgcgctgctgcctgcatgccactcttctgtttcaggccttcaaaagggagggcccagaacccagcccaaagcttgccaagcccacaaacagtagctttagggcctgtttgtttacccccagaattatataatctggattaaataatcctaagaggcaaacaaacagtccagcttaattgccgagattatataatctaaccccttggattatgataatccataagcaagtgaggag

SEQ ID NO: 11422 - DNA, 3923 bp, Zea mays
  misc_feature (3614)..(3614): n is a, c, g, or t
  misc_feature (3885)..(3885): n is a, c, g, or t
accttcggcaccgacggggataggagatggagacagccgcgggcgacgagagagagccctccccccacccaccccgacccttcctcctcccctcggcctctccggcgggcgggcaattcggccatggatcccccacgcggaggaacagtgattgatcctactaaatgtcgattgatgagtgtggacgaaaaacgagaacttgttcgtgatttatcaaagagcccagaaagcgctcctgacaggctccagtcatggacacggcgggaaattgtagagattctttgttctgatcttggaagggagaggaaatatactggtttatccaagcagagaatgctagattatctcttcagggtggtgtctcgaaaatcatctggtccagtggaacatgtacatgagaaagagaaagggaaagataaagagtcaattcttgagcccaatacaactaaccatcagtcccctgccaaacgaccgagaaagagtgacaatccatcacgattaccgattatcacaaacaactcagcagcatctgatgtaactgggccaactaataatctacgcttctgccaaaatttagcttgcagggctattctcagggacaatttttgcagacgctgttcatgctgcatttgttttagttacgatgataacaaggacccaagcctctggttgtcgtgtagttcagaccaacacttacaaaaggatacctgtggtttctcatgccatcttgaatgtgctctaaaggatgaaagaacggctattctgcagagtggacaaggcaagaaacttgatggtggctattattgccattcgctgttgggacccgagtgatttgcttgggtgctggaagaaacagctggtgatagcaaaagatgctcgacgattggatgtattgtgtcatcggatttatctcagtcataggatccttgtctccacagagaagtacttggtattgcatgatattgttgatacggcattgaagaaactggaggctgaggtcggtcctttatctggagctccaaatatgggtcgtggaattgtcagtcgacttactgttggtgccgaagttcagaaactttgtgctcaagcagtagatgctgtggaatcattgttctcgggtgtatctcctgctagttcaaaaattcagcggccatgcatgatgcgaccaaactttgtaaagtttgaagctataacccaaacatccgtcatggtatttttggatttggttgattgtcctatgcttgcccaagaggcaacttcttttaatatctggcaccgagtggctgttactgaatcgtacccatcaaatccgactggcataatacttgcgccattgaaaaaattacttgtcacttggctcgcaccggctacaagctatatctttaaggttgtcgcgttcaagaactcaattgagttgggttcatgggaaattagaatgaagacaagctggcaaaaggatgatccaaggggttcaatgccaggtggtaccggactaggacaaaatagtgagagcccaaaggcaaacagtgatggccagtctgatccttcctcagagggtgtggactcaaacaataatactgcagtttatgctgatctaaacaagtctcctgaaagtgattttgagtactgtgaaaatcctgagatccttgattcaaataaagcttctcatcaccccagtgaacgtattaatgacttgcaaaatatacagatggctgcagatggggtaacagaagtcacagagctggaagaagcacctgggctctcagcctcagccttggatgaggaacccaatgcttgtgttcaaacagtgcttctcagggattcaaacccactagaacacaatcagagaactgtggttcctagatcacatgatacatctaatatactggctggacatgagttggtgattgttggacctcgatattctggttctgtgcctcccactgcaccaagaagtgtggaaaacagcaaagacaatggtggaagggcctccaaacccaaaccttgtgacatagttgttcaaaatggctcttcaaagcctgaaagggaaccaggcaattcgtcaaacaaaagagcaacggataaaatggacgactttggccacaaggatagtttctctgaagtgtcctatgaatactgtgtaagggtggtcaggtggctggagtgtgagggctatattgagacaaacttcaggatgaagtttcttacatggtttagcttacgtgccaccctgcaagagagaaagatagttagcgtatatgtggatactcttatcgaggaccctgtcagtctctctggccagctcgtcgacagcttctcggagaggatatatagcaaaaagcggccttccatgccttctggtttctgcatggatctgtggcattaaggaactgcagggtcttaccgttcgctttgtagggagcatattcggcccattcttttgttgcagatcgttgcattgattcttcattggaaatttagctgaagtatttgacttgcacatcttcattgaaactttccttggtgatgacagtaggttatgttatcgtcgggcaacttctttttcccttctgttttttttttcttcatttgctccataataggttacagtgctcccatgttaatcttagagcatcaatgtgctgcattgttcagtcagcttagtgccgtcatgaattttgtggcgtgtagcttgtctgaagaagaggatggttgccaggctggatcaggaatgcgcctgtgggacgaagcaggcttcgtgtggacgctgacgaatccaagctaaccatgtcttgtcggtaaaatggttgtgctgtatcttcggggggatttgcattttcttgctgactctttctgggaatgggaggaatgatgtttaaggtgcagaacgtctgccttaatttaatgttatgttgactcatgctcctttatctgctgcatttgttggttcgatgcatggtgttctgttctatggcctccaggttctgtgttgcacctgtttgagtttcgttccagtgcactgacactgtatatgtccaatctagcttggcattcatgattgaatgagtgcttgcggcttggtctatggtgctgatggccgacgggtgggatcctggaacaaagtctgggaaagaaatgtactagctgggaaagaaacgtcatctacagatagaagtcacttagatgatttttttttgctgtgattaagagcctgtttggatccacggtgctaaagtttagcactacctttaggacctgtttgtttggaattataatctaactaaattatataatctaacttattttgaactaacacttggtttaaaacaagttgattatataatctacgcagattataataataaagaaacaagctcttagtaaactttagcacttgtagatgtagacatgagtgctaataggtgttaaatgatattaaaagtgaagtgctaaagtttagcacttattagcatttagctctttaagaggtgctaaagtttagtacgtgggatcaaataggccctaatttatgttgtgatgcaccattcaacatctcagatcaaacaaggttctctatactgctaaaaaaacaaagttaatgcattgtatgcaanagatgctctttaaaaaaacaaggttaaggtattgtatgcaacagatgctcttatagtctttgaacataatctcaatacaagtacaatccatgccaccaaaacagagacgagagtgaatggtaaagctggctctgagttgacatcccagtttccttattaggagatgggtacgtgggcaatttaattcccgtagggattaaaacagacaatatttagttttcatggggtttggggggataggatgaaatcatctccaacctgcattgctcanatacctgctctgcgaacttttattgctctaattccgcg

SEQ ID NO: 11423 - DNA, 1707 bp, Zea mays
cgctaaccgccgcggacaaggccacgacgtcacggacctcggcgaggggtcgtactatccaatcgagacccaccaccgaacgagtccaaatccgctcgtctcccctcgaagtcactccctccagccctcgccggctccgcgtcctccggctctcccacccgagccgagaccacccatccaagcgcgcgcagctccggaagcgacagggccggacgagcgcctcccaaatttagcagccgcggagcgcgtgggcgtgggtccgtaaggagggtcgatggggtacctgccgtccctgagcagcaaggcggcgcacttcgtgtccgacctcaccaccgtcatcctcagccccgtctccgagcgcgagacgtcccacctccccgaggttgacgaagtgctagaaaatttggacgatgataaagattccgagcacaattccgatagccttgatggccctgacacatcttcctttagagcattcttgatctcatttttgtcatcatcgagctctaataacgattcaatggagataattcctgagcagaatggggacatgggttaccctactttaacacccatggggaagggaagcaagggaagaacgggtctgttaagtagggggaagcattccatcggaaaaatcattaacaaggcggcaaggattagtggtttcaaacaaacaactgcagagcctaaaattgacagggaggcagtaactcatactgaaccagatgcacctgtactggagcaccaggaaccaaaggaagttgcttccttcggtagtttgccaactatgtcggaaccatctgttcttttgtcagaactgatgcaaaggattctttatgcctctctcccggttcttgcccagggaaggaactgggtcttgctatacagtacatggaggcatggcatatctttatctactttatatagaaggagcatgctttgccctggtttctcactcttggttgttggggataaaaaaggcacagtttttggtggtttagttgaggccccattgcagccatctagttcaaagaagtatcaggggaccaataattcctttgttttcactaatttacacaatcgccctgtcatctatcgaccgacaggtgcaaataactactttacgatgtgctctaccgactatttggctctggggggaggaggtcatttcgcactttatcttgacgcagaccttttgattggttcaagttctaattcagagacttttaacaacgggtgtttatcgcattcttcagacttctcagtgaaagatgttgagctttggggcttcgtctacccttccaaatacgaggagatgctgacactctgccggactgagaaaccaggaatctgtcgatggtgagtggtgaccaatcccatagccagttgaacagacaaatggacatgtcgcgtctgtacagtttttagtaggctttgagagttgcgagcatttttgtgcgccggtagtactggagacttgctttttctcaagcgacttcgctcagatttgtaaatagtgtacttttgttactgtcacatggcgaaacatgtacgctactagttgttccagtgatgggcactttgaggtaaactgtcactggtggatcaggcttctacccaggactcgtgaaacagcatcaacctgttcaaagacagccttttagatccggaaaaaaaaaaaaaaaaacaaaaaaaaaaaaaaaa

SEQ ID NO: 11424 - DNA, 508 bp, Zea mays
  misc_feature (466)..(467): n is a, c, g, or t
ggaccctccggctcccgagaacaacaaacatataatctctcttcgtcactagctcgtggtaataagggaagcttgatcatctttccttatggcggtgatgaagagcagcacaatcgtcgcgcttctgttggctgttgccattctgtcctcactgtctccatgctacgaagccggcggctgcatcgggaaacccaagaagtcaccgccgccgccgagaaggccatacttctcgtcctattccgaggaccaccagaactgccgcttgatctgtagctcgaagggtttcaaggacggtggctggtgtgacgaaagcgtggagcacaaagtgtgctgctgctcccattagaaatataatagcgtatgttatgttgatgcatatatatgcatcatccatctacctgtgtggtgcaaaattctgaataaaactacctgtgtggtgccctgaataaaacctgattgagcacannaaaaaaaaaaaaaaaaaaaaaaaaaaaaaaaaaaaaaaaaa

SEQ ID NO: 11425 - DNA, 1573 bp, Zea mays
aaatccgccgggacgtcgacgacgccaagcaacccgaaccaaaagccactcggatccatctcccactctcccctcctcgtcatcggctcctccgcctccacctccgcccgccccctgatccggatcgacgacgccgaccccagatccctttcctctccgccgtctccccgcccgcccgcccgccgatcccacatccctcccaggccttcaagcagtgaaggagccttatgagctggttggctggggctttactccaattctggtgctactaagatgggccagggcctgctcagcaacaagtctgggacaagactaagcatagatgaaatagcaggcgcttaccatttcttgctcttgctctcccccgtggtttccttctgggactgcatcttccgcaagataagatactcattcagacctgagtgggtgtagcagcatcctgcactcacccacccatcttagcaacagttcctttccttttcttcctcgttattaaaataaaaaaaagttagacaaaccaatgaggccaaagaatgaagtttgaacattttgttttctttcttccctaattatacctagtagtgagtagaggagtcaggtctaccagaggtaatagtgaatagcagcaggcacggctgtcatggacagggctaccatgagcagcaatcaggcaggcaaagtgttgaagaaaggaaaaaagaagcaggccaaggacgagctggaccgccagaagcaggcggagaagaagcggcgccgacttgagaaagcgctggcaaactcggctgccataatctcggagctggaaaagaagaagcagcagaagaaggaagaacagcaaaggctggacgaggaaggtgctgccatagcagaagcagtcgctcttcatgtcctcataggcgaggactccgatgaaccctgccatttgatgctgaacaagcaccatataaggtgcaaccattgggccccctcggctgcttttgaattcaccgtggacgcacagcccgccgaggtgtacccgtctgaggatggactggtatgcggcagccatgcgtatgctcccagagcccccaaggggaggcgggctgattgggggattggacaggcactgccatgctggggagaagtgagtgacctccaaggcccgtactaccaaggaacgttccgtcagtctgttacctgccctggcttcatagccgctcaggctgtgtcatcgttgcagatcagggaagagtcgccagaggtcacctctccaagccatggggccgatgctgctgcgaccgtggttaaccggatgcttggtggcaccagcaggctcaacctttacagggggatataaacatttacacttgtcaaagaattgtattgtatatataaaaaagaagatgtgtttggctgcattgcctgcaatatatatataatatagtcttgtggtttccgaaagagaaatggacagaacatccatcctgttttgttgttgttttttctttgccaaaggttatttgtgtactgtcagttaacactgtgaacatatatgctttttaattaatatgttgagtgcttatggcttgatgtg

SEQ ID NO: 11426 - DNA, 1959 bp, Zea mays
  misc_feature (1786)..(1786): n is a, c, g, or t
cctcttttttgtgaggagctgcaaacactttagtttgcagcagtgctgcaccaaatttttttccctaccccgtttggcttacggtgcacaccatcccgcagcgcacacacgtagactttgcttccacgcctagcagtagtcgcctacagctacagcttgaggcagctgcccatcggccgcgcagaagggatggctggacgagagatgcggctattggagcggcgacgtgcgggcgatgatggaggagaaatgccgagctgttcgagcactgacggaaacaccagcagcgctaatgcgagcacgagctcgagcaccactgctagcagcggcgtgcggcggagcggtggcgcagcggaggggcgggagaccagctccaggtcggcgggcaccatcaatctaagtcaggagtacaggctcgcgatccacaccccgtcctaccaagagatctgggataagatccacatagacggggacggggacgaacaacgggaagggggcttcggcggcaacggtgaagatgaggaaggagaagagggggaggacagggtcaccctggccggcgtgctccgcccggaggacgaggtggtggaccgcgctcttgcagatgcgcccgacacggagctcacccgcctcgccaagaactacttcagcagcacgaaccaagcgtcgctgctctgcctctcactccgtcgggcgctccgccgggcgcggtcgctgtacgggcccatcacggacctcctcgcgctcatcccgcagtcgccgcagctcgccacgccacactgcgactgtgcgttcgacgccttcctcctgttcgaccaaatgcccaatccgttcccggcgcccgcggccgggttccagtgcatgcaacgaagtttctctgggctcaaaaaccacctcgatcttcgtctcctcagtgtccgacgcaggcgccgttggctccgctgtgccaagcgcggatcaggtatctgccttattgcctgcgccaccggcgctgccgtcgcaggcctcgtgcttgcgacacacgccattaccgcgctgctggcgatggcccctgcttgtgctgcatccaattcttgctgctgtccactggctgcttcgatgaaacgcctgcagaggcacatggaccggctcgacgcgactgctaggggcacctacgtcttgaataatgatgtcgctacaattgaacggctggtgggtaggctccatgccactgtggagagcgacaagatgcttgtccgccttgggctggagcgcgggagggggcaacaccacaccatagaagaggtggtaaggcagctcaggaagaaccaccccagcctgcaacggcagcttgctgaccttgccgagcacatctgcctctactttgctgctgtcaaccgtgccaggttactccttgtgcaccacctgaatgcgcaatctgatgctgaaagtgagtctccattgtcatgacctcattagccccaagcaatctgacactgggtgccatgatcatgagtttcagttaaaacaattagctgtatcttgaaattcttgtctcgagacctcatctatcgtgccaagtgatgcacaaatttcttgctttaatagtttagacctttttatagttcaatatatttgatcttctgtactttcagaattattactgtagcgatgtaacaatgctatgtttctgaataaacacgaagtcttaacattttaagaactgaatatttggacaattgcttccatatgttatcatggcagttaagttgcaacttgcaagcaatgtgttgcttctgctattcanagttgcctcgaatactcaatcagtcaatctttgcaccacctattaaatctgcatggaggttttgaaacttgaaagcatcatcttatttgcagtattttagtgctctattataacagattatctggcttgcagtattaatattgggtgccaagtttagtatggaaattccaagc

SEQ ID NO: 11427 - DNA, 1432 bp, Zea mays
attcatataatcatatagcggcgtccctcgtcgtcggcaatcatccgacgatgatcccctcgattcgcggcgccctcgcctccaccactccccaaccacccgacgccgacccccctcaattcacgcccccacctgctgcatcggctccctctggcgccccgcctcctggcccagatccgtgcaccccttgccctctccggactcgatgattcacagatctgcccagctgcccaggcacagactaccggcatccggatctcctgctccactgctcgccgccttggggctctccggcgttggctcagcgcgacgagccccccaatagcctagttccggatcccccaaccgcccacgccccacagttcaagcaccggccaccgatgtctgacgaacgagcgaactccccgcggatgcaggaggaggaggtgcaggagcgaccgccgaccgtccgcgtttcaccatccccttctccgatctcaaggtaaccttctccggtgttgaaaccatccgtggccacctggcgagctggtgcccgcaagaggtggtgctgaggcatgaggcggtgggcgtgttcctgacacactgcgggtggaactcaaccatggagagcttgtgcgtcggggtgccgatgctgtgctggcccttcttcgcggagcagcagaccaactgccggtacacgtgcatgaagtggggcgtggccatggagatcggccaggacgttcggcaggaggcggtggaggagaagatccgagaggcgatgggcggggagaagggaatggagatgcagcgccgcgcgggagagtggcagcagactggtctccgcgcgacgcggcccggagggcgctcatacgccaacctcgacaagctggtcgccgacgtgctcctctcgggtggcggcaagagttctcaggagggtttcagttcgcacaccgccactgtccaatgattcggactgaacatggatggtagtacaccaaaagagaagtttgtgtgaatgtcgaggcaaacccgtaaatcatggagcatgtgatggaatggaaggaccgaaggagccagtggcggaagaagttacttctcgtagcaggcaaaaattggaatatgaaaacctggaagccaagagggttaatccctaattactatattttattccattagttcgtagaagttttggtccctgtattcaatgtaataacgacttacatcattttagcctcacaattttctttaatggtctagctttgtaattgataacataatttttttggttgaactgttagaggataaagaagtaagttactaaagttttggactgtattctttcattttaatctcacttatcctatttctttcaggaatcataaaagcatatggaggaactatgtataggctacaaagaagcataagaagcatttttatagcagaagcccaagtg

SEQ ID NO: 11428 - DNA, 2656 bp, Zea mays
  misc_feature (2593)..(2593): n is a, c, g, or t
taccaacttccatattatactacatcagtctcgtcccacgcgtccgaagtaatcgtcacagtggtagatttgcgctgttacacatcactgcactgcacaggcacagatccacatgggctccatcgttgccgacgccgatcgccggccacacgccgtgtgcgtgccgttcccagcgcagggccacgtgacgccgatgctgaagctagccaaggttctccacagccgaggcttccacatcaccttcgtcaactcggagttcaaccaccgccgcttgctccgctcccgcggcgccagcgcgcttgacggcctcccggacttccgcttcgccgccatcccggagggtctgcccccgtccgacgccgacgccacccaggacgtgccgtcgctctgccgcgccaccatggagaactgcctcccgcatttcaggagcctcctcgccgagctcaactcctccccggacgtgccgccggtcacttgcgtcgtcggagacgacgtcatgagcttcaccctggaagcagccagagaggtcggcgtgccgtgtgcgctgttctggacggccagcgcctgcggctacctgggctaccgctattaccgcgacctcatggagaagggcatcttcccgctcaaaggttagctacatgcactcactgatgcacccacacccccgcctgcacgatgacacgatgtggaagtggaactctgggcagcttgctcacgttttctagccatgatggatgcagacgccgtgcccctgacgaacgggttcttggacacgccgacggactgggcgctggggatgagcaagcacacgcggctcaaggacttcccaagtttcgtgcgctcgacggaccccgacgagttcatgttccacttcgccctgaaggtgacagagcagatagtcggcgcggacgccgtcatcctcaacactttcgacgagctcgagcaggaggcgctggacgccatgcgcgccatgatcccgtcgtccgcgtccatccacaccatcgggccgctcgcgttcctcgccgaggagatagtgccccgcggaggcccgaccgacgcgctaggctccaacctctggaaggaggacgtgtcctgcttcgactggctccacggcagggcgcccaggtcggtggtgtacgtgaactactaggcagcatcacggtgatgacgaacgaggagctggtggaattcgcgtggggcctggccaacagcggccacgacttcctgtggatcatccggccggacctggtcaacggcgacgccgccgtgctgccgccggagttcctggaagccatcaggggccgcggccacctggcgagctggtgcccgcaagaggtggtgctgaggcacgaggcggtgggcgtgttcctgacgcactgcgggtggaactccaccatggagagcctgtgcggcggggtgccgatgctgtgctggcccttcttcgcggagcagcagaccaactgccggtacacgtgcgtggagtggggcgtggccatggagatcggccaggacgttcggcgggaggcggtggaggagaagatccgagaggcgatgggcggggagaagggaatggagatgcagcgccgcgcgggggagtggcagcagactggtctccgcgcgacgcggcccggagggcgctcatacgccaacctcgacaagctggtcgccgacgtgctcctctcgggtactagcggcaagagttcttaaaatctcaggagggtttcacttcgcacaccgccaccgtccaatgattcggactgaacatggatggtatggtagtacaccaaaagagaagtttgtgtgaatgtcgaggcaaacccgtaaatcatggagcatgtgatggaatggaaggaccgaaggagccagtagcggaagaagttacttctcgtagcaggcaaaaattggaatatgaaaatctggaagccaagagggttaatccctaattactatattttctatctgctagctgtattcgttgcaaatgcacacggtctgctgtttgtacgagtgtctggtaggcacctctacgcttaattaggttttgtccaatttttatttagtaattacattaaaaaatcgaagatcgaagttaatactaggtgtaatttatgggggtcttaatatgatcgaactgatgatgggttgataagggttaggtacatattatcgtgttgtttggttggtccattttactatataaaccattaaagtcgtgttcggttaactctcaatccatgtggattaagtgagattggatagatttaaattctaaacaagtcaattttttcttaatttttctaaactattcaatccatgtgtaatgagaataaccgacaaggcctaacatgggtatatatccaataacagtagtttctgtttgtttttgattcactgtaatcaaatcatggtgggatttgttaccggcatgtgtaaatttgataccgcctctatttcctagagttagaccattatgcatctctctctctccactctccccactgctgcaagcacataatcacttgctccaccagtgataccgctatgattcgattcattttctattccggttcccagcggtccaaccaaacagtanctatattttagtgtttatgaaatcttagatgtttttgttatcagtagcagatagtacttcatc

SEQ ID NO: 11429 - DNA, 2263 bp, Zea mays
ttttttttttttttttgcgaattgcattcgcacctcgagccggcgggatacgtttggatcgtggacgacagccactcgtggaacctacagggctttaacttctcccaacttcctcaaacaaatcctagcatcttcctaccccgtcccgatccatccatggcagcccctaccgtcgtcttactgcccgtgtggggtgctggccacctcatgtccatgctcgacgccggcaagcggctgctcacccgcgggggtcgcgcgctctcgctcaccgtgctcgtcatgcgagcgcccacggagcagctcgcggccgatctcgacgcccacatacgcagggaggaggcatcgggcctcgacgtccgcttcgtccgcctccccgccgttcagcccccgacggacttccacggcatcgaggagttcatctccaggctggtacagctgcacgcgccccacgtcagggcggctatctccagcctggcttccccggtggcagcggtcgttatggacttcttctgcacggcgctgctcgacgtgacccgcgagctcgccgtgcccgcgtacgtctacttcactgccagcgccgggatgctcgcgttcttcctccgcctcccgtcgctccacgaggaggtgacggtccagttcgaggagatggagggcgcggtggatgtgcccgggctgccgcccgtgccgccgtcttccctgccggtgccagtgatggacaagaaccacccgaattacacgtggttcatgtaccacggcaggcgcttcgccgaggccgacggcatcatcgtcaacacggctgccgagctcgagcagagcgtgcttgctgccatcgccgacgggcggtgcacgccgggtgtccgtgccccgacggtctatccaattggcccggttatctcgttcagccccccgcccactaacacagaacatccgcacgagtgcgtgcggtggctcgacacgcagcccgcggcctccgtggtgctcctctgcttcgggagccaagggttctccgcggcgccacaggcgcacgagatcgcgcacggcctggagcgtagcggccaccgcttcctctgggtgctgcgcggcccaccggcacccggcgagcggcacccgtcggacgcgaacctctccgagctgctccccgatggattcctcgaaaggaccaagggcagaggcctggtgtggccgacgaaggcgccgcagaaagagatactagcccacgccgccgttggtggtttcgtgacacacggcggctggaactcggtgctcgagagcctgtggttcggggtgccgatggcaccgtggccgctgtacgccgagcagcacctgaacgcgttcacgctggtggcctatgtaggcgtcgccgtggcgatgaaggtggacaggaagaggaacaatttcgtggaggcctcggagctggagcgagcggtgaaggagctgatgggcggtggcgaggaagggaggaaggcgagggagaaggccatggagatgagggatgcctgcaggaacgccgtggaggagggtggctcatcctactcttcactacgaaggctatcagagaagatatgtaaagtcgacaagaacctatgagtctgacgatgagaggcaattttacatcacattctttattgctgtaaactagcagtaagagaggatgtgattgattaaggttgagaataaattcttatcattgaatataaattagatgaatgatatattttatctaaaaataaagtaaaaatcaaacacctataatttggcaatttctattatatatatatttcaagtgttcatagatgcttagaccatagagccttggccttgtgtaattgtgtttggtacttaggtatcacgtatctctgtcgttaccttcaaataaaaagtgtaataagggggctgttgaaatcagatgtctaaatttgaatttgagtttcttcagtgagatggctattatatattctctccgctctaaaatattattcatacaatattatatatatatatatatgtattatatatgtatatagatttattgtcatctattgaacatggacacaaaaaaaataaagaggtagaatgaaccatatattaagacagagaatataatctagatagataatattctgtgcatacgaaagattagtacacacgtgcatttatggaatcttgatctttaaaatcaagtctctccggcacttatcctactcagtagtcagtactcactctctatcagtacattctacgttcatatatatacactctgcta

SEQ ID NO: 11430 - DNA, 1379 bp, Zea mays
ccgggaagcctgccccggcggagggaacaagggcctcgcgctgggccagttcgtctcgctgctcatcaccgccaccggcttcgcctcctccgaactcgcccgccgagggatcaacgcgcccacctcgcagtcgctcctgaactacgtcctcctcgccgtggcctacggcggcgttctcctctaccggcggcagccactcacgataaaatggtactactacttaatacttggaattatcgacgtggaagccaactacatcgtggtcaagtcgtaccagtacacgtcgttgacgagcgtgatgctgctggactgctggtcgatcccgtgcgtcatcctgctcacctgggtgttcctcaagaccaagtacggggcgaggaagttcctgggcgtcggggtctgcgtgcttggcctcatcctggtcgtgttctcggacgtccacgcctccgaccgagccaaagggcctaacccgctgaagggcgacctgttcgtgatccttggttcgatgctctacgcctgcagcaatgtcaccgaggagttcgtcatcaagaaaagcaacagggtggagctgatggcgatgctggggcttttcggagcgcttatcagcgccatacaaattagtgtacttgagcgagaagagcttcactccattacatggactagtggtgctgtgctcccttttctcgggttcgcggtagcaatgttcctgttctactcggctgtgccagtaatattgaagttatgcggcgcgaccatgctgaacctctcgctcctgacctcggacatgtgggctgtcctcatccgcatcttcgcttaccatgagaaggtcgactggatctacttcgttgctttcgccgccactgcgggcggcatcgtcttgtactcgtacaagggctccaatgaagtggaggagacggcacaggtggccggggccagcgacgagcacggcaagggccgggacgaggaggctgggacgcggaacccagcgtgaagctctggcgccagccagcaatggaggtgggttgccccctgccaggcatccaggagtgacgagttgttgttgcatgccttgacggcgagtgtagcagagaacttggtcaagtgtcgcaggagactgcttcaagatttgacgacggagatagtattggtttttatgtaaaacaagaacagttggtaacataccgacaccgaaccgtcgtcagaaatgattagatctaagaatcgaagattttacaggtgtttttggtaggtgtgtttggttgagaaatagagcggtttcatttttattttctgatgtttgatttccaataaaagataagcagagcacagttttcgtaaaaaaaaaaaaaaaaagcggccaaaaaaaaaaaaaaaaagcggcc

SEQ ID NO: 11431 - DNA, 1626 bp, Zea mays
ttgggaccctcgaggccggccggggccgtggagtagaggagcacaagtgagctagctagctctagctaggccacgcactgctgcctccttcatcatcaggtcgtgctagctagctagctatagctgggccgggggacgtacgacatcagcgcgcggccatgggcgtggggaagctgatgaacgacgtgaagccatacctggcgatggtgctgctgcaggtggggttctccgggatgtacatcgtctccgtcgcctccctcaagcgcggcatgaaccacttcgtcctcgtcgtctaccgcaacctcgtcgccaccgtcgtcatggcccccttcgccctcctcttcgagaggcgagtgaggcccaagatgacgccgctcatcttcctcaagatcatggggctcgccgtgctcgagcctgtgctcgaccagaacatgtactacctcggcgcgaagctgacgtccgcgaccttcgcctcggcgctggtcaacatcctccccgccatcacgttcctgctggccctcgccctgaggatggagaggctgaggctccggagcctccgcagccaggccaaggtggtcggcacggtctgcaccgtcgccggcgccgtgctgatgatcctctaccacggcccggtggtgccgttcccgtggtccgcgggtcgtcttcaccaccacgtccccgcggcggcggtggagagccagagcagcgcctcctggctcaacggcatctgcatgatcatcggcagctgcctgtgctggtccggcttcttcatcctccagtcgaacacgctgcagagctaccctgcggagctgacgctgacgactctgatctgcttcctgggctcggtgctgaccggcggcgtggcgctcgtggcggagcgccgcgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggttcttggctccaccatactgaaagaggagaccaccctgggaagcgtgattggcgcggcgatcatagtggtggggctctactgcctcatctggggcaagagcaaggaccacctcggcagcaacggcggcaagcccggcgccgcggccgtcgccgagctgcccctgacctcgtcggctcctgcttggtccaacggcaagcaagctctggccgtcgtcgagacgacaccgccttcgtctttgcccaacaagtgcgttcactgacgcgcggatcggagctccatgcatgatgcggaccgtacaccaccgcacactactagtagtgcattgccagtgactgtaagccgccggccgtgtatgatcatgcatgcataccgtcataccgatatgatgtcccatactcccatcgttgcgtttaacactctcgagtttttgataacgtacttgcgtgtgctctgctgtgtgccactgccagtgccaccacaaccaatagtctaatactactacgacaattaagctttgtttagtttgtgcaaggaaagaagagaattaattactactattcgagtcaaaaaaaaaa

SEQ ID NO: 11432 - DNA, 1254 bp, Zea mays
cgccatcgcgtcgcgaacggcggccagaaaaaagaaaaagaaaaaaaaaaacagctcgccgcaccaatctcccctaccatatcgatcgaccctgcgatcaccttcgtcatggccgctagtttgaggtcgtagcaaggggaggacgtttgtttgggattatatataatcttcctagattatatttataatccgacaaatctttaactaacacttggttggttgaaacagaatcgaacaggtaaatgtgaggaaccctaggatagcgggggcaaccgtcataaccctctacaaagggacgccattattgacagaaacagctcatgcagagggcaccacgcacacgctggaaggcacccacacgctcggaggatgggtcgcaggatgcctcatcatgttcgcgaactgcatttgcttgtctgcgtggatggttctgcaggtcccggttctgaagaaatacccagctaagctgtcgtctttcaccatcactctggcgttgggtttcgtccagctcgctgtcgtcgcgccgtttttcgagagcgacgttgagaggtggaagatcagctcaggaggcgagcttttcaccatcctgtatgctggcgttgtggtgcttggaatcgcctggtatctcatgatctggtgcataaacaaaggagggcctcacttcgtttccgtcttccagccactgcaaaccgtcatggtcgccatcatggccgccatcttccttggcgacacactctacattggaggagtcataggtgcggtgatcatagtcgcgggtctgtactgtgtactgtgggcgaagagcaaggagaccaaaagcagcggcgatctcctagtccttcctgaaagaagccccgcgcagcagaatctcctccagcgtgaagattgaagcgagaccactcactgtactgtacggttctcggccggctgtagctgccccaacaagaaatatgggggtgtttggtttgagaaatcacttcatccaaaatgtggtggtgcatcatgagtccattactcaaatttggtgggatgaccttatgcctcatattagtactaactaaataactataagaaatggggtgatgatggatcaactcaatccattccacaaaccaaacaaaaaagtgaggagtgagaagacgatggactagatcattcctcaaaccaaacagcttatatattccttgtatcgtcagttggacaggccaatagatgatgtcgcctgtggaaaaaaaaaaaaaaaaaaggccccta

SEQ ID NO: 11433 - DNA, 2007 bp, Zea mays
  misc_feature (126)..(126): n is a, c, g, or t
cctgtcatccgtcatgtattctcctatgaatatatgcttctgctatggagattagtggcatgcaaggaattgttggagaaaattcaagaaaagggtaaaactatctattctcattttcggcggttnaatgtaacatgatgcatgagccctcacgtccatagataattattgcaacactcttgtgtacgttatcacagattgatgtttcaaacaaacaagatcagatgactactaaattgaagataacccttttattctctcaaggtttattgaaaccaatacataatttataacgcctggaggaaatgataaaaaaagtgggttttattgagcgatcgatagcatcttaatttacttagccttgtccaccttggccagagctagagcctgatgcacctccgtatccaccggcatacccaccgtcatgcccaccgccttcaccgccaccgcttcccccgccattggcagaacttccaccgtttggaccagcaacgtagctagaagagatccctcttccagaaccagagccggaaccactcccgttttgtggacctcctccacggccaccaccaccaccactgccttgtgcatctgagtaccctccaccatagaagccaacagtgtagctacgacttgccgaagacccggaaccagctccagacccaccattatcgccgccgccgctcccgccaccgtctacactagccatggagctaccggtcccatatggcccaccaggagtgttggtagctccagcggatccgtagccggagccagatcctgaaccatagccattcatggaacctccaccttcccctcctccccctccctgaccagcagcgtcggtcattgggtgctcccaagggaactccctagctttggatacaccaatggtcaacagggctactacaaggctaaaggataggagcctcttactctccattgtgacttggtgttgtgtgggagatgagctgaatgaaggcaacatgtacgcgaacgtagagatatttatactgctttagccaagaaaaatgcattactttatatcagctgtatatatgcatacaactggcgaggatacggcacggtgtacagacagaaaaaaaagtccaatacacatgcaaacgaaatctgtcggtcgcaacagtttcggtgcatctctcgcgcgcgtcacgtggatcgtagtagaagcaagccatagaatacgtttcgttattttttttgtccccgattcccaaggtagatgctcgatcgttagggcacctgctcaggataattaattgaaccattggagaagagagagagatgcttttgtaaatagctatgttctccctccgttctaaattatgttcatttcaaccttttagggggtgtttggtttgaggaatcacttcatccaaaatgtggtggtgcatcatgagtcaattcctcaaatttggtgggatgacctcatgccttatattagtactaactaaataactataaggaatgaggtgatgatggatcaactcaatccattccacaaaccaaacaaaaaagtgaggagtgagaagacgatggactagatcattcctcaaaccaaacagcttattagattatcataacatctcaaatttaaacaagtttatgtaatagaatggaaatatttatgatactaaataagtattgttagatttttactaattacatatctatagtatatttatttgattccataatttttgtaacgacaaagtctggaaaatactcggaaaactctttgtcgagtgtgaggtctcggtgaactgaacatcgacagcggtctctttgccaagtactttttatcgtacactcggcaaagaaagtcgttgtgacggcgccaagtgacggtgatggaggctttgccgagtgtattcattgacactccgcaaagaagcagccttgttgagtgcctactggcctgacactcagcaaagaaaggtccaatgggctcccatggtagcctctatgtcgagagtcacaagctgc

SEQ ID NO: 11434 - DNA, 954 bp, Zea mays
attgggacctcgaggcggcgggaacagttgctctggctagctatctcgtccggtcctgcgtcaggtatagctgcagtggggattgttttgttgatggtgtggaaagaagagagggaaaaaaaaagatccatggcgacggaggaggccggccgtgccctggcgacgaaggcgaagctggtggcggcggtgctggtgctggagctgctcgtcgcgggcttccacgtcgtgtcgagggcggcgctcgacatgggcgtcagcaagatggcgttcctcgtctaccggaacgccgcagccctgctcgtggtcgcccccgtcgcctacttcctcgacaagaaagataggccgcccttcacgctacgcttgctgatggacttcttcttgctggctgcagtcggggtaaccttcacacaggggctctacatcctcggcctgtactacctgtcaccaacctacgtctctgtcatccagaactcagtccctgcgatcaccttcgtcatggccgctagtttgagaatcgaacaggtaaatgtgaggagcagatacgggctggcaaagatgctaggcacggtggtcaccatagcgggggcaaccgtcataaccctctacaaagggacgccattattgacagaaacagctcatgcagagggcaccacgcacacgctggaaggcacccacacgctcggaggatgggtcgcaggatgcctcatcatgttcgcgaactgcatttgcttgtctgcgtggatggttctgcaggtcccggttctgaagaatacccagctaagctgtcgtctttcacatcactctgggcgttgggtttcgtccagctcgctgtcgtcgcgccgtttttcgagagcgacgttgaagaggtggaagatcagctcaggaggcgagcttttcccatccgggcgttgtggtgcttgggatcgcctggtatctcatgatctggtgcataaa

SEQ ID NO: 11435 - DNA, 1226 bp, Zea mays
attgggcacctagaagcgaatatcttcgtcttccccgttctcgccgatggctgcaacaccaacacccactgccgccgttttgctcgcgcgcccgctcatcgcactgtccagtgctttcacctcccctcatcgtgcgcgggtgccgagcggtccctcctccatctcggtgccgccactgaggagtcgatggtgccagtggcgcggcccgctccgatcgctgccccccgaaggatctccggccgagctgatggaagaggactccaagtttgtgccgttgaacgcggacgatcccatgtacggcccaccggcgctactgctcatcggatttgagaaaggcgaaactgtcacgattcaggccttcctgaaagagcttgaaggtgaattcctcaaggtgatccattgtacagaggagatgacaaagcaaaccttatgggatgccatgcacactgagcagcctgatttggaagctgtcaagattgcaggaccactgccaaggatatgcatattttctggtctaactggcgaggagatgatgatgttcatcaacgccttcccagaaaccgggctggaagcagctgcctttgctgcgcttgtccctaacagtgcagagaaggttctcggcgaagtgatcgaggaaataatgggagaccatgagatgctgacaggaaaggactccaaatgagaagaatttgaagcacggacatgcctatcaagaaaattgtcactttgcattctgatatatggcatctaaatctgattcaaattgccgcaacaggaagctgggtatggaaaaaactgttcaagatagtgttgcagaagaaacatcagtttaatttttcttctgataaatacgggtccttttccatctggtcacctccagaatttgagctcctacttactgtatgtcgtacacataatatagtttatagtgaccaacaagttgctcatgactggccagcttttggactttgggggctttctgtccgttgacttttttctattgatttttataatattttatttagcttttcagtacataacaatctaaagaggcttctctcagcgtgttttatagcttttagtttatttgtttactcaaaagtcagttgtccagatttttaaacgccaggtcaacatcttatggcttctggctaccagaaactattgaaacaaagctgagataaatattttgagacattcccaaaaaaaaaaaaaaaaaagcttat

SEQ ID NO: 11436 - DNA, 1098 bp, Zea mays
  misc_feature (1010)..(1010): n is a, c, g, or t
  misc_feature (1013)..(1013): n is a, c, g, or t
gaccgaggaacacaggaagctcgtcttcctcctctggctgtgagatcctatccccctctcgatttcccctgcaattactcacgctcccggattgatctcgccggtgtagccacgggtattacacagtgttgaagcgatcagcgtcttcaccaaggacggcatcctcaaagtcaccggcacggccgtgtgcgtctccggcgccattctgatggccctgtaccgaggcccatccttgatcgcccttcttagaagcatgcccaccgcatggacgagcgctccctaccaccctgctgctaccccagccgtgctcgagcagggtgtagaagcatggcagcttggcgtgctgtgcctcataggaaactgcctcttggtggctgtctatctagtcgtgcaggctccagtgatgataaagtatcctgcgagcttatccgtgacagcttactcctattttttcgccacaacctttatggtgctaactggagtaattgcgactagtggcttacacgagtgggcactgacaaaagccgaggtcatagctgttctgtatgctggaattgtcgcatcttgtctgagctactcgatcatgacatgggcgaacaaagttcttggaccttctctggtcgccctctacaatccactgcaaccagccttttccaccgccctctcaactgttttccttggcgacccagtttacctcggaagcgttattgggggagtctccataattgctggtctctatctggtcatctgggctcgctacaatcaagggcagcgggcgcctacggatgcttgtttggaccctcttattattgtggataatccaagaatccccaagacacaagaaagtcccttcgtgtagatcctcaaaaaatgtgtcgattatccacacatttgtataggtggtctacagtatacttctatttgttaaacttcacatatgcattctaataaacaagtggtcaaagattcccatgggagaatttgtcatttccatcaactacttcaacganggngggtgtaaggaaaatggacccgacccatttgtctaaatgattttggtgtttgatgaacaacataaccagtgaactaatgttttcg

SEQ ID NO: 11437 - DNA, 784 bp, Zea mays
  misc_feature (744)..(744): n is a, c, g, or t
cctcgagggccggccgggatttaattctatttgtttcctgatggctggctgatggcgggtcaaggttgaagccatcaaggcaacgtacgcctaggagtggagacgagacgacgagagtggaggagggctgctgatgggcggaggagacgacgaccggagagcggcggcgctccagcgatcctcgtcgccatggagcgtgggcgagcggtggcgggcgcacgccgggatggtcctcgtcatgctcgcctacagcggttaccacgtcctcgccaagtccgtcctcaacgtgggcatgaaccaggtcgtcttctgcgtctaccgcgacctcctcgcgctcctcgtcgtcgcccccgtcgccttcctccgcgagagaagggtgaggcctcccgtgacgcctcagctcctcgcttccttcgctctgcttggcttcactgggctgtatgggaacccgctcctctgcctcgtcggcctccgctacacaaacgcctcctacgccgcggctttccagccctccataccagtgctcacgtttctcttggctgccattgtcggtgttgaagcgatcagcgtcttcaccaaggacggcatcctcaaagtcaccggcacggccgtgtgcgtctccggcgccattctgatggccctgtaccgaggcccatccttgatcgcccttcttagaagcatgcccaccgcatggacgagcgctccctaccaccctacccccgactgcgtcacccacccatcagnccgtgcccgtgctcgagcagggtgtagaagcatggcagct

SEQ ID NO: 11438 - DNA, 1305 bp, Zea mays
gacggcagttcccgacttccgttggattctcttgcctcggctgctcctctccctccccctgcttggcttcgctcgccttctcagccacgccgccggtcagccacgccgccgcttccctcggtgggcacccccctcccccatctggaacccactcccgccaacgggtatctccattcccccctgcctaccttcgaaccgacgtgctcggattggctgacccgccgcgggcgctccctccgtcgatcaaattgaccgccgcggcgcgcccgtccccatctccgccaatctccggtttcattatgattaataaattgtgtattaatgtagtggaggagccaggccatctagtgacaagtaagtagcattatcggcgaagaaaacatccacagctgagttgccaaagaaaggcggataaatatgtctcaaggaacttctccgctgccaaaagataaacctaccgcagaacctggaaaggctattggcatcaaacggctgcagactgatactccctcaggtcttgcatatcataatgtttatgtacgaaggaaagtagaatctgagcatagtaaagtgaacccttctcaggagttgaaaggtaatggaagagacaaatcaaaagatctggaggcatgccaagatgttcaacatgaggaggccaacaagcctcaagtggcatctccttttgctgaatctgtagaactagtatcttccaaatcttctcaagaaccaaatgcggaaactgtggcggagaaaactgagccaccagttgcttctagcactggcattcaagaggaggtgaaacggtcaagcatagaatactggaatgagagatttaatcggttacagacatatttggagaactgtgatcattcaacccaggagggttatttgcgaaagcttaggtccctttcggctgctgggagaaacatgcatgcaattgagctggagaaaagggcaatacatctcctaatggaggaagggaaagagctccagcgaatgaaggctttgaatgttcttgggaaggtttccccaaatgcttcgtcgaagctgacaccttcgcagcggtagtctctacaatgagatgactgtataacatcaagagggctgtaatactcaaatacattgcagaaaagacatgttgttcctgtgtaacacctttccttttatttcctttgatgccctgcccttttgatgtaagattgttgtaatgctatgtaaccagccgtacatataaacctgccattcttagtcctaaacctgactattatttgtttgtcaaaaaaaaaaaaaaaagtgatttatgtg

SEQ ID NO: 11439 - DNA, 2247 bp, Zea mays
  misc_feature (50)..(50): n is a, c, g, or t
  misc_feature (63)..(63): n is a, c, g, or t
  misc_feature (85)..(85): n is a, c, g, or t
  misc_feature (87)..(87): n is a, c, g, or t
  misc_feature (90)..(90): n is a, c, g, or t
  misc_feature (93)..(93): n is a, c, g, or t
cggacgcgtgggtgctgcccgaggactaggacgcggagaagcgtgcccangctgtggtgcggnacaacttggaggcggagcgccncnacngcnaggaccgcggcgccatgaggccgctcgcacggacgccgcacatgttctgcaagacgctcacggcatccgataccagcacgcacggcggtttctcagtgccgcgccgcgccgccgaggactgcttcccgccgctggactacagccagcagaggccgtctcaggagctcgtggccaaggatctacacggcacggagtggaagttccggcatatctatcgaggtcagccacgaaggcatctcttaaccactggatggagtgcatttgttaataggaagaagctcatttctggagatgcagttctcttccttcgaggcgaagatggagtgcttcgactgggagtgcgccgagcagcccagctaaaaattgtaactcctattcctgcacctcataaccagtgctcaagtaatagcaatcttggaaacgttgcacaagctgtggccacgaagactgttttccacatctactacaatcccaggttaactcaatctgaattcattgtacccctattggaagttcacaagaagcttcaatcaaccaatttctgttggaatgaggtgcagaatgcgatatgaaagtgacgatgcttctgaaagaaggtgcactggtataataattggaagcagagaagctgatcctatatggtatggttcgaaatggaaatgcttggtggttagatgggatgatggtatagagtgccgttggcccaatagggtatctccttgggagattgagctcacaggatctgtttcaggatctcaaatgtgcgctcccagttcaaaacgtctgaaaccatgcctcccccaagttaatccggagattgtgcttccaaatggaagtgtttcttcagattttgcgggatctgccagattccacaaggtcttgcaaggtcaagaattgttgggtttcaaaacccatgatggtcctgctatttctgcttctcaggcaactgaagcaagaaatttgcagtacagtgatgaacggagtaacaataacttagggatcccaagacttggtgttaggtctccaactggaatccctgggtttccctaccattgctcaggctttggggaatctcaaagattccaaaaggtcttgcaaggtcaagaagtgtttcatcctttccgaggaggatgtttggctgatggccatataagaactgctggcatgtatcaacctgacggtaggcatgtatctggtgcagcttataaatggtctgcaccacaagggtatgatttcccacagccagcaaaaccggtttttctgttgcaagaatcatccccatcatctgtgatgatgtttccacaaactagatctaagataactcacttggaatatgagtactcaagacatgaggatggtagacttgataggactgttcctactcaagacatgggaagaagcaatcaaacattatctctttggcctcatcttgtttcaggcgaagcaatagaagaatgtactggaactgtgaatatgcactcccccgtcagtggtgcagagcatgaatcaaacaatgagagtacagttgaaaatggctgcaaaatctttggtatctcattggctgaaaagatccgatcatgcgatgaagcagactcttgtagtgcaaaatgtaattctcggctccagcctttgaagtcacaaatgccaaaatcgctaggcagctgttgggccactgttcacgagcaaaggcctgttgttggcagggtggttgacgtctcggcgacggatatgatgatctgatccacatggcatatccttgtagaatatgcaggaaggactaccgagtgcaactttcatggcctgaaccacatcctggatgaaagattgctgaaggtgaccttatgattcttgaaacagggatgtttgacaaatttgtaatgtacttttgggctttaagtatcttattatcttaagctacctagtaatcagcacttgtaccttaaggtgtgcgttatggcaagttcttttagagggcttgtttggactagcaccatctcccaagtactcgtcgcattgtttctttgccccgggaaacaagtccgttttggaagtttggctccagtcctgttggtaccatttgttgcatcgtgtgtgcttgtacaattgcacatctcaagcggtaaagcatgatttgaccagctaaaaggggaaaaa

SEQ ID NO: 11440 - DNA, 1510 bp, Zea mays
attttcaatcccagaacagggcccgagcgagagcccacgaacgaagggctccttctctctcctctcgttgctgcagttgcagacttgcagtgttgcagataattttggatgccattcaagcgttctacggctccaatttctctgacttctccctgagcctttgcggccggctggagctggacggtccccgggcagcgcaggcagccggactgcgggagtcacctccatggcctcggctgctactgcaaccctccccaaggttcagttgaggccaagatgcaacagctactttcaggtgaccggtcaagtccatgcccacaccaaaacatgcgttgcctgcaagtgtccgacccatatccacgggttgcttgtttcagctggaggaaggaggacattcctgccggtgtctgcagttggatcaggtcagggctcatcggtcactgaggccgacaggaagagcgatttgtcgctggagaacgtcaagacgtccgttgtatcccgcgacgatgaaaagattaatgtacgagtgcagttgcctggaaaggcgacgcaaaaggtgtttgatgaggctctgacgttcttggcccgtgatgcgccaccggttcctggttttaggaagtccaaaggagggaaaacatcaaatatacccagcagcatcctgctgcagatgcttggcaagagccgggtcaccaaattcgttcttcaggaaatactgagcatcaccattgaagaatttgtcaagaaggaaaacctgaaggtgaaacctgagatccagacaacccagtccgaaggcgagatggagtccgcgttcgcgccgggatcagcatttgggttcaatgttgtccttcagctcgagacacctgactctgatgatccagaggagaaacctggctctgatgacgatttacaggaggaatctggttcctcagagtagaaagaaatgcatatcgcctgcatgcatttatcaaccttcttcatgtgccattccttatgaatgaatgtactgaatggaaagccgttgcaaccgttttgagttgagagttgcaactgaaacatttctgaagatatgagtggccgactcgcctctcttaacatgttgacacacagcgagcatacgcttcagaaatcggaacctgctgcacatatgattggaactgaagaaaatgcgcgtgggaggtccatgcccacaatgataacacactagagcttcagcttccagcgcacactacaacaagatcttatccgctttgtctggagtatcatccgttgacaactcggcttccaactaccagatcaatcattccgggtgctccccacctcccaaggttcacactcccccacatcgccagtgacctaccaactgcacatattattcgttccttttttttccagagaaaaccagccgcatatattcttggagaggagaaagacccggccctaaacatttgcacttctgattctatggcccatgagaattccctgtcatgacagtattttgcaactccgacat

SEQ ID NO: 11441 - DNA, 1112 bp, Zea mays
ccggccgggattttcaatcccagaacagggcccgagcgagagcccacgaacgaagggctccttctctctcctctcgttgctgcatttgcagacttgcagtgttgcagataattttggatgccagcccggcgttctacggctccaatttctctgacttctccctgagcctttgcggccggctggagctggacggtccccgggcagcgcaggcagccggactgcgggagtcacctccatggcctcggctgctactgcaaccctccccaaggttcagttgaggccaagatgcaacagctacttccaggtgaccggtcaagtccatgcccacaccaaaacatgcggtgcctgcaagtgtccgacccatatccacgggttgcttgtttcagctggaggaaggaggacattcctgccggtgtctgcagttggatcaggtcagggctcatcggtcactgaggccgacaggaagagcgatttgtcgctggagaacgtcaagacgtccgttgtatcccgcgacggtgaaaagattaatgtacgagtgcagttgcctggaaaggcgacgcaaaaggtgtttgatgaggctctgacgttcttggcccgtgatgcgccaccggttcctggttttagaaagtccaaaggagggaaaacatcaaatatacccagcagcatcctgctgcagatgcttggcaagagccgggtcaccaaattcgttcttcaggaaatactgagcatcaccattgaagaatttgtcaagaaggaaaacctgaaggtgaaacctgagatccagacaacccagtccgaaggcgagatggagtccgcgttcgcgccgggatcagcatttgggttcaatggtgtccttcagctcgagacacctgactctgacgatccagaggagaaacctggctctgatgacgatttacaggaggaatctggttcctcggagtagaaagaaatgcatatcgcctgcatgcatttatcaaccttcttcatgtgccattccttatgaatgaatgtactgaatggaaagccgttgcaaccgttttgagttgagagttgcaactgaaacatttctgaagatatgagtggccgactcgcctctcttaacatgttgacac

SEQ ID NO: 11442 - DNA, 1836 bp, Zea mays
ggggcccgtatgacgtgtctatctagttagttctcgatagcctctctctccctgcctccccgctgttgtggttgcggtgcttctgctgatctgctccgtcttctcctcccggcaatggcctgcttggaggcgcccccgcgcgtcgagctctgcccggtctcgtgccagccccgcggcctgcagcttccgccatggcggctcagcctgtcgaggtcctcctcttcatgcagatcttgcacccttgtgtctcgccagcttccaatttgcaatgcacagtcatatgctgatgatttatgggtggctgcgcctcatagccctgcatctgttcgctcaaggttgcttgcagcggaaagagaggaagcaaaggctgtcctgtccctgtttctgaggcagaaaggtctgcgaagcacgctggccgcacggatcgtcaacaaatcggatggcttcatcgagcacctggtctcgaagctccagattgcttacagatctcgatatgctgaaggaagggagctgagcacgcctgaaatcagagacgctctccttccctatctcgaagctctctccaaagaacatggcgacagtttggtcgaggtggtggagaatttccccgacccttttgctatggaaagggaagccttatcttcatcaatggcgtttacacccacgagctcaaacaagcagaaggcgattgctcgaataagcacggcagcctcaggcgccgccctccctgagctggtcccctacctactagaccttggcatggaccacgaggagataaaggacatcgtgcgcaagttcccagcgttcgcgtactacagcgtggatcgcaagatcaagcccctggtggagctcctgcttgagcttggggtgaaaaattccagcataccaggaatcatcaagaagcggccccagctgtgcgggatcagcatgtcagacaatctcaagccgatgatggcttatctggagagcatcggcgtcgacaaggctcagtggagcaaggtgatcacccgcttcccggcgctcctcacgtacagccggaacaaggtgcagacgaccgtgagcttcctcgccgagctaggtgtctccgagaagagcatcggcaagatcctgacgcggtgcccccacatcatgagctacagcgtggacgacaacctcaggccgaccgccgcctacttccggtcgatcggcgcggacgccgcgtcccttatccagaagagcccgcaggccttcggtctgaacgtcgaggccaagctgaggccgaccacggagttcttcctggcgagggggttcagcgtcgaggaggtcggcgtcatggcgaacaggttcgggatcgttcacacgctgagcctggaggagaacctgctccccaagtacgagttcttcctggcgatggagtacccgaggtgcgagctcgtcaagttcccgcagtactttgggtacagcttggaccggcggataaagccacggtacgcgaggatgactgggtgtggggtgaggttgattttgaaccagatgctttcggtctccgatgccaggtttgagaagattctagagaagaagacggctaggctttgataagacagcagtttcagattaggcacagtgttggagttcatttgagaagaactgtcaatgataaaaccatcagttttcagagcacgtagcttattatcgtggccttcatggacgtgcaacgtccagaggcgaactgtttgatgtgctaatctgtagttagcttctgcgaggtattgaaatgcatgcaactttggcaatcagaaatgccagttgcagtgggcgagattgcttggtgctcaaaaaaaaaaaaaaaaagcggcc

SEQ ID NO: 11443 - DNA, 1040 bp, Zea mays
tagatcccgtataaatggaaatttcattgataagaccttctcgatggtagccaacgcagcagtgctaacaacgccgactacccccggggaaaaaagggcatttacttattatagagatgggatgttggctcaatccgaaggaaattatgcggaagctttgcagaattattatgaagctatgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattaccgaggagaacaggccattctacagggcgattcggaaattgcggaagcttggtttgatcaagctgctgagtattggaaacaagctatagcgcttactccaggaaattatattgaagcacagaactggttaaagattacgaagcgctttgaatttgaataagaccactctccattttcataaaaagggtggtttggttgaaaatcaaatcaagaatttcattatatccctttcttctaccttcaattttatatcatatttcataaggataaacaatagggataggctctggaacagaagtaataaagtacataaaaatcggcaatctaaatattcctacctaatatatcaggacggtcttattaataattctaatgagttatcttggaattttgaatcgaatcaaaaaatctatattatgctcactcaaggaaagtagatgtagataggggcttataccctcagaaaaaaaatacaccagcttcttaaattaaaacgtaaaaaaagatttttttgttatgtcgggaaataattttccagaataaccaatgtccgttaggcacctaatccttatgtcataatagatccgaacacttgcctcggattgacttcaatatataattgctccagtgaataactgaaaaaaaaaaaaaaaaaaaaaaaaaaaaagtactctgcgttgttaccactgctt

SEQ ID NO: 11444 - DNA, 781 bp, Zea mays
  misc_feature (43)..(43): n is a, c, g, or t
attgtgtcggtacccgggattcggccttatggccgggtagggngagaaaagcactacaccacgaaataggaatcaacaagagaaaaactttgttagaaattagccctttcctgattggtatcagggttgggaagaatggttgggataacaaacaaccatcaggtttgtactttggatacccttataaccatcaaaggtcgttgaagtggctaattcctctaaataggaggcgttgagaacaaagaaattcttggagctatcgttttcctctagcattaatataattcattggtgttaagaaaaacctcttgggggaaggttggctagagatttcttggaaaaataccagcccccttcggtccataatgagatgggactaattcgatttttattctatagatttttcgcttagtactatgtatagaagggagaagccgtatgagatgaaaacctcatgtacggttttggaacggagattttttgaatagaatgaacgaccgtaacggatgttggctcaatccgaaggaaattatgcggaagctttgcagaattattatgaagctatgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattacgtgcgactatctccactatagaaaaaaaaaaaaaaaaaaggccccta

SEQ ID NO: 11445 - DNA, 2454 bp, Zea mays
gatgcatcgccatttacagtaaaatatccctgcagcggtggactgtatgaccaactacaccgggcccaaggcgagctcgaacctcagatatagcgtcttgcagtggataccctattcctccacgtggacaaccacctcttcctcgcgcgcgatgccggacttggacggaggattcataaaaagggtggtttggttgaaaatcaaatcaagaatttcattatatccctttcttctaccttcaattttatatcatatttcataaggataaacaatagggataggctctggaacagaagtaataaagtacataaaaatcggcaatctaaatattcctacctaatatatcaggacggtcttattaataattctaatgagttatcttggaattttgaatcgaatcaaaaaatctatattatgctcactcaaggaaagtagatgtagataggggcttataccctcagaaaaaaaatacaccagcttcttaaattaaaacgtaaaaaaagatttttttgttatgtcgggaaataattttccagaataaccaatgtccgttaggcacctaatccttatgtcataatagatccgaacacttgcctcggattgacttcaatatataattgctccagtgaataactaaaaaaaaaaaatagaaggacggtagatagtaaagaaaaggactaatcataatatctatctttaaaagattcaataaaaagacagttggcgggtctctttgtatgtcttgtccggaaagaggaggacttaatgattattcgttcgtcggaaccagaagttaaaattgctgtggatagggatcctataaaaacatcttttgaggaatgggccagacccgggcatttctcaagaacaatagctaagggccccgatactaccacttggatctggaacctacatgctgatgctcacgatttcgatagtcataccggtgatttggaggagatctcccgaaaagtctttagtgctcatttcggccaactctccattatctttctttggttgagtggcatgtacttccacggtgcccgtttttccaattatgaagcatggctaagcgatcctactcacattggacccagtgctcaggtagtttggccaatagtaggacaagaaattttgaatggtgatgtaggcgggggtttccgaggaatccaaataacctctggtttttttcagatttggcgagcatccggaataactagtgaattacaactctattgtaccgcaattggtgcattgatttttgcatcgttaatgctttttgccggttggttccattatcacaaagccgctcccaaattggcctggttccaagatgtagaatccatgttgaatcaccacttagcgggattattaggacttgggtctctttcttgggcgggacaccaaatccatgtatctttaccgattaaccaatttctcgacgctggggttgatcctaaagagataccacttcctcatgaatttatcttgaatcgcgaccttttggctcaactttatcctagttttgccgaaggagcaaccccttttttcaccttgaattggtccaaatatgcggaatttcttagttttcgcggaggactagatccaataaccggtggtctatggttgagcgatattgcacaccatcatttagctattgctattcttttcctgatcgctggtcatatgtataggaccaattggggtattggtcatggacttaaagatattttggaggctcataagggcccatttacaggacaaggccataaaggtctctatgaaatcctaacaacgtcatggcatgctcaattatctcttaacctagctatgctaggctctacaactattgttgtagctcatcatatgtactctatgcccccctatccatacctagctactgactacggtacacaactttccttgttcacacaccacatgtggattggcggatttctaatagttggtgctgctgcacatgcagccatttttatggtaagagactatgatccaactactcgatacaacgatctattagatcgcgtccttagacaccgcgatgcaatcatatcccaccttaactgggtatgtatatttctgggttttcacagttttggcttgtacattcataatgataccatgagtgctttaggccgtccccaagatatgttttcggataccgccatacaattacaacccatctttgctcaatggatacaaaatatccatgctggcgcgcctggcgtaacagctcctggtgcaacaacaagtaccagcttaacgtggggaggcggcgagttagtagctataggcggcaaagtagctttgttacctattccattaggaaccgcagattttttagtccatcacattcacgcatttaccatccatgtgactgtattaatacttttgaaaggtgttttatttgctcgcagttcccgtctgatacctgat

SEQ ID NO: 11446 - DNA, 2674 bp, Zea mays
ccggtcgacccagcgttcgcggccgcgtgggtgagctgacggaaaaccattctttttccattaggcttggtcgttttaagatcgatgttttgtttttatgttatccccccgcctccggaaaagaattctatatagaatgggttgggaattatgcctagatcccgtataaatggaaatttcattgataagaccttctcgattgtagccaatattttattgcaaataattccgacaacctccggggaaaaaagggcatttacttattatagagatggtgcgatttgactctttttttttttagccctacctatatctcattcttacgagaaagagagagggttcgcatagagagaacaaaattagtaaaggaaacccgcgcttggggaaggtgaggtgaactaacaattccttctgtcgtgtatcctcgattgatgtggcctcagatgcttcaattgtagatttgagtattgagcgaaaggttacacctacaggataggttctgtattacagggcaatccgactctactagtaccaataggcagcataggggagaaaagcactacaccacgaaataggaatcaacaagagaaaaactttgttagaaattagccctttcctgattggtatcagggttgggaagaatggttgggataacaaacaaccatcaggtttgtactttggatacccttataaccatcaaaggtcgttgaagtggctaattcctctaaataggaggcgttgagaacaaagaaattcttggagctatcgttttcctctagcattaatataattcattggtgttaagaaaaacctcttgggggaaggttggctagagatttcttggaaaaataccagcccccttcggtccataatgagatgggactaattcgatttttattctatagatttttcgcttagtacctcggccgcgaccgcgctgccatagaagggagaagccgtatgagatgaaaacctcatgtacggttttggaacggagattttttgaatagaatgaacgaccgtaacggatgttggctcaatccgaaggaaattatgcggaagctttgcagaattattatgaagctacgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattacgtgcgactatctccactatagaaagaagaaaaaaaagaaaggaggaaattttctagtgaatactagaaaagagggctttctacatagggatcgtcaaaacaacgattttaccctatcagctgtaggaaggaaggacacttcacgagaatcaaaataggaagaaagtagagcctatactactattctatggataaagctgaaattgatagagaaaacaccgtaaagatcaattagtgagcgactgggtcgatacaactaaaaaaaactgcttcattataccacgatatgggacaaaatttaggaatccgcttatgtaataaagccgatccactaagggattaagcagcggtgtagtatcagatcccaaagatagtaagttcttttttctttcttatggaaaaaggtctttttccaggattctatagaaatttcatatatgaaagaaacgaaaccgagatagttacctttcagaaaattcgaacgaaggatataggtctatctatgcttcattcttctgaaggtgggagaaaagatcaaactgattattgatcaaaattagggtttgaaacttaggtaattaacttcttctgcttaacccaagaagaaattggattgatttttgagaaatcgaattcagttaagataggggaaattaagatagcaatttctgagccgtatgaggtaggaaactctcaagtacggttctagggaaaggaactgcctattccaaccgaggagaacaggccattctacagggcgattcggaaattgcggaagcttggtttgatcaagctgctgagtattggaaacaagctatagcgcttactccaggaaattatattgaagcacagaactggttaaagattacgaagcgctttgaatttgaataagaccactctccattttcataaaaagggtggtttggttgaaaatcaaatcaagaatttcattatatccctttcttctaccttcaattttatatcatatttcataaggataaacaatagggataggctctggaacagaagtaataaagtacataaaaatcggcaatctaaatattcctacctaatatatcaggacggtcttattaataattccaatgagttatcttggaattttgaatcgaatcaaaaaatctatattatgctcactcaaggaaagtagatgtagataggggcttataccctcagaaaaaaaatacaccagcttcttaaattaaaccgtaaaaaaagatttttttgttatgtcgggaaataattttccagaataaccaatgtccgttaggcacctaatccttatgtcataatagatccgaacacttgcctcggattgacttcaatatataattgctccagtgaataaaaaaaaaaaaaaaaaaaaaaaaaaaaaaagtactctgcgttgttaccactgct

SEQ ID NO: 11447 - DNA, 709 bp, Zea mays
ttttttttttttttttgtagaaagattagttcagtcggtttactattgtttaggaacatatcatcatcacatatgcatgtagtgccccacagtcgaatatataaggcctagggggtaccccatcatttccaagtcaatcaccatcccatctcactagtttctccccattccgtagattcctcttgtaacccaccacataaagatccttaccaggaagtagggtattacgcctctccaagtggcccgaacctgtagaaaatcgcctgtcgtctctcgtgcatcttgtacgaaccattgagttacaatcaaaagcaccattctacccaaaagcactgcgaggggtaaccccgggtgtgcggtcgggctccaaacaccgacagaggacatgagcgattgttactgacgtcgttggactttggttcttctggatgtccgctgcgagcgactgattgagaggaagggatcaggaagtagaaggtgcggccacatgaggaaggggaagggaggcagaggaataaggcgtggactactttatagaaatagagagttttacagcttagcagaaggccgaaaaacatatgttgttattttcctataatgtggtgacatgccttacaatcttacatgatatgcactaggtctacaagtgaaaattgaaacatggcgttttggtttcctccaatagttcagactttccctccccatatat

SEQ ID NO: 11448 - DNA, 1059 bp, Zea mays
ccgggaaaccaaatcagccttagcgtagcaaacactcggctcctccgggcccccggccgctgtacctactacccgccccgcccttccagttccagaagtttctggaagccaacccaagccatggacgccgccagcatagccgccgccgccgccgccgtggccaccccgccccctggcccggccgtgaccgtgcaggtaccgcgcgggcaggtggatctgattgacttcatcgactggactggcgtcgagtgcctaaaccaggactcctcccacagcatcgtcaacgcgctcaagcagagtttgagggacgacgaggggctgtacctcgccagtgattcggacgagcagctgctgatctacatccccttcatgcaagtggtcaaactgcattccgtgctattcaaaggccccgaggaagagggccctaaaacagtaaaactcttttccaacaaagagcatatgggtttcagcaatgtcaatgactatccaccaatggacacccttgagctatcctccgatcatttgatagagaataaacctttgccgctaaagtatgtcaagttccaaaatgttcgcagcctgactgtatttattgaggacaatcaatctggaagtgatgtctcgaaaattcaaaaggttgctctttatggcacaactgtggacacgacaaatatgaaggatctgagaaagacagaagagcactgagaccatttaaaggctgagcttaatccagtgggtgtatgacatactagaaacagttagatgttgaattgagcaatttctagttgaccctggcaaactttttccccaatttttatacacgaggagttaaaagacggtctggtgatgccgaagctattacctcttggcatcttgtaatcctgcaatttatgtcttggggatccgaattcatttcatgaatttaccaaaattagtccatgcgtcgatggtctcgcaaactttgccagcagagcttagttcgttcctggccgctgtgatatgcgtaagattcaatcaagtcgtggctgtacccgtaaaaaaaaaaaaaaaaaagcggcc

SEQ ID NO: 11449 - DNA, 866 bp, Zea mays
gtctggctggccgatgcaggaggcataggactgcggatgcggaagagtagagtcaacccaagccgtcaggagaggagcgggggaatggcgacgcctcgccggctcatccgggagcgcgccgaggcggcggtggctactctcgtggcagtccgcccccacgagatccccccgttgatgagcgcggccaccaccttcttcttcatcctgagcgcctacttcgtggtgctgccgctgcgggacgagggcgccatctccatggggctcgacactctcccgggcctcttcgccggctccctcctcctcaccgtcgtcgctgcccccatcgcctccctcgccttctccctcccctccatccccaagcccaaggctttggtgatgatacacaggtttttcagcatatctcttcttgcattttttgtgctttggtatacctctacaccagggcagtccggacctacctcccagtcaagtgaaggaggttcagataaacctgcaggatggagaaaccagagctggttctacatagttgtgagaataagtttgttcctttgggttgctttgctaaatctcattaccatatcgtcaacttgggcaagggtaattgatgtcatggacagtgagttcagtcaggttcaaggttatttggttttattggagctggtgctacgctagggcaactttttggttcattgttcgctgcaagtatggcatggctgggaccatttctgctcctattttcttcactcttgatggaacttgctgccctgtcatcaaaaggaatttgtattgatggaaatcatgcttcggctgaattacgtcaaacaggggcaggacaagctcctaatacatggctgatgatgaaattc

SEQ ID NO: 11450 - DNA, 810 bp, Zea mays
  misc_feature (24)..(24): n is a, c, g, or t
  misc_feature (630)..(630): n is a, c, g, or t
ttgggtacctcgaggccggccggngaaaccaaatcagccttagcgtagcaaatacgcccctcttccagccttcccctccctgtacctactacccgccccgcccttccagttccagaagtttctggaagccaacccaagccatggacgccgccagcatagccgccgccgccgccgccgtggccaccccgccccctggcccggccgtgaccgtgcaggtaccgcgcgggcaggtggatctgattgacttcatcgactggactggcgtcgagtgcctaaaccaggactcctcccacagcatcgtcaacgcgctcaagcagagtttgagggacgacgaggggctgtacctcgccagtgattcggacgagcagctgctgatctacatccccttcatgcaagtggtcaaactgcattccgtgctattcaaaggccccgaggaagagggccctaaaacagtaaaactcttttccaacaaagagcatatgggtttcagcaatgtcaatgactatccaccaatggacacccttgagctatcctccgatcatttgatagagaataaacctttgccgctaaagtatgtcaagttccaaaatgttcgcagcctgactgtatttattgaggacaatcaatctnggaagtgatgtctcgaaaattcaaaaggttgctctttatggcacaactgtggacacgacaaatatgaaggacctgaagaaagacagaagagcactgagaccatttaaaggctgagcttaatccagtgggtgtatggcatactaggaacagttagatggtgaattgagcaatttctagttg

SEQ ID NO: 11451 - DNA, 1298 bp, Zea mays
ggtacacctcgggccgggcccgcccgccggttttttttcccatcgcaactcacgtgtcggattcgctcgtccacctacccggacgcgcgcacgcaaagcagaacgctcccctcccggccttcccttcctccccgccctccgaagtccgaaggccagaagcttccggaagccagcccaagccatgaacgccgccagcaccgccgccgcggcccccgcgcctgccgcgaccgtgcaggtgccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatccccttcatgcaggtagtcaaactgcattccgcgctattcaaaggtcccgaggaagagggccccaaaacagtaaaactcttctccaacaaagagcatatgggtttcagcaatgtcaatgactatccaccaagtgacaccctcgagctatcatccgatcatttgatagagaataaacttttgccactaaagtatgtcaagtttcaaaatgttcgcagtctgactatatttattgaggacaaccaaagtggaagtgatgtctccaaaattcacaagattgctctttatggaacaactgtggacacgacaaatatgaaggatctgaagaagatagaagagcactgagacgattttaaggctgagcttattccagtccagtgggtgcatggcatactagaagcagtttagatgttgaattgagcaatttctagttgaccctgcaactttccccccctatttttatacatgaggagttaaaagagtgcgagtctggtgatgccgaagctattacctcttggtatcttgtaatcctgcaatttatttatgtggcttgggagtgacagtcagacgatccggatccatttcatgaatgaatcaaaattgctccatgcaaaaaaaaaaaataaaaaaattcgccagcaagccgcctttcgagaccgccgcacgcattgaacaggaacatagtagtgattgtaacgtggacagaatactgcccgggccactattgagatcgagggacagtgacatgtcgttgaatcttgttgtagtggacaaaagaagtataggccttttcactgttacaggaacataattgtgtgatgtttcacaagttatacattgtgtgatgttatcaaacaattatcttaaccattcatgatagttgttggattatggtttt

SEQ ID NO: 11452 - DNA, 1093 bp, Zea mays
ttcctattccctctacccgccccgctcttccagaagtttctaggaagccaacccaagccatggacgccgccagcatagccgccgccgccgccgccgccgccgccgccgccgtggccaccccgccccccggcccggccgtgaccgtgcaggtaccgcgcgggcaggtggatctgatcgacttcatcgactggactggggtcgagtgcctaaaccaggactcctccaacagcatcgtcaacgcgctcaagcagagtttgagggacgacgaggggctgtacctcgccagtgattcggacgagcagctgctgatctacatccccttcatgcaagtggtcaaactgcattccgtgctattcaaaggccccgaggaagagggccctaaaacagtaaaactcttttccaacaaagaacatatgggtttcagcaatgtcaatgactatccaccaatggacacccttgagctatcctccgatcatttgatagagaataaacctttgccgctaaagtatgtcaagttccaaaatgttcgcagcctgactgtatttattgaggacaatcaatctggaagtgatgtctcgaaaattcaaaaggttgctctttatggcacaactgtggacacgacaaatatgaaggatctgaagaagacagaagagcactgagaccatttaaaggctgagcttaatccagtgggtgtatgacatactagaaacagttagatgttgaattgagcaatttctagttgaccctgccaaactttttcccctatttttatacacgaggagttaaaagagcgccagtctggtgatgccgaagctattacctcttggcatcttgtaatcctgcaatttatgtcttggggatccgaattcatttcatgaatttaccaaaattagtccatacgtcgatggtctcgcaaactttgccaaaaaaaataaaaaaacgcaagcaaatatacaagaaccagcaatacaataaacatgcatgcaaagacaacagaaaatcaataaagtgacctaaatttaacaaactgacgcctgtgaaaccacggggggaccgcaaaaaccctgcctttacccaaattcatctttttgca

SEQ ID NO: 11453 - DNA, 594 bp, Zea mays
aagaccagtgagacgcgtggggacttggcaacgacagagagagagggaaagaagggagcagccaccggccagcgggacaacccaaccaacgcgatctctggggcaggcaaaggacgacgggtcggcgagaggcggggccatgaggatccggaagcgcacccctgccagggcagcgtcgccgggaccgccgcctctgcctcctcctcctcccctaccgctgcagcgtcccacggagaaaccacgggatgaggcggcggcggaggaggaggaggagaagcgggcggtcctcgccgccggagtccgagaaggcgacgaccgggttcgccccgccgccgccgccgctggctctgggaacagcagcgcaacggacgacgtgccgaggccggagccgcaggagcaggacgccgccaggtgcagccggaacgacgggaagcggtggcgctgcaagaaggcggccgtgccggggtacctgttctgcgaccgccacatcgcgtggtccacacgcaagcgcaagcccagagccagcaccaagccccaggttcacggcagcggcgtcctggagcccaccgccatcgcccaggagttcgcggagga

SEQ ID NO: 11454 - DNA, 1578 bp, Zea mays
tcgaacttgctagattttgtatcagttgtactatgtcataaccataacataccatgtggttaaatgattcattacattgatctattgtgtgacaggtggagattctcggccaacttcaccatcccaacttggttttactgcttggcttttgtcctgaaattggatgccttgtgtatgaatacatggagaacgggagtttagaagatctacttatcaacgataaagggcagccactccattggtttcttcggttccaaattatctttgatgtggcttgtgggcttgctttcttgcatgggacgaaaccagagcccattgtccatcgtgacctaaagcctgggaacatcttgctggacaagaactacgtaagcaaaattggtgatgttggttttgcaaagcccatatcagatcttgtgccagaagggctcacagagtacagagacactgtcatcgctggcacactgtattacatggatcctgagtaccaattaactgggactgttcgaccaaaatcagatctttatgctttgggtattatcattcttcaactcctaactggcaaacgtccacctgggctggtaaatagtgtagaagaagggattaaaagggggatattatcagacatcctcgacaagtctcaacctgattggccaattgctgaggctgagatgttggcaaaacttgggttgtggtgtactgccttaaaatgcagggacagacctaaccttgagtcagtggtgcttccagagctcgaaaatatcctgagcagggttactgtttctctcaaactcgaaaatatccttgcaccaagccacttcttctgtccgatattgcaggtaaaattggccagatactttacatcaacatttccattttcctgtttgccacttaagcagctaaatggatgaattttgacgcaggaggtaatggaaaatccttacgttgctgcaggtcggctcaccggtgggctcggggcaatcaaagcttggctcgaaaaacacaagatatccccaatgacaaatcagaggcttccacatctatccataattccccgccggtccttgcatgcagcaatacagcaatggaagttacgagcatcttaaggcccgttcgttttaatcttaatccatatggattgaacgggattgagtgggtttaaatccataacgagtcaaaattctttctaatttcttccaatctcatcttatcaacatggaatgagaataaccgaataaggcctaataaaggcatgaggtgactggtttattcgttgtatatagtttgattcattactgtctgtttgagttaagatgtaaataaagagcaatagttctataatgtagcagtgaaagaagatagtattgtaggaataagttgtattactagtctagatttgttagagctggtttaggctacccagacaatttaagttacaacggaattaagttttgcaatgctgtttgattttgtagttatagcctacaaggcattatcttggagggtctgattacaattttcagtgtgatttctctgagatcatgtatcttggcgaagtgttgttttgtatatcattatcag

SEQ ID NO: 11455 - DNA, 2350 bp, Zea mays
ggctggacttgaacagtaaccagcttaaagggtcaataccggcggaactggcaaaacagtctgggaagatgaacgtcggccttgtccttgggcggccatatgtgtatcttcgaaatgacgagctgagcagcgagtgccatggcaaggggagcttgctagagttcaccagcattcggcctgaagagctcagccggatgccaagcaagaagctgtgcaacttcactcgggtgtacatggggagcacagagtataccttcaataagaatggatccatgatatttctggatttgtcatttaatcaactcgactcggagatcccaaaggagcttgggaacatgtactacctcatgatcatgaatcttgggcacaacttactgtctggcgtcatcccaccagaactagctggtgccaagaagcttgcggtacttgacctgtcacacaaccagttacaagggcctattcccaactccttctcaacgttgtccttgtcggagatcaacctttcaaataatcagctgaatggttcaattccagagctgggttcgctgttcacattcccgaggatttcatatgagaataactctggtctttgtggcttcccactgttgccatgtgggcacaatgctggctcaagttcttcaggtgaccatcgatcccaccggacccaggcttcgcccccgggtagtgttgctatgggactcttgttctcgctgttctgtatagttggtattgtcatcatagccattgagtgcaagaagcggaagcagatcaatgaagaggcaagtacctcccgtgacatatacattgatagccggtcacattctgggacaatgaattccaattggagactctctggtactaatgctctcagcgtcaacctcgctgcatttgagaagcgactgcagaagctaacttttaatgatcttattgtggcaacgaatggcttccacaatgatagccaaatcgggtctggtggttttggggatgtctataaggcccagctcaaggatggaaaggttgttgcaatcaagaagcttatacatgtgagtggccaaggtgaccgggagtttacagcagaaatggagaccatcgggaggatcaaacaccgcaatcttgttccgctccttggctactgcaagtgtggcgaggagcggctgttggtttatgattacatgaggtttggcagcttggaagacgtgttgcatgaccgaaaaaagatcgggatcaagctaaattgggcagcaaggaaaaagatcgccattggggctgcaaggggattggcatacctccaccacaactgtataccgcacatcatacaccgagacatgaagtcaagcaatgtgcttatcgatgagcaattagaggcaagggtatccgatttcggtatggcaaggatgatgagcgtggtggatacccacctgagcgtgtccactctcgccggcactccaggctacgtgccgccagagtactaccagagcttcagatgcactaccaagggcgatgtgtatagctatggcgttgtattgctcgagctgctcactgggaaaccgcctacagattcaaccgacttcggcgaggacaacaatctcgtaggatgggtcaaacaacactcaaagtcgaagctggcagatctgtttgaccctgtactactggtggaggatccggccttggagctcgagctactagagcacctgaaaatcgcctgtgcgtgcttggatgaccgaccatccaagcgcccgacgatgcttaaagtcatggcgatgttcaaggagatgcaggccagttcggctgtggactcgaagacctcagcatgcacggtcgccgtggatgatgcgtgttttggcgacgtggagatgacgaccctgaaagaagacaaggaggagaaggactagagcaaggcccaccgacacgcgagaagctgcccttggttcctgcccagggccgagcggcagctacacggtcagtcagatctcagatgcaaaaaaacaaaatcaaaaaaacgcccgtaggaatcagttggtcaggacaccattcgaagcatcttcttgagcttagcattcccttctgacggtacaagacagaagttttttttttcccttgtagcttcgcaaagctgaagatgttatgtacctatgggagtaggtcgattttcttttcttttcttttaatccttaatcatctcttctcgtcacactttagtaagagctgtgtatgtacatatataaatggtggtttttcctcggtgccaaatccattttcgtttcattccctgtttgtcaaatcttaccttgcttttgaccaacgatgttgcaaatcataccatgaatgtagatagaatacatggctgcag

SEQ ID NO: 11456 - DNA, 10484 bp, Zea mays
  misc_feature (1075)..(1075): n is a, c, g, or t
  misc_feature (5369)..(5369): n is a, c, g, or t
  misc_feature (6676)..(6676): n is a, c, g, or t
ctgccggcgtaacgggaacttgtccatctctcacggcctcgccatcatgatgacacacgctcggctcacaccggaaaggttgcacgggctcgtcacgacagggcgctgcgtcgaccgcacgcacgcacgcacgctgccgccggatcggatccactaccagcccactcgcgcgctacgggagttgaagacaaaaaaccctcggcgaagcaacgcggcacacgcgtccgccttcttccacgcccgcggtccgcccgccagggatcccgcctgctcggaccatgagctcccgaattccccaaactgtccatgcccggatgccccccgtgggtggagtggcgcgcggattgacgagccccggaggccgcgcccgacggcacgtgaccccgcctcgagcaggacaccgtctgccccgatcggggctgccaccgccgtcggatccgatcgggattaacctcgccgcgggctgcggataagcgctgtggttagaatactactaatctccatcggccctcgggttaattagggcagcgattcgagatgagggcgagcaggcaagagcagggcacatgccatgtgacgtgaccccaccaccactcccttccctcacctacagcgggtttcttcctcccgcctcctccactctccctctctttcactgttgcttcttccttccttgtgcttctctctctaggtatagcagcccattctccacactcccccacctccctcctgcactcaccatctcctccccacctctccctccctcccgtaccatctcgtcggctcctcccccgtcgccgtcccgcttctttaatggttttataaggtagcgcgctagctcatggaatctccggggctggtgctggtcgctgtagtggcactcttcgtcgtcgtcgtggcggccaccgcctccgacggcgacgatgcccagctgctggagcagttcaaggaggccgtgcctagccaggccccggacctgcgcgggtggagcgccagcgatggcgcctgcaggttcccaggcgccggctgcaggggcggtcgcctcacgtcgctgtcgctcgccgccgtcccgctnaatgccgacttccgggccgtcgcggccaccctgctgcagctgagcagcctcgagacgctcagcctgcgcggcaccaacgtcagcggcgcgctggccgccgcgccgaggtgcggggccaagctgcagtcgctcgacctgtcagggaatgccggcctgcggggcaccgtcgccgacgtcgaggcgctggccgcttcctgcaccggccttagcgctctgaacctctccggcggttcggtcggtgggccgaggtctgccggcgctgtcgcttcttccggatttggccggctagacgctctcgacttgtccgacaacaagatctccggcgatggcgacctccggtggatggtgggcgccggcgtcggcgcggtccgccgtctggacctctccgggaacaagatctctcggctcccagagctcaccaactgctctgggcttgagtacctcgacctctccggcaacctcatcgcgggcgaggtagccggcgggattctcgctgactgccgtggcctgagaacgctcaacctctcaggcaaccacctggtcggcccgttcccgccggacgtcgccgccctcaccgctctcaccgcgctaaacctgtcaaacaacaacttctccagcgagctccccgccgacgcttacaacgaactacggcagctcaaggtgctgtccctctccttcaaccacttcaacggcaccattccggactccttggcagcgctgccggagctcgacgtgctggacctcagctccaacaccttctccggcaccatcccttcgtccatctgccaaggccccaactccagcctccgcatgctgtacctccagaacaactacctctccggcgccatcccggagtcaatctccaactgcaccaagctcgaatctctcgacctcagcctcaacaacatcaacggcacccttcccgcatccctcggaaaactccgggagctccgggacctcattctgtggcagaacttgttggagggcgagattccggcgtccctggaaaatttggtcaggctcgagcatctcatcctcgactacaacgggctcaccggtggcatcccgcgggaactctccaagtgcaaggagctgaactggatatccttggcgagcaaccagctgtctggtccgatcccggcttggcttgggcagctcagcaacttggccatcttgaagctgagcaacaattccttctcggggccaataccggctgagcttggcaactgccagagcttggtctggctggacctgaacagcaaccagcttaacgggtcaataccggcggaactggcaaagcagtctgggaagatgaacatcggtcttgtcattgggcggccgtatgtgtatcttcgcaatgacgagctgagcagcgagtgccatggcaaggggagcttgctagagttcaccagtatccgacctgaagagctcagtcggatgccgagcaaggagctgtgcaacttcactcgggtgtacatggggagcaccgagtataccttcaataagaatggctccatgatatttctggatttgtcatttaatcagcttgactcagagatcccaaaggagcttgggaacatgtactacctcatgatcctgaatcttggccacaacttgctgtctggcgtcatcccaccagaactagctggtgccaagaagcttgctgtactcgacttgtcacacaaccagttggaagggcctattcccaactctttctcgacgttgtccttgtcggagatcaacctttcaaataatcagctgaatggttcaattccagagctcggttcgctgttcacattcccgaagatttcatatgagaataactctggtctttgtggcttcccactgttgccatgcgggcacaatgctggctcaagttcttccgatggccaccgatcccaccggaaccaggcttcactcgcgggtagtgttgctatgggactcttgttctcgctgttctgtatagttggaattgtcatcatagccgttgagtgcaagaagcggaagcagatcaatgaagaggcaagtacctctcgtgacatatacattgatagtcggtcacattctgggactatgaattccaattggagactctctggtactaacgccctcagcgtcaaccttgctgcatttgagaagcgactgcagaaactcacctttaatgatcttattgtggccaccaatggcttccacaatgatagcctagttgggtctggtggttttggtgatgtctataaggcccagctcaaggatggaaaggttgttgcaatcaagaagcttatacatgtgagtggccagggtgaccgggagtttactgcagaaatggagaccattggtaggatcaaacaccgcaatcttgttccgctccttggctactgcaagtgtggtgaggagcggctgctggtttatgattacatgaggtttggcagcttggaagatgtgttgcatgaccggaaaaagaccgggattaagctaaattgggcagcaaggaaaaagatcgccattggggctgcaaggggattggcatacctccaccacaactgtattccacacatcatccaccgagacatgaagtcaagcaatgtgcttatcgatgagccattagaggcaagggtatctgattttggaatggcaagaatgatgagcgtggtggacacccacctgagtgtgtccactctcgccggcactccaggttacgtgccaccggagtattaccagagcttcagatgcactaccaagggcgatgtgtatagctacggtgttgtattgctcgagctgctcactgggaaaccgcctacagattcaactgacttcggtgacgacaacaatcttgtaggatgggtgaaacaacactcgaagtcgaggctcacggatctgtttgatcctgaactcgtgaaggaggatccagccctcgagctcgagctactggagcacctaaaaatcgcttgtgcatgcttggacgacagaccgtcgaagcgtccgacaatgctgaaggtcatggcaatgttcaaggagatgcaggccagttcgacggtggactcaaagacttcggcgtgcacagacgatgcatgttttgccgatgtggagatgacgaccctgaaagaagacaaggaggagaaggactaacaaggccaccgacacgcgagaaactgctcctggtgcacctgcccagggggtgagtggcagcagctacacggcgagtcagaggcaaaatgcccgtaggaggaatcagttggtgaggataccatttgaagtctcttgttgagcttagcattcccttcttgatggtagaagacagaagttttccctcatagcttcgccagttgaatatgctgtgtacctatgggagtaggttgattttcttttcttctttctttttaagctttcttcatctcttcttgtcacacgtcagtaagatctgtgtatgtacatatataaatggtgatttttttcttcggtgccaaatccacttcgttctatttcttattgtcaattttttaccttacttttgtccaacgatgttgcaaactgtacccatcaatgtacatagacacagcgagcatgatggagttggcgtccagatctgagaagcaaggcaagcagtgaagcaccatccgaaagggcgaacgaaggtgcgcaagcacgatgaaattggcgtccagatctgagaaagcaagcagtgaagcaccatccgagaggatggaggtgcgagagtacactgcagtggccaagcaagatgaacaggaaaaggccaccaaggaaggggccagtcaagcaagaggctgacacagctcctgtttccatgtgagaacccagcatggctttgcaagtgtaggaccaggcgcagttacacacacccactagaggacgtgctcacgctgcacaggccacaggcacttccttttattttcaatttttttccctgggggcgttgctttgtcctcaatcatcaatcaatattcaaggggagctctgctcagctgagcggagcctttagctggtcaaaggttcctctaagcagtttttgtcctctctacctatcctaatcacttgggtaacatgcccccccccccctaatcttattataatcctcctctcgatattgtagttgcatggtgctgtgcccgatgcgtggcgttagctaaactactcatctctgtccagcaagcgagtggcacactggcgtgcgcgcagattccctcatatttcaagcgagcagcattttcaaatccgtgccgcccttggcttcaagatttctgagcttgcgatgggctccctgctgctctggttcgcnatgttctctcgctgtctacttggatcattagtgaacagcatgtcagtagctgtcagacatggtgaaaggccattaagttactaaacccttttttttgtactgacggagaagtatattgtgcagagtaagcaagaagtttatttttacccttcctgagctccagaggttccatgtagtttgtccatgacttcatgcagagcaacactgaagaagacacacaatgacacaacacacggtctgaaaaggctacatgggccttcggtgtcattgacaaactgcgcctctgaatgaatggagtctctgacatcgccacaggggtgtgggcccccccttcctgcctgcatagcttcggtctttcggagcactggcttctcccaagtgccatcatcattttcccctcatcggaatagtggcaggcagcactaccacgatacccaccgtgtggtttgatggcttcccactttcacagccatacaatggtgctggtagtacttgataactataggaatttgtaactctacgccttttctttttttattttttaaagaaaaatgtaggtcaatatctttggtagcataaaatctattgaagaaataatagaatctggtggtccaataatttccctctcttgtgcttcttcaataaataagttgattaatttgtagagacacgccaaccaagatactacataactagcgaattatagattgttaacactatatgtgaaacatagcggattatgattggtagtatgcggattagattgttaacactctatagacaagagaaataatcaatctactacgggttatgattttatatgaggggatcctcaatgttgcgtggtctatatttggcttctcgatctccgacgtcggtgatagagagagcagtgccttaaaaacatcgctccgctgaagaaactgcacatgttcaacgagtagtgatcacacgattgttcaccaagttgacctacaatgagacatctacacacttcaataataccacaaactcatgttcaacgatcctcaccttgagtaatggttaatttcttgctcatgtttcaggttcaagatagatttgatttggtaaatagatatatttttgtttcttataatttatctattacttgtatagtaattgttttagaaattaatttgacttataaaatgcacagacttcacacaaaatctactgaaatgctaaattgaagcctccaccgttgtcgatgctagtagggatgacaaaattctttgtgagggtggggcccacagggatccgacctattcaaggcgggtacgtggacngacccacgaaaatcaatggtgcggtaacgaagaagaaactatcttgctgggctccattgaggaaccgataagaaattctagtgtgtattatgtgatgtatgagattgtgagactattagtaagttgaaataattatgggttgtgagtcatgatttgtaagataaggttgttatttttatgagatttatttttgtcttgttgtttcttttaataattaataaatatattattgttatcatgcaatgagtatttattttgtttatattatagtattctccaccaaatctaaataagaaacatggatccacggagacagtctccattagggctgatctagttgatagggaattgtagggatctatggggaggaatcctcttgctattcaaatttgaataggaaggaaattcctctcccacctatccctctcaattcactatccaccaaatcaaccaaactaaagagggagagtaaagaatgaggttccaatttgtcttgttgtttcttttaataattaatataattataacattcgttatgcttgtttacattgtactattctccgccgcatccaaatgagaaatagggatccacatggacaatcttcgttaagctaaacgagggagagtaaagaacgagtatagggatgtcaatcaggcgagtagtgtatggatgtcaatcaagcgagtagtgtatggatccacatggacgtcgtcgaccctgctgcttccggcacgcgtcatctacgagtatgtctaatcaatacgcatcatctgatttgattttatacttcagttcttctgatttggtcatgatttatattcagaatgtaatctggaaaatgtctaatatttcaacacttgatatacaaatgtcttgatctttttccacacgatacatgtcgaactcaagacgaaatatgtgccttctttataatagctcaacactcgactcgatcttgcagtggattacattatagtattctccgcgggatccaaatgagaaatagggatccacgggaaccgtctccgttaagcttaacgagggagagtaaagaacgagtatattagactagtagtatacggatatatactcgtgagacaaaacttaacccatatctgtatccataaaagttcgtgggtatggatctgtatccatatccgtactcaccaggtatccggtggatatccgttacccgccagtccaatacaattgtagcattcaacactaaacaacaattttatcatattttaaaataattatcattccagcagtcttaaatgataatttcaacacaaaaaacaatatgtaatggataaaaattgaaaaataagattatgataatatattaaatccggatgacctatatgtcagatatctattaaataacgggtacctacaaaaaaattaatctatagatatcttattatatccataatcgtaccacggatatcaaattacagcgtacctatatttaacagagagcacttgttagcgggtcaagcgagccgggttgttcgtgccggctacttgtatgcggcatttcaattacgacatccatgaatgcagctctctgcccatgaatgcgaggaagagggtaccggcaataaagctgcgtgacccctgtagccgctctgcctgcactcactgcacccatgacccatcggccacatcgcctgcgaaaagctcgtcgtcctggcgcttggtgcttgttggatcgatcagtgcaggagtgctcgcacaaaccgactgcagagtggagggtcgtcctcgtctccctctctttctcgccattccatcaacagaaaaaagagagagagagagagagagagaggacacgtgtcgtccgttccgtcgtcttgaccctagagattagagaaggcgacgaccaagagatctgcagtactactagtacgtacaacgccgcacgttgcacttggccacttcccgttttgtctcgactccttttttttcttcttcttcttttcctccgatgggtttgccaacggatttttacaaataaatcattgcagattcgatctcccgaaaagcacaagcattcctcaatcatagacagcatggcgtagcgctgctgcatgcccagcctagctataggcgccgcgcgatgcagtttcttgtttgccaatgccatcagtagtggctgcttgaccgagaacgccccaccacggcacagtactgatggactgtttttgcgacgctcctactgctactagtatcgtactccgctctcctagcgtgtaccggctgcgtgcgtatgcgttgcagcgctcgctacgactacgagcctaggacggacgggacacgcgaggagcagagctagcgcacgtctgctacggccagtcaggtgcactgtgtccctgtgcgcgtaccgcggcatgaagacatgcacacactgcgtcacccccatctctcgacgacgtgcaggtgcagctagccggccacacggccgataggcgcgcatgtccgggcgcggcggacgcgcgcgcgggccgattgatcagcacaaggggccccgcgacggcaacggcatcggcatcggccgtggggcgtacgtgcgcgtgcacacgcgatcgaatgaacagcaccgtgcccgcgagcccggcggccgccacagtcgccgtccagccgacgagccctcgaacgctttgtttgcccctcctccgatccggcggcccgacttttccacggacaaccgggcggtggctgcctgtgtagcgccttgccggctgcacctgcacgaaccccatatcgagtcgctttcgtgtttcgtcggtcttctcagtaggacgcacacggaggggccggacgacagcgtccgtgaatggcacacaggccggtgatcgagtcactcgtacacgtactacgtaccagcaacgaacgtgtgcgccaacgatgcggccagtcctgtcgccgttgccgcccctgcaattatcctgggctgtgcatggctcgccgccggccgccacgccatcatcatgcggtcaaaggaacacacacccacatccctgagctgtgattattgcaattactagtgcttagttaaatttgagttgaccctgcagggatagggatgattgaaaccagcagagccagcgtaatgcatgtgcaataggctcacacatgcatgacaagaagcagctaggtggcacaggaggatttcagctcaaatgataaggcctgtaccaaccaaatgatcacttggaaaccgcctgccttgcaaccgatccgttctctttctttctttctttctggttcaattctgcagccgatttagataacggatcagcttttggacgcggagaagattactttttttaaaacaaaaaaagaacaaatgtctttactgactaagcaagcgtacagcataataatgtctgaacccggttgagttatgcaggaaaacaaacaagaggtgctttgttctttgacgactgcgattccgcgaagaagagaaacagctgatcaaacatgacctagctggctaggcgaagcgggaagaaggggatggcctagctcaggttcttctgcttctcgtgtccttccctccggtctgcttgctctcccgctatggatttctccctgctggactttgggccaggattggccttcgcgaaatccctctgggatgccttggaagcttcggtttgccctgctcgcccgtgtttgcggtcgcccttttggctggtggtttccttcggtagatgcatcttcaagttgaattcggtttcggttggtcatcttctccaggctgcccttggtgggctcgctgaggatttcgaagtgtttcag

SEQ ID NO: 11457 - DNA, 2086 bp, Zea mays
acgggtccctcgaggccggccgggccgggaaaacccttgcggcggctaccttttccccaggtccctctcgtctcgcggccgccgcaggcgaaaccccctcatcgcttcgcgctgtccaccgacgaatcttccccagctgagttaatcggggactggtcgtgtgcggagatgttggtgctcttcgagacccccgcggggttcgccctattcaaggtgctcgacgaggggaagctcgacaaggtcgaggatctatggaaggagttcacgacgtcggactcagcgagaaaggtggtcgagctgaaggctttcaacaagtttgagaacacatctgatgccctatccgcggcaaccctgattattgatagcaagcctagcaagggtctgcgcaagttcttgcagaaacattgtgagggtgaaacattagcagtagctgattctaagcttggaaatgctataaaagaaaagctgaaaattgactgccttcacaatagtgctgtgatggagctgatgagaggactgagaaatcagcttaccgagcttataactgggttgggtgcacaagaccttggtccaatgagcttgggattgtcccacagcttgtctaggtataagctgaagttcagccctgagaaggttgatacaatgatcattcaagccattggattattggatgatcttgacaaggagcttaacacttatgccatgagagttcgtgaatggtatggctggcactttccagagctcaccaaaatagttacagataatatacagtatgccaaagttgtgaagatgatgggcaacagagttaatgcagtcaaccttgacttctctgagatattgtcagatgaagagctagaaacacagctaaaggaggcagcagtaatatccatgggaacagaagttagtgaccttgacttatcgaatatcagagagctatgtgatcaagtgctggccctttctgagtacagagcccagctgtatgactatttaagaagcaggatgaacactattgcaccaaatttgacagcactggtgggtgaattagttggtgctcgccttattgcacatggtggaagtttgttaaatttggccaagcagcctggtagcacaattcagatacttggtgcagagaaggctttattcagagctctaaagacaaagcattctacacctaagtatggcctcatctaccatgcatccttaattggcaaggcttctcaaaagcacaagggaaaaatctctcgttctcttgctgcaaaaacagctcttgctatccggtatgatgcccttggtgatggtgaggacaactccattggcactgagagtcgacttaagcttgagacacggcttcaagttcttgagggtagagaacttgggaaatctgctggttccacaaaggggaagcccaagatagaagtgtatgaaaaggaccggaagaagggtactggggctttaacaactcctgctaagacatataaccctgcagctgatctggtactcacggaagaaacaccaaagaagtcagaattggcttcaaagaagaggaaacataatgaggtggaaactgaaccattagcagagcctgcagaggaagcaatccaggaggatggtgaccaggaggatcggaagaagaagaagaaaaagaacaaggaaagcaaggaggctcctgctggtgaaggtgatggtgagaagaaaaagaaaaagaagtctaaggaggtcgaggaagagcctgttgtggctgctgcttcagaagttaagaagaagaaaaagaagtctgacgctgatggtgaggatgtcgcaatgcaaaccgaagaatcaggtaagaaagagaagaaaaagaagaaaaaggcgtgctgatgatgagtgagacattcacactggaagagaatttgcgggtaccaaactaccaaaggctgggactcagctgttctgtaaaatggatttgcgggtagaaacgatatcgacatcagtttttttggacccggcttgtattcaagtacttgctcgatcctggtgatgatggaatttaagttttgctgttgcaacctgaaaaaaaaaaaaaaaaaaaaacccccccccccccccc

SEQ ID NO: 11458 - DNA, 810 bp, Zea mays
aaaaacccttgcggcggctaccttttccccagctccctctcgtctcgcggccgccgcaggcgaaaccccctcatcgcttcgcgctgtccaccgacgaatcttccccagagcgtgtgtatctgttgtttcagctgagttaatcggggactggtcgtgtgcggagatgttggtgctcttcgagacccccgcggggttcgccctattcaaggtgctcgacgaggggaagctcgacaaggtcgaggatctatggaaggagttcacgacgtcggactcagcgagaaaggtggtcgagctgaaggctttcaacaagtttgagaacacatctgatgccctatccgcggcaaccctgattattgatagcaagcctagcaagggtctgcgcaagttcttgcagaaacattgtgagggtgaaacattagcagtagctgattctaagcttggaaatgctataaaagaaaagctggtcagtagtatttccttgtttttttttactttttgtgaatggccagcactcgtgacattttaattgtgctgccgaaaattgactgccttcacaatagtgttgtgatggagctgatgagaggactgagaaatcagcttaccgagcttataactgggttgggtgcacaagaccttggtccaatgagcttgggattgtcccacagcttgtctaggtataagctgaagttcagccctgagaaggtgagtcttgtatcggtgccactgtcaatcttattattcatgttgttatatgctctatttctggcttttattgtgtcatcatttgtgcttggcattatgcaccggggg

SEQ ID NO: 11459 - DNA, 1975 bp, Zea mays
cggccggggcgggggcactagcagagctaaaacccttgcggcggctacctttccctcaccccctttctcgcctcgcggcggctacctttccccccttctcgcctctcgcctcgcggccgccgcaggcgaccccttgtcgcctcgtgctgtccaccgccgaatcttccccaggttagggagggtatctgttgtttcagctcagttttaccgggggactggttgtgggcggagatgttggtgctctttgagacccccgcgggcttcgccctattcaaggtgctcgacgagggtaagctcgacaaggtcgaggatctatggaaggagttcacgacgtcggactcagcaagaaaggtggttgagctgaaggctttcaataagtttgagaacacatctgatgctctatctgcggcaacccttattattgatagcaagcctagcaagggtctgcgcaagttcttacagaaacattgtgagggtgaaacattagcggttgctgattctaagctaggaaatgctataaaagaaaagctgaaaattgactgccttcacaatagtgctgtgatggagctgatgagagggctgagaaatcagctcactgagcttataactgggttgggtgctcaagaccttggcccaatgagcttgggattgtcccacagcctgtctaggtataagctgaagttcagtcccgagaaggttgataccatgatcattcaagccattggattattggatgatcttgacaaggagcttaacacttatgccatgagagttcgtgaatggtatggctggcactttccagagctcaccaaaatagttacagataatatacagtatgccaaagttgtgaagatgatgggaaacagaaccaatgcagtcaatcttgacttctctgagatattatcagatgaagagctagaaacacagctaaaggaggcagcagtgatatctatgggaacagaagttagtgacctcgacttgtcaaatataagagagctatgcgatcaagtgctggcactttctgagtacagagcccagctgtatgactatttaaaaagcaggatgaacactattgcaccaaatctgacagccctagtgggtgaattagttggtgctcgccttattgcacatggtggaagtttgctaaatttagccaagcagcctggtagcacaattcagatacttggtgcagagaaggctttattcagagctctaaagacaaagcattctactcctaagtatggcctcatctaccatgcatccttaattggtaaggcttctcaaaagcacaagggaaaaatctctcgttctcttgctgcaaaaactgctcttgccatccgatatgatgcgcttggcgatggtgaggacaactccattggtactgagagccgacttaagcttgagacacggcttcaagttcttgagggtagagaacttgggaaatctgctggttccacaaaggggaagcccaagatagaagtgtatgaaaaggaccggaagcagggtgctggggctttaacaactcctgctaagacatacaaccctgcagctgatctggtacttactgaagaaacaccaaagaagtcagaattggcttcaaagaagaggaaacatcatgaggttcaaactgaaccatcggcagagcttgcagagggagcagtccaggaggataggaagaagaagaaaaagaacaaggaaagcgaggaggctcctgctgctgaaggtgatggtgagaagaaaaagaaaaagaagtccaaggatgtcggggaagagcctgctgtggctgctgctgctgccacagaaggtgagaaaaagaagaagaaaaagaagtctgacgcggacggtgagggtgttacaacgcaaaccgaagagtctggcaggaaagataagaagaaaaagaagaaaaggcatgccgatgatgagtgagacattcttcggaagagaatgtgcgggtacctcggccgcgaccacgcta

SEQ ID NO: 11460 - DNA, 1962 bp, Zea mays
ggtaatataaagtttggctttattcacaataacattgatggcaagagctaccattgtaatataaagtttggctttattcacaataacactgatggcaagagctaccattgtaatacaaatgctctagacatggtaactattgggaatagaaagtaccaccaattaagtgcaaagatacacaataacacaagctaaacgactagggagctaccatcacttagctgcacaaactagcacaagggagcacaatatatgaatgactaaatacaagcttgtgttatatattaccgtatacataaaccaataggaaggtgataacaagttgacacgatgattttgaccctaagatttgatggtttgtaattatattaaaggtaaggtcgtggatcctctttctaatggtgaacgcaagctatactatccacacaaaaagtgctccacgtaatgttttttttttcatcagtgagaaaggggagaaagtttgtaattggttgcttctctaccctaggcgtctctatcatggatgagggaggtgccgtggatggatgggccgatttgggccgccggttaggacagcacgagtggcccattcctagtccctcatcctctcgccgcccgccgcccccatttaccacctggtggtcagtcagtcacccaccccacaccgccgccgggaacttgttcatcgagccgagaggatagatagatagatagatagatagatagggtaaccgatcgaatccgccaaccaaacaatggcgtccgacggcagtggcgtggtgacggtgtacggcaacaacggcgcggcgctgctggagccgccgaagcagcccaagtcgtcgactttctccgtgaaggtgggcctggcgcagatgctccgcggcggtgtgatcatggacgtggtgaccccggagcaggcccgcctcgccgaggaggccggcgcctgcgccgtgatggcgctggagcgtgtccccgccgacatccgcgcgcagggtggcgtggcgcgcatgtcggacccgggcctgatccgcgacatcaagcgcgccgtgaccatccccgtcatggccaaggcccgcatcgggcacttcgtggaggcgcagatcctggaggccgtgggcgtggactacgtggacgagagcgaggtgctgaccccggccgacgacgcccaccacatcaacaagcacaacttccgcgtgcccttcgtgtgcggctgccgcgacctcggcgaggcgctgcgcagggtccgcgagggcgccgccatgatccgcaccaagggggaggccggcacgggcaacgtcgtggaggcggtgcgccacgtgcgctccgtcgcgggcgccgtccgcgcgctccgcggcatggacgacgacgaggtgttcgcctacgccaagcgcatcgccgcgccctacgacctggtcatgcagaccaagcagctggggcggctccccgtcgtgcagttcgcggcggggggcgtggccacgcccgccgacgccgcgctcatgatgcagctcggctgcgacggcgtcttcgtcggctccggcatcttcaagagcggcgaccccgcgcgccgcgcccgcgccatcgtccaggcggtcacccactacagcgaccccaccatcctgaccgacgtcagcgcggggctcggggaggccatggtcggcatcaacctcaacgacccaaaggtggagcgatacgccgccagatccgagtgaacacttccctttcctactccacttatatttatcagtatcatctccgctccgccggctctgccaacaaatttttttgcactgcatgcagtagcttaagtaataatggaatgagtgaatgaaatggtgagaaacgaagctagaagctctgtaattttgtgccgttcttataaagtttgcataggctcccctggattatgaatcagtcactcagcctgcttatgacttatgaatcacatgctcttcatctggtcgg

SEQ ID NO: 11461 - DNA, 1727 bp, Zea mays
  misc_feature (1702)..(1702): n is a, c, g, or t
acccgcggcccggcaagcttggtccgttttgacatgtatatctaacgggaagaagagatgagaaatgcaggagacgttttggtgatgaaaaatgtgtggcatgacttgtcgatgcatgtcgccatcaccaacttgctctctctcccttcagaatcctgctttcatttccatgggtgtttagtttcatatctgcagtgaatcttgcaaagtagtggcacgtgttttagtttttagtgcggaaggaaaaaggtaaaaaaaaaagaagaggaagcaaaggtgaggttggattggtgaactgggcagggcatggcaggagggaggggcaccagccaagccaaccatagcaacttctctaccctaggcgtctctgtcagcccactccgatttgggccgccaccactagtgatggcccatcaccgccgccgcctcctccactctccctccatccatttaccaccccgcccctcgccgcgcccccgcttctctcccctgagcctgactggaaccttcccgagagaggatacaaaggcacccggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcacttcgtggaggcccagatcctggaggccgtgggcgtcgactacgtggacgagagcgaggtgctgacccccgccgacgacgcgcaccacatcaacaagcacaacttccgcgtccccttcgtctgcggctgccgcgacctcggcgaggcgctccgcagggtgcgcgagggcgccgccatgatccgcaccaagggggaggccggcacgggcaacgtcgtcgaggccgtgcgccacgtgcgctccgtcatgggcgacgtccgcgcgctccgcagcatggacgacgacgaggtcttcgcctacgccaagcgcatcgccgcgccctacgacctcgtcatgcagaccaagcagctgtcgccacgcccgccgacgccgcgctcatgatgcagctcggatgcgacggcgtcttcgtcggctcgggcatcttcaagagcggcgaccccgcgcgccgcgcccgcgccatcgtccaggcagtcacccactacagcgaccccaccatcctggccgacgtcagcacggggctcggggaggccatggtcggcatcaacctcaacgaccccaaggtggaacgatacgccgccagatccgagtgaaccctttctttccgtagtcatctccatccatctgccttggattgcatttccgtcgtctcatgtctctcaatcagtaataatggaatgaatgaaatggtaagaaacaaagctatggtactatgcagaacctctttcattttgtgctactgtactaagttagcctagtcccccccaccctggattatcatgtntggatggattgtatgtctgtcactg

SEQ ID NO: 11462 - DNA, 1492 bp, Zea mays
gcacgagctcctccactctccctccatccatttaccaccccaccccgccgccgccctcctcttctctcccctgagcctgactggaaccttcccgagagaggatacaaaggcacccggatcggcggcacgaacgcccgggattccattccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcacttcgtggaggcccagatcctggaggcctgggcgtcgactacgtggacgagagcgaggtgctgacccccgccgacgacgcgcaccacatcaacaagcacaacttccgcgtccccttcgtctgcggctgccgcgacctcggcgaggcgctccgcagggtgcgcgagggcgccgccatgatccgcaccaagggggaggccggcacgggcaacgtcgtcgaggccgtgcgccacgtgcgctccgtcatgggcgacgtccgcgcgctccgcagcatggacgacgacgaggtcttcgcctacgccaagcgcatcgccgcgccctacgacctcgtcatgcagaccaagcagctgggccgcctccccgtcgtgcagttcgccgcggggggtgtcgccacgcccgccgacgccgcgctcatgatgcagctcggatgcgacggcgtcttcgtcggctcgggcatcttcaagagcggcgaccccgcgcgccgcgcccgcgccatcgtccaggcagtcacccactacagcgaccccaccatcctggccgacgtcagcacggggctcggggaggccatggtcggcatcaacctcaacgacccaaaggtggaacgatacgccgccagatccgagtgaaccctttctttccgtagtcatctccatccatccatctgccttggattgcatttccgtcgtttcatgtctctcaatcagtaataatggaatgaatgaaatggtaagaaacaaagctatggtactatgcagaacctctttaattttgtgctactgtactaagttagcctagtccccacccccaccctggattatcatgtacccaaatgttggatggattgtatgtctgtcactgagccagaccttcttattgctatgaacgatgaatcaatcctctttctcgaggctaagacggctaaaaaacttgatccggttgccatatcggaaaggttaagtgaatcacatcatcagg

SEQ ID NO: 11463 - DNA, 1742 bp, Zea mays
tgcatgcctgcagtgaatcttgcaaagtagtggcacgtgttttagtttttagtgcggaaggaaaaaaggtaaaataaaaaagaagaggaagcaaaggtggggttggattggtgaactgggcagggcatggcaggacaggagggagggcacggggcaccagccaagccaaccatagcaacttctctaccctaggcgtctctgtcagcccactccgatttgggccgccaccactagtgatgggacccatcgaccgccgccgccgcctccactctccctccatccatttaccaccccaccccgccgccgccctcctcttctctcccctgagcctgactggaaccttcccgagagaggatacaaaggcacccggatcgaggaaaccaatccattccattccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcggctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcacttcgtggaggcccagatcctggaggccctgggcgtcgactacgtggacgagagcgaggtgctgacccccgccgacgacgcgcaccacatcaacaagcacaacttccgcgtccccttcgtctgcggctgccgcgacctcggcgaggcgctccgcagggtgcgcgagggcgccgccatgatccgcaccaagggggaggccggcacgggcaacgtcgtcgaggccgtgcgccacgtgcgctccgtcatgggcgacgtccgcgcgctccgcagcatggacgacgacgaggtcttcgcctacgccaagcgcatcgccgcgccctacgacctcgtcatgcagaccaagcagcggggccgccgatccccgtcgtgcagttcgccgcggggggtgtcgccacgcccgccgacgccgcgctcatgatgcagctcggatgcgacggcgtcttcgtcggctcgggcatcttcaagagcggcgaccccgcgcgccgcgcccgcgccatcgtccaggcagtcacccactacagcgaccccaccatcctggccgacgtcagcacggggctcggggaggccatggtcggcatcaacctcaacgaccccaaggtggaacgatacgccgccagatccgagtgaaccctttctttccgtagtcatctccatccatccatccatctgccttggattgcatttccgtcgtctcatgtctctcaatcagtaataatggaatgaatgaaatggtaagaaacaaagctatgctacctatgcagaacctctttaattttgtgctactgtactaagttagcctagtccccacccccaccctggattatcatgtacccaaatgttggatggattgtatgtctgtcactgagccagaccttcttattgctatgaacgatgaatcaatcctctttctcgaggctaagacggctaatcgccttgattcaaaaaaaaaaaaaaaaaaaactcgagggggggccc

SEQ ID NO: 11464 - DNA, 1740 bp, Zea mays
acacgacgccgcgccccgcggaatccatcttctccatctccaactgtgctactgtaggagctgctgcaatcggggagagaaacgcgaccagtttgccggcaccaacacggcctgctgccacatctccggcatcttcttccgggttggggactgaaaactgtcgctgttagttggggttggggactctttcagtggtaagtccacatgcaggctgcagcaagcaactggacgatggtggcttccaggcagtcagagaacaatgcacaagaagaagcatcaccattgacgactcctaacgccaacatagccaggatcatcccttcgctgcccctcgagaccaggtggccaccgttccctctccgacggtacgccaatttttggctgcctgaggtaacattgaaggaaggcgtccccggcgttcattcctgcttcgagccgagacccaccgacgtgttcctcgcaagcttccccaagtctggcaccacctggctcaaggccctcgccttcgcgacgctgaagcgttccacgcatccgccgttcgacgacgaccatccgctgcgccattgcaaccctcatgactgtgtcaggttcctcgaacttgatttcaaccagcagaaggatgagctcgaggcgctcccgtccccgcgtgtgctggccacgcacctcccctactccctgctgcccggcagcatcaccggcgacggagagcgctcggggtgccggatcgtgtacgtttgccgggaacccaaggacgtgctggtctcctcctggctgttcacgagaaaggcagcgccggcttgtggggttgacgcccggtcgttcacgatccaggaggccttggagctgttctgtgatggccgctgtctcggcggcccacagtggaaccacgtcctccactactggaaggagagcgtgaggaggcctgacatggtgttgttccttcgttacgaggaggtgctgattgagcccgaggcgcacgtcagaaagctggccaatttcatgggctgtggattctccgaggaggaggaggagcgcggggtggtgagcgccatcgtggagctgtgtagcttggggaagctgaaagacatggaggtgaatagaaatgggagcactatgttggggatcaagaacgaaagcttcttcaggaagggtgttgttggggactggagcaagcatatgacgcaggagatggcgcagaggctagacaaggtcgtagaggatgcattgcaagggactggattcacctttgcgagcacagcatgatgaggcagtgcgctcatagtagttgcgaactgcagaataatgccaagatcaactcgttttatcggtgttgctggttggagatcatgccagtcatggtgagcattcttctttggtgatgaagggggaaatatggacatcatcttatcatttaacgaaaattgatttgtgtacaattcatttgtataactttgttacaaaccatatgttgtggcaccttggcacgccaaaaccatatgcattactgtgcaagatttgtcataaagccatgtatcatcattgatatattatcgattaatgtttggagaagctacaattgattgcaagcagacctgggcagatgccgccgactatatacagtagcttacccatctacatactcatattcaaacttcactctatcaagagtgcagtctacagtgcggagctgtgcaatacattgttttgggtaaactatgagtagactgctgcaggccatgc

SEQ ID NO: 11465 - DNA, 1589 bp, Zea mays
gaactcccagatccacgcggtcttattacctgacctgcctgtctcgccgatcgcgagtacacgacgccgcgcccgcggaatccatcttctccatctccaactgtgctactgtaggagctgctgcaatcggggagagaaacgcgaccagtttgccggcaccaacacggcctgctgccacatctccggcatcttcttccggctgcagcatgcatgcctgcagcaagcaactggacgatgatggcttccaggcagtcagagaacaatgcacaagaagaaacatcaccattgacgactcctaacgccaacatagccaggatcatcccttcgctgcccctcgagaccaggtggccaccgttccctctccgacggtacgccaatttttggctgcctgaggtaacattgaaggaaggcgtccccggcgttcattcctgcttcgagccgagacccaccgacgtgttcctcgcaagcttccccaagtctggcaccacctggctcaaggccctcgccttcgcgacgctgaagcgttccacgcatccgccgttcgacgacgaccatccgctgcgccattgcaaccctcatgactgtgtcaggttcctcgaacttggtttcaaccagcagaaggatgagctcgaggcgctcccgtccccgcgtgtgctggccacgcacctcccctactccctgctgcccggcagcatcaccggggacggagagcactcggggtgccgcatcgtgtacgtctgccgggaacccaaggacacgctggtctcctactggctgttcacgaggaaggcagcgcccgcttgtggggttgacgcccggtcgttcacgatccaggaggccttggagctgttctgtgatggccgctgtcccggcggcccacagtggaaccacgtcctccagtactggaaggagagcgtgaggaggcctgacagggtgttgttccttcgttacgaggaggtgctgattgagcccgaggcgcacgtcagaaagctggccaatttcatgggctgtggattctccgaggaggaggaggagcgcggggtggtgagcaccatcgtggagctgtgtagcctgggcaagctgagggacatggaggtcaacagaaatggaagcactaggcttgggaccaagaacgaaagcttcttcaggaagggagttgctggggactggagcaaccatatgacgccggagatggcgcatagcctagacaaggtcgttgaggatgcattgcaagagactggattcaccttttcgagcacaacatgatgagccactgcgctcatatagtagttgtgaactgcagaatgtcaagatcaattcgttttatcggtattgctggttggagatcataccagccatggtgagcattcttctttggtgatgaaggggaaattgatttgtgactattcatttgtataacatttttacaaaccatagtctttggcaccttggcatgccaaaatcatacgcattactatgtaaaggttcgttttaaagccatgtattatcactgattatatttgccttaataaaatcatcataaaccatcgatcaaaaaaaaaaaaaaaagggggggggcgacagcaacg

SEQ ID NO: 11466 - DNA, 1526 bp, Zea mays
ctcgaggccggccgggaaacctcagctgaggccatcttctccatctccaattgtgctactgtaggagctgctgcattcggggagagacacgcgaccagtttgccggcaccaacacggcctgctgctccgcattttgatgactatttctgtctgaaaactgtctctgtcagttgttcattcaggctgctgcagcaagcaactggatgatggcttccaggcagtcagggaacaatgcacaagaagcagcatcaccattggcgagtcctcctcactccaacatagccagcatcatcccttcgctgcccctcgagaccaggtgcccaccgttccctctccgccggtacgccaacttttgggtgcctgaggtaatattgaaggcagacctccccggcattcattcctgcttcaagccgagacccaccgacgtgttcgtcgcaagcttccccaagtctggcaccacttggctcaaggcccttgccttcgcgacgctgaagcgttccacgcatccgccattggatggcgaccatccgctgcgtcgttgcaaccctcatgactgtgtcaggttcctcgatgctaatttcaaccagcagaaggatgagttggaggctctcccgtccccgcgcgtgctagccacgcacctcccctactccctgctgcccggcagcatcaccggggatagggagcgctcggggtgccggatcgtgtatgtctgccgggaacccaaggacgcgctggtctctgcctggctgttcacgaggaaggcggcgtcggcgctgggggctgacgctcgatcgttcacgatccaggaagccttggagcttttctgtgatggtcgctgtatgtgcggcccgcagtgggagcacgtcctccagtactgggaggagagcgtgaggaggcctgacagggtgttgttccttcggtacgaggagatgctgattgatcccgaggcacacgtcaggaagctcgccaagttcatggggtgtggattttctgaggaggaggaggagcacggggtggtgagcgccatcgtggagctgtgtagcctgggcaagatgagggacatggaggtgaacagaaatggaagcaatatgttgggggtcaagaacgaaagctacttcaggaagggagttgctggggactggagcaaccatatgacgccggacatggcgcagaggctagacaaggtcgtagaggatgcattgcaagggactggattcagctttacgagcaaagcatgatgagccactgcgctcatggtagttgcgaactccataatgccaagaacaactcgttttgtcggtattgcttgctggatggagatcataccagccagccatggtgagcatccttcttttgtgatgaaggggaaattgatttgcgtataattcatctgtataactttgttacaaaccatagtttgtggcaccttggcgcgccaaaaccatatgcattactgtgtaagattcgtcataaagctatgtgtatcatcattgacatatttgtcttaataaaattcatcataaacc

SEQ ID NO: 11467 - DNA, 929 bp, Zea mays
caaagtagagctgtacgggtcattgaacgtgacgttggatgcaagtttacagagctgccaaaaattactgttgatgatctgacttgctgagtggtggatttgactccttcggtggcgggtatagcggttcaaactatgggcgctcaggtggattcggtggacgtggtggttttggccgatcaggcggtggcggcggatatggcaattctggatttggtcactcaagcggtggatatggacgttctggtggtggaggattcggtgactcagggtttggtggtcggtcaggtggcggtggaggattcggtgactctggattcggtggccaatcaggcggcggtggaggattcggcgactcagggtttggccgcacaagcggtggtgggtcaggttttggtcgttctggtggtttcggcgattctggttccggccggttcggtggcggtttcggcggttctggctcgggtggtttcggtggctttggcgacaagaactcacggtagactcttgcaagtaatagcaggtataaaattatggacgtcctgagccaggttcagcattggtaatgcacatcactctctgaccccctatccatgaccccctcagaaagtgcagaaatctgtgttttgcggtagcaagaacatctggagagacgatccgccggatctcagaaggcagaaggaaataatcacgtgcctttgcttattagtgttcttctctgtttgcattttgatcgttcaagctctagctctagaccatacctgtaaaatattccgtggctcctctatctactgtatgattattgtggcgctgtcttttcttgtaggctgttttaacctgaatgacggcctctatataagcatgtcataaatcgactttattcgtcaaaaaaaacccacgcgtccgcccacgcgtccgcggacgcgtgg

SEQ ID NO: 11468 - DNA, 2787 bp, Zea mays
gcacgagaccattacctagaacatcctaatcgaaaaatcggggtctccttcccctcctccggttgtccggtcccccagaaaccgtgtccttccgtcgtgacagctcccgaccttctggcggtcttcccctctcgtagtcggcgcgaatcccgaggtggaggaggaagaggtagagggggcgggccccatcatccatgagccttgcgggctccgcgctggaggcagcgctactggcggtggggcgcggcctcgacgcagctggagaccaccggctgctctactgcaagggagacggaaggctcgtcgcgctcgaggaccgtgcgcgggacctcccgctccccgacggcggcgtcctcccgagcgtgccccacgacgtcgaggtcgagcagtgccgcagagacctcgagcgcatccgccccttcccgtccgggtccggcccaagctccgccgcagcggacggtccctttgtctgcagcttcgataagatggctgagtatttcaacaggaagtcatgtttgtccgagacagtaccgctgggttccttcaactctctcttcagcttcaccggttcttggaagaatgatgcggcgaccacgaaggcccttgcgattgatggctattctctgcctctgtttcgagttaaaattaggaattctgaactgacgctgcttgagagcgttaagcgaaggatcccaaatgtttgggatccatcagcattggcaagctttattgagaactatggtacccatattattatctctgttacggttggtggtaaggatgaggtatacattaagcagcattcattgtcccaattgtcagagctggagttcaaaaattatgcgagggaaattgggagggaaagatttgcagatgtggaaaataagtcaaatgcatcttctatcaattacagtgagaaggatatgacagtaatattcagaaggaggggtggttgcgaccttgttcaaagttttagtgattggagaggaactgttgcctcagcaccagatgtcataggcatcacctttctatcaattgtctctcttgttgacgatataccaggaaagaagcaccttgctcgtgcagttgagctatacttgacctacaagcctccaattgaagaattacagtacttcttagattttcgagtcccactagtttgggctccagctccaccaggtattgctggtcaccataggaaagaaccagtctgcccatcgcttcagtttagcttaatgggcccaaagctcttcattagcacagaacagatctctgttggccgtcgaccagttgttggcctcaaactgattttggaaggagccaaacagaatcgtctggctattcatttgcagcaccttggctcattaccaaaaatattcctacctcattgggactcctatattactattggacctccaaaatggcaaggtcctgaagaacaggacagccgatggtttgagccaatcaaatggaagaactttgctcatgttagcacagcacccatagagtacactgaaacaaatattacggacctatctggtgtttatattgttacaggagcacagttgggagtgtgggattttggtgcaaagagtgttctccaccttaaacttttgttctccagggttcctgggtgcacaattagaagatcagtgtgggaccacagcccatcaagttcctcggtacatagaacagatgaatcttcgtcatcctcaagtgataatgctaaacttctgaagatcgttgacctgacagaaacattcaagggcccacaagatgcgcctggccattggctgatcacaggtgctaagttgggtgtcgagaaaggcaggattgttgtgcgtgcaaagtactccttattgaattattaaccaaatgtttaaatcattcaatcactctgatattgagcactgtgttttaaggtagcatttgttcttttgtttttcatgtatggcttttgttcccccttgtaacatgatgtggatcatgtttcttgttgatgatgccgtgagtgaagcactacattcgttctcgaatatttgacgtccactagtccactagttcattactaatcagcgataaataaaaaagaactcgaatatttggcgtccgctagttcattactaaacaacgataaataagaaagaatggagggagtggcatatgaagatgttatggtgtgtttggtttgtggagtcacccaatgtatgatgaggtggtgcatcataagttcattccatcaattttagtagaatcaacccactcctcatgtatatactaattattagcttatgaggaatgtggtggtgatggatcaactcattctattcaacaaaccagataaaaatgtgaggagtgagaagaagatggaccacttcattccttaaaccaaacacacccttaatgcagtgttagatacgacaaaatgtctggtataaaaattgtgcaatataaatcagagtcggttaagcctcccccgacaaagtcggtgagattgggtctctaaagtcgatgtggttgtctatatcggttctccaaagttgactaaaatttagagtgtgtttggtttgactttaactttggtcctaagcaaaaagccaaaccaaaggactaaatcaagaaaacagttttttctttctaaaagtcgactttctctcggtgtaaaactgaaagcacttctatacctgcttttaacggcttttagatgaaattgtgataatatatatgaaaaaatattagcttttaatgatttccaccaaacggattattagtagttcacaacccaca

SEQ ID NO: 11469 - DNA, 1971 bp, Zea mays
ctggccgggttgtccccagaaaccgtgtcccctactctctctctctctctctctctctatctctcttctcccctcgatcaacagcaacagcggcggtcagaagcttccgtcgcgacagctcccgacctcctgccggtcttcccctctcctagtcggcgcgaatcccgaggcggaggaggaagaggggagcggagtgggggtgggccccatcagccatgagtctcacggggtccgccctggaggcggcgctacaggcggtggggcgcggcctcgacgcagctggagaccaccggctgctctactgcaagggaggtggaaggctcgtcgcgctcgaggaggaccgtgcgcgggacctcccgctccccgacggcggcgtcctcccgagcgtgccccccgatgtcgaggtcgagcagtgccgcagagaccccgagcgcatccgccccttcccctctggcccaagctctgccgcagcggatgggccctttgtctgcagcttcgataagatggctgagtatttcaacaggaagtcatgcttgtccgagacagtaccgctgggttccttcaactctctgttcagcttcaccggttcatggaagaatgatgctgcggctacgaaggcccttgcgattgatggctattctctgcctctgtttcgagtgaaaattaggagttctgaactgacgctgcttgagagcgttaagcacgcgatcccaaatgtttgggatccatcagcattggctaggtcagtagctttattgagaattacggtacccatattattatttctgttacgggttggtggtaagggacgaagtatacattaagcagcattcatcgtcccaattgtcagggttagagttcaaaaattatgtgagggaaattgggagggaaagattctcagatgtggaaaacaagtcaaatgcaactcctatcaattacagcgagaaggatattacagtaatattcagaaggaggggtggttgtgatcttgttcaaagttttagtgattggaaaggaactgttgcctcagcaccagatgtcataggcatgacctttctttcaattgtctctcttgttgacgatgtaccaggaaagaagcaccttgctcgtgcagttgagctatacttgacctacaaacctccaattgaagaattacagtatttcttagattttcaagtcccactagtttgggctccagctccaccaggtattgctagtcaccataggaaggaacctgtctgcccatcgcttcagtttagcttaatgggcccaaagctcttcattagcacagaacagatctctgttgggcgccgaccagttgttggcctcaaactgctcttggaaggagctaaacagaatcgtttggctattcacttgcagcaccttgtctcattaccaaaaatattcctacctcattgggactctcatattaccattggacctccaaaatggcaaggccctgaagaacaagacagccgatggttcgagccaatcaagtggaagaactttgctcatgttagcacagcacccatagagtacactgaaacaaatattacggacctatctggtgtttatattgttacaggtgcacagttgggagtgtgggattttggtgcaaagagtgttctccacctcaaacttttgttctccagggttcctgggtgcacaattagaagatcagtgtgggaccacagcccatcaagttcttcaattcataaagcagatgaatcttcatcgtcctcgagtgataatgctaaacttctgaagattattgacatgacagaaacattgaagggcccacaagatgcacctggccactggctgatcacaggtgctaagttgggtgtcgagaaaggcaggattgtagtgcgtgcgaagtactccttattgaattattaacccaatgtttaaagccttcattcactcactctgatattgagcactgtgttttaaggtagcatttgttctttt

SEQ ID NO: 11470 - DNA, 1876 bp, Zea mays
  misc_feature (1876)..(1876): n is a, c, g, or t
gtactaggtaggtctttctcctcgcaatctttccgtttcttcgtttgattccctcccgccgccgccgccgccgctggagacgctgaaccacgacagcgccccagggttcgtcctcccgctggaatagtaagtgaccggagaaaagcagcacaagagagatgtggtacctatgcgtcttctaccacaggctcctggactaccggcgaccggaggtggagtccctcgccgagctctttgccggtccaggcgcccgtgaatccgtcgagtggcgcatgccggagaaccaccacgtagactcccccttccacctcgttcgcctccctggagacgagcgcctcgccgctcaggtcgccaaccgcagcttgttggtgaaggggatctacgagctctggggctatggcactacctacgaggagctggagaagtcggtcagggagtaccccgacgagaggaagcttccgttcctggtcccggaaagcagcttcaagatcgttatcgacagcttcggcaaggtgatcagctcccaagagcagaacgagatcatacagagcctcacttacataccattcaagggacgtgttaatttgaagaagcctgatcacagattctttgtcatggagaccgatgactatgggtcgaacaatggtctcccaccggttgtcaagaggtcgatattctttggccgggaggttggagcagctgataggcatctcctgccaacataccagctcaagagtaggaagtacattggccccactgcaatggatgctgaaatggctttcctcatggccaatcagggtctggcctcgcctgggaagcttgtctatgacccttttgttgggaccgggagcattttggttgcagctgcacattttggagctatgacgatgggtgcagatatcgatataagggttgtacgggatggtcgtggccccgattgcaacgtttggagcaactttgagcagtataagttaccagagcctttgtgtttgctaagggcagacaacaatctcccaccctggcgtcctggattgaaggagatgttcgatgcaataatttgtgacccaccatatggagtccgggccggtggccggaagtctggtggtcggaagctcataaaaggcgtcaaaggcccttacacagtgcctgatgagaaacgggacaatcacatcccatcaaccgccccatatagcctcgcagagtgcgtccatgacctcctccaccttgccgcaaggatggtagtcatgggtggcaggctcgtcttcttctaccctgtactgcgaggtgaagatggcactgcgaacccgcagttccctgagcacccctgcttcaagttaatcacctcctctgagcagatcctgagctttcggtacagccgggttctgctgaccatggtgaaggttgcaccttacaccgaggagatcgagaagttggccgcagagcggcaccgggagttcagggagaaccaccagaagtggatggaggagggcaacctccattccgccgtgttcgagccagcccaggatgggaagcctgatagagactccaagcccaaatacagaggcaagtatgtgtagcagcgcagatactaacttgttgaatttagtggaaacacatttttggtggtttcctgttctgcatcctgtaccaaattttatgagctagtgtgttggcaggcgctgcgagatgtaccactgttccagagtaccattcaaatcttgtcagtccatttgatggatgaggaagtgtaattgcagcttaattgactgaacttatttttttggttaacctgcctttgacacgtcaaaaaaaaaaaaaaaaaaaaaaaaaaaaaaaaaaaaaaaaaaaaaaaaaaaaaaaaaaaaaaaaaaaaaan

SEQ ID NO: 11471 - DNA, 696 bp, Zea mays
gtgtgtttttattaaaccctaaaacgggaactgggaggggattaggggattaaatcatctggtcctgtcttgcactttctagaaccgggaggagagcaaggcatgcgacgtttttcctaccaattggctctcgtcgtacgccatcgctgcatgaggatctggatgaggtaggcgaggtagaggaggccaaaacatgggccaaggcggtgatgctcctcatcatgtgcggcgatcaccacgcatctggcgaggccatcaaggatgtgctttcagtctttcacctaggagcttggcgatgactaccaggttgacatggaagaaataatggtagcaccaatttaggatggataacaaccaaaatatcctacaaaagttgtttctagtatcataccgggctccagtgtgttcctatgcaatgttggtcttcggtctgcatccaagaaaagctccatagcgtcaatttctgcaaaggttcaacaactttaggatgaacttgagatcaagaagcaagaaatatttgtagtgaacaaattcatgcgatattttggttgtgatgtgtaatattccttgacgatatgaatgcttatgatgtgttccttctaatgactattgtatctatcacaaatgctttggcacatcactgccatgtcatcatattttatgatgaaaatattcgtcacaaaaaaaaaaaaaaaa

SEQ ID NO: 11472 - DNA, 1443 bp, Zea mays
caagttctctggtttaattcagttctgagtcggagttcagaatggggtgtatccttcatgcttttgtgaaactacattatatttctttcctcccccagatattagtttgctatcatatcttcctttatgttgcttttctgagcgtgctgcctgttccactcaatttatgcatttaccaaagtaacaaaacatggtacactagtgctgatgtgaatcacctacctctgttctccttgacttgcttaagacccattcaattcattggtactttacatcggcgcttccccgttccatgatagtggcataccctctctgcatggttggtgctcttcttgatagaaggatagtaccatacatgtttccggtcttcttatttgttgtgctctattcaaaacttccacataaggaactccgtttcataattggctcaattcccatgtttaatgtgtctgcttcactaacagctagcagactatataataaccgaaagaaagctgggtggaatttgctttttattctcatgcttggtgcctttcttgtcagtctaggatattctactgtgactttcatggcatcctacaacaattatcctggtggctatgctttaaaggctctacatgaagcagattcttcagtgaaggaaaagatggtacatattgatgccttcactgcaatgagcggggtttctcgtttctgtgaaaatgaatatccttggagatactccaaggaggaagaaattcccatcgaagaatttgagaaaaggaatttcacctatctactgaatgagcaccgctccatcggtggctaccagtgcctgttcgctgtggatggattctccagagtaaaacttacgccccaaatccccccgctctctctggtgaaagaacccaaggtgtttgcacatgggaatacgagagaccctgacattctttcactgagttggcccggttgtccttgagggcatggggacaccggacacccagattcctgtggcaggaccactaactgccagcagtgaagatgtgtttgagtcagtccgcgtgacacatatatggtatacatctctgggtcttgccatgaagctaccttacctgcaaatctagaatggggcccctcctcccctagatcccacggcttcgaaaccacagctttaaggaacactgccattttcaggtgcaaatttgtgtaacattttagagccggaagaaagacagaaagcacacggggggtggggggaatcatagcaattagcaaccttgtatttacaagttggtcgatatatttttttcccttttgaggcaactttcatactccatcttatataacaagagcttctagactttatttatcggcagcaggcatacagtcgtgctggagacgcatacttgctccattcaaagataatatatttgttttctatcaaaaaaaaaaagaaaaaaaaaa

SEQ ID NO: 11473 - DNA, 1542 bp, Zea mays
  misc_feature (7)..(8): n is a, c, g, or t
  misc_feature (30)..(30): n is a, c, g, or t
atcacgnngccctcaaaaacgcagcagctntaaaaaccccaagcttaagaaaagcgtaccggtttcttatcaatttgagaatcctgatattataaaggagagggaagaggagcagaagatgatgaaagaaaagcagaagaaggagaaagccgaaagaaaaaaggaaagagtaagaggaagcatcgatcgccgagtgattcagatagcagcaatagtgctgcttcggtgttcgactctgactctgaatcatcgggctctgaatactcttccggaaccagttcaagttatagttcctcagactctgaagacaagaagcggcaacacagaaggaagcagaagaagagaaggcacaggagggacagcacatcatcatcatcttctgaatctgagtctgcgtcagacagtgattcggatgacaagaacagccggaggaagagtaaaagaaggggtggtaggcgctgaatctaatgagctgcacaaagcagtgtggatgttgaatatcatcattatatacttgtgttcaattcatgaataacttttcgtcatcatcagaccatgtgctgggctttgccaatccaagaaacaaatgtagcatttgctttcctgaatgctagtactgatatttttccctgtacgaagaagcacttgggagcttttaggtgttcctattctatgatctttgtgtaacgatattcatatatggatttctaagtttggtgtgttcacgttcctgtgcgccttagggtgcgttcggttcctctcttaaaccgttgcctggaaccattctgacctgacccagaatgcttatctaatttgcatagggtttgatcagctggaacaacacccttagggcccgttcggttgtatcggaataaaccaagattcatttcagttcatcaaaatctatataaattagagaagtaatccggctaaaaaataatccggggctccaatccctgacaaccgaacagggccttagggcgtgttcggttatatcaatccaggatttaaaccccttcaatcctcttctggattgacctaaccaaataagcccttagtattgctgtaatcatttactcctggatcctcctcgcctcgttctttagtaccctgcactgcagtcctttgctctgtgtagaaagttttctgttaacattgggccatccttcctcgtgggatctctctctcatacctccagtccttactgttcaccgtttgttcagaggaaaatcacatcactggccagtattccttgttcagaggaaaatcacatcactgccccagttattctctcattcccaggataccagacgatcagtgtcatttttctgacaaccaaccggtgcagttaacccaggatggaccgcatggcaggtacaacaatgatattattgccttcgaagtggagcaaatgatgtctctctacagctgaatccacagtcgccagtgcttgagcagagacttgacacgaacagtttcactgtttggaactttatctgcatttttgtctagcctgcaatgtggaagacgagcacagtatac

SEQ ID NO: 11474 - DNA, 4028 bp, Zea mays
  misc_feature (801)..(801): n is a, c, g, or t
cctcaagcgtccgcaagaaatgtggtaggacagatgagcagattgaaatgctgacattaaagctgcgaattgttgatgaggagctagcttctggtcggtggaaaacaaaactgtctaaatctcatggaagagtagtctacctttctctcagagatgaaaaagcaaggctattggggaaccttgcttgggcctatatgcagtccgaaaattatgaggaagcggagatgctctataggcaagctcttgctatagaagctgactacaacaaagagtgtaacttggccatctgtttgatgaagactggaaagttggctgaagctaaatatctgattcatgctataccttacaactgtaatgatgaaagtcatgttaagtctctctcccgggctactgaaatgcttagggaatttgacttgcaatccctcccctctcccataactcaggcgaagtccaaagaaccacggaattttgttgctgatgatgtggagatgcttgtagatctacagccacaaacactatcaactccttttagtgaactgaaatataaagaagcacatatttcagtttcacaaaatgcagagaagcatgagaactgcaattcatgccttccatctcccataactcaattgagacgggaagaaccacacactatggttactgctgatgccgaaaagaatgaaggctttgcagagttccaagatctttctcgactgttcaatgatgctgccacgcctcattcagtacttgagaaactacgaaagaggctagttaaagaggcaccaaaagtcagtattcatgatncaactctggcgcctccccctgaaagcttgcccaactctgaaagaaacctagatgctagtgagacttcccgtgcaggaagggaagctattgaccaaaggtgttagaaaaacatggtctgacatggtggatgaagaggaaacagcaattgggtgatgacaaaccatgggctgacatggtggcgaaggatgaccagcaattgggtgatggcaagtcaacacatggtgttggaattactgaacaaaacgagagcagtaagcatgcaagtaagctggagtatagaacgccatcgtcctctcaagaaagcaggacccatcaaagaccagtcatgggtggtcaactgcaaggttcttcagcaggttcatggagacgcagtgactccaaaatctacatggataagaacgtgaactgggatcttgtgaggactgctccgacatggagcaggcataaggtacatgaccacaacaatcgagtttggcaaaggcttcacacaattcatccccgtgagagagcctcaggcacgaagcaagtaccacggagaagcaacacatctcagcgcgctctttttcctgactggaaatcaaaaggtgaaggatatggccatggctatgttccgtttgatgataacgaacacactcagtgttccagtcacattgaggccgccactcatcgctggcataataatgaggcaagtacagggtcatggaggccacagaaccgtctgcgggtcttccaggaaatcacaaatgagatcaaccaaaatgttgtgtaactatgtccttgttccttgctgtcgatggaagttctcctttccagcaacatgttgtttgcactacaaatgggatctgtgaaatagttcagcaataaacagtttttcgcttcagttgcttctgtttttgagattcagcatagctacagaaaactatgtgaatatcttcactgcccaccgttcatactactggcacgttggtggatcgtgatatctgtatatattttctttatcactagtgtgccaaagtatctgtaaaaaaaaactggtggcctgtctatcaatttctcagagtggtctgagaatcttttccttccctgatttcacatcacctccacaatgtggcttaccatgaaactgcttggactcttgtcccaactgtttagatgctagtacatggttccatctgttgctggacatctcctgcataatggggcgctgcaagatctgagtgtgctccctccctccctcgctccctcctcttgtcctctgcaggaacaagcaatggagagcactgcagtttgcaaatggacacagttgcagctgccgagcagcctcctgcatcagcatagtgctcattcctgtgtcattttctagcttgtctgcacaccggagcctgacggattccattactgcagctggtctgggtgtcctaacatggtggctgtccttcctcaggggcagcaatggctggctggccggcagccttgagcttcatctgcgacctggacttgggccccaaggccgaggcgatgctgccagctcagttgtcatgacgtgtagcgccttgtcgtcacttcggtgagggcgacaaggctgccgtcgcctctccggctgccaccagggtttggcctctaataattctggtgcatgattgttggcttcgcatacggagcgagagatagttgtgtacctgctggatcctcgtcctggtgcttgtctatatacacaactatctctctctatctggtcgatctgcactgcctatgaatggtaagatactcttcttcaacctcttgatcatctatctccctggttttcgataacgaagctagtcgcattgcttcacatttctcttgtgatgtgatactgatacacacacacacactgaccaatatgtacatgtgtgtgcggccgctgcctggtcagtgcgagcagtgacccgctgcagcaacggatgcatgcatttgcgggcaggggttgcacaggcacagcacagggcacgtgagatccctcatgcacactcatcctgaggtacagaccattactgctatatagactgtgcagccgtcaggagtggcagccggccggccgacggtacgccgaccattacctgaatcatctgtgggtggcttttttcagggcgactactatatggggaactgttctaccggctcaatcatgccaggcggccagccaatcttcttcagttatttcctggacaggtagagagagagagaggagacgcggcacagcacagtgctgcgattttcacgtgccggtactgtgacggccggagagaggtaattggatacttgcgctttattacttacggtcgtttatttcgttaagcctgcacatatgtcatgcatgtcgagcggtagtgtagcttgaacaaattttggcactggattcagacccgcctgcatgcatgcattcccggattttgacgctgctgtgcgtcgatctgtgattgatcgaatggatacattatagatagatgcacatgtagatctatctaaacgactcgattataacagccggtggagcctttatttcttgccgacaaaatgaacggaataattacatcgcaaatggcacattattgaagatatacccaaaaccaccagccatgtgctctttgaacacccgcaagcagatcaactcgatcgaaacgctgctgccagctgttcattcgggacttttgccggatcctgctacaataattaaaaaaaaatggaccgagcaggtcgtttggattttgtgttcacctatcttgtgtcccgtgctagcaaagttctccttgctgccgagagagagagggagagccaacaggctggctggcgagcgtctcgtgtggctagggaacctggcaatagtccccaaacacgacacgcccttggtatcccgctgcctgtagagtgaaacactagctcagggtttcaaatacaaaacacaagccttgaggttaatagcttgtttaggagcaaagatacaaaaggagattagaggggctaaaatctcttgctattcaatttttaatagcaagaaaaatttagcccctccaatcctcacaggagtactggctctcaaacaagccataacagtctattaaattatgtggattcagcaaggttaataatatagctcataatagactttttgatgttgtcatatatatatatatatatatatatatatatatatatatataacaattaggaatgatttggtgtatagg

SEQ ID NO: 11475 - DNA, 2352 bp, Zea mays
gccatggccgcgcgcgccaaggccgccgccgtcgacgaccacgaccccatgccgccaccgctgccgctcccatggccgcgcccagcgccgctcctcgtcatgctgtccctgctcgccacggcctcctacctggccctcacgcgctttcccgccgcgctcctcccgatcgcccctcgctctcgcccccacgacgcgcccgcgcacgcgcccggggacagctgcgcggggttctacgcgggcgcggggccggcgcgcgaggtgtgggcgtccgtcgaggagttcggggccgtgggcgacggggccacgctcaacaccgcggcgttccggcgcgccgtcgcggagctgggcgcgagggccgtcggtgggggaggggccaggctcgacgtgccccccgggaggtggctcacgggcagcttcaacctcaccagccgcttcaccctcttcctgcaccgcggcgcggtcatcctcggctcccaggatccagaagagtggcctctcattacccctttgccgtcttacgggcgcgggagagagcggttaggaccacgccacatcagcctcattcacggagagggcttaaacgatgttgttattaccggtagcaacgggaccatagatgggcaaggtcatatgtggtgggagctatggcggaaccgaaccttgaaccacacgagaggccatctcatcgagcttgtgaactcaaccaacgtcctgatatccagtgtcacgctgagcaactcccctttctggacagtacacccggtctactgcagcaacgtggtgatgaaggatttgaccatactggctcccctggatgctccaaacacagatggcattgatccagactcgagctctgaagtttgcatcgaagtcggcttccgttgctgtcgagacgacctcgtggccgtcaagagtggctgggaccagtacgggatctcatttggcaagccgagcacgaacatcgtcatccagagggtttcgggcacgactccgacgtgctcgggcgtaggcttcggcagcgagatgtcaggaggcatatctaacgtgctcgtccgtgacctccacgtgtggaattcggcgcaggccgtgaggctcaagaccgacgtagggaggggtggctacatcaccaacatcaccatagccagtgtggccatggagaaggtcaaggtgccgataaggttcagccgaggcgcagatgaccatcctgacgacaggtatgacccggccgcgctgccgaggatcagcaacgtgctggtcagcgacgtcgtcggtgtacacctgcagcgagcaccgatgctggaggcagtgcctggcgcagtttatgaggggatctgcttcaggaacttcagcttcagagggataaggcggcagcaggacagcaggtggcattgcgagtctgtgtatggagaggcgcatgacgttttccctgcaccgtgtgaagagttcaggagagatggatcctcctcctggtgtggacttctttgaccaactactctatctagtagtagtacatactacagcgcccacaagttttgggagtggatgatataggttttttagattatacagacaaactcaattttttaaactttaattagtcttctgttttcgaatggggttagaaatatgtgttgggcaccaaatagacgggcgacggtctgcggtaccttgcagcacacaacagtacctcctctctcaatcagcaccaccaaaacactaagacgaaccaggcttccttcccctctctcaatcagcagtaccacccagcagcagttcttctcccaccaccacctgaacgaacgcaagctgcagctggtctgggtgtcctaacatggtggctgtccttcctcaggggcagcaatggctggctggccggcagccttgagcttcatctgcgacctggacttgggccccaaggccgaggcgatgctgccagctcagttgtcatgacgtgtagcgccttgtcgtcacttcggtgagggcgacaaggctgccgtcgcctctccggctgccaccagggtttggcctctaataattctggtgcatgattgttggcttcgcatacggagcgagagatagttgtgtacctgctggatcctcgtcctggtgcttgtctatatacacaactatctctctctatctggtcgatctgcactgcctatgaatggtaagatactcttcttcaacctcttgatcatctatctccctggttttcgataacgaagctagtcgcattgcttcacatttctcttgtgatgtgatactgatacacacacacacactgaccaatatgtacatgtgtgtgcggccgctgcctggtcagtgcgagcagtgacccgctgcaggcatgca

SEQ ID NO: 11476 - DNA, 2068 bp, Zea mays
aattcggcacgaggcacgctcggcttggctgaagcggagagtttcctctgttcccccattccgtcgtgtcaccaccgccgccgccggagtgtgtcatcgccgattcgcctggtatggcagcaccgcccgggggagcggggatagtgtggcagacgccggccaacccgcccgagtcgcacgactacatcatccgcaacggtcggcgctacgtgaggccttactacttcgagttcatctcccatgtgaagaacagatgggctggaaagaccatcgttgacctcttcactgatgagttcaaagggcgttcccgcgattactatgttcatgcagtgaagtgtgggaggcttcaggttgatgggcaaatggttcacacagactatattgtgaaatcatcacaaaagataagccacttcttgcataggtcagttgctttgatcaattttgaaattattacccccactaaacaagtgttcgataatttcacttcataagttcaacatagattactccatacaaacaaatgttccaaagattaggagcagcataaatcttcacaattttctgcagatacattatcctttacatgcttatatcataaaaatggcaagtgaatcaacaggtaagtaacagatgttttggttaatgtctcaatttgctctttctattggaattatttttagaatatcaataaaatattagttatactgatgaactgttgttgattccttgacttctaagttaatgatgtcatttagtttaactttgtgtgccattttaccttcatgtagttctctagttaaccagatacttcctgtggcatgcagacaggaacctagaccctctgtgttctgacttaacaaaaataattcacatgtctttttctcatttacaaatttttagttcaagtctttttctaaaggtgtttttttcttccaggcacgagccacctgtcttggcgggtgatatttcaatacttaagaatgaagttgatgtcgtaactatttgcaaaccagcttctgttccagttcatccatgtggtcaataccgcaagaatactgtagttgggattctgcaggcagagcatgggttaacacccctatttcttttgcagcggtgcatcggttagatcgtttggtttcaggcctccttatatttgcaaaaaatgccgacagagctgaatgtttcaggcaacagattgaagctggtctgctgcaaaaagaatatgtggccaaggttgttggggtttttcctgatggtgagcaaaccgtcgatgccaatgtaaatttcaacgcacgggaaggaaggagtaccgtggagattagtggtggtgctggtgaagaaccaaatggaaaccaagccctccctaggtttcaaaggatttgcacggatgggactcacagtattgtcttgtgcaaacctgtgactggtcgaactcaccagataagggtgcatctaaagcaagctggttatccaatagctaatgatgagctgtacctatcggggaacttttgtccacgatcaacaaaaggaacaaatgccagtaaaaaaattgcaccatcagatccagacagtagtgctgctgatcatggcagcaaagatgcaggaacggatgtggagtttgatatcgaccccatgtgcacaaactgtccaaatcttgctccagtaggttatgatagagatgaggaaggactatggttgcattgtgtgcggtacactggtcctgattggagctacgaatgtccttatcctgattgggcgttccttggtagcgtgtcaacaaagaagatgaagtcatgatgtagttcatggtgattggtgaatagtaagcccataaaaaaactgaacaatcaaatagtattgttttggcgttacctatgactgggcttccgaggttttcattcaaatcaaacacattagatccggttttcctcggcttctcattcagccaattcacggttcaaaatccactccttaaaattccacatacattatcgcatccagcctttttgattggttccaaaaaaaaaaaaaaaaaaaaaaaaaaaaaaaaaaaaaaactcgagaaggg

SEQ ID NO: 11477 - DNA, 1454 bp, Zea mays
cactcctatgggcgattgggatcctcgaggccggccgggaccaaaagcagtgcatgcactactagctctagcttcgcactactagctctagcttcgccattgcattcgcttactggagtacgtctggtacttgcacaactggctatcatggcgccccacattgtcgtcaacaaaaccgtgatcacattcacagcggtggccctgacgattcttgctgtgacaaccatgatggccgaggcccgagacctgtcatccacctccaccggtggctatggcgaggaagccatgaaagtgaggcatcagcagtggatggcggagcatggccgcacctacagggacgaggctgagaaggcgcaccggttccaggtattcaaggcgaacgccgattttgttgacgcgtccaatgccgcaggtgacgacaagaagagctatcggctggagctcaacgagttcgccgacatgaccaacgacgagttcatggccatgtacactggcttgagaccagtcccggcaggggcaaagaagatggccggtttcaagtacgggaacgtgactctctcagacgccgacgacggccagcagacggttgactggcggcagaaaggcgcggtcaccggtatcaagaaccagggccagtgtggttgttgctgggccttcgctgcggtggcggccgtggagggcatccaccagatcacgacgggcaacttggtgtcgctatcggagcagcaggtgctggactgcgacaccgacgggaacaacggctgcaacggcggctacatcgacaacgccttccaatacatcgtcggcaacggcggcctcggcaccgaggatgcctacccgtacaccgccgcgcaggccatgtgccagtccgtgcagccggtggccgccatcagcggctaccaggacgtgccgagcggcgacgaggcagcgctcgccgcggccgtcgccaaccagccggtgtcggttgccatcgacgcacataacttccagctctacggtggcggggtgatgaccgcggccagctgcagcacgccgccgaacctgaaccacgccgtcacggcggtaggctacggcacggcggaggatgggaccccgtactggctgctcaagaaccagtggggccagaactggggagagggaggatacctcaggctcgagagaggcgcaaacgcctgtggtgtcgcccagcaagcctcctacccggtcgcatgatgaataaagcatatattctacatatacacgaaggcatgcataaaaatggctagtaaggaataaagcatgcaaacacattgacagtacatacatacatagcttaaaattgaatcacaattgtcatgtacaacactccagatatcatttatttctatttggccttcttttcaaagatcgatattctatatatacatatatgtaagggaacaagtttttatagcataataagtccttcgcacctc

SEQ ID NO: 11478 - DNA, 1166 bp, Zea mays
  misc_feature (12)..(12): n is a, c, g, or t
  misc_feature (15)..(15): n is a, c, g, or t
gggtaccctcgnggnctcggccggccgacacccacgtttctttaccctaaccttttcaccgctcgagccaagggacacagccgccgccgtttcttcatctcccatcttcatagtcgcgctaggcacacaggcgtcggcggcggcgctcaggctcgggatctcagctacagcgtcagcggcttcctctcccgcctctcgccagtcgtctcgcgccctcgcttccgatcctccgcacaccggccggtgaccctgcaaatggcagggcaagcagggaacccagtaaaccaccctataagtccccacgtgataagtggcgctttcgttcagcaatattaccacattttacacgaacaaccagatcaagtgcacaagttttaccaagattcaagtattcttggtcgaccagattccaatggaattatggcatatgtaaccactatgcgtgatattaatgaaaaaatcatgtctatggacttcaggaactgcttaacagagatagagactgcagatgcacaattatctcacaaggatggggtgctcattgttgttactggttccttgacttcggatgaaggcgttttccgtaggtttacccagtcattcttcctagcaccacaagaaagtggtggctattttgttctcactgatgtatttagatttatttcggaaaggaaaccagctgagataaatcaagttgctactcaagaaaatgaaatcagtcagaatgttagacctgcatctgaaacatgttcagcactaccagaacctattccagctgatgggagtgtgatctcagaccatgtgacagctgatagtaatgtcacggaggagcaaataagtgatctttctgctcatgcggctgccattgaaagtaatgataatacccagccacctgtgcaagtgcccaaagaggatccaaagaaggccctacttgttggttctcccccttcaactcagatggatgttactaagaaatcttatgcatgcattgtcaaggtcatgaaggaggggccaccaactgcagttgttaaaacaacattgtgagttttcaaatcagaagccaggtactaaaccattgttcatggttgtcgaaggcctagagaaaccatctgtgaaacctaccccagctattggaaccgggatgggattgttggccaaaacaattt

SEQ ID NO: 11479 - DNA, 3816 bp, Zea mays
acccacgtttctttaccctaaccttttcaccgctcgagccaagggatacagccgccgccgtttcttcatctcccatcttcatagtcgcgctaggcacacaggcgtcggcggcggcgctcaggctcgggatctcagctacaggaaatggcagggcaagcagggaacccagtaaaccaccctataagtccccacgtgataagtggcgctttcgttcagcaatattaccacattttacacgaacaaccagatcaagtgcacaagttttaccaagattcaagtattcttggtcgaccagattccaatggaattatggcatatgtaaccactatgcgtgatattaatgaaaaaatcatgtctatggacttcaggaactgcttaacagagatagagactgcagatgcacaattatctcacaaggatggggtgctcattgttgttactggttccttgacttcggatgaaggcgttttccgtaggtttacccagtcattcttcctagcaccacaagaaagtggtggctattttgttctcactgatgtatttagatttatttcggaaaggaaaccagctgagataaatcaagttgctactcaagaaaatgaaatcagtcagaatgttagacctgcatctgaaacatgttcagcactaccagaacctattccagctgatgggagtgtgatctcagaccatgtgacagctgatagtaatgtcacggagaagcaaattagtgatctttctgctaatgggactgccattgaaagtaatgataatacccagccacctgtgcaagtgcccaaagaggatccaaagaaggccctacttgttgctcctccccctccaactcagatggatgttactaagaaatcttatgcatccattgtcaaggtcatgaaggagggcccaccaactccagttgtcaaaacaacatcgtcagtttccaaacagaagccagctcctaaaccagtgtccacggctgtcgaaggcctagagaaaccatctgagaaacctacccaggctattggaaccggtgatgggattgttgcccaaaacaactcttctcgcaatgagcaaggctattcaattttcatcaagaatttgcctttccatgccaatattgaaatggttgaggaggaatttaagaaatttggtactataaagccaggtggtgttcaagtccggcacaataaggttgatcgatttggttttggttttgttgagtacgagtcccagcagtctatgcaagcagcaattgaggcatctccgattcgtatggcggacaaagaagtcggcattgaggcgaaaagagccaattcacgaggtggccgtttccaatctggcaggggagtgtaccatggtgataactttagagggcgaggaagtggctatgtggacaacacaaactacagaagcagcggcagcttcaaccgccagaatgaaggggagatgtacaaccgcaggaatgaaggggagatgtacaaccgcaggaatgaaggggacttctacaaccacaggaatgagggggagttctacaaccgacggaatgatggtggcgagaactacaaccggcgcaacgatggtggcgagaactataaccggcgcaatgatggtggcaagaacttcagccgcaggaatgacagtggtaccgagaacttcaaccgcaggaatgacggtggcggcgagaacttcagccgcaggaacgatggtgttggcgagaacttcaacgtcaggaatgacggcgttggtgagaacttcaacaggaggaacaacttcagaaatcagaatgacttccctggacgaggacggggttcacctacaccagggaacagttactaccagaacgggaatgggaggttcagtcgcgtgaacaatggcgccaagcaagctcctgtggccgcgtagaggcatcaaggcggtaggcttacatcaaactaggaagcataaggctacattcaagtgagctgagtgcaaggattattcttagtaggagcattgctgtcagacagcttggttatttttttttgtgccgtgttgggtcgctaagagattagtagttgcagtcgtccgtggatggtaggtgaattttgttgccgttgatgagcttgtcaactgggtgttggaccatggttcgtaactttgtgtcatctgccaatcaggattggtgggaggttagacactaatcttatgaagcggtgactgcaaaaatcagtgtccatgttaaatgctattattgtcatggtattcgataatgcgaagtatgtccatgtttagtgctattattattgccctggtattcgataatgcgaagtatgcctatgtttattgcagttgtcatggtatttgataatgcgaagcgttggttcgtcgttgtcactactgttgtttattagtactaagcatcagtaataactgtatcacctacggtgttcctcatttgctttacaatttgtttaggttcttaaataatcttacttcaaaaatgaatagaaagcgaacctagatccttaaatttcatagtttatgtatacaatttagagtctgatcaaaatttcaaaagcaagtatcagcgtttgttatcctagataagtattattaggttcaccatataatatatttttatagtacccatgtacgtatctggtagcataaataccactactcttggttaataaactttgtataatttttatttaggacggaggtgacagtattagtgtcgtatttgatagagctctgtttttctggaagaagggatgtttttctaggataaaacaaactctagggctatgatgagttgcactgctctcctcacagatgctcggctagttttttttattggttgaagtactatgtgcatttgcagctggagcatctagcttattttagaaagaaacatatcactacatagaattattctttaattaaaaaaactgtttagcagagtttattttaacctaaaagctgctctagactgagtccaataggcaccgcaaacacgtcgcgaatgcgtattattcgcggcatgcaacactatagctgcatccggcgggtatcggagcctcggaggtgtctgccaaagaaaggagagcatctgcatcctctatcctacagcagaccacagtcatgtttgtttcggcttctagcagcttctgaccaccaaaagctgctgcggacggtcaaatgctcagcttttcagtcagctttaataaaattcgttgagggcaaaaaccatctaaaatcaacataaacacataatcggttaagccgttgtaatagtaggaatctgtcactttctagatcctaagccttatgaataactttattttcttccacacgtaatcgtaatgatactcagattctctccacagctagattctcttcacaaccagattttcagaaaaactggtcagaaaaaagctgaaccaaacaggccccacatcttctctgttttaatacatctcctatccacatcttctctgtttccgtcggtaagtacggactcgcagacgcgcggttcgaatacggtagctattgcatgacggggtctcctctatccgcgctcgtcgatgggtcctcgttcgcgccgcggtgtatgctaaggctatttccactttccagtgcacattatcaatctcatttaatacatgccatatagaatacaaatgtgatacgtcatgttattaaataagaaagagaataaagcagtatattaaaatagataattattttgacatgagatcatatacattaaaatctgaaccatcgaacagatctacaattcatactctcatatacatctagcatttaactgtcttttgg

SEQ ID NO: 11480 - DNA, 1011 bp, Zea mays
  misc_feature (899)..(899): n is a, c, g, or t
  misc_feature (901)..(901): n is a, c, g, or t
  misc_feature (907)..(907): n is a, c, g, or t
  misc_feature (911)..(911): n is a, c, g, or t
  misc_feature (913)..(914): n is a, c, g, or t
  misc_feature (927)..(927): n is a, c, g, or t
  misc_feature (936)..(936): n is a, c, g, or t
  misc_feature (958)..(958): n is a, c, g, or t
  misc_feature (983)..(983): n is a, c, g, or t
cattgggtacctcgaggccccccgcgtaccagcctccgcgccggctgggacttggcaatcctctccacctagctcagcatccgacgacgggacttgcacgatggatgctgctcttatgcctctgctcgtcgtctccctcgtcctctgcctgctggcggctgccccagcggcgtccgcggcgcgggccttcttcgtcttcggcgactccctcgtcgacaacggcaacaacaactacctgctgaccacggcgcgcgccgacgcgcccccctacggcatcgacttccccacgcaccaagccacgggccgcttctccaacgggctcaacatccccgacatcatcagcgagcacctcggggccgaacctgcgctgccgtacctgagccccgagctccgaggggagaagctgctcgtcggcgccaacttcgcgtcggccggcgtcgggatcctcaacgacacaggaatacaatttgtgaacatcatcaggatcggcgaccagctgcagtacttccgggagtaccagcggaagctgcgagccctcgtcggcgagccgcaggcgacgcagctcgtgaaccaggccctcgtgctcatcacgctcggcggcaacgacttcgtgaacaactactacctggtgcccatgtccgtgcggtcgcgccagtacgcactcccggactacgtccgcttcatcgtctccgagtacaggaagatcctctcgaggctgtacgagctgggcgcgcggcgcgtgatcgtgacggggacggggccgctggggtgcgtcccggccgagctggcgctgcacagccagaacggcgagtgcgcggcagagctgacgcgcgccgtgaacctcttcacccgcagatggtggacatggtgcgcggcctcaaccgcgccatcggcgccgncntcttcntcgncnncaacacctaccgnatgaacttngactacctccgcaaacccgcangacttcggggttcacgaacgtgcangtggcgtgctgcggccagggcccgtaca

SEQ ID NO: 11481 - DNA, 1375 bp, Zea mays
gcacgagaccattaccccgcacgtccggccgggctggtacttggcaatcctctctagctagctcagcatccgacgacgggacttgcacgatggatgctgctctgctcgtcgtctccctcgtcctctgcctgctggcggctgcccctgcggcgtccgcggcgcggccttcttcgtcttcggcgactccctcgtcgacaacggcaacaacaactacctgctgaccacggcgcgcgccgacgcgcccccctacggcatcgacttccccacgcaccaagccacgggccgcttctccaacgggcttaacatccccgacatcatcagcgagcacctcggggccgaacctgcgctgccgtacctgagccccgagctccgagggtgagaagctgctcgtcggcgccaacttcgcgtcggccggcgtcgggatcctcaacgacacaggaatacagtttgtgaacatcatcaggatcggcgaccagctgcagtacttccgggagtaccagcggaagctgcgagccctcgtcggcgagccgcaggcgacgcagctcgtgaaccaggccctcgtgctcatcacgctcggcggcaacgacttcgtgaacaactactacctggtgcccatgtccgtgcggtcgcgccagtacgcactcccggactacgtccgcttcatcgtctccgagtacaggaagatcctctcgaggctgtacgagctgggcgcgcggcgcgtgatcgtgacggggacggggccgctggggtgcgtcccggccgagctggcgctgcacagccagaacggcgagtgcgcggcggagctgacgcgcgccgtgaacctcttcaacccgcagatggtggacatggtgcgcggcctcaaccgcgccatcggcgccgacgtcttcgtcaccgccaacacctaccgcatgaacttcgactacctcgcaaacccgcaggacttcgggttcacgaacgtgcaggtggcgtgctgcggccagggcccgtacaacgggatcgggctgtgcacggcggcgtcgaacgtgtgcgacaaccgcgacgtgttcgcgttctgggacgcgttccaccccacggagagggcaaaccgcatcatcgtcgcccagttcatgcacggcgacacggactacatgcaccccatgaacctcagcaccatcctcgccatggaccaggagggcctctagactatagcttgatcagccggacacgattatacgtacatgcgtgatgtgtctcacgtgcctagcacgttagccatgtgttggatgatggcagcccaatttgccaataatattcgtgcctcgatccaagtttcaccttaaaatcaataacgccttaaaaagggttagtgactggctatggttaatcgatccgtgtt

SEQ ID NO: 11482 - DNA, 1488 bp, Zea mays
  misc_feature (896)..(896): n is a, c, g, or t
gcacgagaccattacctagaacatcctaatcgaaaagtacttggcaatcctctctagctagctcagcatccgaggacgggacttgcattgcactatggatgctgctcttatgcctctgctcgtcgtctccctcgtcttctgcctgctggcggcttccccggcggcgtccgcggcgcgggccttcttcgtcttcggcgactccctcgtcgacaatggcaacaacaactacctgctgaccacggcgcgcgccgacgcgcccccctacggcatcgacttccccacgcaccaagccacgggccgcttctccaacgggctcaacatccccgacatcatcagcgagcacctcggggccgaacctgcgctgccgtacctgagccccgagctccgaggggagaagctgctcgtcggcgccaacttcgcgtcggccggcgtcgggatcctcaacgacacaggaatacaatttgtgaacattatcaggatcggcgaccagctgcagtacttccgggagtaccagcggaagctgcgagccctcgtcggcgagccgcaggcgacgcagctcgtgaaccaggccctcgtgctcatcacgctcggcggcaacgacttcgtgaacaactactacctggtgcccatgtccgtgcggtcgcgccagtacgcgctcccggactatgtccgcttcatcgtctccgagtacaggaagatcctctcgaggctgtacgagctgggcgcgcggcgcgtgatcgtgacggggacggggccgctggggtgcgtcccggccgagctggcgctgcacagccagaacggcgagtgcgcggcggagctgacgcgcgccgtgaacctcttcaacccgcagatggtggacatggtgcgcggcctcaaccgcgccatcggcaccgacntcttcgtcgccgccaaccacctaccgcatgaacttcgagctacctcgcaaacccgcaggacttcggggttcacgaacgtgcaggtggcgtgctgcggccagggcccgtacaacggggatcgggctgtgcacggcggcgtcgaacgtgtgcgacaaccgcgacgtgttcgcgttctgggacgcgttccaccccacggagagggcaaaccgcatcatcgtcgcccagttcatgcacggcgacacggactacatgcaccccatgaacctcagcaccatcctcgccatggaccaggagggcctctagactatagcttgatcagccggacacgattatacgtacatgcgtgatgtgtctcacgtgcctagcacgttagtcatgttttggatgatggcagcccaatttgccaataatattcgtgcctcgatccaagtttcactaatgtgtcactcacgccttaaaaagaattagtgactggctatggttaatcgatccgtgttatatgtgctccgcgagcattcgtttgttggtggtgttggttcgttgtcaagcgaaatggccatttgcagccgtggcgtcaaaaaaaaaaaaaaaa

SEQ ID NO: 11483 - DNA, 1561 bp, Zea mays
cctcgaggccggccgggaaaccagattcctctccatcgcactccgcctccctccgcctcccttggatcacctccccgtccccaacccaacgaggcaacgagtccccaacgccacccaaagtccagttcacccacacggccacacgcgcgctcaccggccgcctagcgcgctctgccccccacggaaatctgcagcgaatagaaaggatttccatcctttccaatcccttccaattctttacggcgtccctcaatccccctattaggatccaggttgacccgcattgcccgagccagtcggtttccgtttttggaatttttgtttccacgtgctgccgccgccgctcctaggttctggttacaagcgtggaagacggcgagctatatggcgtgcaatcgcggcgtgaaggagcaggaggaccccagcgcggcgtctgcagccccagctccggcggctgtggctagggcgagggcggcgcggcctccgaggccaaggagccgcaaggggctcggcgtgcggcacctgctgaagccctgccgattccttgcagctgtccagagggcgaatgccagggtgagggaagcgggggaggcgaccctcgtggcagcgcttgcggcggcccaaaaggagagcgagagggagaacgaggtggtggccgatgtatgcggcgggtggaagagtgaggatggaagtttaaattgtggatactcaagcattagaggcagaagggtaaacatggaagacttctatgacataaaatcttctagagttgatgataagcaaataaatttttttggagtatttgatggtcatggaggtacccatgctgctgggtatttgaaacaacacttatttgaaaacctcctgaaacatccagcattcattggtgatactaagtcagcaatgagtcagtcctataaaaaaactgacgcagatttcttggatactgaaggcaatattcatgttggggttgggtcgactgcatcaacagcagttttgattggcaaccatctgtatgtggccaatgttggtgattcaagggctgtactatcaaaggcaggcaaagctattgcactctctgatgaccataaaccaaacagaagtgatgagcagaaacggattgaggatgctggaggagttgttgtttggtctggaacatggagggtaggtggtatacttgcaatgtctagggcatttggcaatcgtttgttgaagcagttcgttgttgcagaccctgagattcaggatctagaaatagatggtgatatggagtttcttattttggccagtgatgggctctgggatgtggtgccaaatgagcatgctgttgcatttgtgaaggacgaggatagccctgaggctgcagcccggaagcttacggagatcgccttcaggcgtgggagcaccgacaacatcacatgcattgttgtagaattttgccacgataagatggttgatggttctcccccgtcaaccaataagagttgacttcatcattcgttttttaattatccatgatgctgcgcctctcgaagtatggtctcgaaaaaaaaaaaaaaaa

SEQ ID NO: 11484 - DNA, 738 bp, Zea mays
ttttttttttttttttgactgaaatgttaaattttatcagaagcataaggagtagtttacatttgcctaccaagaaacaatgcgatttacaagttacaagggctcggcctagctgactgaacaactgaatttggtgcaagctgtcccaagaactgcgcgtttttatgagccattggtccattgctggcaggccggtggccgtcaatgattcgagggctccacggctgtcctgaagagcaggatgtagaccttatcgacggaaaaatacaagaaaccgccccgggcgtgcgtgacatacgaaccgaaactcgtccccacgatgcagtgccaagctggcccgtaagcagtatcaaactccttcttgagcgccagcgcgaggcgcttgggctcgagccggcgcgggaagtgcggcatcgccgcgagctcgtcgcgggcgcagcggaacgcgcggcgctgcagcgcgggcggcatgtcagccgccaccaccctcaccaccgccttcctctcctcgccgctgtccgcggccaaatgctgcttctccgaggaggctccgagcgccccctcggcgtccgcgtcgccctccgcaagccggcgctcgacgcccagcagcgacctgatgaccccgccccggcgccccgtcacgtcgccggaatcctgctgctccctcatgctacctcccgccgcacctgactccgttggccgtgcgctgtccgttttcctctagcgtcgtgcagcgtt

SEQ ID NO: 11485 - DNA, 1714 bp, Zea mays
tcggttcccgcgacctggagcctcctggaaccaggatagggacagagacggagccacggtcgcacagagcagtcttcgctccggccacggccaccgggagtagctctggccatgaggacctcaacggctacttgtgctatcctccctccgcctacctgctcctcccttcgtttcccgctccgcagcttcatcggtctccggtggtccgccccccgtttccaggttagggagcgagctggtgcgtccgtagcggttgtcaatggcaagccgggatgcagcttcagactcggagtacctactttaaatgtttgtcaatctcgccaaaggtctgttgtcattagaaatgaacatgctcaaaatgctgaccttccacgaaaatattcaaaaagagagaagaaaccatttcctatcccagtgctggagttaaggcgccgagcaaaggagaggatgaaggcagcacaagggaaaccgaaacaaccaatgcctccaccaaaaaacggaatgttagtgcgtagacttataccagttgcatacaaagtgtacaatgcaagaattttgctgatcaacaacttgaagaggcttatgaaagtagtaccagtaaaaggctgcaagtattgcagcgagatacatgttggatctgttggacatcctttccgaacatgccgaggaatgtcatcagatcaacgtagaggagaacatgactggggaagtactctagtggaggcagttttcttacccgtcgaagcctatcatctagaggaccgtctagggaatcgcattcctcatgatcagaggtttactgtaccccgcattcccgctctcgtggaactttgcatccaagctggagttgacctccccgagtaccccacaaagcgtcgaagaaagcctatcattaaaatcggaagaaaagagtttgttgatgcaaatgaagacgacctaccagaaccagagcctgacagatttaggcagccacttcttgaggaactacgttatgatgagattattgctccatctagcccagaggagacggtggctcttgccgaggagacacttgaagcgtgggaggccgttcgggacggagccttgaagcttatgaagggctatgcagtgagggtttgtggatactgccctgaggtgcatgttgggccaactggccacaaagcacggaactgtggagcttttaagcaccagcagaggaatggacaacatggatggcaagcagcggtgctcgatgacctgatacctcctaggtacgtgtggcacatgccggaatcgggggaagaactgcagagggagctaaagaccttctacggtcaggcaccagctgttgttgagatgtgcattcagggtggcgcaaaagttccggagaagtacaaagccactatgagactagacataggaatcccctctagtttgaaggaggctgaaatggtcgtctgatcctcccaatgatctgggcagatttgatcaacctgtaattgagttttttcttttgtgttgaaaagatgatgtcgtcaccaagctccatcgtggcttgacataggttgaatctgttagccaatgtgtatatatcagaactcagatgagataattctcgttcggttttctttcagtccgcaaaaaaatgtttgtgtatttctttagaaacaaatgtgctatactgtgctgcacctacctcttgatcacaggcagtataattcatgccttgcaaaat

SEQ ID NO: 11486 - DNA, 1656 bp, Zea mays
gccggagtttgtgttcccgacctccagcctcccggccccgggatagggacggagacggagccacggtcgcacagagcagtcttcgctacggccacgggagtagctctggccatgcggccctcaacggctacctgtgctatcctccctccgcctacctgctcctcccgtcgtttcccgctccgcagcttcatcggtctccggtggtccgccccccgtttccaggttagggagcgagctggtgcgtccgtagcggttgtcaatggcaagccgggatgcagcttcagactcggagtacctactttaaatgtttgtcaatctcgccaaaggtctgttgtcattagaaatgaacatgctcaaaatgctgaccttccacgaaaatattcaaaaagagagaagaaaccatttcctatcccagtgctggagttaaggcgccgagcaaaggagaggatgaaggctgcacaagggaaaccgaaacaaccaatgcctccaccaaaaaatggaatgttagtgcgtagacttataccagttgcatacaaagtgtacaatgcaagaattttgctgatcaacaacttgaagaggcttatgaaagtagtaccagtaaaaggctgcaagtattgcagcgagatacatgttggatctgttggacatcctttccgaacatgccgaggaatgtcatcagatcaacgtagaggagaacatgactggggaagtactctagtggaggcagttttcttacccgtcgaagcctatcatctagaggaccgtctagggaatcgcattcctcatgatcagaggtttactgtaccccgcattcccgctctcgtggaactttgcatccaagctggagttgacctccccgagtaccccacaaagtgtcgaagaaagcctatcattaaaatcggaagaaaagagtttgttgatgcaaatgaagacgacctaccagaaccagagcctgacagatttaggcagccacttcttgaggaactacgttatgatgagattattgctccatctagcccagaggagacggtggctcttgccgaggagacacttgaagcgtgggaggccgttcgggacggagccttgaagcttatgaagggctatgcagtgagggtttgtggatactgccctgaggtgcatgttgggccaactggccacaaagcacggaactgtggagcttttaagcaccagcagaggaatggacaacatggatggcaagcagcggtgctcgatgacctgatacctcctaggtacgtgtggcacatgccggaatcgggggaagaactgcagagggagctaaagaccttctacggtcaggcaccagctgttgttgagctgtgcattcagggtggcgcaaaagttccggagaagtacaaagccactatgagactagacataggaatcccctctagtttgaaggaggctgaaatggtcgtctgatcctcccaatgatctgggcagatttgatcaacctgtaattgagttttttcttttgtgttgaaaagatgatgtcgtcaccaagctccatcgtggcttgacataggttgaatctgttagccaatgtgtatatatccgaactcagatgagataattctcgttcggttttctttcagtccgcaaaaaaaaaaaaaaaaaaaaaccccggaaggggccccg

SEQ ID NO: 11487 - DNA, 1711 bp, Zea mays
ctatagatggacgaatgttatccggagaccggagagaattgaagactcaaccggcagccacgtgatccgccgacagcaacgcctcattgaattcggttagatgagtgagtctagttttggttggctttgcggttgacgacgaccagccagctggataagattccattttatcatggtgacaaggcattgttgccgtgagcgtgacattgttgtgcgccttccactacagtaatggaagcaggcgccggggaagcagcaccaagcgcgccgcgcagactgaccctgccgtggaaggtgcggctcctgctcctctgcctcgatgtcgtcgccggtctctcgatgcgtcgcgacggcaccatcaaccgctccatcttcaacctcttcgaccttcgtgccaccgccagcacgcgcccggacaggcagggcgtccggtccgccgacgtggacgcgtcgcgcggcctgtgggcgcgcgtgttctggccgtcgccggagtcgtccgcggccccgctcccagtcgtggtatacttccacggcggcgccttcacgctgctctctgcggcctcgtacgtctacgacgccatgtgccgccggttctgccgcgagctgggcgccgtcgtcgtgtccgtcaactaccgcctcgcacccgagcaccgctggcccgccgcgtacgaggacggcgtcgccatgcttcgatacctcgcctccgcgggtctccccgacagcgtcgacgtccccgtggacctctcccgctgcttcctcgccggggacagcgccggcgccaacatcgcccaccacgtggcgcagcgctggacgacggcctcctccccgccgcggtccatccccgtccacctcgctggcgccatcctggtgcagccgtactttggcggcgaggagcggacggaagctgaggtcaggctggatgggaacgtgccggtggtgaccgtgcgtggctcggactggatgtggcgggcgttcctgccggaaggcgccgatcggaaccactccgccgcgcacgtgacagacgacaacgccgacctggcggacggctttccgccggtgatggtggtgatcggtggcttcgacccgctgcaggagtggcagaggcggtacgccgacgtgctgcggaggagggggaaggaggtaagggtggtggagttcccggacgccattcacactttcttcctcttccccgagctcaccgatcatggtacgctcgtggaggcgatgaaggcgttcatacgcgagcaacgcatctgatctaattctgcctcacggtcacggatcaccaacctacgtggacctacatggtccgtgcaaataattttgtttcccatgcacgtaatggtccctacatggtccgtgcaaataatttctctataaaccactattcaagtctcccatatatttattcagttcatcgagcatctcttctagatcttaattctggatcgtcatgtacattatgttatggattcatagttgcctttttgttctacagcaccatcgaattcatcccaatgttgctcatatgtattgtctagaactactattggctgagtatctcaaacctccgctagccaactctgttagttgtattaccaacaataacctccactggccgacccagttgtagtaccaatacccatcgacagctcaaacatccacaaagcacaaaaggcagaaccatcaacagtgatcatatttgttttca

SEQ ID NO: 11488 - DNA, 1162 bp, Zea mays
cccccctcgagttttttttttcctttttttttttttttttttcgcacaaactttctttctcacttttacttccattctgtctgtagatagaggtgtcaaactgtcaactacatccacgcaactaggtcaatacaatcatgtactagtagtattgtagtagtattctgcagcgacctgtctctgcagactgcggacatactaggagacccataccgagacacccacgcatacacacacacctctatgactctctatcctggcttgggatcttgcactagtagcagttaaaatagcttacagacaactgccatggtcatgtgcacttctacagtcactgggcctccctagtggcctagtagtatacaatatctgatgaatctcgcagcaggctgtagctgtactgctctttacatgtgacatgtggctggtaccagaatcgtggattaacctcgcatttagtataataaacctagtgggggtggggtgggttggggggcctgtcattgtagagtacatcaaggacagtgtcacagtaacatctttgtgctcatgttacctgcctgctactggtaaacattaagtacagatactatttatatatctctctctaaagactagggtgacactggattatttgtatatataatatatatatacttatatctggcaatactgcatatgctgccgttttcttaatcaaggctaatggcatcttcttctcttgtggtttagtagaactatcctctaaaaaaggtactagaacataagggagctaacactatgctgacactcgactcctttttttttccctatatattccaccatcgcttttcttggcttctagtattctatgattaggttggggggtataactcgcctacaatggtgaactttacatccccatggctccgtgatcggaggacagcctgtgcatggggaagaagtaggagctgggcgaagggatttccaacgcgggggggcggagatggttgcttccaccgtcgatcttgctcccgacaccggcatccacgccaacacgggacgcggcggtgctctcggtctccgtggcagtgaaactgtcatgcaaaagcgcagcccattcgcatcccctacgaaatctgctgcgcttttgcatggcagtgaaactgcctcgtgccgaatt

SEQ ID NO: 11489 - DNA, 968 bp, Zea mays
  misc_feature (64)..(64): n is a, c, g, or t
  misc_feature (85)..(85): n is a, c, g, or t
ttttggagataaatggaggggcaaagcactcacttgcttcccattctttctgtaggggtgtcanctacactaggatccactcaancagatgggttcaaaggcacaacaataacatataatcatataacagtagtattttgcagtaggtgtcaaagccatacaaggccacaagcaaaacacacgcacacacgtctctttctctctatccataggaggacccagcttgggatcttgcagcagtagcagtaaaaatagcttacagacaactgccatggccatgtgctctttttcctgtcactgggccgccctagcatacaaatgtccgcgtcaggctgtagctgtactggtattacatgtgacctgtggctgtcgctgtggctggtaccagaactgtggattaacctcacatttggtaaacctagtggaggtggctgtagttgtaggaccttgtcacagtaaaaatctttgggctgacgttacctgctactgttaaatactaagtacagatactatatatatactagaaactaggggattatttgtatatataatatatatatacttatatctggcgataatattgcatatgccgccgttttcttaatcaaggctaatggcatcttctcctcttgtggtttagtagaactatccactaaaaaggcagggactaaaagaacaaaagaaagtgggagctaacactatgctgacactcaactctctttttttttctcctatatatccaacatcacttttccttggcttctagtattctatgattaggctggggtatcactcgcttccaatgctgaactttacatccccatggctccgtgggcggggggcggccggcgcattgcattcggagagaatcatttcactcgtggatgacagaatgttcacggacataatcggcgccacggaaaagtagagtagagaggcctttccaacgcctcgggccgaattcctac

SEQ ID NO: 11490 - DNA, 1533 bp, Zea mays
gcacgagaccattacctagaacatcctaagacacgcaaggttgatagttgataccgcccgcgatagccgatagccatcccgatgcgctcgcgcccaaccgacctgactctacctgacccgggccgaaacagaaaggcgccgtctggtagtggtagtctggtagactggtagtagtagttggtttgttcaggcctcagggcaggggaccgcctcctcgaacaggccacagcccgcagcgcagggggtagcgaggagtgcgagaggaggcgagtgggtccaaacaccagagggaggggagggcaggcgaatgagcgaggaggcggcgcgggcgggagtggaggagtccatcgggcagcggcggcggcgggatgggcgcggggaggcggcggcggcggggcgggtgtgggagttcgagcgggatctggtggccggcgcgctgatggggggcgccgtgcacaccgtggtggcgccgatcgagcgcgtcaagctgctgctgcagacccaggacggcaacgccgcgctgctgggcagggcgcgcaagttccggggcttcgccgactgcgtcgcgcgcaccgttcgggacgagggggtgctctcgctctggcgcggcaacggcaccgccgtcatccgttactacccctccgtcgccctcaacttctcgctcaaggatctgtacaggagcatactgaaagatgctggaacctcatcagacaataagttcacttctattgctcttagcaacttctttgctggtgctgctgccggatgtacaaccctggtcctcatctatccgctcgacattgctcacactcgtcttgcagctgatatcgggcgtacagacacccgccagttcagaggcatccgccacttcatccagaccatctacaagaaaaacggcatcagaggcatatacaggggattaccagcatcgctccacgggatggtcgttcaccggggcctgtactttggcggcttcgacactgccaaggatgtcctggtgcctttggagtcccccctgtggcagcgctgggttgcagcccaggcagtgacatccatggcagggctcatctcgtacccactggacaccgtgcgccggaggatgatgatgcagtcagggatggaggtgcagatgtacagcagcacactcgactgctggaggaagatatacaggctggaggggatccggtcattctaccgtggtgcattgtctaacatgtttaggagcactggtgcagccgccatacttgttttgtatgacgaggtcaagaagttcatggacaggggtaggttgtaacagctatagaggggtttctttcacagaattttggattcgatatgggaagtgggattaggccaaaaggtgcaaggagcagcagctcgagcattttgtaactggatgctggtttcctcctgcttactaacctgctcgatgtaaccgagcctgaaggttctgactcgcgaacaatgcagcttgttcatttcacctcatctttacctcttcgaggttacatttatgggttgtttgttgcctgc

SEQ ID NO: 11491 - DNA, 1357 bp, Zea mays
  misc_feature (1)..(1): n is a, c, g, or t
  misc_feature (5)..(6): n is a, c, g, or t
nctcnnggggcccccggggccggccgggatgcagagtgcagtagaacggcatcagttacactagtagtgctcatctcgctggtactgctgagctgaccaccgccgatccttccaagatggcgaggcagggtgtcgtcgcttccatgcatgcgctggcattgcttctcggagcattcgcagccattcctacaggagtccaatccatcggcgtgtgctacggcgtgaacggcgacaacctgcccccggcgagcgacgtggtgcagctgtaccagtccaacggcatcaacctgatgcgcatctacttcccggacgcgaacgcgctgaacgcgctgagcggcaccagcatcgggctcatcatggacgtgcccaacacggacctcgcctcgctggcctccgacccgagcgcggcggccgcctgggtgcagagcaacgtgcaggcgttcccgtcggtcagcttccgctacatcgccgtgggcaacgaggtctccggcggggacaccggcagcatccttcccgccatgcagaacctcaacgcggcgctggccaacgccggcctgggcggcagcatcaaggtgtccacggcggtgcagagcgacgtcacccagggcttcccgccgtcgcagggcaccttctcgcagggctacatggcgcccatcgcgcagtacctgcagagcaccggcgccccgctgctgtgcaacgtctacccctacttctcctacatcggcaacccggcccagatcgacctcagctacgcgctcttcacctcgccgggcaccgtcgtgcaggacggcagcaacgcgtaccagaacctcttcgacgcgctcgtcgacaccttcgtctccgcgctccagaacgccggcgccggcaacgtcccagtcgtcgtgtccgagagcggctggccgtccgccgggggcgacgccgccaccgcggccaacgcgcagacctacaaccagaacctcatcaaccacgtcggccagggcacgcccaagcgccctggccccatcgagacctacatcttcgccatgttcaacgaggaccagaagacgggagccgagtcggagaggcacttcggcctcttcaacccggacaaatcgccggcgtaccccatcaatttctcctaattcctaaacaagacgccgaggtccattccaagacatttataaggcaatacacacacatagatatatacatacacatacatacgggagaaagtagaataaataaactgcctgcagtagaatgcaaagtgtattcatgtaaggcaactgcttcgattatttcctaaagatcaataacaagaagtacaattatttctaaaaaaaaaaaaaaaaaaccgcgcccccgagctcgggcggcc

SEQ ID NO: 11492 - DNA, 716 bp, Zea mays
agaacagaagaggagaaggtaccgcagccgcacgcacaggtcctgcggcatggcgcagtggagcagcgtggcccgagcctggaccggtggattgggcttgggccatgccgctgcggctcaccgccggcaccgtcccgggcggcgatgccgcggcgcgggcgtgcaaggaggaacggcggcaaggtcgtcggctgcgcgtccgtcccgcgggagcaggccgagctgccgccgcttgccgtcgatggcaccgaggaagaaggcgtaggcgggtgcggagcgtgcggcggcgcggggtgggtgctctgcgacttctgccagggcaagaagaacaacgtcaagtcggagaccggcagccgggtgtaccgccgctgccccacctgcaaggctgcgggcttcatcctgtgcccaagatgcagggtgtacaagtgcgtcaccttcccagagagcactgaatcgtgagcgtgtcatggtggtcgcacgtgtttgttccaaatccatgtatgagtctgcagaagagatctgtgtgaattactactattatcttctgaagatatttaaaggagaattattatattctgaccgtgtttacagtagaacacctgtctgtgcacgtataccagttttaatttcacacacacagatgctcgctcttccttcaaaaaaaaaaaaaaaatctggcgcccgccgacgcgtttcgatcgcctgacagaaaaaaa

SEQ ID NO: 11493 - DNA, 1530 bp, Zea mays
gcacgagaccattacctagaacatcctaaccggggtgtcatcaatcaaatactcagacaaccatggggcaccagcaggcgcagacggcaaggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgccagcgagatcccggcgtccaaccacgactacctccggcgggtcatgcgcacgctgacagccatgcgcatcttcgcggccagccacgaccccgccaaggccgacgacgcggccgccatctcctaccagctgaccccggcgtcccggctgctcgtcagcagcagcagcagcgtcgacgacgccgccggcgcctcgaaggagaacactactaccccgagcatcctccccaacatcgcccacctggtccgccccaacaccatctccctgctgttcagcatgggcgagtggatgaaggacgagagcgcggcgtccgtgtcgctgtacgagacggtgcaccggcaggggatgtgggcgtgcgtggaggacgacgcggccaacagggccagcttctacgagagcatggacgccgacacccggctcgtgatgcaggccgtggtccgccggtgcccgcacgtgttcgacggcatcaagtcgctcgtcgacgtcggcggcggccgcggcaccgccgccgccgccgtcgtcgccgccttcccgcacatccagaggtgcaccgtcatggacctcccccacgtcgtcgccgaggctcccgccggcaccgccggcctgtccttccacggcggcgacatgttcgagcacatcccgtcggctgacgcactcatgctcaagtggatcctgcacgactgggatgaggacaagtgcatcaagataatggagcgctgcaaggaagcgatcggtggcaaggaagcaggggggaaggtgataataatagacacggtgctcggatctcgggcagacgacgacgacgacgacaagacgtgcagggagacgtatgtgttggatctccacatactgagcttcgtgaacggggcggagcgggaggagcacgagtggaggaggatcttcctggcggctgggttccgtgactacaagatcacgcacacccgaggcatcccgtccatcatcgaggtcttcccgtgatgatcatggatcgagagtcgatcatatatgcatgtttgtacgtgtttgtgtcataataaatcgatcgatcatgttgtttaccctttttatttcggtatctagttgcatctgtgggcgggctaaaataaatcacggccggccgggcttcatcaagcccatgtatccagctgtgtgtaataatgcaatggaaaacgaaccaaaaagaatgcttccattccaaaaaaaaaaaaaaaaaaaaaaaaaaaaaaagaacgcaaaaaaaaacgacgccccgcgcgtccgcccacgcgtccgccacgcgtccg

SEQ ID NO: 11494 - DNA, 2284 bp, Zea mays
ccggccgggccggggtcatcaatcaaatactcagacaaccatggggcaccaggcgcagcacggcacggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgcaagcgagatcccggcgtccaaccacgactacctccgacgggtcatgcgcacgctgacagccatgcgcatcttcgcggtcagccacgacgaccccgccaaggccgacgacgcggccgccatctcttaccagctcaccccggcgtcccggctgctcgtcagcagcagcagcagcagcgtcgacgccgccgccgccggcgccggcgcctcgaaggagaacactactaccccgagcatcctccccaacatcgcccacctggtccgccccaacaccatctccctgctgttcagcatgggcgagtggatgaaggacgagagcgcggcgtccgtgtcgctgtacgagacggtgcaccggcaggggatgtgggcgtgcgtggaggacgacgcggccaacagggccagcttctacgagagcatggacgccgacacccggctcgtgatgcaggccgtggtccgccggtgcccgcacgtgttcgacggcatcaagtcgctcgtcgacgtcggcggcggccgcggcaccgccgccgccgccgtcgtcgccgccttcccgcacatccagaggtgcaccgtcatggacctcccccacgtcgtcgccgaggctcccgccggcaccgccggcctgtccttccacggcggcgacatggtcgagcacatcccgtcggctgacgcactcatgctcaagtggatcctgcacgactgggatgaggacaagtgcatcaagataatggagcgctgcaaggaagcgatcggtggcaaggaagcaggggggaaggtgataataatagacacggtgctcggatccccggctctcgggcagacgacgacgacgacgacaagacgtgcagggagacgtatgtgttggatctccacatactgagcttcgtgaacggggcggagcgggaggagcacgagtggaggaggatcttcctggcggctgggttccgtgactacaagatcacgcacacccgaggcatcccgtccatcatcgaggtcttcccgtgatgatcatggatcgagagtcgatcatatatgcatgtttgtacgtgtttgtgtcataataaatcgatcgatcatgttgtttaccctttttatttcggtatctagttgcatctgtgggcgggctaaaataaatcacggccggccgggcttcatcaagcccatgtatccagctgtgtgtaataatgcaatggaaaacgaaccaaaaagaatgcttccattccagcagctctctctcgcgtccgcgtgcatgtcatgtgtgagtgtgactccagctgaaacattttgcttggctctcggaggacggaaacataaatgatatctgtttgtagctagctcgctgctcgcctcgggactcgggtcgggtgatgcatgcagctcacggacgacgcacaagccaaccaatcaatgcctgagtaaagcctgtcctgcgaacacatgcaaacaacaacaaaaaaagctgcctgcgcgcggccaacctgtctgcgttcagctcgtgccctgtctggtttcttgtcagggtgacaagcaaggagatctaaattttacactgctatgggtatgtttggttgcctgacccagggcacaaccaggcccatttgaaacaacgtctcaatgtttggtttcgtggcccagcgcacgagcctgtctcaagcgagcgcacaaccaggcccatttcgaacgcggaaaagttgcttcgcaagtgagcctggctactcgcagccgccgcggctctagggttttctcctctcgccactcctcttgctctcgtcttcagacccctcgcagccggcgcggctctagggttctctcctctcgccactctcctctcgctctcgtcttcagaccactcgcagtcgccgccgcggctctagggttctctcctctcgccactctcctctcgggttctctcgccactcgcagccgccgcggcggctctcgcctctcgggttcactcgctctcgcctctcgggttcactcgcagtcgccgtgctcacgggctcgccgccgtcatctctctccacccgtggtgacgacaccgcgcccgtggacgagctcgatctgt

SEQ ID NO: 11495 - DNA, 1819 bp, Zea mays
tgataaggttcagagcgtctttgcttatgacctcttcttattcaagcgtataaacacacctcatatatagaagaagaggaaaaaaaatatctatcacatgaagctttttctgctgacatcattgatgaactcagctgacaacactgaatatgcagtgatgcaagcatatgtgcaagctgtcgggactagatcaagtggccgctcagcatattacattattatatatataataaattaataacccctggaccgatcgaatagatcgccacctccctcccgtcctcccctgtagaagatgctcttcatcatgcatgctttaccaacccattctgtttcatccctggatcgatatttaccgcggcaaattcttttttcccgctcctggcgtacctaccgtacccctgctatgctaacgctagtgtatatataatgctgaatgtatatgggaagagtgtcatcaatcaaatactcagacaaccatggggcaccaggcgcagcacggcacggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgcaagcgagatcccggcgtccaaccacgactacctccgacgggtcatgcgcacgctgacagccatgcgcatcttcgcggtcagccacgacgaccccgccaaggccgacgacgcgcggccgccatctcttaccagctcaccccggcgtcccggctgctcgtcagcagcagcagcagcagcgtcgacgccgccgccgccggcgccggcgcctcgaaggagaacactactaccccgagcatcctccccaacatcgcccacctggtccgccccaacaccatctccctgctgttcagcatgggcgagtggatgaaggacgagagcgcggcgtccgtgtcgctgtacgagacggtgcaccggcaggggatgtgggcgtgcgtggaggacgacgcggccaacagggccagcttctacgagagcatggacgccgacacccggctcgtgatgcaggccgtggtccgccggtgcccgcacgtgttcgacggcatcaagtcgctcgtcgacgtcggcggcggccgcggcaccgccgccgccgccgtcgtcgccgccttcccgcacatccagaggtgcaccgtcatggacctcccccacgtcgtcgccgaggctcccgccggcaccgccggcctgtccttccacggcggcgacatgttcgagcacatcccgtcggctgacgcactcatgctcaaggtatgtgtgtatgtatgtatgtatacatcatcgtgtatactattactccatataatatatactgataaacagttgtatatatatatatgatgctgcagtggatcctgcacgactgggatgaggacaagtgcatcaagataatggaccgctgcaaggaagcgatcggtggcaaggaagctggggggaaggtgataataatagacgcggtgctgggatctcgggcagaggtggactggtgtcgtcaagaggtgcaggtagacgtatgtgttggatctccgcatactgaccttggtgaacgggtcggagcgggaggagctcgagtggaggaggatcttcctggcggctgggttccgtgactacaagatcacgcacagccgaggaatcccgtccatcattgaggtcttcccgtgatgcattccatgatgatggttggatagtcgatcatatatgcatgtttgtgagcgttggcgtcat

SEQ ID NO: 11496 - DNA, 857 bp, Zea mays
cattgggaccctcgaggccggccgggcttcatcaagcccatgtatccagctgtgtgtaataatgcaatgggaaaacgaaccaaaaagaatgcttccattccagacacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcagtcatcaatcaaatactcacacaaccatggggcacagggcgcagacggcacggacgacaccgaggagctgctcgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgcaagcgagatctcggcgtccaaccacgactacctccgacgggtcatgcgcacgctgacagccatgcgcatcttcgcggccagccacgaccccgccaaggccgacgacgcggccgccatctcctaccagctcaccccggcgtcccggctgctcgtcagcagcagcagcagcgtcgacgacgccgccggcgcctcgaaggagaacactactaccccgagcatcctccccaacatcgcccacctggtccgccccaacaccatctccctgctgttcagcatgggcgagtggatgaaggacgtatgtgttggatctccacatactgagcttcgtgaacggggcggagcgggaggagcaggagtggaggaggatcttcctggcggctgggt

SEQ ID NO: 11497 - DNA, 2064 bp, Zea mays
tatcttaatttttagagtattaatgtgagacatctcgtgggaaatgttctaatagatgatggtaaaagtttgacacagtttatatccattcagcatttcagcagcaccatccacttggatggcgtctgcaataatgagcagactgccagactgtccccgcccgcttccgatccaagcagcaacgacaagttggcaaccacgcgcgtctctcgtgcttctgcttgcatcacggcgctgtaacctgcctgggcgatccatccatggcgtcgttagccaccagcacggccgccgccgccgccgggccacgcccacgcccagaccggccgcacgtcgtgcttgtgcccagccccggcgtaggccacctcatgccgatggccgagctggcgcgacgcctcgtgtcgcaccacgccctcgcggccacgcttgtcaccttcaacctctccggggaccctgacgcgaagtccgctgccgttctgtcctccctccgtgcagcaaacgtttccaccgccacgctccctgcagtcctcctcgacgacctccccgacgatgccagcatcgagaccgtgctattcgaggtgatcggccgctccatcccacaccttcgcgcttttctccgcgacgttggcagcaccgccggcgccccgctagccgcgctggtgcctgacttcttcgccaccgcggcgctgcccctcgcctccgagctcggcgtcccggcgtacatcttcttcccctccaacctcagcgcgctctccgtcatgcgaagcgccgtggagctccacgacggcgccggcgccggcgagtatcgcgacctcccagaccctctcccgcttcccgggggcgtgtcgctacgccgcgaggacttgccgagtgggttccgagacagcaaggaatcgacctacgcgcaactcatcgacgcgggccgtcagtaccgaaccgctgccggcatcttggcgaacgctttctacgagatggatccggcgaccgtggaggagtttaagaaggcggctgagcaaggtaggttcccgccggcttatccggtgggcccgttcgtccggtcaagctccgatgaaggctccgtatcgtcgccgtgtatagagtggctggatctgcagccgacgggatccgtggtgtacgtttccttcgggagcgcaggcacgctgtccgtggagcagacggccgagctcgccgccgggctggagaacagcgggcacaggtttctctggatcgtgcgcatgtcaagcctgaacggcgagcactccgacgacatgggccggaattactgtgacggtggcgacgagaacgatcccttggcatggcttccggaggggttcttggagaggacccgcgggcgtggcctcgccgtgtcgtcgtgggcgccgcaggtacgcgtgctgtcccacccggcgacggccgccttcgtgtcccactgcggctggaactcgacgctggagagcatctcgtccggcgtgccgatggtggcgtggccgctgttcgcggagcagcgggtaaacgccgtggacctgtcggagaaagtgggtgtggcgctgcggctgcgcgtccgcccggacgacgggctggtcgggcgcgaggagatcgcggcggtggtaagggagctgatggagggggaggacgggcgcgccgtgcggcgccggacgggggacctgcagcaggcggctgacctggcgtgggcgcccgatggctcgtcgcgccgggcgttggaggaggtcgtcagcagatggaaagcgggggctattcgcagagcggcggtataacctggtggatttgcttgcttttctcttggattttgttaagaaaataataacacttctgctatatttcagctgatgatatcaggcagcacacttgtctaataattatatgatttatctttacatcatactaacatatttaatatttttctctaacaatatgaaccttgtaaattgttaatggtcaacaagtttaaaataatttaacccaaacgatttttttcataaaggataaagaaaaactacgtcgtccgaagaaatctatttatggattaaaataagcgtcgagacaggg

SEQ ID NO: 11498 - DNA, 2909 bp, Zea mays
accataggtacatgtcactgacactagctcctcgacccttcttacgatttggaaaattggttcgagggtttctattgatcgatctcccaaatgttaacacccttttactagtgtatcccatctaggttatcctcttcaatgcatgtgtcatgcatacctattgacaatttagatgtatcccgatgatggtatactaaaggacctagatagctagagggcgatgaatagcctctaaaagctttctacaaaactaacagatcgttatagcctataaaattttaattttatataacactatcatgtcattaactagtgtcagtataatatttattttataatttgttatttattttggggtcccgtgctgtccttgtccgactataaaaacaattatagattattaattgtctttgtactaacataaatcagattatagttttgtttaaggccatgttcgtttttcacggattggaggctcgaaacggttcatggcctgattgtttctctaatttatgtaagttttgataagttggaatggatcttagtcctatcctagacaaacgaacagaccctaaaggatttttcattcttggaactgagaagttgtaaattatgtctacagaaattacaacaaactaatatataattttaatatataataactatgtcaaaaaaactaaaattcaggcaccaaaattttagtaagtcctttaaattttcctttttcatatctacgtggcgcgacgaaaaatacccccgagcgattattgttttgagaaaaaaaatatttctaaacgagaaatcgcagatacgacgaggcaagatcattggaaatctcgtgctgttgtgccatcttcgggtgaggtcgatggcgccaaaattgctggcaccgatggggcggctcctgcaaaacggcttgacatctccaacccaaatttttccaaggaatgcactgggcatccttgccttctggtgttcggtgctcgtggatgagcatagagaggctgagattgtgcatcgtagaagagatcaaaatataggtttacccatatgttctattctagaaaaaaccaagcttacaaaaatatgtcctcacaagtgacaacatcagccaaaatgtttggcaaattttgactgaaaaccctagaaggaaaaaggaacctacttgcggaaagaaagaaaaaaacgccctcccatggctatataaattatgtgcacctcgacacttctactcaggccacacactctatttcctacaccattcatgcggtgcggcccgcccgaagtccttggcaggcagctagcttagcacgcacgtcgtccatggcgcccacggaggaatcggttgctgatacgccagcgccaccgccgccgccacctcacttcgttatcgtccccctcgtggcgcagggccacaccatccccatggtcgacctcgccctcctcctggcggagcgcggcgcgcgcgcgagcctggtgacgacaccgctgaacggcgcacggctgcgtggcgtcgccgagcaggccgcgcgcgccaagctgctcctcgagatcgtggagctcccgttcccgacggacgttgacgacctgcccccgggcatcgagaacatggaccaggtcacggacaacggccacttcgtccccttgttcgacgctctgcagaagctcgccggcccgctggaagcgtacctgcgagcgcaggcgccgcgcccgagctgcatcgtctccgactggtgcaacccgtgggcggccggcgcggccagaagcctcgggatccgccgcctcttcttccacgggccgccgtgcttctactcgctctgcgacctcaacgccaccgaccacgggttacgcgagctggccgcgggcgcggcggcggctgacgtcgacgacggggggcaggagaggttcgtgttggatccccggccggatcaacgagcgacgagtacagccgcgacggcgaacgcagacaggcgcggtgactgcggcgagagcgaggaaggctgagcgcgcggacacacacaggttagaacagattatttttgtctgcgcaatgtgccgcagcttttctgggttttttcactgaataaatgaacggtgcttacacaggcttgaaagccctctaccccgtcgccatcgtgccccatgatctccaccattttcggatcacgcagatcatgtgcatgcgcagcgcgagtgcgacggggtcaacaaacaccaaggcggcttgtggtgccaggcacagcactgatcacccacaaagctacgccactaagactagataacgtaaacacaaatgttccaactagattacacgtgacaaaccttattcagactaacatatcacccctttaatcttgttggacttgaaccatccctagtcttgatctcagttccacaagtctgattcggctcaaaggctttgtcaggatgtctgcaagttggtgttcagttcccacatgctccacatccactatgcctttgtcaatgcagtcacgaatatagtgatatcgtgtatcgatgtgtttgcttctgtcatgatacacggggtttttgctcagctcaattgcagacatgttatctattaacagtctgaacttctgaggattcttatccatgatgtctgctatcagcattctcagccatacaccttgacaagctcccaatgcagcagccacatattcagcttcacatgatgacagggctacaaccctttgcttctgagaggaccaagtcaccaagttatctcccaagaagaatagaatacctgaggtactttttctgtgcactaagtcacctgagcaatcactgtctgtgtagccaagcaatgtataatctgctgctgcccccttcttgaaattcactcccaggttaagtgtacctgccacatatctgagatattcttcactgca

SEQ ID NO: 11499 - DNA, 934 bp, Zea mays
ccctgcggcccgccgggggcccccgggcgtccccggagtctcactccaaaccaaagccatcggaggagcagctggacgaccatggcctcgccgctgctcaagtcgcactctcagctcgccgccgccgccgccctgcactccgtgaggagagccgaccgctgccctgcgacaatacacctgggcaagttccatgaccacgggctcaggtccggccgttctaagagatccggttcagcgaaggtgggcgccttcccgtcgctggacgtggtgccgctgatggtgacgatggtggagcacgtggacatgtcgcgggactacgtcgtgaccaagtccatctggcatctcagcgacgcagccctcaagagcgtctataccttctacgccatgttcaccgtctggggagtctgcttcttcgcgtccatgaaggatcccttctacgacagcgagacgtacaggagccagggtggcgacgggaccgtgcactggtactacgacaggcaagaggacctggaggcgtctgcgagggaggagctgctgcgggaggagctgctcgaggagattgagcagagggttgggggcctcagggagctggaggaagcgagcaaggaggagcagctcacaaagtgatcacgcgggcgaatgggctactcatcagctctctatctgagcttcgttagcaaataagttcagacttctctttactgccatgctcaagtctgtatatggccaaaacccaaaacgattgatcaactgcgctactgcagtgcaatagcaggatacgtatagttttcttttcaagggaaacaggaggggagtgcagtgcacccccgcccatactgcatgttattaataaaagaaagttatttacaaaaaaaaaaaaaaaaaaaaagcctaaaaaaaaaaaaaaaagccgtaaaaaaaaaacaaacaaaat

SEQ ID NO: 11500 - DNA, 1222 bp, Zea mays
  misc_feature (79)..(79): n is a, c, g, or t
gggtacctcgaggccggccgggagaccattcatccatactctcgatcggaaaagaatcaatagaaggagaatcggacgnatatctttttcgaaacaaataaaaaggaaaaaaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggctgcagttactaattcatgatctggcatcagcgagccaaacatgcccgtccgcccagtctcactcccaaaccaaagccatcggaggagcagctggacgaccatggcctcgccgctgctcaagtcgcactctcagctcgccgccgccgccgccctgcactccgtgaggagagccgaccgctgccctgcgacaatacacctgggcaagttccatgaccacgggctcaggtccggccgttctaagagatccggtttagcgaaggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgccatgttcaccgtctggggagtctgcttcttcgcgtccatgaaggatcccttctacgacagcgagacgtacaggagccagggtggcgacgggaccgtgcactggtactacgacaggcaagaggacctggaggcgtctgcgagggaggagctgctgcgggaggagctgctcgaggagattgagcagagggttgggggcctcagggagctggaggaagcgagcaaggaggagcagctcacaaagtgatcacgcgcgggcgaataccgaatgggatggatacgggctactcatcagctctctatctgagcttcgttagcaaataagttcagacttctttactgccctgctcaagtctgtatatggccaaaaccaaaaaacgattgatcaactgcgctactgcagtgcaatagcaggatacgtatagttttttttttcaagggaaacaggaggggagtgcagtgcacccctgcccatactgcatgttattaataaaagaaagttatttacagaatcaaaaaaaacaataaaaaaaaaaaaaaaa

SEQ ID NO: 11501 - DNA, 882 bp, Zea mays
attgggtacctcgaggccggccgggggtctgactacaaaccaaagccatcggaggagcagctggacgaccatggcctcgccgctgctcaagtcgcactctcagctcgccgccgccgccgccgccctgcactccgtgaggagagccgaccgctgccctgcgacaatacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgccatgttcaccgtctggggagtctgcttcttcgcgtccatgaaggatcccttctacgacagcgagacgtacaggagccagggtggcgacgggaccgtgcactggtactacgacaggcaagaggacctggaggcgtctgcgagggaggagctgctgcgggaggagctgctcgaggagattgagcagagggttgggggcctcagggagctggaggaagcgagcaaggaggagcaactcacaaagtgatcacgcgggcgaatgggatggatacgggctactcatcagctctctatctgagcttcgttagcaaataagttcagacttcttaatttactgccctgctcaagtctgtatatggccaaaacccaaaacgattgatcaactgcgctactgcagtgcaatagcaggatacgtatagtttttttttttcagggaaacaggaggggagtgcagtgcacccctgcccatactgcatgttattaataaaagaaagggtatttaccggagcc

SEQ ID NO: 11502 - DNA, 3887 bp, Zea mays
  misc_feature (2323)..(2323): n is a, c, g, or t
tcgcaactcccctccaaagccagcacgagagcaaggtcccctgatcgccgccgcttccctcgccccaccgccccagcaccacctgctgacctgcacatctccaccacccgtcctcctctgcgggttctccgcaggacgcgacccttggccgcggcattcgcccgaggaatcgccgctcccgcgaggcctccgtctctcgccgtgcccggatcccccgagctgccttcagggtgcaagatctcttccgtgatccggagccttcaccgtttcctcctctctgatcttagctcgatatcggagcgactggcccgagcttctcttaccccatgggcggcggcggcgggttccggggcagctgcagggttggtgccgtgctgcttttctccgcctgggtcgctcttgcagctctcagccgcttgctgcgtccggtgcccaatggctgcgtcatgacctacatgtacccgacctacattcccatcgccgccacgccccggaacatctcctcagatagatatggcttgttcctgtaccatgagggctggaagcagatcgacttcgccaagcacattaggggactcaggggcgtgcccgtgctctttattcccggcaacggaggaagttacaagcaggttcggtcattggctgcagaatcttttcgagcttatcagaatggtccacttgagcccaccttttatcaggaagcatctagtagtttaccaggagatggactcaacaatttttctattccttcacggtatggccgcatgttggactggtttgctgttgaccttgaaggagagcactctgctatggatggtcagatacttgaggagcatactgaatatgttgtctacgcgattcataggatccttgaccaatacaaagaatcacatttggagagatcaaagggtggtgctcaatcctctcctgacctgccatccagtgttatacttgttggccattcgatgggtggttttgtggctcgagcagctgtagtccacccaaacctgaggaaatcagcggtggaaactatactgacactttccagcccacaccagtaccctcccatcgcacttcagccatccttgggtcatttcgttgctgtcgctcccatgtcaatgaagaatggagaaagggatacaagactggtgtatcacatgcaatcagttcaaaattatctaatgtagttgttgtctctgtatcaggtggcattcatgattatcagattaggtcaaggttggcatcattggatggaattgtgccttctactcacggctttatggtaggaagctccagtatgaagaatgtttggttatccatggaacatcaatctatcctatggtgtaatcaattagctgtacaggttgcacacactcttcttagcataatagatcctgttgacaggcagccattttcaagcacacaaaaaagagtttttgtgttcacaaaaatgctccaaagtgcagttcctcagtctctgagttcaatgactcatgttcctgcttctctgtcacgaaatttacctgccaatgagaatcaggatgctggcgaactacacaaaaaagattcactttcttgcccatcatccactgaatggactagtgatggccttgaaaaggacctgtatattcaatcaaattctgttactgttttagccatggatggcaggagaagatggttagatattaaaaagctgggatcaaatggcagaggacactttgtttttgtaacaaatcttgccccttgttctggagtaaggattcacttgtggccagaaaaacatcattcgcctgtgcaaaatgaattacctgccagtaaaaagatagtggaagttacatcaaagatggtccaaattcctgcaggacctgctccaaaaccaggttgagcctggcagtcaaactgagcaaccacctccttctgcatttcttctactgagtccaggagaaatgagtggtttcagattcatgactatatcagtagcacctcgaccgacaatttcaggtaggcctcccccagcagcctctatggcagtggggcagttcttcagtcctgaggaaggggcaagttcattttctattggtacaataatccgctccagctttgctcccaaagaaatatttctgttggaggatcacccattggctctaaacttgtcattttctgcaagccttggccttctaccagtaactttatcactgaaaactgccggatgtggaataaaaaatcctggtgatcaaatggaagctcggccgggtaacctttgtaaattgcggtgctttccgcctgttgccttggcatgggattctgtatctggcctgcacantcattccaaatatatactcaccacgcgtccgggttgattcatcacctgccttttgggattcacctgaggggactgacaaaactacagtactgattctggctgatccacactgctcatacgaagtcacttctcgtgcttcactaagtgatgcggcaagcagattctttttgttgtactcatcagagattcttggtttcatggtggccataatgttttttggaattatgcgacagacttcagcatgggaatgtgattcttctatgccatccattttgtcagccatagagtctaatcttggactcccaaaggcattcatgtttctttgcttcatgccaatacttgtattttgtgcctttttcattttcacggcggagcaaaaaccaccatttgggaccttcttattggttactctgatctgctacatagttgctaatggtttcacaattttgttgatactaagttcgaaattgcttctgtatgtggttgccattctacatgtctttactaaaagacgatggcaatcatgggggaatggtgttcaatcagcatttcttggtcaattcctcagtttctcctcgtttcagtcagtgaagattgtgcagatgcttaggaacaatccaaatataattgtagcagttgctacattaccactcgtctgtttggttcatccagccattggccttggtctgctacttctctctcatgctttccatgctcattcaaatctatgcagttttttagcagcttcttttcgtagcatcactcagaaaaaggacctgtacaagtccaagatgggcgatggttcagttctgctatccaaaagtaaatccgatgggctgcagcaacttctgccaatggatgatagcccaacagcttcaaaaagttttaccgacagccaactagaactgtttgattatcggcatggcgtcatgatcttgcatcttctaagcacactcatgtttgtgccttcacttgttgcctggctacagagaattggtatgggacaaaattttccctggttcattgattctgctatttgcgttggtgttatactgcatggactttttggatcccaaccaaatgtcagctgctgcatatttttcaagttacctggcaggagaggccgtgaaattggtctgagtttcctctacctcgtgggtggctattattcctttgtcagctccatggcgttggcaccttatagggccttgtatgccatggcgaccattggttatatatgtttcatttccagaattctcgagagaagaaatatggtaaggggtgacattaactctaggaggactcggaagcactcacacagacactgacacaccacagaaagtgtgatttctttaaaattatttgtaagagatagagaatagggttgaggaacctttcctccaacctaagttatctccttttttgtttttttccaaatcttgcttatgtgcatgtgattgtgtacggccatggttttgaaagttgttatcggatatggttatcctcggtgtgtggggtcttcataaattgcatcaagaatagcaaatttctaggtgttgtgcct

SEQ ID NO: 11503 - DNA, 2352 bp, Zea mays
ctgcatatgtgaggcattccccttcccctggttcatacgtttctgccaacgccacgtgtctggcttgcgcttgccgtcgtcaccgactcctggagctggaacatgcggccattgatgtcccgtgaagctcgcacgtccccacactcatgtccaccccctcctctccttcctttcctttgctgtatatattcgcgccccccccgcccccccggggacgacattgccaaggctccccaaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttctcgaccccgtcgaatttttttcctttctattcttctactatactactactatctgtttgtcgcgttgatttcttctcatacatcgatcgaggatcgactcatcgttttgtaattcctgcaatttgtaagtgtaatgacctatatgatttagtcttccttttaaaaaaaaaaaaaaaaaatttgcgcccaaaaaaaccaacgatgttgccgcccctccaatcccccacccgtatctggggatcacaaggacgccggcggcggcggggggaacggcacctccacgagcccttcgagcatcaggatgacgctcctcatgtcgggcctcgcctggggctccgcctgcgcgcaccacactgccaccttaaccgcccgctccacctccgtgacgtccacggcatcgtcgccgccaaccacccgccacacctcgccgcgcaccaaccactcgtgcgcgcactccatgagcgtccgctcctcgcctgcctcctccagctccatgctccgccggcacgtcacgatttccagcagcaccacgccgtagctgtacacgtccgccttcaccgtcacgggcccggcgccgcggtaccactcgggggccaggtacccgcgcgtgcccggacgcgtgggcggacgcgtgggcggctccgccgcctgcagcagcttggccagcccgaagtcggcgatcttggccgtccccgacgcgtccatcaggatgttctgcggcttcacgtcgcagtggatcacccggctgtccagctcgtcatggaggtagcgcagcccgcgtgcgacgtccagcgcgatgcccatccgctcgtcccaccccggcgggcccccgccgccgctgttcttgaacagacgctccgccagcgacccgttgctcatgtactcgtacaccagcagccggttggcgccctcgtggcagaaccccagcagccggaccaggttccggtggctcgtccgcccgatggcgcgcacctcccgctggaactccaactccccctcctccaccattttctccagccgcttcaccgcgatcgccttctcgccgccgctgtaaagcagcgtgcctcggaacaccgtgccgaacgcgccgcggcccagcggctcgcggaagctccacgtcgcgtgctccagctcctggtagctgtacgacctcaggggcgcctcctcgtccagcgcctccgccgcgtccggctccgcagtcgtcctccggttcgccaggaccagccgcaccgccgccacgagcgcggctagagacacgaacgtcaggatcccgatgcagaccagagcgacggtggtcgagcgcccgacgcggcggtccctgccgccgtcgagcgctgggccccccaccgcgttcttgacgaacagagtgaacccgccgcccgcgtggccgtaccggagcgggagctgctgcttggtgcaggtgccgtcgctgctgtcgagcagcacggcggcgcagaggcagtcggccacgcacgcggcctggcagtcggcggcgctcgtgcccgcgcccagcacggcgtacggcgtgtccgcccacgacatgttctgcatcgcggccatggccggcgccgcactagaaccagccgccgcgcagccgccggcgctcgaggtctcggtgcacccgagcgtggcgtcggcggcgtcgatgaagccgaaccccggcgggcaccggcagtcgggctgcgcgtcgcggctgaggacgcagtagctgttgaggccgcac

SEQ ID NO: 11504 - DNA, 2919 bp, Zea mays
  misc_feature (35)..(35): n is a, c, g, or t
  misc_feature (37)..(37): n is a, c, g, or t
  misc_feature (2120)..(2120): n is a, c, g, or t
taaaaccaaggataggaagaaggaaaaaaaggggnanaatgacggcgtcacgctcagctgagcgtctgagcggcaacacgttcaggaaccttcttgtggccgtttgtaagtcacggccgcccacttcacgtcgctgcggtgccgcctctaagcccatatcttttcggaaaaaaaaccccacaaggaaccatttcttctgatcttctcgcgtcgattgcttgcccagctcgcttcctcttcgtcttccttctcccccttctcctcgcctccggttaaccgccacagcctggattcgccttctcccgcggcggcgcggccggccgctgctgctgcgtcggcgcgtgagatggatgattgcggcggcggcggcggcaagaggccgttccagctggcgcggtcgctgacgtaccaccaccacccggggcaccggccggcggctgcgtccaggtggcggcggcagcaccagcagcatcagctcgcggacgagccgcgcgcgccccggccgcaggcggtggtgctgtacacgacgtcgctgcgcggggtgcggcgcacgttcgcggactgcgccgcggtgcgcgccatcctgcgcggcttccgcgtggccgttgacgagcgggacgtgtccatggacgcggcgctccggcgggaggtccaggcgctgctggccgcgccgcggccgcgccttcgcgctcccgcagctgctcatcggcggccgcctcgtcggcggcgcggacgaggtgcggcagctgaacgagaccggccagctccggcgcctcctcgacggcgcggccgggcaggacccggccttcgtctgcgacgcctgtggcggcgtccggttcgtcccgtgcgccggatgcggcggcggccgcaaggtgttcgtcgaggaggagggccgcgtcgtccgctgcgtcgagtgcaacgagaacgggctggtacgctgccttaactgctgctcttgatcgccgacggcggcggcgaacatcgccgttccattcgtgctgctaatccaagcggtagaggttgtggtagatatcaacaaaaggaagaagaagaagaagaagagggggctttcggtttcccggcgtggggttcgtgtgtgtccgatccgatcattttgaggatcggatttgctgctagtcggtggacaagaacagattgttcttggctcattgctgcaaaattgccatatggtgatggcgattggagaataagaactgggcttgtttgtatatgcatctgatgtatcaaagattgatactgctgctagttcaactaatgtaaatacttaagtttggtgtgatgaattgcttcatgccttgtccagttcatggacttgcttcatgcctttcttggtaaaattgctagagatctgaagctgtaggcagatcatttttcataaaaaaaggataattgtggcctcgctatcggtctcacacaacagctcatatgctaattacattcgaaggggtaacgggaggggtcaataaatagaagtatttcagaacgacaattttactctgaaatttgaagtctgaagattaggtgggctcgatgctctcacacactctgatttggagataatctcactagagtccatggccgacctgccgcgactagttttttttgtggggccaattgttttttttttggttattttcgtagtgatttattgaagacagctggagatggtcttattcagtgcctcctagtattttggggggatttgaagaactctttgatagaaaactcttagagatgcttcgcggctgcaggtcccagatgaagtgaagtaatcgggattcttccatcaatttctttcataataatatactacatccgattcttgaatatttattgtcagctagtttatttttaaactaaaacgcgataaataaaaaaacggagcgagtattttttttattgatacaactggaagtgtgatgttcttttgattcttgggtagttaggtgtctgtgctgtgtagctatattcagcgaagaaggcggtttgctaagatgacacttgattctgcttatgctagcaagcgtggatgagagcatgtaacaaggaaaatggttgacatatccattgggactgagaaaggataagatctttttttncctactttttttgcattgtaaaaaatccatgaatatgaatctcatcgacggtcaaatgcaagcagggatcgtcaacggattcggtgcccagtagtggagtcgtgccatgtcctttgaccggttgaccagtgcaggttacctaggcagttttggttcaccgagaaccatggccgtcgtagctgcaaataccttcagaacaccaactgggaggaaaacaaaaggagcagattgggctcctgcctcctggagctctggcccaagtaaacggagcagactagcagaggatggcttctagttgtaaactctggtatggctcacaaggtcgtgttatgctcttgtacggcaatactgtttttacgggcactgtcgcattttaacagcccaaaaacaaagaagaaaaaataaaaaaaacaatcaaataaacttcgaatggcctaaaattttgcacataccttatcaacaaagtttctaaagtaacccaaaattttgagctataaaagattaagcaagctctataaaaaagatagattcttatactcaatataaatctgtccaaaccacttggtgaaaacaattatcagatgtcattgcaccttttgatcgaacccaatagaccagatgcgcgagtccatatcaaaagccaaagaaaacaagaccaggagaggaaacaacccaagcaaacatgataatcaacacaaaatcttgagccaccgcaaacataggaggataggggcatcactctgggatttcattcagcacactaaaggaaggggaaagcctaacatctctactatttatt

SEQ ID NO: 11505 - DNA, 2002 bp, Zea mays
gaattgagatgggaatatgatcacccatgataggtatggatttagggataggaatagacatggcttcatggggtcgcgatagtgtgcccaaattcaatcgaaaaattcccattgacatttctagataacatgaatacatgatttgaaataggccctttccttttatactgtatcaaactatattacctgtgttttccccggtgatcaaggtctcggtcgggaaccgccaaaacccggtaaaatttatcgtttttgggtagttcgagataaaaaaccgatcaagtttttgatatattatagttttaattttaaaaatataaaagttaaactttagtcaacaaatcggttttctaaaattacaaaatgaaaatgtaatccctaggccggccagcctgcctccctgctacgccaggccacgttaaccctaagacacaccctaccaaacacacacacagctgctgccctaaaatcatttggctagaggcctggagtgaggaggatgacaaacaattggaacattatcacgagctggcctgtttattcttcaaattaaatgaagacgtgctgattcgaaaccttcggttgcgttgtcttccatgaagaacaaactttaatttaatggagctcccttctcctgctgaacgcgggcggcgccacgtgtgtggcttgtgcttgacaccaactcctcctgcatggcagctggaacatgcgaccattgatcgatgtgccggccggccgtgaagctcgcacgtccaccctctcttctcttctcactcctaagggcgattgggtttctcgaggccggccgggaagccaggacggacacaacgacgaaagctagccagctagtaacaagaacaaaaaacaccatcatcccatccgcccgtgtcaacgccaccctagccctgtgatatacaatggcggcccagagcacgaggatggtggcgctggccctggtggtcctcctggtggcggcgacggcgttggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcatcatatacaatcgctgctccgtcgctcacgtcagcccatgcataatctctcgacccggcccattgaatcttctccttctactatagtatctctttgttgcaggtcttcgttctcatacatcgatccactcatccttttttgtaattcctactaccattaagtgagatgacctctctatatatgcatgattcagttttttttaaaaaaattgttattgtgttgtgcctcgatctgattttcatttttctggatgtattgtatataactatatattattaccacatacattctgtcaaaaaattagaaaaaaaagtcgacggccgcggcctcaatctctgatggagagagagaaaaaagaaataaataaataaataaaagaaagatgccgcccgcgcatgcatcccatagagtttggactgggtcatttaaaaccggcacgacacgtcacgaaaataagagtctaaaacacgaagaaaaatgggtgggctggcacggcccgaacggtcgtgtcataccgcgtctcaaacttaggcacgatagtcggcatgacacgaaaaaggcgcgaattataaaactaacgtttaaatggttattttattctacaatatttttatctctttacaaaagttataaaaaaattgatttttctttcttatatgatttttaggctatagtaaagttataaatattttgaggatgtatttttcagatatatataagttttttgttcatatcgtgtttggtccgacacaacacgatcatcgtcctgctgtgcttcgtcgggctgggcctaacttttagtatctaggcacaacacaacccagccc

SEQ ID NO: 11506 - DNA, 707 bp, Zea mays
cactcctatgggcgattgggttcctcgaggccggccggggcaagctaggacggacatcgacgaaagctagccagctagtaacaagaacaaaaaacaccatcatctcatccgcccgtctcaacgccaccctagccctgtgatatacaatggcggcccagagcacgaggatggtggcgctggccctggtggtcctcctggtggtggcgacggcgttggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggctttatcggcgcgcgggctcagctcgatatcatcatatacaatcgtttgctagctccgtcgttcacgtcagcccatgcatgatctctcgacccggcccattgaatcttctccttctactacattatctctttgttgcaggtcttcgttctcatacatcgatccactcatccttttttgtaattcctactaccattaagtgagatgacctctctatatatatatgcatgattcagttttttttaaaaaaaaaaaaaaaaaaaggggccgccggcgcgcccctctacaagcacaggccgcacgaggcggtttcgtcggcagacgagctcttcagcat

SEQ ID NO: 11507 - DNA, 690 bp, Zea mays
  misc_feature (676)..(676): n is a, c, g, or t
tcactcctatgggcgattgggttcctcgaggccggccgggacggacattgccaaggctccccaaagatagcatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatgattcgatcaatcttcctcctctaatttctcgaccccgtcgaatttttttcctttctattcttctactatactactattatctgtttgtcgcgttgatgtcatctcatacatcgatcgaggatcgactcatcgttttgtaattcctgcaatttgtaagtgtaatgacctctatgattcagtcttccttttaaaaaaaaaaaaaaaaaaggggccgcccaagaaccggccaagaaaaaaaanaaaaaaaagcggcc

SEQ ID NO: 11508 - DNA, 2350 bp, Zea mays
aacattttcaatcttcttgcgcgtcctcgaggccggccgctgaaacaagcgcatgtcccccgtcccgagtcctagcgcgactccgtgcgacggcgaggcctctgtcccgtcctcgtctcctcgaggcccggaggctgcgagtctgtgacacttgaccgtgaggcggacggcgactcggaggacttcaccagcgagtccctcaagcaccgaggccgagccgcccaccgcccgccgccgcctcgcctggcgctagtcgccgttgccgagcctgttcggcacatccgttggggtgccggggcaccgatcaggctgcgcacagccgaagtcggcctccgggtgccccaagctgcagagcagcgcgccagcgcccgtggaccggtgaatcagactacccttgtttcaaatcctgggtccgccattgggggcggtgaggccaccctagtagaggctagaggatgatatacacggcgatcgacacgttctacctgacagatgagcagctccgtgactcgccatcacggaaggatgggatcgacgaggccaccgagactgcgctccgcgtctatggctgtgacctcatccaggagagcggcatcctcctcaggctaccacaagcagtgatggccacggcacaagtattgttccatcgcttttactgcaagaaatcatttgttcgatttagtgcaaagagagttgctgctagctgtgtttggctggcagggaagttggaggagagtcccaggaaatcaaggcatattatatttgtcttccacagaatggaatgtaggagagaaaacttgccaattgaatttttagatgttttttcaaagaaatattcggaactgaggcatgacctgatacggacagaacggcatctgttgaaggagatggggtttatttgccatgtcgagcacccccataagttcatatcaaactaccttgcaacacttgaagcccctcctgagcttactcaagaggcatggaaccttgccaatgatagcttaaggacaactctgtgtgtgcgatttaagagtgaagtagtagcatgcggagttgtgtatgctgcagctaggagacaccgggttccccttcctgaagatcctccgtggtggactgtctttgatgctgatgaagcaggaattcaggaagtttgcagggttcttgctcacctctacagcttgcccaaggcccaatacattccagtatataaagacaacgattcctttactgttaagagaatctctgatctacaggcttcaaaggaaagtccagcaagggctgttgctagcgataagggtacccctgtaccctcaagttctagccaggagaaggatccagtggctaagactatactgaacaaggtgaaggaaaaaagtgatgacgaaggtaaaccattgcccgctgaatttgatggaaaagaaaacccggtggcaaactcaaaaaatgacaagtctgattctggtgtcgaccggagtcgagaaagagagagatcaagagggcgggaacgtgatgccaggggtagggattctgatcgtgatagcaggggtcgcgagtctgatcgtgagagggaccggagacgctgctctagggaaagaagttcaggacactcagacaaggagaaatcaaggcgccattcatcacgcgaccgggctgactactacaattcgcattcatctcgtgagaaagatcggcataggcaccattgatcaaggtgacgaggatccccggtctgcagggcttcgctgcatggagaccaccacttggcagtgccgaccggatcatgaaaacttgtggattatcatcccactggtggttgtattggcttgattgtgttttgcaccttggattgtaacttgcaagatacgctagccatgagctgtgtgcaacttgaatttataaacacaacatataagatacaattgacgcacgtgcactaactgccattccagcagagcttgtggaatgttataaagaaacagtttgtggaaaacaaaaaaaaaaaaaaaaagtttggtgactagggaaacgaaggggattgaggaatcctcttgtttttgttagtttttgaataacaagagaattcctttttccatagatcctctcttcatttctctggtcaccaaattagtgtataccattgttttcaagtcatactaattgagcctgatgcaagaaaagcagagcaacatcttaggacgagctcattgtttcggtgcttgaagcagacggacacaaaagagctaggtctggcgatgatgcttgaaccttgaatattgtgggcattgcctggggcagcagtagtgcagcatgagcggccacctggaagtgggtggcactgcaggcatgcaaa

SEQ ID NO: 11509 - DNA, 6344 bp, Zea mays
ggatcaaataatgtagattagcatcgctgccttatcgaggaaagctgccttttatcgaagaaatgggtttcggaccctatatacagtatcgtaccggttgattctcactgttagcgctttagagtaagcattaatatcagttgatgattcgaaccgatattaatattctgactttaagattccctccgtttgaaaatagtaagtcgttttagttcttagatttttttgtctatatatatttaaatggatgaaaatgaaactagacataaatataaaacatatacatcaaacattttatgaacccctattaattaactaaaatgaattttaatttgggatagaaggagtactagttgttggagctactaatcggtactaatatatatacttgagaggttagtacttgttagagcgatcaattggtaccactattttagtccattatttgagagctgcttaatttctttgacaccattaacagagagatgcttttcactcctcggacttgtggatcttgagactgtcgagctagtcctatttacagagcagtgaccctagctagttgtcgaggaggggcatcggcttgtgcccttgctctcgagtcttcgacgatatgcagcgtgtcgatcacctcctcaacagagatgttgttgatgacgattagggtcttgatggaactgtcacctaagtcagatgctctggatcgacttagcatcttccgcactaccttgacatcagtgatgttgtcaccgaggagacgcagatcaacaacaagcctagtgatgttcaagaaatcttctatgttcgttcctccttcccactaagagactctgaattcacaacaagctatgtgtgtatcatcccattccccttatatatcgtgactgtgatacaaggaagcactcaggagaataacttcttaagcccagcataatgataaatttatataaaaaatagagagaaataagagaatcacatgtcttgacaagagacagccacatgtcaagttgccatgcatcagccattctagctagtgtggatcagcaattcagcatgttacctctttggagtctggagtcgatctgggttcaggcaagaagacgaacacagatgctttgatccatcagtcgtcgtgctactggctggggttatgttatcgttcaagcgttggcagatgaacaacttgcagactgtattgtagtagctcttactgatcgatcaataaaaagcgaggaacagccagccaaattttcttggcacagagatcgagagagctgacgactaacaaaacaatcatgcaacgaacacgaacaccttttggcattattgagatttggagcactagcttgttttaaataccagcaatggcatggtggtcttcagactttgatcattaattaaccacacccgatctgagcagccgatcatgtggtgtggtacgtttttcgtacgggacaacacggtcggtaggggtgaaggatgcgaaggacgatcgacaccgtagatgccgaaacctgatggggggaaaattaaaaaataaacacgagcgcaggccaacttttttctttcctttatccaagtcaacgctagctgccatgcattgccaaccgcgccaaaatgattagggcaaggtaatcacaggcagctggttggctaattgaggttaggaaattagcgctggtataatgctttggcttggcagctggtaaaaaaggctcgttgtggtataagggctaattatgagctagctagctaaagattgggtctagtgtgtgtcgaaataggggggaaatattggtggactatttttttacaagttttcagctagttggtagccatctaactaaccggttttaacaaatttaacatttttaagcctaaatattaagctttgtctagattatcacatgtactatatagctactagattttcagctagttagtagcttctttcaaccggcatgttcacattctgatggccggactccggcctctctttcaatgcgtacatccagcatcaaatccagagatgaatatatatacataataatatggaggaacaagaacttttaacgaggcctacgctggagcgaccacgcacgccgcatatgcagatgcagagcagagtgcatgcagttctcgctggattcctggccgcccaaagcgcagagacagagaggctctgacacgcccgacctgctgtagatctgttgcagttgccgcagaagagggggtgggggggtggctggtggtcaggtcaactggcggttttcggagaacggccgttgcttgttggcagaccagagaaggaagctctggagatcgccagcgcgctttgtttgactggatatttcagcccagcgggtcccggtagattttcgagcccgatagctgtcagaaaagaaaatcaacaataacttctgcacatccatggactggcgcgtgcaaaaggcagcattttgtccaagataagatgagagaaatgtacccagcgtctccagcacgcttacctgtttcttcgcgcccggtggccgtggctcgtcgggtgcaggaacggctgcctgcgcgagcgccggagcccggaggcgaaaggcatgcaaacgttgccgctgagcctggggcctggcttccgcgggcgggcgcgagtggagacgcctcgtgcctcgtctcagagacagctacaaaccaaagaacagacaatttgtctccaaaaatttaaagtgaactatatatacgcactctcaaaacttaaaactctccaaaaataagtcaaggcaatttgcctgaaacccactacagatcgagggaaaaatgaagcttcagagcctcactaggatgatatatgcgcgggcgacatctaaaactattttcagatttaaagctctgtagagctttgtgcaggtatctaattaaagttgcatctccggagcctggcgagaacatgtacgggcaaccaatgctgacataaagctagtattttggtctgagactctgatggccttggccacaaccagcaagaaatatatccaggtgcctttaactagtggcggatcaataaggacttcagaaacccaaaatactatggttaaataaaaatatttatctaggaaaaaaaatgtaatgttcctttttgaaaaagatcatttgcgcttcaccgtgtctaaggggtgtctggtttatagtgactaattttcagttcctctatttaaattctaaattattaagttttagtttccatatttattaatttagagattaaaataaaataaaattgagtgactaaaaattagtgcctataaaccaaacaaccgcggtcatctaagggcgtcgtgaggtggatccaccactgtctgtcggtgtacatcagaaaaacggagcaattagggcgtctctaatggtaaagtcattatctataagaaacatgcactttacctgaagatggcatcaatagacagactcaatcttaacatgggttcggctgccgcagagctttattaattactccctccgtttctttttagttatcgctggatagttcaaatttgcactatccaacgacaactaaaacgaaacggagggagtacttccttacttctagaatataagtaatctttagttctcccaagtcagatcattataactttgaccaagtttgtaaacacaagcaataatatttgtgaaatcaaatgtgcttcattagatacactgtaaggtatattttcatggttactcattttaaatatgataaaattttaataatattctatcgaaattcgaccaagtttgggatattattacattctttggatttgaaacgtctgacaaaatcctaagaagatgaagaaaggagcgctttattgaccagttaaaactagtcgacagtttccttgaatcagtatttttttaagataataatcgacagagagaaactcaccccaaaaaaatatattgaagtgggaccacctacccaagaaaaaaggccgctggggcagtggggcccatcgctcccctgcctttaaaacccccccctcgcgcccccccggccggcatcgaccgcaccatcaaaactaactcgttgagagcggcctcctcaaagcccgcagaaaaaaattcccaagatcgtcgtcgtcccgagctcaaacaagcgcagatggagcagtccggcgccaagaagtcgaacaagatcaccgagatcgtgcggatgcagcggatgctgaagaagtggcgcaagctgtcggtcacccccaaggagccaagctcgccgaccggcggcggcggcggcaatgccgttggcgagagcaaggctaagaagttcctgaagcggacgctttctttcacggacgcaccgccctcggggtccccgcccaagggccacctcgccgtgtgcgtgggccccgcggcgcagaggttcgtgatcccgacggagtacctgaagcaccgcgccttcgcggcgctgctgcgggaggccgaggaggagttcgggttccagcaggagggcgtgctccgcatcccctgcgaggtccccgtcttcgagtccaccctcagggccgtcgagaagaacaagaaggacgccgccgcctcctgttactgcagcgccgagtacgccgccgacgaggtcgggcgcggcacgcccaacaacccgctctgcagataggtggagctcgaggacagaacaaaaatgtcttcttcctcttcctttttttgtttctttcttcttgctctatgtaacgtggtgtggtgagggattgagccgatagcatctccccccgcggattacaattactgctccgatttctctctctctctgctgaaccgagctgatcttgactgggtaatgcagccctcgtggatgcaacgaattatggaaaaattgatgtggaaacgacgggtgttacgtgttctattgaaaggcaatgaggaggatctacctctgactgaaagattcgattttgttttccctttccgactgtcctttgtcatccttgatttgcagtaattgctctcctatctttacgtagtgcatcacaattatttatgaagaatcttgactagttgcgcataatctataaaatataatgtacattatgtacttcatcagtacatttgtctagtactctaatgaaatggttgctgcttcaaaattaatctgtgcatagtttgatggactctggaacatcagttgtttagactgagaaccaatagctgacatttttttttattcgaacgatgagagctgttgactactacttcacatgaaggcaaagtatgaggtctgcatcactgcatgagtcaagacctacctgagcgaagaatgagcaacaacttatcgacggtacgggctagatcgccaaggccgcacacgacccaaacatacagcgtatggaggtcttaacggcgaggtcgaccagcaggtcgatatgatcgattaaacgctcatttttttgatcccacaaatgatgaagagttagatcgccagaagtcgcacactctctaccatatagcagaggaaggcctcactagcgagaggtggatgaggctgattagacagacgctcgttctttctctgatgacccacgaaagtcttctccgtccacatgagtttgcctttattcttcgttttgatctcactaatccattctagaccaaagtttgttttgttgagctgtttttctacatgatcacctattcaccctctctaggtgctctcacaatcagatataggctttcacatttatattaggctatcttgcttgcgtgatttaccttcctagcttaattataggctagtggataagtttcgaacctaggttgtataacttctttgtgatagtgttagcaacacttagttaaaaccttaattgcatacaagataacttaattattgcataaattttgactaggaaaaaatagatgtcatagtttaggaagaaattggattgcctaattcaccatctcttaagcgtcaagtgttcctacaatgtagttggatgccttaattggctatgtatactatattttatatggaatcggatggacttgttatgttggaaaattaatatgatattatttatatatctttccgtagagtttttaacttagatttagtcaaaactaacatgagacaattctaggaccgctcaggtctaatttaaacgtcaacatctgatatattcatatatatgttgcaaattggcagcaagttgtttgatgtagaaaaaacacagcttttgaattcctgaagcaatacctgatgtatgcatgttcccatgaccatgaggccatggcacgcctagtatgttttctgagaaaggtatgaacaccgaggttgcgtgagatttcaatcc

SEQ ID NO: 11510 - DNA, 920 bp, Zea mays
gcacgagaccattacctagaacatcctaatcgaaaaaccacacgccccatcgacacaaactcgttgagagcgcctcaaaaccaccagaaaaattccccagatcgtccccagcacgaaaaagcgcagatggagcattccggcgccaagaagtcgaacaagatcaccgaggtcgtgcggatgcagcagatgctgaagaagtggcgcaagctctcggtcacccccaaggagccaagctcgcccacctccggcggcggcggaggcaatgccggcgagagcaagaccaggaagttcctgaagcgtacgctctccttcacggacgggccgccctcggggtcccctccgccgccgcccaagggccacctcgccgtgtgcgtgggccccgcgatgcagaggttcgtgatcccgatggagtacctgaagcaccgcgccttcgcggccctgctgcgggaggccgaggaggagttcgggttccagcaggagggcgtgctccgcatcccctgcgaggtccccgtcttcgagtccatcctcaaggccgtcgagaagaacaagaaggacgccgccttctgttactgcggcgtcgagtacgccgccgacgaggtcgggcgcggcacgcctaacaacccgctctgcagataggtggagctcaagaaccaaacggaaatgctttcttatatttccccccattgtaacgtgttgcggtgagggatgagtcgatagtatctccccccgcggattagaattactgctccgatttttatctctgctgaactgagctgatctggactgggtaatgtaactgccatggatgcaacgaatcatggaaaaattgatgtggaaacgaagggttttctgtgttctattgaaaggcaatgaggaggaggcggggagctacctctaactgaaatattcgattttttttc

SEQ ID NO: 11511 - DNA, 1211 bp, Zea mays
gccggccgggcccccattcctctccgccccctcccaccccacccgcttctaggacgcagcagcgcacccccgatcctcgcctgtcgcctccatctccattcgcaggcctgagaccctcgcctgcaccgcgctgccgccagccatgggaatggggcctctcgagaacgccgcgtcggccgccgctgagtccgcggccttgccggaggccggcgccgcctcggcagcgggctcgtacgcggtgctgcagtgcggcgaggactcggagtacgtgcggcagaagtacggcggctacttcgccgtcttccgcgcgctgctggaggaggacggcgagagctggcgcgtgtaccgcgccgtcggcggggagctccccaccgacgccgaggcggccggcttcgacgggttcgtcatctccgggagctgctccgacgcgcacggcgacgagccctggatcctggacctcgtcggcctcatccgccgcctccacgccgccggcaagcgcatcctcggcgtctgcttcggccaccagatcctgtgccgggcgctgggcgggcgcaccgggcggtcgaccaagggctgggacatcggggtgagctgcatccacccgacggcggcggcggcgcggctgttcgcgccgctgaagctgccggtgcacatgccggtgatcgagttccaccacgacgaggtgtgggagctgcccgccggcgccgaggtgctggcgcggtcggaccagacccgcgtggagatgttccgcctgggggaccgcgccatgggcgtccagggccacccggagtacagcaaggacatcctcatgagcatcgccgaccgcctcctccggcataaccacatcctggactgccaggtggacgtggccaaggcgagcttcgacgtgcggcagccggacaaggagctgtggaagaaggtgtgcaggggcttcctcaaggggaggctgcaggcgctatagcaattccactaaccgctgcagaggaggaaattgggatgtcttaggttaatttttaattcacccttgttttgtgcttcagagctcaagagttgtacataaactactattgtccgaagcattaataaactcaacaacatcgttctcgtactgcctgctgtttctgtgcctcgtcgacagtctcagcatctgtcattggcgtatctggtgaacgatgtcgttggaactgattttcagaaaaaaaaaaaaaaaa

SEQ ID NO: 11512 - DNA, 1127 bp, Zea mays
  misc_feature (1)..(1): n is a, c, g, or t
naactccccccatcctccccgccacctctcaccccccgcaagcgagtcagccaagccaagcgacgcccaacccccgcctccattcccgggccggagacgcgcctgcctggccgcgacgccgccagccatgggaatggggccgctcgacaacgccgcgtcggccgcgctggaggccgccgccgccgccgccgccgccccctcgcgggcgggctcgtacgcggtgctgcagtgcggcgaggactcggagtacgtgcggcagaagtacggcggctacttcgccgtcttccgcgcgctgctggaggaggacggcgagaggtggcgggtgtacagcgccgtccgcggggagctccccgccgacgccgaggcagccgggttcgacgggttcgtcatctccgggagctgcgccgacgcgcacggcgacgagccctggatcctcgcgctcgtcgacctcacccgccgcgtccacgccgccggcaagcgcgtcctcggcgtctgcttcggccaccagatcctgtgccgggcgctgggcgggcgcacggggcggtcggccaagggctgggacatcggggtgagctgcatccacccgacggcggcggcggcgcggctgttcgcgccgctgaagctgcccgtgcacatgccggtgatcgagttccaccaggacgaggtgtgggagctgccccccggcgccgaggcgctggcgcggtcggacaagacccgcgtcgagatgttccgcctcggcgcccgcgccatgggcgtccagggccacccggagtacagcaaggacgtcctcatgagcatcgccgaccgcctcctccgccacaaccacatactggactgccaggtggacgtggccaaggcgagcttcgacgtgcggcagccggacaaggagttgtggagcaaggtgtgcaggggcttcctcaagggaaggctccagtcgtcgcagcagcaaggtgtggcgctatagcaggaggaaattggggggcattggatgcctaggttaatccgtcatattgtttgtttttttattatatgtgcttcagaactcaagagttgtacagaaactgctatcttcgtccgaagcattaataaaaaaaaaggagggagcaaaaaaaaaaaaaaaaaaaaaa

SEQ ID NO: 11513 - DNA, 1104 bp, Zea mays
ccgggggcgccccctgccccgccccaacattaggtccagtccacccctccagccaacccaagtctccatccacaagagctcgagaacctggccacgagcccatgacggcaagaagcggtcatggccggtgatgaggaggaccacctagcagacgcgccgcgggtggtgggcgtcctctccgcgctcctggaacgtgtcgtggagcgcaacgacgcggttggccgatgagctcgccgccgggaccgagtccgcggcgccgccgtcggcgttccgggcgacggcgaggcccgacatctcggtgcgctcgtacatggcgcgcatcgcgcggttcgcagggtgcagcccggcttgctacgtcgtggcgtacgtctacctcgaccgcctcctgcgccgcgcccgcagcgcgcccgccgtggactcgtacaccgtgcaccgcctcctcatcaccgccgtgctcgcggccgtcaagttcatggatgacgtatgctacaacaacgcctacttcgccagggtcggcggcatcagcctgtcggagatgaactacctggaggtggacttcctcttcgccgtcgggttcgacctcaacgtgtcgccggagacgttcggccactactgcacggtcctccgggccgagatgctgtacctggagctggagggtcctcctcctccagccgccagtacaagtctgcacaggtgctgcttgtcagaagacgacgacggtagcagcagcaccagcagcagctagctgcatagagacaggtacagcggttgcttccaagcaagcaaccatgtatgaatgtgtccgtgtacactgtacagtacagacatgcttgcttgaaagcaaacacggagtacgtgacgtaggcatctgcgtgtgatcggtttgctatctggcggctggcgcttagttgtttttagctttgttattaggtaatctgttgctcttgtagtcttgtatagctgcattgctgttgttcatgtggaaatcggaaaaccgtaaggaacggtataaattgcagtcttggggcagtgtaattgttttcttgtccagcagtttatccatagtttatctaaaatattgtttttacaaaaaaaaaaaaaaaa

SEQ ID NO: 11514 - DNA, 909 bp, Zea mays
actcctatgggcgattcgggtccccgcgctcccgcccgggttttgccggccggctagcatactagcggggggcagcggcagcagcacagagcacacgtacaccactgtccacttcaacttgccttctcctgccactattatatcttcgtagtcaaagaggtgtcgtccatggggacggcttcaacaagcccagacaccatggaggcggcaaggctccccagtctctccatcaccgtcgagaagaacccgccggaggcgcgcttgcttcaactcggcgtcaagtcctggcccaaatggggatgtccgccggggaggttcccgctcaagttcgacgcggcgctgacgtgctacctagtgaagggcagggtgagggccgccgtgaagggctcccgcgagtgcgtggagttcggcgccggcgacctcgtcgtcttccccaagggcctcagctgcacctgggacgtcgtcgtcggcgtcgacaagcactacaacttcgacccctcctaaaaccatatattagctagccccactcctcgggtggaccacacgaacgcaccttctttcttgtgttctgatttgtctcttcttctttttgtctgctgaaagcctcgaccgaattcctgtgccgacgtggtttgtaaacctctgcgacgaccgtggtttatctagcgaggattcgtatggtaggcattagttttccctttcaggactcgatcgtaagctgtgttgtgacttgtgagttaactgaagtgatggtagctagtaaattaatatactatacgacaaatataatgtaatgtaatatattaacagtacagttacataacgataatatatatgagatcgagcggcatgcagtaatgcaatgggccggtgatgttatttcatgcaaaaaaacaaaaaaaagcggcc

SEQ ID NO: 11515 - DNA, 2332 bp, Zea mays
  misc_feature (2311)..(2311): n is a, c, g, or t
ttttttttttttttttggtaattagcgaatatatatatatccatatttactagacaagccccccgggcccccagatccgtccacccccacgctccgatccagcccgtccagttcgacgcgaagcggatcgtagccgtccgaatccgaggggtggacccgtgaattccgggaaggacgaggggtagttggctaccggttaaaacgcccgtgccagtggcccccgtcttcctcctctcctacgcgggcggggaagccaaggaagaagtagtagtagttcgctggaggagttggcctcgtcctcggatccagagcgcggaaacccgtgcgcgcgtccggatcgacccgctcgctcgacggccgcgggcgcgaggctagggatcaggatcggcggcggcggcggcggcgatggggaagtccgtggtggtgggcgcggcggtcgtggcgtgcgcggcggtgggggtggcggcggtgctggtgcaccgccggcgcaggcgcgacgccgcgctcctggggtccgcggaggcggagaggaggcggcgcgcggccgccgtgatcgaggaggtggagcgcagcctcgccacgcccacggcgctgctgcggggcatcgcggacgccatggtcgccgagatggagcgcggcctgcgcggggacatccacgcgcagctcaagatgctcattagctacgtcgacaacctccccaccggagatgaacatgggctgttttatgcactggatcttggagggaccaacttccgtgtgctgcgagtccaactaggaggaagggagaaacgtgttgtcaaacaacagtacgaggaggtttccattccaccgcatttgatggttgggacttccattgaactatttgatttcattgctgctgcattggctaaatttgttgatactgaaggtgatgatttccacctcccagagggtaggcagagagaacttggtttcacgttttccttcccggtgaaccaaacatcaatatcatcaggaacactcatcaagtggacaaagggcttttccatcaatggcacggttggtgaagatgttgtttctgagttgagcagggccatggagaggcagggactagatatgaaagttacggcattggtcaatgatacagttggcacattggctggtgggagatatatggataacgatgtagttgcagccgtaatattgggcactggtacaaatgcagcatatgtggagcatgcaaatgcaattcctaaatggactgggttactgcctaaatctggaaacatggtaattaatacggaatggggaagctttaaatccggcaagcttcctctctcagaatacgacaaagccatggactttgaaagtttgaaccctggagagcagatatacgaaaaaatgatttctggcatgtatctgggagagattgttcgaagaattttactcaagttggcacatgacgcttctctatttggagatgttgttccaactaagctggagcagccatttatattgaggacgccagatatgtcagccatgcatcatgactcttcgcatgacctcaaaactcttggatctaaactgaaggatatagttggggtcgcagatacttccctggaagtaagatacattacccgtcacatctgtgaccttgtcgcagagcgtggagcacgcttggctgccgcaggtatatatagcatcctgaagaagataggccgggacaaagtaccaagcagtggcagtaaaatgccaaggactgtaattgccttggatggtgggctctatgagcattacaagaagttcagcagctgcgtcgaagcaactcttacagacttgctcggcgaagaggcctcttcctccgtggttgccaagctggccaacgatggctctggcattggagctgctctccttgcagcctcacactcccagtatggcgagagtgactagtcttgaaaactggtgtggatcgaacttcgagtgtagctctcatttttatctttttttcccttcaaaacatccctaatattccggctctcctcggggaatttttcggcttcctttcttggctattctgtggatgcacttaaggctctgcagcgggatatagctagtatagagccaatcagtttggaggttatctaatggcataaggtttggacggcaggaacatagaaatggaagctgaacaatgccattcatgttctgcccagtttttcttctccttgtatggtgttgtaaaccaatcaaaacttttaacctttttgtgttggcaataaagaggaggcacgataatttgaccaaaaaaaaaaaaaaaaaaaaaaaaaaaaanctcgagaaaggccgcggtacc

SEQ ID NO: 11516 - DNA, 2104 bp, Zea mays
tccctcttctcctacgcgcacggggagggaagaattggttcgttggcgttggccttggcctcggatccagagcgcggaacgcgtgcggcgttcggatcgacccgctcgaaggccggggggcgcgaggtaggggccaggatcggcggcgatggtgaaggccgtggtggtgggcgcggcggtcgtggcgtgtgcggcggtcggggtggcggtggtgctggagcgccgccggcgtaagcgagacgccgacctcctggggtccgcggaggcggagaggaggaggcgcgcggccgccgtgatcgaggaggtcgagagcagcctcgccacgcccacggcgctgctgcggagcatcgcggacgccatggtcgccgagatggagcgcggcctgcgcggggacatccacgcgcagctcaagatgctcattagctacgtcgacagcctccccaccggagatgaacatgggctgttttatgcactggatcttggagggaccaacttccgtgtgctgcgagtccagctaggaggaaaggagaaacgtgttgtcaaacaacagtatgaggaggtttccattccaccacatttgatggtcgggacttccatggaactatttgatttcattgctgctgcattggctaaatttgtcggtactgaaggtgaagatttccaactcccagagggtaggcagagagaacttggtttcactttttccttcccggcgaaccaaacatcaatatcatcaggaacactcatcaagtggacaaagggcttttccatcaatggcacggttggtgaagatgttgtttctgagttgagcagggccatggagaggcagggactagatatgaaagctacggcattagtcaatgatacagtgggcacattggctggtgggagatatatggataccgatgtagttgcagctgtaatattgggcactggtacaaatgcagcatatgtggagcatgcaaatgcaattcctaaatggactgggttactgcctaaatctggaaagatggtaattaatacagagtgggggagcttcaaatccaacaaacttcctctttcagaatatgacaaagccatggactttgaaagtttgaaccctggagagcagatatacgagaaaatgatttctggtatgtatctcggagagattgttcgaagaattttactgaagttggcacatgaagcttctctatttggggatgttgttccacctaagctggagctgccatttatattgaggacgccagatatgtcagccatgcatcatgactcctcacatgacctcaaaactcttggagctaaactgaaggacatagtcggggtcgcggacacttccctggaagtaaggtacatcactcgtcacatctgtgaccttgtcgcagagcgtgcagcacgcctggccgccgcaggcgtgtacagcatcctgaagaagataggccgggacaaagtaccaagcggtggcggtaaaatgccgaggaccgtagttgccttggacggtgggctctacgaacactacaagaagttcagcagttgcgtagaagcgactctcacagacttgctcggcgaggaggcttcttcctccgtggtcgccaagctggccaacgacggctctggcattggagctgcgcttctcgcagcctcacactcccagtatcagtatggcgcgagtgactagtagtcctgaaatgggcgcggatcgagattttgagtgtagctctcatttatcttttcttttttcccttttcaaaacatctttttggggatttttttcggcttccttttgttggctattccgtggatgcacttacggctctgcattgggatgtagctagtatagagccaatgagtttggaggttatctaatggcacaaggcaggagcatggaaatggaagcagagcaatgacattcatgctctgcccattcttttttccccttgtatggtgttgtaaaccaataaaaaaatgttaacccttttttttgtgtgtgttggcaataaagagaatacgataatttgaccaaatgaaaaaaatcttattcctcttaaatatcttttcttttcattctcctcgatcgatcctgcccggttcgccgtttgtaaaa

SEQ ID NO: 11517 - DNA, 2282 bp, Zea mays
  misc_feature (2228)..(2228): n is a, c, g, or t
catgaaacttcattggagaaattaattatcattaacatatgtttataattatatatatctatgaaacttcattcgagactgatcccgtcgtcgagacgtataggcgggggcgcggggcccgatgacgtgcatgcatcagtggtccgaccgacgcccgatgctgtgtgcagcatgtgctgcatgcgcctatagccctatacatacgctgtttgcatgacatgcaaaatggaccgtccagtgcagatgctacttcggcggtatgccagaatacacattttttctacacgagtgtgacgcgaccatcctagctagggcattaggtggacgccgacactaagtgcatgtacagtggtgtttaatatggaggctcttaaggtgtttaaagaggctatttgcaaaaaaatcttagagctgtctctccgtgaagacacgcatctggctcgtaaaccaagtagcaacagacgacttactttccactgtacggatttgtcatctgttctatcgatctgctgttgtacaaatgcatttaattctgtatttattaatagactatatttatagacactgcattgtataatagaatctcttagttgtctcttatgcttggagaaccgttttagggtctctccactgtacatgccctaacaattaaactacaacaaaattattacatgcatgttacttgaaataatagtttttattatattttatatgtcaaaacttatagcataacaactcggcgttgagatccatgatgcatgccgcataccgccgagatcactgtatatgtcagcgatagatcagcacacacctcggcatcaaatcacatattacgatatagaactgctgatttagaaaaaaagactaaaaatctctaagataagtgtagttgtcggagatttgtctaatctcactaaaaaacagtgtgcatatggctgcacatgcatgtcgtcagccatctattctattataaatacacagcacatccaggccgctcatccaaacatagccactctcctctcctggagctatagctagagagcaagagagaggggggtagatctatatctgtaccgggcgggcggcgcgatgatgccctacggcacggcggcggaggcagaggcggcgctggggcgctccatgacctgggcagaggccctgtggttccggtactcggcggggatgccggacctgtggctgacgtggcacgtctccctcgtctacctcgtcttgtacgcgttggttccgctgccggtcatggttatccagaagctcgcgccggggtacgccctgcggcacaagctgcagcccggggtgccggagccctcgccggtttccacctacgtcgaatacataagggacagcaggggcgtcaccctggccgccttgggcccgttcccgctcatctactccatcgcattcaagctgttcggggtccggacgggactccctttgccgtcggtctgggagactgcgacgcacctggtggtgtattcgctggttgaggactacacgtcgtactggctccaccgcttcctgcacaccaggtgggggtacgagaagatccaccgcgtccaccacgagaagacggcgccgtccgggttcgccgccgcctacgccacgggcactgagctcagcttgtacctcaccacgctcttccttgggccggcgatcgtgcccagccacgtcaccacgcactggctcttgttctccatccgcataatggaggccttcgacacacacagcgggtaccacttcccgttcagcctcgcgaggttcatcccgttctacggtggcgcggaattccacgactaccatcactacgccggagagaagaccaggagcaatttcagttccgtgttcacgtactgtgattatatatatgggacaaacaaaggctacatgtaccacaagagaagcctagccgagctgaagacgaaggaggccgaacacagcgggaaagaagactgagattacgtactcgctctcaatattttatgcacgaataagtggcatatactgaaagcgtccatcatatacagttgctcgctccgttctgttccgttgcctagagattgagatgtccagcaaataatagtccatatgtgtactacaccacagggtttgtcgtcccccatgtgtaccctcagtcctacatcgatttgattagtggagaccggagtggatttgaacaggtcgtcctcatgtggacgtacacctgaacgtantaaaaaaaaaaaaaaaaaaaaaaaaaaaaaaaaaaaaggaaaaaaaaaaaaaaa

SEQ ID NO: 11518 - DNA, 1909 bp, Zea mays
acgaagcaagcaagactactgctacagaaagcagcagcaaaggtctagccggctgcgtggcctaggcgcctaactatatagttaaggtctatctttgagcagttaacgtgcaggaggaataacacgatagccatggacgtgtacatctaccaggcgctcctcctctcggtccttgctgtggcactgctgcagctggtgaagatggccctcaagccgaggccacggctgccgccagggccttggaagctgcccgtcatcggcagcatgcaccacctcgtgaacgtgcttccacaccgggcgctgcgggatctggcggacgtccacggcccgctcatgatgctgcagctcggccagacgccgctcgtcgtcgcctcttccaaggagacggcgcgcgccgtgctcaagacgcacgacaccaacttcgccacacgccccaagctcctcgccggcgagatcgtcggctatgagtgggtcgacatcctctttgccccctccggcgactactggcgcaagctccgccagctctgcgccgccgagatcctgagccccaagcgcgtgctctcgtttcgtcacatccgggaggaggaggtgatgctgcgggtggaggagatccgcgcggcgggcccgtcgacgccggtgaacctgagcgtgatgttccacagcatcacaaacagcgtcgtgtcgcgggccgcattcgggaagaagcggaagaacgcggcggagttcctggcggctaccaaggccgtcgtcggcctgtcgagcggcttcaacatcccggacttgttcccggcgtggaccacagtcctggccaagctcaccggcatgacgcgcagcctcaaggagatccacaagacggtggacaccatcctcgaggaaattatcgaggagcgcaagcgcatccgcgacgaaaagatcatgggcggcgccgccgccgaggacgtcgacgagaacctcgtcgacgtactcatcggcctgcaggagaaaggcggcttcggcttccaacttaccaacagcatcatcaaggccatcatactggacatgttcgcgggcgggacggggacgtcggggtcggccatggagtgggggatgtcggagctgatgcggaacccaccagtgatgaagaagatgcaggcgctgatcagggaggcgttccgtgggaagacggtggtgacagagggcgacctacaggcgagcaacctccagtacatgaagctggtgatcaaagaggccctgcggctgcatccgccggcaccgctgctggtgccccgggagagcatcgaggagtgcgagctggacgggtacacgattccagccaagtcacgggtcatcatcaacgcgtgggccatcggccgtgaccccaagtactggaatgacgccgacgagttcaagccggagcggttcgaggacggctcccgagacttcacgggcagcagctacgagttcttgcccttcggctccggccgaaggatgtgccccgacttcaactacggcctcgccagcatggagctcgcctttgtcggcctgctctaccacttcgactcgtcgctgcccgatggcgtcaaggaggtcaacatgggggaggtgcctggactcggcgtctgccgccgcacgccactaatgctttgcgcaaccccgttcgtcccggtccccgcctagctagccaacgtacatcgtcatgccagccgcgagctgagggacctattgtatctctgtctcagtatctctatgtgcttgctggctaaataaacacgtcatctgtacgtctcgttatgggtgctgcccattgtagtgtgctgtgcgtacgtgtagtagtacagtgaagagtgtactataatcatgtacctaaagtttcaacttccaaagtaaagtgcgtcccaagggtaataaatctatacttacactctggacc

SEQ ID NO: 11519 - DNA, 549 bp, Zea mays
  misc_feature (5)..(5): n is a, c, g, or t
aagancaagcgacatcgtgggggccgccccccaccgcctgggcagcgccccgccgctcggaggatgcagaggacgcggttggaagaacgtagggacgcagcgctgggccggaggagcacatcgccacagtgccccgatagatgcacgggacgccgacgcggggccgtcgttgacctaggcagtgcccgccgctcggaggatgtaggaggacgcgagcgggggccggaagaacgcaggtacaaagagtcgggttggaggagcacatcaccatagtgctcgacggatacacggggatgccggtgcagggcggtcatcgacctgggcagcgcccgccgctcggaggatgcaggaggacgcgggcgggggccaaaagaacgcaaggacgcagagcccgacagatgccacaaggacacatggcgcggggtggctggcgactgtaggcacgcgcggagcgctgcgtctggcggcaacagggaggagggctcgagcagttctatcggaattgctagggttcaacgaaggaggcaagaatggggaacgattggaaat

SEQ ID NO: 11520 - DNA, 4927 bp, Zea mays
  misc_feature (3066)..(3066): n is a, c, g, or t
  misc_feature (3208)..(3209): n is a, c, g, or t
ctgcagcaaaagttcaaaagggggcagcagattatcttacagtgaacatgtacacgtcaggaactacacgataaaaaagggcaggcaggcccagtgcttgaggctcccacgtgagtggagtcttcacgccttcccccacaaatgtggagagaggctgcttcgaactcacgaccttctagtgaaacaactatcatcactgcaccaggcctgcccttcaattgttcaacgaaataacatagtagagtaatgagagactatgtacctgcacgaacaggaccaaaaatgtggccttcctttatatcagcaaggtattcttcaagtttcatatggaaaacacgagctacgatatctgacctatcagtagacttttgggcttcttcaaatcgaattgtctctgtgatctctggccacttagagttgcaagtatgtcaacatcaacacatcaacatgataaattggtagcagaaagtgtttgtagcataactaattaaaatatcatgatatagcaaacatatgaagggaaggtggtaaaaagaaaaggtgtcaagctacatcatttctgtgatcccttataacgctccagccagtaattgaactgaaagagttaaaggtgctttcagacaaaacagagagtttattcgcagtgtattatccagtgttcccagtaaatgcatctctctcaactgaccctttagtgtactttaaccatattttgtgtttaatatatgcctatattagaaaaaatacaaaaacactaataacaaaatgggttactcagcccttaacatcatgagcccttcttatatgcatgtaagatttagactgaaaattccacagcaaaagtaatgtgcattgtctaaagcattctataagacatctaataagtagcacttcagaaggatgcttgtaaaattagtcttgtttttcacataagattaccattctggcatttttaatttccatggaatagatagtgtacaacaatactcttgcttgtgtaagttaccaatggtctttgcatgaacattcaccatttacaaagtggtgatagcggttaacatctcttatgataatttcacgctgctcaatctgtgaaatcagcttgatgacaacatggcagtcctcacaaactcgaagattctttgtcacaagcaactttgtcctaggcggtgtactaatgagtccaaatgcaatggccaacctctcgctgtggccccataccatgttcctcttttcatcatcttccacattatggaaaaccggcgtggtgtcaggcacatagccagtttgactgatgagaccttccaatcgctccaactcttcatatatatcatctgatctaggatgagaagcatcacccacaagaaaaccatgggacttccctttcaattcgatccagctacaagcaatgatctttttcaagcctctattggtcatcagcttcctcacccttgcagcttcttcccatttcccagattcagcatatatatttgatagaagcacatagttaccagcatcttcaggctccaattcaatcagtttttgcagggctaattcagctagctcaacatttttgtgaatcttacaaccatttagcagtgcaccccatatccctgaatctggcttcaccaacattcctttaataacatcagaagcttctttgaacctaccagagtgaccaagaacatctacaaggcaggtgtaatgctgcactgtcggcttgatggaatatacagtcaccatcagatcaaatacttcttttgcttcttgtaccattcctccatggttacaagcagataggactccaacaaaagtaatatggtcaggcatcacctgagcctcactccgcattctgctaaacagctcaaatgcatgatcagcatggccatgcatcccaaatccgcagatcatggcattccaagaaataagctccctgtgtaaaagttgctcaaagagaacatgcgccaccataacccaaccactcttggcatacatgtcgagaagggaagtcttcagcttgtcctgtgacccaaaccctctcctccaaccatatccatgcagctccctccctctaggcagcgcagacgcaacagctgcagctgatatcgcactcaccagagtggcgatcgttggcgcaatgccttcagccgccatgttacggcacagagtgagcgcctctgctggtcgcccattttgcccacatgcggcgtgccgcgtattccacaccgcagcatccctgattgtggtgtcattaaacaccgcccaagcctcatccacgcaaccacacttggcgtacatgtcgatgaggcctgcacatacaaaaacatcagtggcccaactcgtccgcatgacacgatcgtgcacctcccggccagcgcccaggtccaggagtgcagcgcacgccttgagaaccggcggataggtgaagttgtctggtttcatgctaccatatgccagcatcgcgcggtacagttctattgccgcttcacatggcccgtcgcgtgcataggcacggatgagcacgttccacagaaagacgttcccctggttgggcatttcgtcgaacaagcgacgggcaagagacacatggccgcaagacgcgtagaggtcaacaagcctggtggcgaggaccgcatcgaggccacttcccgacacgaggagcctggcgtggagctgccgaccgggacgaacggctctggagaggacgcaggatcggaggatggtggcgtaattgctatggttgtacggagatgggcacggggagaggaaggcggggatttgggcaggaggcggaggtggaggagatgcgccattgggtgcaggacggagatcgctggtcgtttggagggaagagacggggaggaggtgatagaggcgtgccggagacggcgaggctgttgattttgagagcatggatgtcagcatcttcgggccgcgcatacgcccggccgggccgcgatggttgttgcacgaagtacactccaggaccagctctcggacgccgccgttggtggtccgacgcccgcgtccccgacgccgacggccgacggccgaccgaccgagaanggtggaccgcagcttctcaacgccgcgggatgtcgcccgccgtctgccgcctcatcgattcgatgaagtcagtctcgcaggaactagatcctcgccagcgtgggtggccggcggccggtcatctgtgcggccgtgggctcgnntgtggtgtaagtgttagggcgcaggcggccggccggcgaaaaatttgcaatttggctaaacgtgggcttagcttagattgctatcaactgactgagcttcgtccaagtaccattataaaccatgccacacattttaaaatactccattagtctcgaattataatttgtttgaccttttgtttcacatttgtatttaattttttcgaaaaaaatgaaaaattcaaaaccacagttaaatatattatataaaccacatttaaaatatattatatgctaaataatatatagcgaaaattaacaataattatgaatttttttgaataagacggcttgatcaaatttaaggtaaaaaagtcagatttgaattggaacgaatgaagtatcatttagctatttaacaaaaattaaagtatctttaatttaattctagaagacaaacggactattttgcccttctttctcacttctcctttctgtgtttcttccctgtattaattcttgtgcatggatttttctccctcacgatagggtcgtggcatgatgaggttagctcgtcgttgtgaggccatggcaaggcagcagcaacaccgagcgcgggttcatggcgaggcaacagcagaaccgagcgggcgcagggttcatggcgaggcagcagcagcatcgggcgcggggttcatggcatcgcggtggagccagctcgccgtggtgggtcagcagcaacagcgggcgcggggttagtggcgaggcgaactaacagagatgaagatggtgaggagaaagctacaaaagcacgggggtgttgcccgcgtcgtcgtcctagccatgagcagaggtgacggggcagttggccagctggccttctcgtcgccgatggtggtcaccagcatgacccactacgctatcctgctcgaccctgtcatgttcgtcgcccgcctcgacgacctctaactcgtcgccaccatgctcaacaactcatgggcgtgttaagttctcactaggattcaccacaatagttcttacagcaatcagatagtagaaggagaggaagaacacaagagaagaagacttggagaagaagattttgatagctctgttcgatgatgcccttcctgccgccgccgtcaggctcagtatactgatcaggtcatccactctggtccttggaacctggagttgggcttccgcatccgtccgactcttttcggcccatcgataatcatcgctggcccatcactctgctcctgtaggccagccggtacttgttgccttgtagttgcactgctgacatccccctggataacgcattgcttgtccctaagcaggcgcattgggaaaacgttgtcgcaggggaatcacatcttcccaagtagccaacgaagacggaaatccagaccattgtataagagcttgtgaaacaccagcagggcccaagcggcgctgcaatactttttcaggaatctgaagaccatccaattgatcaggaagctgagcaactgcgaccgaagatccaacggcccgtttgagttgagacacatgaaatacagggtggacagctgaagaaggaggtaatggcaacttataagccacagtaccaatcttggaaacaatgggaaatggaccgaaaaaccgaaatgctagattttggttagcccgaggagccaaggatgactgaacataaaaggaagcttcacgaagacatgatcacccacctcaaagtt

SEQ ID NO: 11521 - DNA, 1210 bp, Zea mays
ctctgtaaccactaccgtccgtcgtccagtccacccacgcgggcgaacagtgaaaggcatcgtctccgtctcgtgactcgtgatcgctggactgccgccgcccgccgccctcagcttagctcaatgattgggagcaccaagccgctcgcggcgccgctgcacccgccgtgcccctccgggcgccgcctcgcccccccgtcctgcgcccctgattcctccccagctctcacccccgccgtcgagaggccaggccagtctcagtctgacggcgccccgccgccgccacgcccggatgtggtcgcctcgtccctcgcgctgcgcgctagcccgcaactcaatcggtggtcccgctcgcgggcgctgcggtcgaaccgccggcctgggctggaaagcgcgctctcctcgtcctcggcggcgtcggtgaccaagacgtcgcggcctgaggacgctgcggtggcggtggaggatggcgaggacgacgacgtgtgcgtagagacggacgccgcgggcgggaaggccatctacatagtatcggacgggaccgggtggaccgcggagcactcggtgaacgccgcgctcggacagtttgagcactgcttcgtcgaccgcggctgcgctgtcaacacccacctcttctccatgattgataacatggatcgacttcttgaggtaataaagcaagcagcaaaggaaggggcactggttctatatacccttgctgatccttcaatggctgagtcaactaagaaggcctgcgatttctggggtgttccatcgactgatgttctacggcctactgttgaagcaattgcttctcatatgggtgttgctccatctggaattccacgaagttctcctagtcgacagggtcagttaacagaggattactttcgacggattgatgctatcgattttaccatcaaacaagatgatggggctctgccacagaacctcaaccgtgcagacattgtacttgtcggcgtttcacgtacagggaagacaccattgtcaatatatctagctcaaaagggatacaaagtggcaaatgtcccagttgtgatgggagtggatcttccaaagactctttttgagatcaaccaagacaaggttttttggattgacaataaacccagtggttcttcaagcaattagaaagactagggccaaagctctaggttttggggatgggtatcagagcaattatgctgaa

SEQ ID NO: 11522 - DNA, 889 bp, Zea mays
cattgggtacctcgcgccccgccgggacacacaccacacacgtacgcccacaccagagaatacactacagcacagcaccgacaacacctctcaagtaacccagcaggcaccatggccgccgccgtgcccctcctcctcctgctactgccaacgaccctgatggccgcgtcggcggcgtccggcggcgagaagagcacgcacatcaagctgtactggcacgacgtggtgagcgggccgagcccgacggcggtgccggtggcgcaggcggcggtgaccaacacctccaagaccgccttcggcatggtggtggtgatcgacgacccgctgaccgagggccccgacctcaagtcctccaagccgctcggccgcgcgcagggcacctacgtcggcgccggcaaggacgagctctccctgatgatgaacatgaatttcgtgttccaggccggcgagtacaacggcagcaccgtcgccatcatgggccggaacgccgtgttcgacgccgtccgcgagatggccgtcgtgggcggcaccggcgcgttcaggatggcgcgcgggtacgcgcaggcccgcacgcacaccttcgacctcaacaccggcgacgccaccgtcgagtacaacctctacatcaagcactagctagctagcccatcggctttgtgtttctgattgttggtgctcatatatgaacacgatcgaactccataattgtcttgtgagctcaatttgtgccactggcttttgcagttttggtgaaaaagaagagggtaattaaaggacgatagcttcggtcgttgtaagctgacttcgatttaacttgcacaatgattgaggacttaaagaataaagatagtaatagactttgtttatctgatcaaaaaaaaaaaaaaaa

SEQ ID NO: 11523 - DNA, 1854 bp, Zea mays
ctcaccaaaccatctttttttgttacgatgaatcggaggggaaaaaacatactagaccaaaatgaattgcatgtttctttcatatccgtcaaccatgactctaccctatcttttatgaaaaaaaaggccagagcaacagtgagatggctgggcgggatgctgttttctgcatgaaggcagcttgtttaaattgtggtttttatggctcttagttcaacggatctgtgcctggaatacccttccttgatagcgaaacaaacaacaaagctgcacctcctgactgttttgctcttcctgctgactaatgtgccgaaaccaacgtcgttacaggctcttttgcatgcatcggttgctatggaaagaaaacttgtagtcgagtgggttccttcctgcgacctggaagattcttcagctaaagaggtcggtttagtcgtgggcattgaatcgatttctattcctcgatggagcttttgctgatgcttttggagacgtgtttgtttcgtgtagacccctgaagcccataaaaaagcatggaaattgctgaaggtaggtgcaggcatcaaacggtagtttcttgaaagtcatgtgcttatgtacatacagtccgtctcacggaattccattccatcccagggcgcagatggcgtactcgtccctggagggtttggggacaggggagtccagggcaaaatcctcgccgcgaaatacgcacgcgagaacaacgttccttatcttggcatctgcctgggaatgcaaatcgcggtgatcgagtttgcccgctcggtgatgaagctacgaggtgccaatagcacggagttcgatccagctacgacgtcaccctgtgtcatcttcatgccagaggtaggtcatgcttacttggtggtactgccgttcatttttgaaccgcgaacttctgactgacagcacttccactccacgtacagggctccaaaacccaaatgggagccacgatgaggcttgggtcgaggaggacctatttccatgtcagtggctgcaaatctgcgaagctgtacggcaacgccagctctgtagatgaaagacatcgccacagatacgaggtgaaccctgacatggtcccagactttgagaaggccgggcttcagttcgtgggcaaagatgagagtgggaaacgcatggggatcgttgagcttccctctcacaagttcttcatcggtgcacagttccatcctgaattcaagtcgagaccagggaagccatctccgcttttcttagggctgatagccgcggcgtctgggcagctagaaccattgctccaacgcagcaacccgacaacgaaagcatgttcgatcagtaaagtcccgaaactgaaactgtaccccactgggcctgtgaataatccactgaacagcttggtaaacgggtacttcccaaatggcactgggatccacacctagaagcgtagcgcttagcgatggtttggttggtatttgctgctatggtttttgcttgtacccctcctttttcatgtgttcctttttttcagtttgttatttgtctctgatcaactgagagaagagaaggctaagattcagcaagcccccagctccagcgacacatggttccgacatttttaacgaggaacgccctccagtccgttgaagcgaactagccatagggtggtgaggtctagtgtgatgtttgttgctttttttttctctttcctttttttttggcctggaactaaggcgcgaagtgttttgagtagcgctagtagagcctggaagaagttatctaaactatttgtacattatggaagaacttatctaaggactgaatacacaaatgcttggccatgattgctttgttgccaca

SEQ ID NO: 11524 - DNA, 961 bp, Zea mays
taccgtaactggtcccccgactggaacgagatgacgcctgatgacgtgatatacaagtacggcaatgcttgctacgttgacgaaagacaccgccacagatacgaggtgaatcctgacatggccccagaatttgagaaggcagggctttctttcgttggcagggatgagagtggcgaacgcatggagattatcgaactaccaactcataggtttttcgtcggagcacagtttcaccctgaattcaagtcaaggcccggcaagccatctccgcttttcttaggattggtagcagcgtcatcaggccagcttgaccacttgctccaacgtggccttaccagttcagcaggcagagacatctgcggcaaagggggagcgcagaaaccaaaagcttgccagaacgggcatgtcatgaagccactgaatggcctggtgcacgggcactattcagcgactcgctgcaatggcgtcattcccatctagcaggctgttttcgcttgttctttttctttccgttctacctacctgcagggcaaccaggaagagaagggctgtttgctctagcgacacggcagccgtttccgatgttttaacgaggaagcaattggcatgcaaagctgtcgcgcgcattaagaggcaaatctagcagcttattagctagggttcgattagtagtagtagtaatccgatgttgctggtttatttgttagtttgtttgctaagaaagattacaagggttagtgatgtgcagctagctccagtgtagcctgccgtctcgccccatttgtacattgtaaaaccactgctactctccatgattgactgaatggatgagtataaacgtattggaccaacatgctcggtgttataaaaatctaagttgcaatccaaaaaaaaaaaaaaaaaaaaaaaaaaaaaaaaaaaaaaaaaaaaaaaaaaaaactcgagagagggcgccggtacc

SEQ ID NO: 11525 - DNA, 2411 bp, Zea mays
ccggccgggaaaaaaaaaaaaaaaaaaaaaaaaaaaaaaaaaaagggtaccccggcccggcccgggagcctaaaaacttgcccagagcgcctgaacctgcctccgctccactcttgcccccccctggcaccacactagcctagtgagtagtgcagcagtcttgctcggttgctcctacctgtcctgcacagcacaggagcagagcccaggaccgtcggcaaaaggggagcggccatgaagtacgtgctggtgaccggaggggtggtgagcggcctcggcaagggcgtgacggccagcagcatcggcgtcgtgctcaaggcctgcggcctccgcgtcaccaccatcaagatcgatccatacctcaacactgatgctggaaccatgtctccattcgagcatggagaggtgtttgttttggacgatggtggagaggtggatttggaccttggaaattatgagcgttttctggatatcaaattgacccgtgacaataatataaccacaggaaagatctatcaggctgtcattaacaaagaaaggagaggtgactacctaggaaaaaccgtccaggtagtgccacatattacagacgaaatacaagattggattgaacgcgtcgcagtgattccagtcgacggcaaagaaggacctcctgatgtttgtgtcattgaacttgggggcactataggggatatcgagtcaatgcctttcattgaagcattaggtcaattttcataccgtgttggacctggaaacttctgtctcgttcatgtcagtcttgttccggttataaatgtagtcggtgaacagaaaactaagcctacacaacatagtgttcgagggcttagaggacttgggctagcaccggatgttttagcatgtcgcagtactgagccactggaggaacatgtgaagatcaagctttcacaattttgtcatgttccgatctcaaatatagtgaacctccatgacgtgacaaacatttggcacatccccttgctgctaagggaccagaagacccatgaagctattctgaaagttttagatcttcagtatgatggaaaagtacctcgggaacctgagttagggatgtggactaaaagagccaccaagttggacaaattgaagacttcggtcaagattgccatggttggtaaatacactggcctgtcggactcctacctgtctgtcataaaggctcttttgcatgcatcagttgctatggaaagaaaacttgtagtcgagtgggttccttcctgcgatctggaagattcttcagctaaagagacccctgaagcccataaaaaagcatggaaattgctgaagggtgcagatggtgtactcgttcctggaggattcggagataggggagtccagggcaaaattcttgccgcaaaatatgcacgcgagaacaatgttccttatcttggcatttgcttgggaatgcaaattgcagtgattgagtttgcccgttcggtgatgaaactacgaggtgccaatagcacggaattcgatccagctacaacatcaccctgtgtcatcttcatgccagagggctcaaaaacccagatgggagctacaatgaggcttggatcgaggagaacctatttccatgtcagtggctgcaaatctgcaaagctgtatgccaatgccagctctgtagatgaaagacatcgccacagatacgaggtgaaccctgatatggtcccagacttcgagagggccgggcttcaattcgtgggcaaagatgaaagtggaaaacgcatggggatcattgagcttccctctcacaagttcttcatcggtgcacaattccatcctgaattcaagtcgagaccaggaaaaccatctccgcttttcttagggctgatagccgcggcatctggacagctagagcctttgcttcaacgcagcaatccgacaacaaaagcatgtcctatgagtaaagtcccgaaactgaaactgtacccaactggacctgtgaataatccactgaacagcttggtaaatgggtactacccaaatggcactggcatccacacctagaagcataatgcttagcgatggtctatttgatgtttgttcctatggttttgcttgtacccctttttatgtttgtttttcagtttgtatttgtctctgatcaactgggaaggctaagattcagcaagccccagctccagcaacacatggttccgacattttaacgaggaacgtcctccggtccgttggagcaaactagctatagagtggtgaggtctagtgtgatttttttgagccctggaattaagcgcgggaagtgttttggtagcgttagtagagcctggaatctcaactatttgtacattatggaagaacttatctaaggactgaatacacaaaaacttggccatgattccggtccccaatcg

SEQ ID NO: 11526 - DNA, 2426 bp, Zea mays
gccggccggccggcgagcctcaactcttgccctccccccggcaccacactagcctagtgagaagtgcagcagcagcaccagcggcagaagtgttacttagttgctcctcctacctgtgctgctgcgcaggagcagagcctgaaaggacgacggccgtcggcgtaaggggagcgagcgagcgagcggccatgaagtacgtgctggtgaccggaggggtggtgagcgggctcggcaagggcgtgacggccagcagcatcggcgtcgtgctcaaggcctgcggcctccgcgtcaccaccatcaagatcgatccatacctcaacaccgatgctggaaccatgtcgccgttcgagcacggggaggttttcgttttggacgatggcggagaggtggacttggaccttggaaactacgaacgttttctggacatcaaattgacccgcgacaacaatataaccacgggaaagatcttccaggctgtcattaacaaggagaggagaggcgactacctagggaagaccgtccaggtagtgccgcacatcacggatgagatacaggactggatcgaacgcgtcgcggtggtcccagtggacggcaaggaagggcctcctgacgtctgcgtcatcgagctcgggggcactataggggatatcgagtcaatgcctttcattgaagcgttaggtcaattctcgtaccgtgttggacctggaaacttctgtctcgttcatgtcagtcttgttccggttctaaatgtagtcggtgaacagaaaactaagcctacacagcacagtgttcgagggcttagagggcttgggttagcgccggatgttttagcatgtcgcagtactgagccattggaggaacatgtgaaggccaagctttcacagttttgccatgtcccggtctcaaatatagtgaacctccatgacgtgacaaacatctggcacatccccttgctgctaagggaccagaaggcccatgaagcgattctgaaggttttagacctccagtatgatggaaaggtgcctcgggaacctgagctaacaaagtggactaaaagagccaccaagtttgacaagttgaagactccggtcaagattgccatggttggaaaatacactggcctgtcggattcctacctgtctgtcataaaggctcttttgcatgcatcggttgctatggaaagaaaacttgtagtcgagtgggttccttcctgcgacctggaagattcttcagctaaagagacccctgaagcccataaaaaagcatggaaattgctgaagggcgcagatggcgtactcgtccctggagggtttggggacaggggagtccagggcaaaatcctcgccgcgaaatacgcacgcgagaacaacgttccttatcttggcatctgcctgggaatgcaaatcgcggtgatcgagtttgcccgctcggtgatgaagctacgaggcgccaatagcacggagttcgatccagctacgacgtcaccctgtgtcatcttcatgccagagggctcaaaaacccaaatgggagccacgatgaggcttgggtcgaggaggacctatttccatgtcagtggctgcaaatctgcgaagctgtacggcaacgccagctctgtagatgaaagacatcgccacagatacgaggtgaaccctgacatggtcccagactttgagaaggccgggcttcagttcgtgggcaaagatgagagtgggaaacgcatggggatcgttgagcttccctctcacaagttcttcatcggtgcacagttccatcctgaattcaagtcgagaccagggaagccatctccgcttttcttagggctgatagccgcggcgtctgggcagctagaaccattgcttcagcgcagcaacccgacaacgaaagcatgttcgatcagtaaagtcccgaaactgaaactgtaccccactgggcctgtgaataatccactgaacagcttggtgaacgggtactacccaaatggcactgggatccacacctagaagcgtagcgcttagcgatggtttggttggtatttgctgctatggtttttttgcttgtacccctcctttttcatgtgttcctttttttcagtttgttatttgtctctgatcaactgagagaagagaaggctaagattcagcaagcccccagctccagcgacacatggttccgacatttttaacgaggaacgccttccagtccgttgaagcgagctagccatagggtggtgaggtctagtgtgatgttgttgttgtttttttctctttccttttttttttggcctggaactaaggcgcgaagtgttttgagtagcgctagtagagcctggaagaagttatctaaactatttgtacattatggaagaacttatctaaggactgaatacacaaatgcttggccaaaaaaaaaaaaaaaaaaggccccta

SEQ ID NO: 11527 - DNA, 2789 bp, Zea mays
aaaccccacctcccttggtttggctggcggctagcccctaaccaaaaaaaataaaataaaaccaactctcccccgcccccgccggcccatttcccatctcgccttcgcttccacgcccctccgtcccgcctcgccgcggcaaggcaccgccgccaaccgccctctccctcttcgactcgaccgcgtgagtgagagacgaccgcgcgcgcccttcgcccgcccgcccgcccgccaggaggagatcgacccccgaacgcgtcatgaagtacgtgctggtgaccggcggcgtggtcagcgggctcgggaagggcgtcacggccagcagcgtcggggtcgtcctcaagtcctgcggcctccgcgtcacctccatcaagatcgatccatacctcaacatcgatgccggaaccatgtctccgctcgagcatggcgaagtgtttgttttggacgacggcggtgaggtggacttggaccttggaaactacgaacgatttctggacatcaagctgactcgtgacaacaacataaccacggggaagatctaccagtctgttattgacaaggaacgtagaggggattacctaggaaaaactgttcaggttgtgccgcacatcacagatgaaatacaagagtggattgaacgtgtggcaatgaatccagttgatggcacagaagagccagctgatgtttgtgtcatagaacttggtggcactataggggacattgaatcaatgcctttcattgaagcattaggtcaattttcataccgtgtagggcctggaaacttctgcttggtgcatgtcagtcttgtaccagttttaaatgtggttggtgagcagaaaacaaagcccacccaacatagtgttcgcggacttagaggacttggactcatgcctgatattttggcatgccgtagtacacagccacttgaagaacatgtgaaagtgaagctcgcacaattttgtcatgttccgatatcaaatatcattaatctccgtgatgtaacgaacatttggcacatccctttgttgctcagagaccagaaggcccatgaagctattttgaaagtgttagacattcagtgtgtgggtaaagttgctcgagaaccccagttgtctgaatggactgaaagagccagcagatgtgacagattgaaatctccggttaggattgctatggttggaaagtatactggcctgtcagattcctacctatctgttatcaaggctcttttgcatgcgtcggttgctttggacaggaaacttgtggtagactgggttccttcctgtgatcttgaagattctgcagcagaagagaatcttgatgcctacgaaaaagcatgggaattgttaaagggtgcagatggtgtgttggtgccagggggttttggagacagaggagttcaagggaaaattctggctgcaaaatatgcgcgagaaaacaacattccatatcttggcatttgcttgggcatgcaaattgcagtgattgagtttgcacgttctatcatgaagttgcacggtgcaaacagcacagagttcgatccaaccacaaaaaccccatgtgttattttcatgccagaggggtcaaaaacccatatgggggcaacaatgcgccttggatcaaggaggacctttttccaggtcactaactgcaaatctgctaaactgtatgggaatgctagctacgttgatgaacggcaccgccacagatacgaggtgaatcctgatatggtcccagaatttgagaaggcagggctttctttcgttggcagggatgaaagtggtaaacgcatggagattatcgaactgccaactcataggtttttcgtcggtgcacaatttcatcctgaattcaagtcaaggcccggcaagccatctccgcttttcttaggattggtagcagcgtcatcaggtcagcttgatcacctgctccaacctggtcttatcagttcgactggcagacacacctgcagcaaaggaggagcgcaaaaattaaaggctgggcacgtcatgaagccactgaatggcctggtgaacgcacactattcagcaaccggcaatggcgccattcccatctagcagcgcagagctgcgacgcgtcgcgtgcttgtttgggatttctcttctaccgttactgcttgttctttttttttccctttccttcgagggtgttcttccgtacgttctgccaggccaactgagaagaagagaagggctgtttgctctagcgacacgggcagccgcgtttccgatgttttaacgtggaagcatttggcatggaagctgtcgcatgcatcaagaggcaaatctagcaggttagctagagtttgattagtagtggtaatccgatatatatgctggttgatttgttcgtttgtttgctaagattacaagggccggtgatgtgcagctagctggtagtgtagcctgccgtctcgcctcatttgtacattgtaaaacaactgctactctccattgactgactgaatggacgagtataaacgtattggaccaaaaaaaaaaaaaaaaaaaaaaaaaaaaaaaaatagaaaagctactatcgaatgccagttttatatacaggcgaggccgatacagaagggattttcagtctaaatttgaattgcattttatttaaattccaatctagcccgctagcgtttcatcccactaacctttgcgcgaattcaaaactgattgggtaaattgcctcggcttaccctaagttcctaattctaaaatctattgcatctttggatgttgatgggtatgcgctctctgatactccgt

SEQ ID NO: 11528 - DNA, 867 bp, Zea mays
gggaccctcgccgccggccgggccaacctcccttggtttggctggcggctagcccctaaccaaaaaaaataaaataaaaccaactctcccattcggccatttgcccatttcccatctcgccttcgcttcccacgcccctccgtcccgcctcgccgcggcaaggcaccgccgccaaccgccctcgtccctcttcgactcgaccgcgtgagtgagacgaccgcgcgcgcccctcgcccgcccgccaggaggagatcgacccccgaacgcgtcatgaagtacgtgctggtgaccggcggcgtggtgagcgggctcgggaagggcgtgacggccagcagcgtcggggtcgtcctcaagtcctgcggcctccgcgtcacctccatcaagatcgatccatacctcaacatcgatgccggaaccatgtctccgctcgagcatggcgaagtgtttgttttggacgacggcggtgaggtggacttggaccttggaaactacgaacgatttctggacatcaagctgactcgtgacaacaacataaccacggggaagatctaccagtctgttattgacaaggaacgtagaggggattacctaggaaaaactgttcaggttgtgccgcacatcacagatgaaatacaagagtggattgaacgtgtggcaatgaatccagttgatggcacagaagagccagctgatgtttgtgtcatagaacttggtggcactataggggacattgaatcaatgcctttcattgaagcattaggtcaattttcataccgtgtagggcctggaaacttctgcttggtgcatgtcagtcttgtaccagttttaaatgtggttggtgagcagaaaacaaagcccacccaacat

SEQ ID NO: 11529 - DNA, 2496 bp, Zea mays
catcgggccgcgcctcgcgggccggaaccaaccctccttggctggactggacccccaacccaacaacagcagcaggaacaggaaaaagaaaaaactctctcccattcccatctcgcctcccacctcctccgcctcgccgccgcggcaggcaccgccaccaatcttctcttccgccccctcgttcgttcgctcgctcgctcgccaggagatcgactcgaggcgaggccatgaagtacgtgctggtgaccggcggcgtggtgagcgggctcgggaagggcgtgacggccagcagcatcggcgtcgtgctcaaggcctgcggcctccgcgtcacgtctatcaagatcgatccatacctcaacaccgatgccggaaccatgtccccattcgagcacggcgaagtgtttgttttggacgatggtggtgaggtggacttggaccttggaaactatgagagatttctggacatcaagttgactcgtgacaacaacataaccacggggaagatataccagtctgttattgacaaggaacgtagaggagattacctaggaaaaactgttcaggtcgtgccacacatcacagatgaaatacaagattggattcaacgtgtggcaatgaatccagttgatgacaccgaagagccagctgatgtttgtgtcatagaacttggtgggactataggggacattgaatcaatgcctttcatagaagcactaggccaattttcataccgtgtagggcctggaaacttttgcttggtgcatgttagtcttgtaccagttctaaatgtagttggtgagcagaaaacaaagcccacccaacatagtgttcgcggacttcgaggacttggactcatgcctgatattttggcatgtcgcagtacacagccacttgaagaacacgtgaaagtgaagctcgcacaattttgtcatgtcccgataccaaatatcattaatctccatgatgtcaccaacatttggcacattcctttgttgctcagagatcagaaggcccatgaagctattttgaaggtgttagaccttcagtgcgcgagtaaagttgctcgagaaccccaattgtctgaatggactgaaagagtcagcagatgtgacagattgaaatctccggttaggattgcaatggttggaaagtatactggcctgtcagactcctacctatctgttataaaggctcttttgcatgcgtcggttgctttggacaggaaacttgtggtggactgggttccttcctgtgatcttgaagattctacagcaaaagagactcctgacgcctatgaaaaggcatgggagtcgttgaagggtgcagatggtgtgttggtgccaggaggttttggagacagaggagtccaagggaaaattctggctgcaaaatacgcgcgagaaaacaacgttccatatcttggcatttgcttgggcatgcaaattgcagtgattgagtttgcacgctctgtcatgaagttgcacggtgctaacagcacagagtttgatccaaccacaaaaacaccatgtgttgttttcatgccagaggggtccaaaactcatatgggagcaacaatgcgccttggttcaaggaggacctttttccaggccactaactgcaaatctgctaaactgtacggcaatgcttgctacgttgacgaaagacaccgccacagatacgaggtgaatcctgacatggtcccagaatttgagaaggcagggctttctttcgttggcagggatgagagtggcgaacgcatggagattatcgaactaccaactcataggtttttcgtcggagcacagtttcaccctgaattcaagtcaaggcccggcaagccatctccgcttttcttaggattggtagcagcgtcatcaggccagcttgaccacttgctccaacgtggccttaccagttcagcaggcagagacatctgcggcaaagggggagcgcagaaaccaaaagcttgccagaacgggcatgtcatgaagccactgaatggcctggtgcacgggcactattcagcgactcgctgcaatggcgtcattcccatctagcaggccccatctggcaggctgttttcgcttgttctttttctttccgttctacctacctgcagggcaaccaggaagagaagggctgtttgctctagcgacacggcagccgtttccgatgttttaacgaggaagcaattggcatgcaaagctgtcgcgcgcattaagaggcaaatctagcagcttattagctagggttcgattagtagtagtagtaatccgatgttgctggtttatttgttagtttgtttgctaagaaagattacaagggttagtgatgtgcagctagctccagtgtagcctgccgtctcgccccatttgtacattgtaaaaccactgctactctccatgattgactgaatggatgagtataaacgtattggaccaacatgctcggtgttataaacatctaagttcccaatccaaaaaaaaaaaagcggcc

SEQ ID NO: 11530 - DNA, 3825 bp, Zea mays
  misc_feature (109)..(109): n is a, c, g, or t
  misc_feature (2289)..(2289): n is a, c, g, or t
ggcatcttatttaaccgtccacaatggaactctcttacaggaccagaaggcccatgaagcgattctgaaggttttagacctccagtagtacgtacttctcacatcgacngactgttcatactgttgcttgaacactgaaggagcactgctcactttctgttactgttatgtgtgcagtgatggaaaggtgcctcgggaacctgagctaacaaagtggactaaaagagccaccaagtttgacaagttgaagactccggtaggtttcagtcatcgttcttgctattgtttccatgaggggagggggtgaaatatttattagacacttgtgtttctgagcaagcagttggttaaattgagcgctgctgcattaacttttcaggtcaagattgccatggttggaaaatacactggcctgtcggattcctacctgtctgtcataaaggtgacattattactgtctgaattaaaaaagaaaaagaaaacttagccaactaggaggaactgggtggtaacataaataagaagaaatagagatggacaaatttgacctgaaaacgaacatgggttgtgggagagtacatccatacctctcaccaacccatcttttttttggttacgaatgaatcggaggggaaaaaacatactagaccaaaatgaattgcatgttttcttttcaatccgtcaaccatgactctaccctatcttttattgaaaaaaaaggccagagcaacagtgagatggctgggcgggatgctgttttctgcatgaaggcagcttgtttaaattgtggtttttatggctcttagttcaacggatctgtgcctggaatacccttccttgatagcgaaacaaacaacaaagctgcacctcctgactgttttgctcttcctgctgactaatgtgccgaaaccaacgtcgttacaggctcttttgcatgcatcggttgctatggaaagaaaacttgtagtcgagtgggttccttcctgcgacctggaagattcttcagctaaagaggtcggtttagtcgtgggcattgaatcgatttctattcctcgatggagcttttgctgatgcttttggagacgtgtttgtttcgtgtagacccctgaagcccataaaaaagcatggaaattgctgaaggtaggtgcaggcatcaaacggtagtttcttgaaagtcatgtgcttatgtacatacagtccgtctcacggaattccattccatcccagggcgcagatggcgtactcgtccctggagggtttggggacaggggagtccagggcaaaatcctcgccgcgaaatacgcacgcgagaacaacgttccttatcttggcatctgcctgggaatgcaaatcgcggtgatcgagtttgcccgctcggtgatgaagctacgaggtgccaatagcacggagttcgatccagctacgacgtcaccctgtgtcatcttcatgccagaggtaggtcatgcttacttggtggtactgccgttcatttttgaaccgcgaacttctgactgacagcacttccactccacgtacagggctcaaaaacccaaatgggagccacgatgaggcttgggtcgaggaggacctatttccatgtcagtggctgcaaatctgcgaagctgtaagaaaacactagccctcatgttttcttcagtctagcgcatgattgtacacgtacatttgatgtggtgaaacataaccgttgtaaatatgcatcaggtacggcaacgccagctctgtagatgaaagacatcgccacagatacgaggttccgtgatctaatcgatctattagccatatcgaataataatagtgcatgccactgttaatctttttttgctcagtgaagaagagatctctttgttcttcttttctttcaggtgaaccctgacatggtcccagactttgagaaggccgggcttcagttcgtgggcaaagatgagagtgggaaacgcatgggggtaagcttaagctaggcctggagatcttctccgatgctgtagacttagttagatgtgcttttctaggaacttaataagaaaaaaggccttctcaatcacttgatggcgcgctctgttggatgatgcagatcgttgagcttccctctcacaagttcttcatcggtgcacagttccatcctgaattcaagtcgagaccagggaagccatctccgcttttcttaggtaacgcttttcttcttctctcctgatattcactctgctgatgaggctgctgctgctgcattttgacttttgagcacgccccgagggcctcaatctcaagtcngagcccagggaagccatctccgcttttcttagggctgatagccgcggcgtctgggcagctagaaccattgcttcagcgcagcaatccgacaacgaaagcatgttcgatcagtaaagtcccgaaactgaaactgtaccccactgggcctgtgaataatccactgaacagcttggtgaacgggtactacccaaatggcactgggatccacacctagaagcgtagcgcttagcgatggtttggttggtatttgctgctatggtttttttgcttgtacccctcctttttcatgtgttcctttttttcagtttgttatttgtctctgatcaactgagagaagagaaggctaagattcagcaagcccccagctccagcgacacatggttccgacatttttaacgaggaacgccttccagtccgttgaagcgagctagccatagggtggtgaggtctagtgtgatgttgttgttgtttttttctctttcctttttttttggcctggaactaaggcgcgaagtgttttgagtagcgctagtagagcctggaagaagttatctaaactatttgtacattatggaagaacttatctaaggactgaatacacaaatgcttggccatgattgctttgttgccacaatatgaacaaccacgctcagatgaagagtattggtgttgttaaaaaatgccagtgaaattgttgttgttaatgtttgtgcctgtgttgccctactgcatcgtgtactacattacttatctaaacacgtttatacacaatacagtacattaaggtatgcataaatggagttttgacgaacgaagacagtttcttcccatgggggagaggaacagtgagttgtatttgaatacagtgatgaatttcatgagcatggaaacgattcatgtcagatacaacccactgaattttgttagcgatgacacttccgctcccaccccttggcgctccctctcccgccgacgcctaggttatcgtatcccactctagccacacgacggtgcttactacaagcccggcggccaccaccaccctgtccccggcatcggtgggcactccttcggctcctcttcctggtggacggacgaagactcagcgctagagtgatgatggcgggtcttcttcttccccaaagatggagtggtgatccagagggtgattcgcgaagttagtggcgggagtagctaccccaccctaaccaagacgaactactccgaccgtgcgctcctcatgaaggtgaaactcaaagcccgagctctctgggacgcgatccagcagggtggcgtcgattctcatgaggagatgatggcgctggacgtgctgtgcagcgccgtgccacctgaaatggtgccaacgctggcaaaaatggagacggccaagcaggcctgggatgcgaccgcaaccatgcggatcggagacgaccgggtgaggaagtcaacggcgcaacaactgcgtcgaaaattcgacctcgccgcgttcgacgacggcgaaaccgtcgaggagtatgcactccgcctcaacaatag

SEQ ID NO: 11531 - DNA, 1422 bp, Zea mays
cgtttccgaccgttttcatccctgccaagttgcacgttgcgctttctcctgtcgtcgccctcgcccaccaccttcggagctcggagactcggagtcttcccccacccccataacgtcctcttccgtgctctgcgttgccgcctgcgggcgccgcaagccgtgcgtgcccgcgggttccccgatttgtttatttacggaagtttacaattgatcaacaagacttagtccaaccctacttttcaaatcactatggttaccctttcctacagctgggcaagcgtagaatgtcagtcataatgttgggctcaaagaaggaaaggaatctcagcatgcactttcaatcagaccagaaatcttctgctaaattttgtttgttttcaaaagtccaatctgccagcccaccaccagggaatacactggtttatctaaatgtgtatgatttgacaccagtaaacggctatgtttactgggctggtctaggggtatttcattctggcattgaagttcatggtgttgagtatgcatttggagcacatgactattcgattagtggagtttttgaggtggaacctcggcagtgtcctggtttcaaatttcggaaatcaatatgcatgggaactaccagcctggatcctctccaaatcagagagttcatggagattcagtcagtaaattacaatggtgatacctaccatttgataagtaaaaactgcaaccatttctgtgaggatatctgcaaaaggttgacaggaaattttattccaaaatgggtgaatcgacttgctagaatgggtgctgtttgcaactgcattctaccagagtccctcaagatcaacgcggccggtcatgacccagcttctcgagctgaagatagcgagagaaaaatgctgacaagttccttcagttgcttctgttcaatctctctatgccaaagacatttctcaacatcttcgccgtctctgcgttcctccgcgaacggcacttcttgggataccaagcagtccaattctacccgactgaagaagagctgacagttgaggtcctgtgtatcatatttaactcatgaggcacaaggatccttttttgtcagcaatctcttctacgaccttcatcagagaaggatgaagaggtattgattgataaggtgtttttgcatactcgagcgtcggatccagctgtgcttgaacatctgtacagagattgtgtagaaattatttcttacatttgaatttgaaatacagtgagctggaggaaactccaccctagacttttggaaaaaaacaaactccaaaaaaatcattgatgggtgctgcctctggagtccgaagtgatatttcgcctgtggtagtttgcaaatttggccatttttatacccttgcctatataaagttttatagttttgttttaaaaaaaaaaaaaaaa

SEQ ID NO: 11532 - DNA, 945 bp, Zea mays
gtggcgtgcgaaccaaaaccaggtgtcaccttgggtgcgtgcatggaagacaagagggcaaacacaagctgagatacggcggaaggcaacaagaacggccgccttcgcctccgttcatctctatcccagatactactagcgagcacgccatggagcaaaccgaggcggcggtgagcggcgcgcttggagcgggagtggaaggtggcgacaagacggcgaggaaggcgctgaaggtggtggcggccgtggacgcgagcgaggagagcctgcacgcgctgtcgtgggcgctggacaacgtcgtgcggtgccacccggacgcgacgctcgtcgtcgttcacgcccagcacgccgccgaccacttcgcctaccccgtcgccgcgcacggtatcggtaccggcatcgtgtacgccccgtcctcggcggtggagtccgtgcgggcggcgcaggaggagagctcccgcagggtcgtggcgcgcgcgctggacatctgcaaggagaggcaggtggacgccacgggggccgtcgtggagggcgacgccaaggaggccatccgccaggccgtggagcgtatgcaggccgggcttctcgtcctcggcagccggggcctcggcgcgatcaaaagggcgttcctgggcagcgtgagcgactacctcatccatcacgcctgctgcccggtgctggtcgtcaggcccaggccgaccaagtgaactcgcctatcgttctcgagcagtactccagtcatgtacgcagtgccctgtgccgctgcgcggtcagtaataccagtatatgtatgctcatagaaaaaaaatgtagaaaactgaataaagaacctatgcatggttgtatctgcacaaattatcaacgcgcctccttgcctgcacttccgaactttgccgttatcaccaaagaattaagacaggactgcaacaaaaaaaaaaaaaaaaa

SEQ ID NO: 11533 - DNA, 1190 bp, Zea mays
gcccgtcccccagccacacagggactgagggacacatgacaaaacaggaagcactgcctgctcattttcttcctgtgcgcgtacagagatactactagcgagcacgccatggagcaaaccgaggcggcggcgcgcggcgcgcctggagcgggagtggaaggtggcgacaagacggcgaggaaggcgctgaaggtggtggcggccgtggacgcgagcgaggagagcctgcacgcgctgtcgtgggcgctggacaacgtcgtgcggtgccacccggacgcgacgctcgtcgtcgttcacgcccagcacgccgccgaccacttcgcctaccccgtcgccgcgcacggcatcgtgtacgccccgtcctcggcggtggagtccgtgcgggcggcgcaggaggagagctcccgcagggtcgtggcgcgcgcgctggacatctgcaaggagaggcaggtggacgccacgggggccgtcgtggagggcgacgccaaggaggccatccgccaggccgtggagcgtatgcaggccgggcttctcgtcctcggcagccggggcctcggcgcgatcaaaagggcgttcctgggcagcgtgagcgactacctcatccatcacgcctgctgcccggtgctggtcgtcaggcccaggccgaccaagtgaactcgcctatcgttctcgagcagtactccagtaatgtacgcagtgccctgtgccgctgcgcggtcagtaataccagtatatgtatgctcatagaaaaaaatgtagaaaactgaataaagaacctatgcatggttgtatctgcacaaattatcaacgcgcctccttgcctgcttttccgaacttaaaaaaaaaaaaaaaaaaaaaaaaaaaaaaaaaaaaaaaaaaaaaaaaaaaaaaaaaaaaaaaaaaaaaaaaaaaaaaaaattttttcggggatgaagccccgtttgaaaaatattgcaactttatgctaaaggatggaacttgggctgcccacatggagctgaaagccgtttttttgttgacaaaaaaaaatatatgcattcacatgcttaattcaccacgtgggaacataaacaacttttttggccgggaagctacaaacagggttcacttgtctaaaataagggggagcattacaacagtgtcaggctgaaaaaaaatccatgtaaaggccctgcaatgccagttgtcat

SEQ ID NO: 11534 - DNA, 842 bp, Zea mays
cactcctatgggcgattggggccctcgacgccggccgggaactttccatcgccaatccacggtcaactacacaacaccttgtcgccttaaacgcacaaccagcgacaagatgcgaacctacgaggacaccttctccggcgcgagaatctaccctggcaagggtaagctctacgtccgtggcgacagcaagatcttccgattccagaacggcaagtcggagtctctcttccttcaaaggaagaacccccgccgtatcgcatggaccgtcctctaccgccgacagcaccgcaagggtatctctgaggaggttgccaagaagcgaacccgccgcactgtcaaggctcagcgtggtatcgttggtgcttctcttgacgtgatcaaggagaagcgcaacatccgacccgaggcccgctccgctgcccgcgcccaggccatcaaggagagcaaggagaagaagcaggccgaggctgctaccaagaagtccgagaaggctaagctcgctgcccaggcctccaagggccaggctgtccgacaggtcagcaagcagggtgccaagggctctgctcccaaggtccaggccaagacccgttaaattaggaatggaacttgagtgaggatgaaaatgggagagtggagtccgtggttcttgtgtctttgtccggccggttcttctacaatctcgggtgcatggaatgccaatagggtgcattgatagttgagcaatgcaaaatggtcaaacaaacaaaaaaaaaaaccagcggcccccggccgtgacgaacaagggatgtgcagttgtgcggtggctcggtaaatacctcacggcgttattgggaactagcaac

SEQ ID NO: 11535 - DNA, 921 bp, Zea mays
attatggttattgttagcagccatacgttttggccatttgagctattcgagcaatttgcttccaataattcaagtttttacagacttaatggttatgcactagatgatgtaacgttctcggttctccccttccgtaccgccagtcggtacttcagttattagtcagcagattgtgaagaaacagctgtctccaaagcgagaagacgaagaaaggggaaatcgagagatgagctaccagagagtccctcccgaggaaccctaccctcctccaggacatcctcgatctcaggcgcacccttacccaccgccaccagatgtgtacccgcctccccctcggggccatggacatccaccaccaccccatggcgtgtacccgccgccgccgcagggtccttaccccccaccacagcagcctccaccggggtaccagggctacttcaacgaccagcagcgtccttactacccgccgccgcatggagagcatcaacacaaccaccaccagggaaaccagggtagctcctctgggttcctcaaaggatgtttggctgctctctgctgctgctgcgtgctggaggaatgctgcggctgcttctgagacgtgagatgtccgggaatccgatcgcaagttatcgtcgctagcattcgggagcaccccagttattatcatataatagtaactgtgcttgtaaataatctggagcagcagtgttcatgagctcccagccccgcatttatattctcataatttgtagtacgttctatgatttatccgaaaataaaggactctatatatgggattctaaataaaaaaaaaaaaaaaaacatgaaaatcaaacaaaaaaaaaaaaaaaaaaaaaaaaaaaaaaaatccctaaggcgcatttcccgcccgtttggacacgtgataaaatcatctcaccc

SEQ ID NO: 11536 - DNA, 3614 bp, Zea mays
cgaaattcgtttttcggttagtagcgaaaacgggaaaaattatcgagattcggtgattccaatgcgggatagtaaacagtggtccaggtccatgtgtgtctgattaaggaaggaataatgacgcgcaaatatgagggaagggaggccacaaatgagggacgccaagcttttggggaaggaaaagggacctgttagagcgacaaaaaagtgattgtttcccccctagaattgattttggggttagtttaaggtttcttttggagttactctaagccccccataacggagcgatgttaaaatggttctcctccctatacacctaagattaactagatttaagtgcatcgtaatttatgacaacaaattgatattattaaatatatctttttataatatgttcatgtggtatcataaattatcatgatttctattattttagccaaacatacaaaagtttaacttgactaattctacgatttgatttatttaggaacagagggaatacaaatcattataacactggtaatacaaaaggagctagtgtggtttgcgaacactaactgcatttgaatattatcgtgagcaggctgggatgtcaggatccggaggtggagatcatcttcgacagtgtaagcgtcgaagccgtggtgcctgtcggccgacggacaacgcccacgcttcccaacaccatcatcaactgtgggaaggtaaccacatcttaatttcgtgtagatgcgaattttaaggaccatggaaggtaggtatttctggcaactactactgatttctgtggtgcaggctgtaatggattctgtgctcatgcgccgctccagggaagaaacgtttaaaatcatagatgcagtgagcgggacaataagatcatccaggtacagtcccatgaccattcggtattaaacagcacaccacagtgaaaaatggcagtttctctaaaaatgtttcaatgacttgttcagtctaattaataacctggtcagcctgtaatcaatcaggtgcttttcttgtgtggccagaatgacacttcttcttggagcacccggatcaggaaagacgaccctgttaaaagcactggcaggaaaactagattcttctttgaaggtagtactagtccagtccagtcctcaaaattagtgtaaataaatcaaaaccatgtcacagaagcagcatgtattgattagtggttattcctaagaagttagtacgtacttttgtgatagaaaaacgaacatcattaattttctgatttcttgtcaatagatccatggagatgtcaaatacaagtgtaatggggaaacaatgtcatctacatcgcagcacctctgtgcgtacgtcagccagaatgacctccatcatcccgaaatgacagtgagggagactattaatttcgcttcaaacatgcttggggccaacaatgaattcggtatgagtgcctgttggttttggtcaaaatcaaaatattaaattgatatcctcaagcgatagcaacatgcattcatactgatatatacatatacacacacgcgcgctaattatctcctgctggtgataactgctttagagacgctgagagatgcattacaaagaaaaatggaaacatgcaatgaactaaatcaggacctattttccaaggtgctatagccatatttgtttaagataagaaagcatcagtttattttagtagaataacagctaagttgttcccgtacaggcaactaaacctggaaacggaagcaatcttaaaacaaactacatcatcaaggtaaaatcttattttaatcaatgaagttatcattttttactgtcaacagggaggggggacatcctcactttttttttttttttttcttttttttttttagagaaacgaggcaaagcactatataaaattgtggtagaccatagattacaaacaagtgctagcacaacacagcaaatacttcaacaacacaggggaaacaaagaaaggaaacccaacacgtcgcatgttaaagcagttgaaacgacaattgtcgaacgacgactagcgcttcgactaaaaataacatactcgtcgacaaacctaggcctttgctcatctagacctccccttgtagctacgcgtgtcccgttgacttatggccacgaacaggggctaaaggaggtcagaggcatagcgaccataacataccgaaaacgacgatctcctttcgagaaaacagaaacacccgatggcgcatccgggctctaatgccaccatccaacgccgcttgaggagaaatcctcatgggtgaatggcaggagaggcggatattcaccgacctagcataagattaatatgcttctgttaacaaggagagtgctgacggagcagacgcaccaaaggaaggcactcgtcgcaccacgacaaaggctggaacgccagtgccaagcacaacgacacaagagaaccttacaacaatccaaggaggtcatcggcgtcgagggcattgctgttgtctgtgcagactacacctggcatggctttcgtatgagaccccaaaaaccctgctcatgctagcggcaatgccacaacgaacacaacagcagccaaggatagccggggtgacaggagtagccctaaactcccagtgtcgaggatggaggcttaggtcgtgctccaatcaggggtccagtgcaggctatggaggccagctttggcggcacaaccttgaagatgtggaggcgacgagggggcgggggtgctaggtcggcccttaaggaagccgaggtggcggagtagccccgttctcctggcgacaagggtggaggctcgggtcatgctcctctcaggggcccagagacggcgatgggggctgacggtggcggcacgagtgcacgaccctgaaggcgaggcgacgagggcccaaggggagccgaatccattgaagccgaagcctaccgcatgcagcagcggctagggcctagccaccaccgccggccgcccctgtcgtcacgtgtgccagccacggcgatgcgagccagcgggggcggccatgtcaacggtacccagccaatggcaacagggccgctcgcctggcaccgcgagacgcgaccggccggcgagaggcgacgacgacaccagtgagaggtcaagctgctccagcgtcgagaagtagaaagtcggcctaatgatgaggaacgcgagcgatcgtgggtccctgctcagcgtgagcacagaccatgtggtccgctccgccgcaaggagccggtagcacaccggcgtggcgtggtgccaggatcgtgcatcggtgaggaagcccaggatgcggagcagtagcggcgagaggccgacgccaagcagatccgactagagggaggcggatcaggccggcgctcagcaggaccggctggcgcgaggcgtggcggaggggcaacggcgaccgaaaggcagatccgaccagcgcccgatggatccaaccggcgagaggccgagaagatgacggcaccgatgtcgagacagagggggcggggaagagagagaggggagaagagtggaaagggagggatgggccgccgccgccgtggccggcagtggcggccaagtgaacaccaccggggcctaggcttttggcgcagct

SEQ ID NO: 11537 - DNA, 2749 bp, Zea mays
  misc_feature (693)..(693): n is a, c, g, or t
  misc_feature (2627)..(2627): n is a, c, g, or t
  misc_feature (2725)..(2725): n is a, c, g, or t
gtgtggtgtattcgtatactccatttatcctaatgcatgagcgtaggtgtcctacaaccaggttatgggaaaatactaacaggactgatgcaaatatggactactacatgctctgggcttttttagctggtccacttttcattttagttttctatttggggaactgctggagtaaaatcttagcctgccgctaataagtttttgtttgccgctaattatcagttttgggggaaaaatttttagtatccttttggagatgctctaagtagctcaatgcctcaatcagagacctttcgctttcgacttggctttcgtgtggcaacgtcattcgacaagcccatccacaatacatcccatccttcaccatcacagacccagagccaatcaataaaaatctgggtcagtttaaaaatccgacacctttcctcactaaaacatgcttgatcgtacccgagttttgttttttatcacttgtcgatccgaacgagcgaagcccgagaaactgcacctaaaaccatcagccggtgttctgcttcttggtgcccagtttgtctccggattagccgtcaaacccgtctctgaactctgctgccatgtactaccttctaacgacgcatgaagtcgctggtcttcgcggacgcctttggcacgcctggttgaactgaattgtgacccgtcgtttacgtgtcgaanaacgcctttggagtctggccaggagacgacgaggtcagccgatggccaaccggggcgccatcgtctgacccgcttcccctatccgcaccgcagccttttagtttcgtctcgtgcggcgagcacaaaattctttgccgcctccgcgacaactaggccggcctgcaacgggaataaccgcccgccccgcgcatagcctaacggggcagcttgcttggctctgatgctgccatgtcgcgcgcgcctcgtatcgtatcggtgctgttcctgttgcttggccccctccccgtctccttggtccacgtgaccgccgacgggcccgtgacggcgacggttcaccggcaggacggcaccgcgtggcgctcgttcaagcagctgctggacgcgcggcgaggcagccacgttgagggcctcggcgagctcaagcgctacctggcgaggttcgggtacatgcctggggcgggggcggagcacgagccgacgactgacgcgttcgacgcgcacatggaggccgccgtacggcggtaccagtccatgcttagcctgccggtcacggggcagctcgactccaccacgctggaccggatcatggccccgcgctgcggcgtcggcgacggcggccacgctgtgccggtatccctctcggggtcggcggcggcgagcccggacggcgccgtcagccggttcacgttcttcaagggtgagccgcggtggacgcagccggacccgctcgtgctcacgtacgccatctcgccgaccgccaccgtcgactacctgcctgccgggaccgtgcgcgcggtgttccggcgcgcgttcgcgcggtgggcgcgggtcatccccgtgggcttcgtcgagaccgaagactacgaggcggccgacatcagggtgggcttctacgtgggcagccacggtgatgggatccccttcgacggaccgctcggcgtgctcggccatgccttctccccgaagaacgggcgcctccacctcgacgccgcagagaggtgggcggttgacatggacacggaaacggtgcactcggccgtcgacttggagtccgtggccacgcacgagattgggcacgtcctcgggctggggcactcgtcgtcacccaaggcggtcatgtacccgagcctcagcccgcgggaaaagaaggcggagctcaccgtcgacgacatcgaaggcgtccagtggctgtatgggtccaacccgggattcagcctcagctcgctttaccagcaggactcctccatggcgtcgggagggagcagttggcttcctgcctcggctagattagtttgtgcagttctggtcatgctagtgacgcacttgtagatagacatgtctataatacacaaaaaggataagaacagaaacagaatgaaaaaacacaatgatcctgctacaggagagaatctcttgtgggattttatctttgtttttgcacacaaattgtgtgtgagactcgtgcctctcctttgatagtttggtatttggacagtaaaattattacagaaatggcccatgtaactgtacataatcttatcagtcaaaagtgtacataatcagtcaaaagtgtggacaaagtgttatcaacacaagatatgtttactggctgctacctagtcaaatatgaaatggtgagatgtaatcatgagggcccagcttgctctgcttccgacgatttatgtgccacagtctttgacatcccgaacatcttcttgatagtctttgtgaagcatgtcatgtgttcatcagaagaggcgttgatgaactcgtggatgtgatctctcaaatctgagacgaatgatgtgccgggtacattttttcggcatgaatgcaaatcacgtttagaaccatgttgatgtgatccttgaggttcggtggtcatgagataccagacgaaatccaccggtgaagtttttttcttcaataggaanctgctacggtagccaaggacggggtggcaacagaccccgcccgggctgggagcggcggctagggttttaaagttggcctagcgaattagggttccttncgatgttactcgaacacttcatgc

SEQ ID NO: 11538 - DNA, 1813 bp, Zea mays
gaaatatggagccggatagacgtgagaaagggagggttgttggagacggcctaaacccttctccatccgacggcggacaccagcttccctccgcccgcccacatccctgctgtgtgctgcgcctccccgcctgatcttgtcgcgcccgagagaccgcgcgccagggaacgtcggccgccggagcctggcctgcattccgggggcagcgagaggatgttgcgttgcgcatacacgcagcggcggtgggcgcaccgccgggggggcttcgtaaccggcagcaccggttggtccaagccgccaccgccgggcctcggccgcgccgcgggggttggtacgaagaagtcggagtggtggacggtggacggggagatgcacgagatcggggaaagcgtgccgcatcgcgagcgcttcgccatcccgcgggacaacctccctaaccgccgccgcaagcagatgcgggagcaattcatgcgccgcacccgcctcgttctcaaagactcggaacacgaaacatggtgcaaaaattacatggaattataccaagaacttagagaaaactgggaaaggttgtactgggacgaaggttattcaaaaaagattgccgaatctcatgctaattatgactctgccgaagaagatgatattgacttctcgccatacagcaggagaaggcagtccaatgtagaaccaaacaaggaccttggcttcggggtgaacaaacgaggtgaaacgtgggaaagggttactcaaattcgtgacaaatttgaatatgacagagaaaggagaatgagagaacgagcatttgctcccatgaacacggagaacaattttgctcggcgtgacccaagatttagaagccaggatgattcaagttttgctcatacgaacttgagtgatgattttggcttgcatgatcaaacttttggaaaccgttctgatcaaagttatgaaaatgagtcaaatttcaggaataagcgtgattcaagtttccaacatgaaccaagtgtcagaaaccagcgtaatttaaatatccaaaacgaaccaagtttcagaaaccaccgatatccagatttccaaaaccaaggtggcacaagaagtcagacatttgatgagtagagggtgaaaaaaaaagtggctgctgatttgctggcaacgtgagcatgctggttttgctgatttctgtggtggctcgtatgagatgttgtaatttcttctaaaatgattggtgtaagaaattatctcttgtggtagctggttgcaacaaaatagaaaggaagagatctgctgttgtaatcttgtaatatacgttggctacttactaagccaaaaaccgtaagcatcggattttgggcttgcacgttgctgagcaagttaaaagttggaataatgaggctaatttccaaatctgcctttgcaaaaaagaatgcaggttgctcctaacgtatctcaacaaacttattttctgcttgcatttgaaatgcgcatttgtttatttctttaggttcaccggcaacaatggtacttcatttttagtggattcgatttgctcgtcgtgtagtgtttggattttttttattttgttttataaagcaacgtttctagttctcccacaaacgggcccaattcagctacaatgacaagcccaattcagctacagagacaagcctaataatctaggcccactgtgtgcaatgcggtgaggttccctccgaagatataatgatgagccagccggttggacggtcgagattctccaaatcctagtagccgtccgcgcaaaaccctccctgctcagactcgtctgctgcaggtc

SEQ ID NO: 11539 - DNA, 2588 bp, Zea mays
gaaggggtgacgaacgcagactgcagcaggagcggagcgggcggagaggttcagggcgttcgggagatgccccccgtggagaagtccaagagggggaagcgggaaatccaaggatggcaagctcaagattgtcagggcgcggggcgcgccgccggcgctgccgccggagctccgcgccctcgacaccgagtggtggtacgctttccttgaacaagcaagtcgagctagagcatgctgtgcctccagatgagggggaagcattcaggcacttcttcaggacttcaaggaagacttttgactacatctgctccattgttagggaagatctgatctcaaggccaccgtctggactgatcaacattgaggggaggctgctcagtgtggagaagcaagtggcaattgccatgaggaggcttgcgtccggtgattcccaggtgtcagtagggactgcttttggtgtgggccagtctactgtttcacaagtgacatggagatttatcgagtcgatggaagatagggctaggtatcatctggcatggccaagccaagagagacttgagcagatcaaagctgtgctggaggatgcttatggccttccgaattgttgtggtggtgttgatgccacccacgtaatcatgacgcttcctgctgtcgagtcatctgcagattggtgtgatcatgcaaagaactacagtatgttcctgcaagggattgttgatgatcagatgaggtttattgatattgttactggttggcctggcagcatgacattctcacgcctgatgaaatgctctgggtttttcaagctctgtgaagctggggaacgtttgaatggctctgtcaaagtttcagcagagggtgcagagatcagggaatacattgctggtgactcatgttatcctctactcccatggcttatgactccattcgaaggaaaacatctgcctgccccattgcaaaactttaatgcccgccaaaaagctgcaaggctgcttggaacaaatgccttggcgcggctgaagggatcctggaggatcttacacaaagtcatgtggaggcctgacaagaacaagctgccaagtataattcttgtttgctgtctgcttcacaatatactcatagactgccatgatgaattgcttccgagtgttcaacttcccgaacatcatgatactggctataatcgagaaaactgcgagcaggtggatcctaatggcaaagtgatgagagaaaacattacagcacatctccaacactgtgaagctctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatc

SEQ ID NO: 11540 - DNA, 2910 bp, Zea mays
aaagactgcagcaggagcggagcgggcggagaggttccgggttttcggggtggggtttgggagatgcctcccgtgaagaagtccaagaaggggaagcgaaatccaaggatggcaagctcaagattgtcagggcgcggggcgcgccgccggcgctgccgccggagctccgcgccctcgacaccgagtggtggtacgctttcctgaacaagcaagtcgagctagagcatgctgtgcctccagatgagggggaagcattcaggcacttcttcaggacttcaaggaagacttttgactacatctgctccattgttagggaagatctgatctcaaggccaccgtctggactgatcaacattgaggggaggctgctcagtgtggagaagcaagtggcaattgccatgaggaggcttgcgtccggtgattcccaggtgtcagtagggactgcttttggtgtgggccagtctactgtttcacaagtgacatggagatttatcgagtcgatggaagatagggctaggtatcatctggcatggccaagtcaagagagacttgagcagatcaaagctgtgctggaggatgcttatggcctgccgaattgttgtggtggtgttgatgccacccacgtaatcatgacacttcctgctgttgagtcatctgcagattggtgtgatcatgcaaagaactacagtatgttcctgcaagggattgttgatgatcagatgaggtttattgatattgttactggttggcctggcagcatgacattctcacgcctgatgaaatgctctgggtttttcaagctctgtgaagctggggaacgtttgaatggctctgtcaaagtttcagcagagggtgcagagatcagggaatacattgctggtgactcatgttatcctctactcccatggcttatgactccattcgaaggaaaacatctgcctgccccattgcaaaactttaatgcccgccaaaaagctgcaaggctgcttggaacaaatgcgttggcgcggctgaagggatcctggaggatcttacacaaagtcatgtggaggcctgacaagaacaagctgccaagtataattcttgtttgctgtctgcttcacaatatactcatagactgccatgatgaattgcttccaagtgttcaacttcccgaacatcatgatactggctataatcgagaaaactgcgagcaggtggatcctaatggcaaagtgatgagagaaaacattacagcacatctccaacactgtgaagcttccaagtttctctgcaactgagctaagttagcttgttgttttgctgggattttgatgatgcatcattattccttttaccttatgcaatttcccttagtttctgttattgtagtgagactttctgattgcaattcagtaaagattctctagaaatggcatggttcagtactatagaaaatagctagttggaaaattacaaggactagccctcatgcttgggtttatgttcttcaggataatgccagtcctcatcatgctgagtgccatgaagttgcataatgtaacaaaattcatgaatgatctggtatctggtattttattttttgaatgatttgatatcttaagttaggttggtttataaggtcccagtttatatgatgtgacctttattgttggagagggcttgaacttgattgcatgaattccataccatgataaatgtgcaacaggcaggtccagaattttgtggcgttaccagatatagcaggaattgcataacctgacaaaggtacattaagttgatctagtaaaggttgcatgatctgattttggttataagaaatgtggatgagaggaaacaaacttttgtttagtttcatgattagaattaactggattgcgatgatagaatctgttaaagatacaataatgatagttccctactcttatcttacattgttctcaatcgtgatttgtaatttctatcaagaactaaaattgaatcttctttgatggagctctgtaaatgcttcaagcgatgtttaatagttttattaatcagcttcagaaaacctttttcgcaaatgagctggctccataaaactaatgtgggcttctgaggttgctttcgataattttgcttggttaatcatgagatttgaaaatgtttttatcctcttgtgctcttaaaatctttcgcatgaatgttacccgattatttcttcagaatgtttcttgagcaaaaacatgctaatatccagtccaatgaaactgtttttacattgcactactgatttttcaagcaaaaggcaagtatgcactactgattttacattgccctgcatttgaatcttcaaacgttccaccaatctgcatctccaatttcactgccaatccctttcaaacaacattttaaagcatttaaacaatggttgccaacacatgtgaaaacttttggtgcatagatatagagaaacaagataacagttaaaggatatacaggcagcaggtgaaaatgaagaaaagattgacctgctctcctctgttcttttcctttgttagggcatgatcaaaccttgcattgtaaaccttttgctcacgtatcttctaaatggaaaatgattattggaatgcattcatttgtaactaaatccataagtttgttgccttgagaaattggtgatgtgctgatccagtaggctttcttattatatgctgttcttttaggtacaggtaactaggagagttatcttttgctgttgactgatgattccagtcaggtgaaattgaagtgagtccattccactatatgtgctcacagttttgcctgcacttctctgattttgagtggtactatagttgtcgcagtcacgtaggaggttggtttgcttcttttgtggtgattcccaatgcatccaatacttttctgcag

SEQ ID NO: 11541 - DNA, 2549 bp, Zea mays
  misc_feature (2331)..(2331): n is a, c, g, or t
cccggtcgcccagcgtcgtgctgctgcagggctgggagagaaagtcgccggttcaagcttggggagggagcctgccggtagcttcaaggtgatgcatgacgccagaagggggtcgagaccctcatgctgatttggagagagcgccttgggagggtgcacctgtggatttgggttctggtggatcatactcctccgggcctacacaaaaaccaccggtgatttgacgctggcagagacgccggagtgccagaaagggatgaggctcatactcagcctgtgcttatccgaggggttcgataccttcccgacattgttatgtgctgatggttgctgtatgatagatcgcagaatgggtgtatatggctaccctattgagattcaggcccttttctttatggcactaaggtgtgctcttcaaatgcttaagcatgataatgaagggaaggagtttgtagagaagattgctactcgccttcacgctttaagttatcacatgcggagttatttttggctcgatttccaacagctaaatgacatctatcgttacaagacagaagaatattcccacactgctgtcaacaaattcaatgtcattcctgattcaattccggattggctatttgacttcatgccttgtcagggtggttttttcattggtaatgtcagtcctgccaggatggacttccgatggttcgcacttggaaacatgattgctatactttcttcccttgcaacacctgaacaatctgttgctataatggatcttattgaggagcgttgggaagagctcatcggtgaaatgcctctgaagatatgttatcctgctattgagaaccatgaatggcgaattgtgacgggctgtgatccaaaaaatactagatggagttatcataatggaggatcgtggccagtacttctgtggctgctgactgcagcctgcatcaaaactggacggccacaaatcgcaagaagggcaattgacctagcagaaaggaggctgttgaaggatggctggcctgaatactatgatgggaagcttggtcggtatgttggcaagcaggcgaggaaattccagacctggtccatcgcggggtatttggtcgccaagatgatgttggaagatccttcacatctcggcatgatctccctggaagaggatagggcaatgttgaagcctgttttgaagcggtctgcgtcatggacaaactgagatggccacgaaaatttttagggaagcaaagtctgctgaaaacacgagttcttgggggtagcatctccttgtctgctgatccgtttcctttgacttccaaacatggatggtttgtgtcttctggattttccttggttgtacaatatctcagctcgttttctgagttgaaagaaaaagaagcaactgcagaaatgggcattttgttttcttctttcgcaatctctgtaagaagatactctgattcttgcttgggtcatcctataagttgtggatccttttggttagagtcaactttgttgtgccagtggattatacggatgagtaagctgattccagcttccctgtgaagcataagtgctctttctaacgaatgaataaagctcctttctctgtgttgctggatgcctgtgtttctgcggcctttacttgactgcctgtctccctgccctgtgacgacaagtcatagaaagcgtgccttgtgtgtctcttcctccttttgtctcctagagcttcgcggttgtacttgtgttcaaggaaagaaaacaattctgatccagccacccctgttcccctctatacatttagggcttattcaatttgctcttaattcatgtggattaggtgggattggacgagtttaaacctcaaacaagttaaaatcttttataataatgtttctaattctattcaatccacgtgcggaacaagactcagaaacatcattcagtgtaagaatttaagaaatgattcaagacatgagtagtgcttcatgcctgagtttgagacacgacatagttcaatcattcgagtcgtgccaattcgatccatttttttcgtgtcaggctatgtacttatgtactgggctcttattttcggttggccattcttttttcaggtctaatccccgctacgccatggctgctgcctcgctacgccatgagtagtgagagtgagaggcagaaaataaaaaatacctttaaaatattagatttagatatttttatatttgttcaaacttttaactctatttgactgataatttaaatcatacagtacattttacgacacgaagggcttgtttggggcaaagggtaatggaagggattgaggggactataatncctcactattcaaaattaagtagtaggggattcttgcccccttaatccactacattacctttgatcacaaacaagcccgaagagtgcacagcgattatcatcgggctttcgccagcaaattttcaaaaggcaatcaaaattctattggaggcccgaagtttaacatataagcggacaaacacagaagcccagtgcctgcaacacagttcattccagcc

SEQ ID NO: 11542 - DNA, 1258 bp, Zea mays
cattgggaccctcgaggccggccgggttgctgtatgatagatcgcagaatgggtgtatatggctaccctattgagattcaagcccttttctttatggcactaaggtgtgctcttcaaatgcttaagcatgataatgaagggaaggaatttgtagagaagattgctacccgccttcacgctttaagttatcacatgcgaagttatttttggctcgatttccaacagctaaatgacatttatcgttacaaggccgacccacgcgcccgcacagctgtcaacaaattcaatgttattcccgattcaattccggactggttatttgactttatgccttgtcagggtggttttttcgttggtaatgttagtcctgccaggatggacttccgatggtttgcacttggaaacatgatcgctatactttcttctctcgcaacacctgagcaatctaacgctataatggatcttattgaggagcgctgggaagagcttatcggtgaaatgcctctgaagatatgttatcctgctattgagaaccatgaatggcgaattgtgactggctgtgatccaaaaaatactagatggagttatcacaatggaggatcgtggccagtgcttctgtggctgctgactgcagcctgcatcaaaactggacggccgcagattgcaagaagagcaatcgacctagcagagaggaggctgttgaaggatggctggccggagtactatgatgggaagcttggtcggtatgttggcaagcaggcgaggaaattccagacttggtccatcacggggtatttggtcgccaagatgctgttggaagatccttcacatcttggcatgatcgccctggaagaggacaaggcgatgttgaagcctgttttgaagcggtccgcgtcatggacaaattgagatggtgacgaaaatttttagggaggcgaagtcagctgaaaacacgaattcctgtggtagcgtctccttgtctgctgaccccttcatttgacttccaaaccaggatggtttgtgtctacttggttgtacaatatctcagctcgtttcctgagttgaaaaaaagaagcaactgcagaaatgggcattttatttttttctctctctttctcaatctctgtaagaagacactctgattcttgcttaggtcataccctataaataatggatccttttggttaggctcaactttgttgtaaaaaaaaaaaaaaaagatgagtaagctgattccagcttccctgtgaagcataaa

SEQ ID NO: 11543 - DNA, 1383 bp, Zea mays
  misc_feature (1275)..(1275): n is a, c, g, or t
ggggacgcctccgctcggtttactataaatacgccggctccccccccgccgcgtgttttcccctctttccgcgttcccaccctgccgtcgttgctactcgcatcgagatttgcgcggccgtgtcttgctcgcgcctgctgctctgttgccccccttccttccaaggtcgcgtcagcgcccagatctctcgctcgctcgccggcgccccggctagatctgggcggagctcggaggcggagccgtgcgccagtgtccaagtttggtaagacccaaagcggtgaggaggcgagggaagacgcgcggacgccatggagctggctgtcggcggcgggatgcggcggtcggcgtcgcacacctcgctgtcggagtcggatgacttcgagctcacgcggctgctcagcaagccgcggataaacgtcgagcgccagcgctccttcgacgaccgctcgctcagcgacgtctcgcactcgggcgggtacagcaggggaggcttcgacggcatgtactcgcctgggggcggcctgcgctccctcgtcggcacgccggcctcctccgggctgcactccttcgagccccaccccatcgtcggcgacgcctgggaggcgctccgccgctccctcgtcttgttccgcggtcagccccttggcaccgttgccgccgtcgaccacgcgtccgaggaagtcctcaactacgaccaagtgtttgtgagggatttcgtgccgagcgcgctggcgtttctgatgaatggcgagccagatatcgtcaagaacttccttctgaagaccctgctgctgcagggctgggagaagaaagtcgatcggttcaagctcggggagggagccatgccggctagcttcaaggttatgcatgacgccaagaagggggtcgagaccctacatgctgattttggggagagcgccattgggagggttgcgcctgtggattcggggttctggtggatcatactcctccgggcctacacaaaaaccaccggtgatttgacgctggcagagacgccggagtgccagaaagggatgaggctcatactcagcctgtgcttatctgaggggttcgataccttcccgacattgttatgtgctgatggttgctgtatgatagatcgcagaatgggtgtatatggctaccctattgagattcaggcccttttctttatggcactaaggtgtgctcttcaaatgcttaagcatgataatgaagggaaggagtttgtagagaagattgctacccgccttcacgctttaagttatcacatgncggagttatttttggctcgatttccaacagctaaatgacatctatcgttacaagacagaagaatattcccacactgctgtcaacaaattcaatgtcattcctgattca

SEQ ID NO: 11544 - DNA, 1238 bp, Zea mays
cccacgcgtccgcccacgcgtccgcccacaagatgggtagcagaagcagccagtttccgtcaatggcactggccatggccacggtgctgatggcactggccggggtagccgccacagcgcgagccggcggcggcatcgccatctactggggccagaacggcaacgaggggacgctggcgcagacctgcgccacgggcaactacaggttcgtcaacgtggccttcctccccacgttcggcaaggggcagacgccggcgcttaacctggcgggccactgcgacccagcgagcggcgggtgcacgggcgtgggcgcggacgtcaaggcgtgccagcgcatgggcgtcaaggtcctgctctccatcggcgggggcgtcggcagctacgggctctcgtcccgggccgacgcccggagcgtcgcggcgtacctctgggacaactacctcggcggcggcggcggcggcgggtccgagtccagctccaggcccctcggcgacgccgtcctcgacggcgtcgacttcgacatcgagagcggcgggggcatgtactgggacgacctggcccggttcctcaagtcctactcccggcgcgggcgcgcgcggaggcccgtgtacctgtccgctgcgccgcagtgcccgttcccggacgcgtcgctgggcaccgcgctcgccacggggctgttcgactacgtgtgggtgcagttctacaacaacccgccgtgccagtacagcgcgagcgccggcgtgggcagcctggcgaaagcgtgggcgcagtggacgtccatcagggcggggcgggtgttcctcggcctccccgccgcgccccaggccgctggcagcgggttcgtgccggcgagcgacctcgtggcgcaggtgctgccggtggtcaagaactccaccaagtacgggggcatcatgctctggtccaggtactacgacgggctcacggggtacagcgacgcggtcaagtcctacgtgtgagctagccagcctcgtgtcatgtcgggcgtgcaggagggagtaggactgtaggaggcacatgcttccatgtgcgtgcacgtgcggggcgttatcatacctatgggtatactgggtcgctattcgctaaggaagagaccggaaagaagcaaatcgcaaatacagcttcttagcggtgtttgtttgggattataatccacttagattatataaaaaaaaaaaaaaaaaaaaaaaaaaaaaaaaaacaaaaaaaaaaaaaaaaaa

SEQ ID NO: 11545 - DNA, 1128 bp, Zea mays
aaaaaaagatgggtaggagaagcagccagtttccgtcaatggcactggccatggccacggtgctgatggcactggccggggtagccgccacagcgcgcgccggcggcggcatcgccatctactggggccagaacggcaacgaggggacgctggcgcagacctgcgccacgggcaactacaggttcgtcaacgtggccttcctcccgacgttcggcaggggccagacgccggcgctgaacctggcgggccactgcgacccggcgagcggcgggtgcacgggcgtgggcgcggacgtcaaggcgtgccagcgcatgggcgtcaaggtcctgctctccatcggcgggggcgtcggcagctacgggctctcgtcccgggccgacgcccggagcgtcgcggcgtacctctgggacaactacctcggcggcggcggcgggtccgagtccaggcccctcggcgacgccgtcctcgacggcgtcgacttcgacatcgagagcggcgggggcatgtactgggacgacctggcccggttcctcaagtcctactcccggcgcgggcgcgggcgcgcgcggaggcccgtgtacctgtcggcggcgccgcagtgcccgttcccggacgcgtcgctgggcaccgcgctcgccacggggctgttcgactacgtgtgggtgcagttctacaacaacccgccgtgccagtacagcgcgagcgccggcgtgggcagcctggcgcaagcgtgggcgcagtggacgtccatcagggcggggcgggtgttcctcggcctccccgccgcgccccaggccgctggcagcgggttcgtgccggcgagcgacctcgtggcgcaggtgctgccggtggtcaagaactccaccaagtacgggggcatcatgctctggtcgaggtactacgacgggctcacggggtacagcgacgcggtcaagtcctacgtgtgagctaggcagcctcgtgtcatgtcgggcgtgcaggagggagtaggactgtaggaggcacatgcttccatgtgcgtgcacgtgcggggcgttatcatacctatgggtatactgggtcgctattcgctaaggaagagactggaaagaagcaaatcgcaaatacagcttcttactactactttgc

SEQ ID NO: 11546 - DNA, 1061 bp, Zea mays
ctcgagccggccgggaaatgatgtgatgatctaattgtttccctattggtttgattggccgccatgatggctccatttgggtcccccccggccggccgggacaagttgcagtgacacagttccacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagcggtgggggtggggagtggagggggtggatcgggtggtgggagtggaggcggaggatctggtggaggcggcagcagcggtggaggcggcggatctggtggtggtggaagcggtggcggcggcggatctggcggcgggccgacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgactatcacacgcccatcgatcgatcgatctggaggctaaataatttctccaagctgctagtatacgtacgtacgttgatatatatgatgtagtattatatatatgtccatgcatctcgtcgtctatcgcatgttgttgttgttgttgttgtttttcgatgatcctgtctctgttataaatatcattattattacagtaaaaaaaaaaaaaaagcggccccatttggcctgatgcatgcacattcatggttcagatttttagcgacatctcgctgaattaattttccgtgttggccgaaagaaaaatcgt

SEQ ID NO: 11547 - DNA, 819 bp, Zea mays
aagagtttcctcctccactccctcccccccgcctccactaccccactcccaggagccgcccaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtgggggtgggagtggaggcggaggatctggtggaggcggcagcagcggtggaggcggcggatctggtggtggtggaagcggtggcggcggcggatctggcggcgggccgacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgatcacgcccatcgatccatctgcaggctaaataatttgtccaagctagtatatatacgtacgtacgttgatatatatgatgtagtattatatatatgtccatgcatgcaatgcatctcgtcgtccatcgcatgttgttgtcgttgttgtgtgtgttttcgatgatcctgtctctgttataaatatcattattattacagtaaaaaaaaaaaaaaaaaaaaagaaaaaaactctgcggtggtaccactgctcggtgga

SEQ ID NO: 11548 - DNA, 3492 bp, Zea mays
cgcgcctggagttctacgtacgtgcatatgtgtgtatactacgtatatactaatatataagcaccgccgatcatgcatgcacgcagacaccagctgtccaccacgtactacgttgacctctcgatcgtcgtgtaggctgatggatcaactaaagaggggacgatcgatttgcagcggctgacggatatggatgctcattttttaaaactctgcttccccctcctctcaatcttttacagtcgtacgtaccatgcatatacagcagttactacaagcagcaagctactcctaactaaaaagtgaaggatggatgagtgagcattgtagccatccatggcgattgcatagcatgcagtacgcccgtcttttcgaaaccactataccgtgacaccacacagacgcaagctcttccaaagcccacccctgcccgttgtctcctttcctcgtgacagctgctagctagcttttcttttcacctttctagagtagaggaacgatggatgttgtagctagctaggtgacgccggccgacaccacgcactagcactccactgcctagctagctagctttgtaccatccggacatgtacatactagtactacgtacaatacagtcaactagctgctaggtaccaaggtcgtcgtcgatctagccttcctccctagctatatatataatgaacagtacgtaggtgtacgtactaatcatggatcgttattaattactagggctttgtttccccgccccgccccgcctataaatagcaccccaagcaagctgcgacctgatcacaagttgcagtgacagttacacgcagcagatcagagaggcacacgcactaggtacctgcagtctggtctgcaggtacgctagcgatctagctaccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggaggtgctggtgctggtggtggtggtggtggaagcggtgggggtgggagtggagggggtggatcgggtggtgggagcggtgggggtgggagtggaggcggaggatctggtgggggcggcagcagtggtggaggcggcggcagcggtggtggaggcggaggaggatctggtggtggcggcggcggcggcggtgggacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccatcgggcttccagtgcttctgatatatatggtgtagtattatatatgtccatgcatgcaatgcatctcgtcgtccatcacatgttgttgttgttgtgtgtgttttcgatgatcctgtctctgttataaatatcattattattacagtaaaaaaaaaaaaaaaatatttgtaattggcctgatgcatgcacattcatggttcagatttttagcgacatctcgctgaattatttttccgtgttggccgaaagaaaaatcgtaaattttatacacactaataatgcatgcatgtgaactttggactaggcgtctttattgtttatgttatatttttcaacacaatggatataaatcatactagtaagtatttgtttaaatctattttttagatggtgatatttttgttttcatgcatatgtaagtctctaaaaatatctaaagaagtttcagtggtggccgaaatcttcgtactaataacggaataaaaaaaaaaaccatatgcatgcaggataaatgaatgcataagaacgagaacaccgtatatatacctgcatggtcgatcgatgcaacgtaacaacaacaggaaacaaaaatcctttgcatccgggatgcaaataaagaatctcttttatagctcctcacattcaacacttgttccataaaaataaaagaaaaataaattactaaaatagggtatttgcatctgagatatacagaatttcttttcccaacaacagcacacgtaatattattttttttttttttgcatgcatgctcggtcctgctcacagcaacaaaatggacagtaatatatgggtttcgttcttctttctacatgaaagaaaagaaaagaaaagaaaaaaagatatatgggtgcacggccggccaatcgtccttggaatgtttgacgatggactgcgggccaatgcaagctggtagacagagaaatgatggatggatggatcgatacgtgcaggctagggcaccaacgtgctcatctctttagctaatttctcaacgtactgtttattattatcacgtgaaaaactatatcatgcatgcatgatgttttctagagagagagagagacagacagagagagttgcacacaataacacgtacaggatcgagagatgaggaacgtacgggtgtgcacgtacgctggccgcccatggtttagctacagctgggagagctgatcgagagggtgcatcgtctggtcaggatcggaggccaggctgaccattcatcgatatcgtctggaaaggtgaggctgacgtttgttttgtagctaggtatatgcccggcccgtgaaccctagggttttgttggcttgcgcgcccataatttgcaatccgtgaccagtgatcggtccataatgcatgcatagaataagaaagcatagcagcacgagcaactgtacctcccccctctccatccgcatacgactgtcgtcatccttcgctagctatatacctaccttttcaacctactttatttcaacaaaagttagctagtcttccttttttttctacctacgtacagtatgtcagtacgcatacatgtacatcttatacggttgcgcaattcatgtacatgcatatagatgtcccttttatttggcatggctatttagacggctttggctttagtttataaagtcctaccaaatggtcaacaaatagtttctcgttaagtgccctccaagaactggagccgttttcttgttggagccaaagcaccaaaaacctcggtagaaggcttctaccgggtcctatctacaccttttcttatacatcattcgaatgaaacacaagagaagatgttttgccaaaccaattacaaaatggatctctctcctctcgataaaccaatgagttcagagaaaccatagccagaactatttttaaataagccggagtcctgtcaaaaagggctctagatttagggttgatttggtagatagaggaatccataccctaagagaattgtttcaatgtccggattgaggaacatatatatata

SEQ ID NO: 11549 - DNA, 1928 bp, Zea mays
actttagaaaaaaaaaatcctgaccgggcatccctcggctgcagagtcgacctcatccaagttccatttattattttctccgaggaagccctttccccaggcacagatccggctcctcgccgccgccatggccgcccgcctccccctcctggtcctcgccgttgtcgctgcgtccctcctcgctgccgacgcgcggccgtgccacaccttcttcgtcgccttccgcgccgaccccaaccccagcagaggcgacgacgctgtaccccaccacctcggcgccccgcatgtcgctacagtcatcaccgtcttccgtgtccgccgtctcggtccgcacgtcccccacggccaccgtaaccaccaccacctccactccatccccgccaacgtccggatccaccgccccgatctcccgcaccccgccgcggggccccaggagcgcgccagggacatcttcgtggtcgtcatcgggctcctctttggcgtcgcctgcggagcgctcaccgctgcttccgtgtacctcgtctggtccatggtcgccggagctgctgcggtctccgcgtacgacgagctctacgacgacgaggacgaggcgtccgacatcgagagccccaagaaggtcggctacgtcatcatccaggagctcgaggtcgatgaaggcggtaagaactagggccggatttggtggcgctcgtgctcccgggaggtagggcaagttcctgaagtgggttggcctatggccatatgttgagtgaatcgtaatgtctgtatgacaatgtgatgcgcagttgggacttgggagccttaggggtttgccctccatgtgaatatgatcgtgaagcatgcttaagctaccaaatgtgcttgtttctgacgaacctatcaatcaatgttatgcaccactgtgaaactgttcatttgatctgctatctaatgtattatggcctggcttcgagatcagagttatacaatgtgaggccccgttgggacttgggaaccttagagctagtttgggagccacaaacccggttgattttagcccctccaatcccctctggttttgtggctcccaaactggcccttagggttttcctgtttgcttttagcagttctgtggtcccattataggtgttatataatggcttgtctgtcctgatgtaccaaagcttggcttatcggttgtttgaagattatgtggtttgagtatgcttgttttatcgtgtgtggattaacgattgtgttggactgaagcaccagcagctgcactagctgatagttagttctgaatgtgttcgtagtctgtttgttttgttaacatgttatcgctgccaacctatctgatgattgaaatgttcttaatgtgttgataatctgtttcttttgttactatatgttatcaccgccaaactatcagatgatttaagtgttctctgcattataatatgtgtctcttcaattggtgatggcaatatggtagtcaggtactcaggtggttgctatagcattaccaacaacccaacatgttctaatcaaggtatattatgtaccatgttaattgaaaatgtctatttgccattcatattgtttactgtgcttatggctatgagcacaaaatctgtgcaacctgaattagtattgaaatatgtggatggtcgtcatttttcatgatgtgatggtgtagttctgtaacagattagtcattttgatgatgcagattagtgctattagattgtgggtggccttgatttgatttggctaagtgttatctatgcttttgtttgggacgtcagtatagtctatgctgttgttaggtatcctgtttattctgtctattcgctatatattaaagccaactgttcacactgctgcagctgcaatctatagagataaaacattgtagaaacaatagaagccattttagactagagcta

SEQ ID NO: 11550 - DNA, 1115 bp, Zea mays
  misc_feature (510)..(510): n is a, c, g, or t
acacacacctcgagctcacatacactcccatctccccctctatctggagagagagagagaaagagacatggggtcatctctctccccgtcatccgtcgccgcgctcaccaccgcagcccatgggcaccgctaccacctgtcctcctcctcctcctccgactactacgaagacgacggcttcgagttcacgccactcctacccaggccgcggcgccggcacagcgcgcgcacggagcgtccaagaaccgtcgcccaggctgcggccacgacggcggcccagccgcagcctccccagctgcgcgcgcgccgcggagcgccaagcgtcgtggccgcgacgccggcggcgccaccaacaccaaggaagcagcaggtgcggtggcacgacatggcgttcgggtccgcgcgcgtgccggcggccatggacatgggcgagatcaggaggcgcctgagggcgcggcagctggctctggccggtggccccgctgggaacgagcggccgccatcctccgnccgcggggtgggcgccgtggaggctcatacggtcgctcagctgcaagggcctcgagcccgtggcggctgccgcggcgccggtgaggctggtggcggcggcggcggcggcggtgggacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgactatcacacgcccatcgatcgatcgatctgcaggctaaataatttgtccaagctagtatacgtacgttgatatatatatgatgtagtattatatatatgtccatgcatgcaatgcatctcgtcgtctatcgcatgttgttgttgttgttgttgttttccgatgatcctgtctctgttataaatatcattattattacaggaaaaaaaaaaaaaaaatgtttgt

SEQ ID NO: 11551 - DNA, 4258 bp, Zea mays
  misc_feature (1344)..(1344): n is a, c, g, or t
ctaaagtcttcatgacatgactaacctttgccgaatactatggcctacaattttacatataaataattacagagaacaatattgtaaaaccgtatttttgagaaatattggtgccaaacagagccttgagttgagaagctgatacattcggttcggccctgcaattccagacagatggttctggttgcagctcaaattctttggctggaagaagggcgcacgtcgctgtctctgatgagcaggctttagttggatcaaggtcgctgttgctcggtttatatggtccagtctaaatccgtctactgcttctatgcccaaaaaaagatcgatccactctctcgtaggatttgtttttgggaaggaaaaaaaaacaattcatatgccttgagtggaaaaaaatcgaaatggaaatgaaaggcttgctaattatcaaaggacattagctaagctctgcacatcactctaagtctttacccctactagtactacctaaggtattaaaaaaggagaataaaaaccaaaaggaaaaaaagaagaagaagaaaacttgtggccagggatgctttggcagcgtaacgttaacgacggccacaagttggggtggggtgggtggtgtgggccccgccgcaggatctttctgggcctcgaagctggccgcgtgacgtggcgccgaaaaagcgcagcgagaaatacttgtggccacgctttttgcggccacggatattcttcttttctttccctgcacaagcacagcacagcacggtgcacttcctatattattttacttttctgttacaaaaaaagagaggaaatgctcttggaatttcttgtggacacgacacagctaggaatttatccttctttcttgttcgtttcctttttcttatctagtaacgagaaaacggtccgggtttatccgcggaaaaaatatctgctatttgaacggccgcagatatttgcggtgttttctcttttattttctctacgctgcttcgtgccctattgtcaacacgtggaaaccttcctatccactccaatcacttcactccacttctcaaattttcagaacaaacttctaaatttataatgaggctcaatgaaatatttaatttcgatacaatgctatagataaacaaaaccaccctgagaaaatggggaaaaaaaagagaaagagaccctctatctcaaaagggaaaacagaggggtcagaacgtaaaatatccgcagagggcggaggtgggccctcccctcccggggcctccccagccactcgatccctggcccttctcgaaatttccagccctgacaggcggggcccacggccgacgtggcccgcctcccctnccctcccttcgcccccagaaatctcgccgctcccacccctctccttcctctcgccatttccatttccttgcccttgccagccagagcgagactccaccgcttcctctccgccgcgtcctcctcccctccctccgttcctcacggctctccggactcgccccgcggctggccgtgctgagtttcgttctctggccggcaaagaagcgatttttttgtgctttctggacggatcccggccggagaagggaccgaatttccacgacctcgaccgccggctgctcctctgctgggctctccgtgcgcaagaagagcctaccaaggtgaatccggagatttgagctccgggcccgcctcatggagtccatggcgcaggtatgcaattgtctcctccctttccctcctccacttgatccttccctgccgcctgccggtgttgaaaatagttttttaatgccaatatctcatcaccctcttaaaaaaatgtgctgtttctagacgcttctccttcctgtctgttgcacgccaatcatggcacccgtagagagttctactagaacgagatgaccaacacgtaacatgtgtttagctaatttgctgtactcgttccccttttttacagcactatcgcaacttgtcttccaatcaatccaacagttcccacccatcctattattaccaccaccattacatgtcttaagttgatgtcgtttgcgggatccggagcactgggagctcaaatctggacatttatgcatggtagaagtagaatctggcatggctttgacctgttgagggacgatcactaaatacttgtttcctgttgttccttacaggaaagggacgcgttggattcacctgccttgtcgattgacaaaaggctgcggtcggatgctgtcgaatcacccctggtggatgatgcaacgcaacccaaggagggggcggacggttaccctgtcaaggtacccatttattgtcccacttttgagatcagtgtgagcgtacagcactgtcaccagctcaccatgccaactaatgggcacctgccttgattcaagtaggttcggaagccttacacgatcacgaagcagcgagagaagtggacagaggaagagcatgggaagttcctggaggcactgaagctctatggtcggtcttggcgccagatacaaggtgcgtgcaggctttacatgtgaccctacgttagagcacgctgatgattagttctctgatttgtcctccaaactgccgtttattagaacacattggcacaaagactgctgtccagattcggagccatgctcagaagtttttctccaaggtgcttaaccctcatgtggctgtgctcaatttagctgctgtcactgcattcacagtattttaccatcacatatgcttgcacagtgagattatcggggccctgccccggagctttcctccctggtcgtgcgtgaacctggggccagtaattcaatggagatcccaccccctaggccaaagagaaaaccactgcacccataccctcgcaagtgtgccgactccaccgtgacaaatgctccaatgggcgaaccgaagaatgctcctgtttcatcaccatctggttctgaccaagagaatggttcgcctgtctcggtgttatctgcaatgcagtcggatgcttttggttcatcaatatcaaacccatcaactgggggcacgtctcctgcgtcatcagatgatgggaataatgtccctgagatagtgaatggggaggaaaatttgctcactcagcaaatagaagaccgatcccatcaggaatcaaagcaggacaacagtgatggtgagctgtctgaagaagattcatcacgagtccaagaaaccagtttgaagctttttgggaagacagttatcatcccagacccaaagaaagtctgttcctcggatgggggagctggagatgatacacaagaagtgatgcaaacatcctgggttggaggaggggtggcagcataccctgcccataacggatggtttcttccgttccattctttccctgctcatatgtatgagtcaggggatgctaggatttcccctcttcatatgtggtggccttactacggttttccggccggccatccaagagggtttggcacagggctgcttaacgaaggcgccattgagagtgatgccgacaatagcccatcggttgaaactaattctgatcgcacgggcaatgttcatgttcagacgacgacccctaccattcacaacaatgctgtcaaggagtcagttgggccagttgagatgccagagtcgggtccgagcattgagctgaaacccagcgcgaactcggcctttgtaagagtgaagccgagcagcagcgtcagcggagaccaatcactggtaagggggttcgtgccatacaaaagatgtaaggtcgaataacccaacccaacgacatacctgtctgctgctaatcttactggagattgattgatcctgaacagtgtagggactcgagtggcacacatcccttgttccagtgtgcctgccattttttgcctgcaaaattggctgctggtgtatgtgtaatattgtcgttttactgcctgcagcggaatgtaagatgccgcaggcttgttgctgtcacctaggcgtagactgaacagatgttgtgcagggatcgccgatctctgcacccttatgtttgttgtacgaggaaaaccggattctgttgaactctcgtgttcaaaaattcattgattcctgatggaaactgatttgtaaatgaacatggcaatgccgccggacaggttacagtgtatcctgtaagaccaattcttttggtccttgaacaatggaatgcagactaggttttggtcattcaaagcaaagctttggtgtgatgttattgtgttggatgcaaagcaagcgatct

SEQ ID NO: 11552 - DNA, 1919 bp, Zea mays
ggcgggccgggcttccgctctccccatttccatttccttgcccttgccagccagagcgagactccaccgcttcctctccgccgcgtcctcctcccctccctccgttcctcacggctctccggactcgccccgcggctggccgtgctgagtttcgttctctggccggcaaagaagcgatttttttgtgctttctggacggatcccggccggagaagggaccgaatttccacgacctcgaccgccggctgctcctctgctgggctctccgtgcgcaagaagagcctaccaaggtgaatccggagatttgagctccgggcccgcctcatggagtccatggcgcaggaaagggacgcgttggattcacctgccttgtcgattgacaaaaggctgcggtcggatgctgtcgaatcacccctggtggatgatgcaacgcaacccaaggagggggcggacggttaccctgtcaaggttcggaagccttacacgatcacgaagcagcgagagaagtggacagaggaagagcatgggaagttcctggaggcactgaagctctatggtcggtcttggcgccagatacaagaacacattggcacaaagactgctgtccagattcggagccatgctcagaagtttttctccaaggtcgtgcgtgaacctggggccagtaattcaattgagatcccaccccctaggccaaagagaaaaccactgcacccataccctcgcaagtgtgccgactccaccgtgacaaatgctccaatgggcgaaccgaagaatgctcctgtttcatcaccatctggttctgaccaagagaatggttcgcctgtctcggtgttatctgcaatgcagtcggatgcttttggttcatcaatatcaaacccatcaactgggggcacgtctcctgcgtcatcagatgatgggaataatgtccctgagatagtgaatggggaggaaaatttgctcactcagcaaatagaagaccgatcccatcaggaatcaaagcaggacaacagtgatggtgagctgtctgaagaagattcatcacgagtccaagaaaccagtttgaagctttttgggaagacagttatcatcccagacccaaagaaagtctgttcctcggatgggggagctggagatgatacacaagaagtgatgcaaacatcctgggttggaggaggggtggcagcataccctgcccataacggatggtttcttccgttccattctttccctgctcatatgtatgagtcaggggatgctaggatttcccctcttcatatgtggtggccttactacggttttccggccggccatccaagagggtttggcacagggctgcttaacgaaggcgccattgagagtgatgccgacaatagcccatcggttgaaactaattctgatcgcacgggcaatgttcatgttcagacgacgacccctaccattcacaacaatgctgtcaaggagtcagttgggccagttgagatgccagagtcgggtccgagcattgagctgaaacccagcgcgaactcggcctttgtaagagtgaagccgagcagcagcgtcagcggagaccaatcactggtaagggggttcgtgccatacaaaagatgtaaggtcgaataacccaacccaacgacatacctgtctgctgctaatcttactggagattgattgatcctgaacagtgtagggactcgagtggcacacatcccttgttccagtgtgcctgccattttttgcctgcaaaattggctgctggtgtatgtgtaatattgtcgttttactgcctgcagcggaatgtaagatgccgcaggcttgttgctgtcacctaggcgtagactgaacagatgttgtgcagggatcgccgatctctgcacccttatgtttgttgtacgaggaaaaccggattctgttgaaaa

SEQ ID NO: 11553 - DNA, 2829 bp, Zea mays
gttcgaccccctcgctgtgtccctaccgctaccgagttgcatactgcacgctaccctccgtctgggcatgagtgggtaatgatgacaagctagtaatcagagatattgttagcgaggaccatgtttccatctcttgctctccggcatactcttacggcagcaagtagggtcgttagatctgaagctaaattactgctactaaaacaaactgaacctgacgctggaatggatggatctacgcgctaaaccagcagctagctgttcaggcaggcgcagagcactcaattcactaccacaccactcctcccaccaggccggcctctgaattcactgcgccaaattacctgacaaagacagttccgaagtctcagtgtgatgtcaacgagcaagaagcgacgcccggccggcggcgaagcacaggcacagcacatcacaggtgtgtgcagtgcagtgcagggcacagcgctcggtctgcactactgcaggtttgtataattagacaagacacgattcgtgtacgttaattagcagctggtcatggctacaggcccaatcggatggcgtgcatgttcgtccagatgacaacacaccgctggccatgttgctaggtgccttcttcctcctccctacctctagctacgcacgcagtatacctaattaagtagccactgtacgttcttcaccagttcactctgcacatggatgcctggatcgatcgatcgatctgtatatataatagaaggttcctcgatcttcttttccttgccactccaccgagcaagctactagctgctggctgcttccttctgtcagtgtacagtagccggcttgcgagctgtgggccggccggtggcggtgctctcccgtctctatcctatccatcatagaatagaatagatagatagataggctactcagtgccactcgatcagtagtggtagcagctggcggctggcctgggacgacgatgagcgccaagaccagagctggggccgcccatgtacgccggcagctcgtcgcggccgtggcggtgacggtggcatgcttctactcctcggaggcgacgcagctgcaggtggggtactacaacggcagctgcccggccgccgagagcctcatcgagaccatcgtccacgccgccgtccgcaaggacgccggcaacgggccgggcctgatccggctcttcttccacgactgcttcgtcagggtacgtaggattattcgatgcccagccccagcccaatcggacaatgcaataatgcaactgagctccttgacagggatgcgacgcgtcggtgctgctggacgacccgacgggcagcccggggaacaggacggtggagaagacgtccccgcccaacttccctagcctgcgcgggttcagcgtgatcagccgcgcgaagcgcgtggtggagcggcggtgccccgggacggtgtcgtgcgcggacatcgtggcgttcgcggcgcgcgacgcggcgcgcatcatgggcggcatccggttcgcgatgccgtcggggcggctggacgggcgcgtgtcgaacgcgtcggaggccacggccaacctgccgccggcgtccttcaacctgacgcagctcctgggccgcttcgcgtccaagaacctgagcgccgacgacctggtgacgctgtcgggggcgcactccatcgggcgctcccactgctcgtccttcgcgcccgccaggctgtacccgcagctggacccggcgatgaacgccacgctgggggcgcggctcagggcgcggtgccccgccggcggcggcgggcggcgcgaccgcgtcgtcgacctcgacttcgccacgccgctgcagctggacaaccagtactaccgcaacgtggtgacgcacgaggccgtgttctcgtcggaccaggcgctcgcggggcgcaacgacacggccgcgctcgtggcgctgtacgccgccaaccgcacgctctggtcgcagcgattcgccgccgccatggtgaagatgggcagcatcgaggtgctcaccgggccgcccggggaggtcaggctcaagtgcaacaaggtcaactgatcggggggattggagttaggtgagggtcagctgcctgtactactaagctagctagtagcagcagcgggaatcgcgtcaagtcaagccggcccagagccagagattatttcaccatcactctcgacgatatgcacttcatctgcatgattcattcatgtgtgtacttaattgtacatgggatcacgtactacctgcacttttttttgcctagcttgtatactattattattgttgtttcttgaaaagaaaaaagtaacatatataccaattgcgcgcatgactgtaagtatgtatgaggcatacaattaagagatgatgattactgagaaattcgtggccctagctatgcatgcataataaattattgttcacgatccaagctgatctggtctgcggaagctagccacgcatgcaactgaaggcaacaactggcacgcatgcatgttgcctgtctaattgactctcgcttgtcgctgcgctcgctgtcgtgcactcgatctcttgccttgcctctctatctctaacttagctagcatgcttattggtctcgatctctttacacacgaggcgaacgaacgaaccgagaacatgcgtgcatgtgcatgggcctccatcattgacgattattgcatgcactcacagtgtcagcacctgcgcccttctcctgttcgggccgccggcgcatctgctggttatcaagtacggtttggcatgcatgcatggaggaggacggccgggtccagggagggaccgccatggctacctgcaggcatgcaag

SEQ ID NO: 11554 - DNA, 1126 bp, Zea mays
tgcaggcccatatatatggatagaaattatatgaggggctacaacccgacgagtttgcattgggttttttttttttttttgttttttcccattaattaaatgatataatctgtatattaggaactgcttcatttttcttgtataataaacaggtactctcaaactctgagcttcactacagcggactgagttttccattgaagcccgcatatgcatgaacccaacacaacacttgaataggttctagcaggtgaggttgttccctgggccgacgccgaactgcttgcagtactccttgtagtagcccacgcgcgcgttcacggcggcggggttctcgccgttgcactcgagggcgccgttgatggcacggatagtggcgccgaacccccgcggcatgacctggtgcgcgttgctcatccagaaccagagcgccgtcttgaacgagaccacggggtcctgcgccaccatgtccgggttcaccagcccgtcgaagccgacgctcctcccggcgggaccgtagttgtagttccacgagatctgcagcgggccgcgtccgtagtacttcttgcccggggcgcacggccactgcgtgttgctcgagttgcagtagctgttgttcttgttgatctcgctgacgtagcagaaatggccggtctcgtgcgtgacgtgcgcgaagaaggcggcgacctcgcgcttgccgtcggcctccgatcctgcacgggcgaagccgggatacgagctggcggcgctcaggaacgcccttcgcgagtagaagctcaagctactgccctcgcacccgctcccggcctgggacttgatgccgctgagaaatgcgtcggtgacgacgccactcacgttcgcgccgccgccgctaccggcgcccccggccgtgcacgggccggactggcacgtgttggcattgcagtagtcgaagctggtgccgcagtaaccgaacttgctgcagcagtagcctggcgggcagccgcagttctgcgcggaggccggagctgcggcgcggaggaacgctagcccgagagccagaacgacggtcaggatcgttgccgagtttgccatagccatgaccatgaatgatgatgatctgtgtttcaggaaatcaggactcccg

SEQ ID NO: 11555 - DNA, 2014 bp, Zea mays
ccaacctcgatccatcaaagtcacagagacgaccagctgaagcgaacacagagctgctcgccgtgtaacgcagcaggcagcagcacccagaggcggcaggtcacacacacagcacacgcagatcttcgatcaccaccatgggttctctcggcagcgccgcgcagcagcagcagcaaccgcacgccgtgtgcctgccgtacccagcgcagggccacatcaccccgatgctcaacgtggcgaagctgctgcacgcccggggcttccacgtcaccttcgtcaacaccgagtacaaccaggcgcgcctcgtccggacccgcggggcggcggccgtggccggcctcccgggcttccgcttcgccaccatccccgacggcctgccgccgtcggaggacgacgacgtcacgcaggacatcccctcgctgtgcaagtccaccacggagacctgcctcggtcccttccgccgcctgctcgcggacctcagcgacccgcccgtcacctgcgtcgtctccgacgtcgtcatgggcttctccatcgacgccaccaaggagctcggccttccctacgtccagctctggaccgccagcaccatcagcttcctcggctaccgccactaccacctcctcaagagccgtggcctcgctccgctcaaaagttagttcgtgtgcttttttttaatgatgacaccagcgacgtggggaaatttagctagtagtgcgcgcgccgcctactctgccatgccatgtctgaattctgataatctcaactcgtcgtttacatgcgcaggtgtggagcagcggacgaacggattccttgacacggcggtggaggacgtgccggggctgcggaacatgaggttccgggacttcccgagcttcatccgctccacggacccggacgagtacatggtgggctacgtcctccaggagacggggcgcacggcgggcgcgtcggccgtgatcctcaacaccttcgacgagctggagggcgaggcggtggcggccatgcgctcgctcggcctggcgcgcaaggtgtacacgctgggcccgctcccgctgctggcgcgcgaggacccgcccaccccgcgctccgccatcagcctcagcctgtggaaggaggaggaggagtgcctgcggtggctcgacggcagggaccccggctccgtcgtctacgtcaacttcggcagcatcaccgtgatgaccagcgaccagctggtggagttcgcgtgggggctggccaacagcggcaggccgttcctgtggatcatccggcgcgacctcgtcaggggcgacactgccgtgctgccgccggagttcctgtccgagacggccggccgcgggctcatggccacctggtgcccgcagcaggcggtgctggaccacccggccgtggccgcgttcctcacgcacagcggatggaactccacgctggaggccatgtgcggcggcgtcccggtcatcagctggcccttcttcgccgaccagcagaccaactgccgctaccagtgcaacgagtggggcgtcgggatggagatcgacagcaacgtccggcgcgacgccgtggcgagcctcatcgctgagctcatggagggggagcaggggaaggagatgaggagaagggcactggaatggagggacaaggccatcgaggtggccaagcccggaggcacgtcttaccggaatttcgatgaactggttcgcaatgtgctcctgccaaagaactaggcaacttagctctatatttgcagtttgcacggtgcttctgccagtgccgtgtgattttgttcctttgttttggagggagatggacaggtcagtgtcgttgtgtaaacaataaaaatacatgcatacgagcgtccaattgaggatgggcaagtctgaaacaaaaaaaaaaaaaaacatggattattgtggacaccaaatgtgtctcgccggtccgcggtccggactgtccgcggtggtggtgcggacggtccgcgcgtgcgcagaatcagttagggttcctagtttctcgcggg

SEQ ID NO: 11556 - DNA, 1833 bp, Zea mays
ccggccggttcgggccatccatcaaagtcacagagacgaccagctgaagcgaacacagagctgctcgccgtgtaacgcagcaggcagcagcacccagaggcggcaggtcacacacacagcacacgcagatcttcgatcaccaccatgggttctctcggcagcgccgcgcagcagcagccgcagcaaccgcacgccgtgtgcctgccgtacccagcgcagggccacatcaccccgatgctcaacgtggcgaagctgctgcacgcccggggcttccacgtcaccttcgtcaacaccgagtacaaccaggcgcgcctcgtccggacccgcggggcggcggccgtggccggcctcccgggcttccgcttcgccaccatccccgacggcctgccgccgtcggaggacgacgacgtcacgcaggacatcccctcgctgtgcaagtccaccacggagacctgcctcggtcccttccgccgcctgctcgcggacctcagcgacccgcccgtcacctgcgtcgtctccgacgtcgtcatgggcttctccatcgacgccaccaaggagctcggccttccctacgtccagctctggactgccagcaccatcagcttcctcggctaccgccactaccacctcctcaagagccgtggcctcgctccgctcaaaagtgtggagcagctgacgaacggattccttgacacggcggtggaggacgtgccggggctgcggaacatgaggttccgggacttcccgagcttcatccgctccacggacccggacgagtacatggtgggctacgtcctccaggagacggggcgcacggcgggcgcgtcggccgtgatcctcaacaccttcgacgagctggagggcgaggcggtggcggccatgcgctcgctcggcctggcgcgcaaggtgtacacgctgggcccgctcccgctgctggcgcgcgaggacccgcccaccccgcgctccgccatcagcctcagcctgtggaaggaggaggaggagtgcctgcggtggctcgacggcagggaccccggctccgtcgtctacgtcaacttcggcagcatcaccgtgatgaccagcgaccagctggtggagttcgcgtgggggctggccaacagcggcaggccgttcctgtggatcatccggcgcgacctcgtcaggggcgacactgccgtgctgccgccggagttcctgtccgagacggccggccgcgggctcatggccacctggtgcccgcagcaggcggtgctggaccacccggccgtggccgcgttcctcacgcacagcggatggaactccacgctggaggccatgtgcggcggcgtcccggtcatcagctggcccttcttcgccgaccagcagaccaactgccgctaccagtgcaacgagtggggcgtcgggatggagatcgacagcaacgtccggcgcgacgccgtggcgagcctcatcgctgagctcatggagggggagcaggggaaggagatgaggagaagggcactggaatggagggacaaggccatcgaggtggccaagcccggaggcacgtcttaccggaatttcgatgaactggttcgcaatgtgctcctgccaaagaactaggcaacttagctctatatttgcagtttgcacggtgcttctgccagtgccgtgtgattttgttcctttgttttggagggagatggacaggtcagtgtcgttgtgtaaacaataaaaatacatgcatacgagcgtccaattgaggatgggcaagtctgaaacaaactgttgtgcttgcatggattatattgataaaaatacatgcaaactgcaaaaaaaaaaaaaaaaaaagcggcc

SEQ ID NO: 11557 - DNA, 1839 bp, Zea mays
atttgtttctttctttgccttgcagacaaatagcacgcagcaatcaaccgtcgtcttcttcctcgacgcctcataggctcatagggttctccaaattctaaatcgttgcaagcgaaaccaccaaaactgtactcacaaccctcgtctgcgctgcgccaccactcccccgtggcggcttgtagttgtagaagttcccggaaccagacaacccctaggcgctgagttttctgatagcggcttcggatatctcgtcgtgggcggccatggcgggcccgtgctgagtgcggggcgggagcaggtgaaggtctccgagctcgagatctcgatgcagattcgggagggcccggcgcggcggcaggcgccgtccgccgctggggcgctgcggtcgcccatgtccgccatgatgctcgctatgttcgctactatggcctccttctacgtcgccggtcgattgtggcaggatgctcagaaccgacttcatctcattaaggagctcgacagacgaacaggccaggggcaatcagcaatatctgtggatgataccttgaaggttgttgcatgcaggcagcaagggaagcggttggcatcacttgagatggagctggctgcagcaaagcataaaggttttgttggcaaatatactcctgagacaaatggaactcattctgggaaaaagccactgattgttattggaataatgagtagctttgggaggaaaaactaccgtgatgctgtcaggaaatcatggcttccaacaggttcaatgctgaagaaactagaagaagaaaaaggcattgtagtacgttttgttgttggaagaagtgcaaatcgaggtgatactttcgatagggagattgatgacgaaaataggagcaccaaggatttcttgatattggatgatcatatagaatctgatgaagagcttcctaagaagacaaaaagtttctttgctaatgcagcagaaacattcaatgctgcattttatgctaaggtcaatgatgatatatacataaatgtcgatactttgagtgcaatgctcgaaactcactgggacaggcctcgtgtctatataggttgcatgaaatcgggcgaggttttctctgacttaacccacaagtggtacgaatcagactggtggaaatttggtgatgggaaatcgtactttcgacacgcttctggtgaaatgtttgtcatatccagggccatagctcagttcatttctataaacaagtccgctctccggacatatgcccatgatgatgttagtgttggatcgtggatgattggccttgccgtgaatcatgtaaatgaagcaaaactgtgctgttcatcgtggccctcaggtgcgttatgttcagcgctataacgagcaacaatgcttaatgaggaagagttttgcaaacactgtgcctgttggatcgaatcggtattgggaaaattttgttttcttctgccatcttgtgtagtcctttggaggaggcttgtacgagccagttcatactgattactggatcggatatcttgtttttcttttccaaaggaaaggtcttgcatattttctttgcaaggccactacactagaatcatgagttctgacgaaaagccctctgcagattgtatcctgttccgcgtgccatttgtagatgccccaccctttaccattcttttttctgacagacactgccattgttggagtgacagaaatcaatagcaattcgggagattactttgctccagaataaaaaaaaaaataatgcgtgtcttcagacctgttgccatggttgtgattttttgacacatacataatgatgcccttttgaagtcaagaatctgccatgt

SEQ ID NO: 11558 - DNA, 1787 bp, Zea mays
attgggtacctcgaggccggccgggagacaaatagcacacaatcaaccgtcgtctccttcctcgccttcataggcttctccaaattccaaatcgttgctagagaaaccaccaaaccggccggcagcccggcacctctcactcagtctctcaccccttgccaccactctcccgtggcgccttctagaagcttccggaaccagacaaccactctgcgccgagttttctgaaggcggctttggtctttcgagatctcgttgtcggtgccatggcgggtcagtactgagtgcgcgggcgggagcaggtgaaggtctgccagctcgagatcccgatgcagatccgggagggcccggcgcggcggcaggcgccgtcggccgcgggggcgctgcggtcgccgttgtccgccatgatgctcgccatgttcgctaccatggcctccttctacgtcgccggacgattgtggcaggatgctcagaaccgagtctacctcattaaggagctagacagacgaacaggccagggacaatcagcaatatctgtggatgataccttgaaggttgttgcatgcaggcagcaagggaagcggttggcatcgcttgagatggagctggctgcagcaaagcatgaaggttttgttggcaaatatactcccgagacaaatggaactcattctgggaaaaagccactggttgttattggaataatgactagctttgggaggaaaaactaccgtgatgctgtcaggaaatcatggcttccgacaggttcaatgttgaagaaactagaagaagaaaaaggcattgcagtacgttttgttgttggaagaagtgcaaatcgaggagatacttttgatagggagattgatgacgaaaataggagcaccaaggatttcttgatattggatgatcatatagagtcagatgaagagcttcctaagaagacaaaaagtttctttgctaatgcagcaaatacattcgatgctgcattttatgctaaggtcaatgatgatatatacataaacgttgacactttaagtgcaatgctcgaaactcactgggacaagccccgtgtatatataggttgcatgaaatcgggcgaggttttctctgactcaacccacaagtggtatgaaccagactggtggaaatttggtgatgggaaatcgtacttccggcacgcttctagtgaaatgtttgtcatatcaagggccattgctcagttcatttctataaacaagtctgttctccggacatatgcccatgatgatgttagtgtaggatcgtggatgattggccttgctgtgaagcatgtaaatgaagcaaagctgtgctgttcatcgtggccctcaggtgcaatgtgttcagcgctataacgagcaacaatgcatgctgaggagttttgcaaacatcgtgcctggtggataatacatgcaatatgaggtcgaatacctgaggaaattttgttttcttctgccattttctgtaacgtcttttggaggaagcttttgcgagccagttcataccgaatcagatatcttgttttttttctttgcaaggccactacactagaatcgtggcttctaacaaaaagccttctgcagattttatcctgttccgtgtgccatctgtagatgccccacccttaccattctttttctgacagacactgccattgttggagtgacagaaatcaatagcaattcaggaaattattttggtccagaatacatatgtatgcgtaatgcgtgtcttcagacctgttgtcatggtggtgaagttggcccattcat

SEQ ID NO: 11559 - DNA, 4637 bp, Zea mays
  misc_feature (724)..(724): n is a, c, g, or t
  misc_feature (938)..(938): n is a, c, g, or t
  misc_feature (2556)..(2556): n is a, c, g, or t
taaaattcatgtttataaaataatgaatataaattgcagtcataaacacttacttgtacttgatatcaagttgacaagtttcttctaacattttgcgatacaaagtcatcaataatagtgttgatatcaatctcatctaataatttcttctcgatgcataaagtcgccaaatgattcaacctttcttgagtcattgttgatctcaaatagtttttcaacaatttcagctttgaaaagcttctttcggcagatgcaacagtcacatgcacagtaaataagattcgatatgcaatggagacattaggatagcaattcacctctatgacatgctcaaaaatctctttagcagacaatactccatctggcaaagtgaatttcataatcttcaattcagaaataagatcatgtacctcaacattagatgaaccatcatgggagaaagtcttagcaaatttaatgcaacactcttcaagttcattatcatttaacaacttcagggtgtttgagctcagtaaaaatccaaatatatctttaaatatcatgagttcttcaaatctggtcttcaaagaagtaatcgccatgtcaaccataaccaaaaaatatttcacttcaaaagccctctcagcttcaagaatttcctcttgacaattactttcatcaaattctttctttcttattgcacgacgctttacaggaaatgaagcctccacacccattttatctncaatacctttggcaatgatcaagctagacgaaaacccctcagttctatatgtctcaaagtattgcattatatcttctatttgtttcaaagtagagtcaatttcataattatttggtcccggagtaagatagtttgggaaaattcagacttaaaatatatcaagatcaaccgttagtctgcaagattaaaaaaatatataaacatcaaggcattnaagtatagtaaactaatagcaatccaccggacttgtgtttgtgtaataaactaataataattcaagatgatctctggaaagcggtaaactcacattggaatttggaacacagcctgtccagttcaggcgtccagcagcaggctagcagtagcagcgattcaggaacagaactgtgtgccgtcgtggcgatcagtgagatagcgatctcgcgattcaggcagagaggaaagaccgaacgagctggcgcctggcgaatgcgtccagccgtctgcccgtccacggcggcggcggcacgcacgcaggattgggcgaaagaaggcgatcgcatcccacgcggctgcggcgattcgtttcccctatacgtcgctgactcactgagtcactgtgtatcatatacggcatattacttgtacatttatacttggggtggggccccatagtttttgggggcccagggcggtggcccaccttgccccccccccctagggccggccctgaatgagcccggcacgtttaagcaattacggaccgggccgttggccgagggttagcccatgggtcagcccagcacggcccgaaattcaaataatacgggcattttcgggcttgagccgggtcgagtctggcggtccaaatgtacacctatagcaagtatactgcagtagcaataaaatgagggaacagacagtccgagcctcgtcctccgccctgctggcgcctcttttctctcctgcgcactcctgcgcgatcaaatccgattcaacggccgagaaaaaaaccctgaaagaggaaaacaaaaaaaggaagaagaaaaaaacagggagaacccaaaactgagacgaacacgaagaagcaaggagctcggcacgacgcgagcgagcccatcccaacccacgaagcagcagcagcagcagcaggcagccgcctcgccacgcgcccgagcaacgccgccgagagagcaacccgcccgcccgccggtgggcagtgagggcaattcgtcttcggctggtccccgtcccgctcccgcccgccaaccccaattgctcccctcccgaggtcagctcaattcctgctgtttctcggattcgattcggttccgccgggcgcgccatctccctcgccggagatccagcagttacgagctcgccggggcccgggatcatgcctccattgctctagggtttgggcgggtaatccaattggctcgcctggcccgcggcttccatgctcgattcaggcctgccgcgccgctccctgggcggctccttgatcccgcggcggttggtgtggcgccagcggagatgagatcccctccatggccggcgagctgggaattcgggtacggcctcgcgctctgcaggaagcggcgcaagccctaatggtttgatcctacggcgtgctatccccaatttcgttggtttctctactccgggtctgatatcggggtttgctgccgtggtaattgcatggacacagtaagggaggaggcatggccaatggctgcaccacagcagcggaggcggcagccgtcagctccacaacagcaacatcagaatggccgtattgatctcagggatctcaaggctcagatgttgaagcggcttggtccggatcgctngcggagatattttggctacttgaatggctacttatcggagaggctcagcaggcaagactttgaaatgccgtgcctgcagaccctggggcaggagaacctccagctgcacaaccggctaatccgtgcaattctctacaatgcctaccagggaaagtgcccgcctcctccattggatgcagggagacctgtagggtcatcagtaaagaaggcttctcaggctgctgaagtgttgaatacttgcaatagtgatgccaagttgttacaggttcagggattgagatctgtggccacagcacaggatcatactttgaaagatagtatgaataacatgggtccaaagtgtagggtggctgctgtaaatcacaaccaagttactcacggtgcttctggatctctggagaatggtactataaatccaattgagttaaagagattgcattttcaacaatgtgaacctgtagagccaccggcaaagcatccacgtgtggaacagttgccccccaataatatgcttttgcagagaagcatgagtagcactgcagaacgttctgcagaaatattaagaagtcctgtacgagctccactaggaattccattttgttcagcaagtgtgggcggtgcaaggaaatttccacctccaccaattgttacaggtgaggatcacttcaacagctgttttgaggatggtgggctgttcagcaccgagctgctgcatagacgtatggagaaaacagcagaaacactgggtttagctggtgtcactatgcatagtgctgagcttctaaatattgctctggatgagtacatgaaaaacttgattaggtcatctgttgagttagtaggaggtagtgttcagagggatgcaaggaaagggacactaccacacaagaaccaagtttatggaaatcggattaatggtgtctggctgccaaaccatgttcatatgcaatcaggcagtggttcatcaggaactacgaatgagattggaagtaaccaattgatctccgtaagtgattttaaggtagccatgcagctaaaccctcaacatcttggggagaactggccagtccttctggagaagatatgtctatgttcttcagaggaaaatgactgacagatggcgcctttttacttcacattgaagttctgtaccaatgtgcttcttggtgcccatccgatgtacatttgagctggaagtggcaagattgcaggcacaacacagaatatgcacatatggggtcaaagcagaattctgattccacgttcagccgtcggagttgtagtagtgaaagaaagacattctttttttcctgataaatcatgcccaaataaaggaaaacgtcttccggccaagccatgcagcttaggcctcattagcacttacaaggtggatagtgttacatctaaaagtcccaacttctatgtaacatctggcataagggactgggggcagcaaaatgcaagtgttgccttgtaacttataggaaaatgttctgtaagtttctaggtcaggatgtacattattgattgcaaaatttttctaggtatcttcagtactaatttcagggatctcgaatgttaatttcatttaattcttttgtaactgtggtacgagggttatatgttagatccctacctttctaccttgacgtgcgtgagtgtctttgggattaggttggtgcccccatacacttttttggtgtttattatactaaaaaaagggagatgatgcatcgtcgatcacactgttcagagagccccccatacacccaccgtgttctgtgatgtcaacatttctgaaacagagatccccgttcaaaattttgtcactttcggttctttctgttgtccaacttttattttccattctgtacaatttcagtaatcagtatgaaaagatatctggtctctggtgtcattttaaggctgtcaaaagcattttcaactatcattatactgtactgtaccacaggtatgttgtatctgaactagtgctcttattggtgtaatggtgttggagaggatcagagaaccttggatgctgactgtttgaatttgcaataaaactctgcaaaagatgt

SEQ ID NO: 11560 - DNA, 5123 bp, Zea mays
cgtggtttccttcaaagttttggagcaagaagcactaccattgattgacatgatgcgtttggaaggagccacgttgtaacttgtatgtcatctctaacatctatgaagatgtcttttcattgtacactttttatttatatgctaatgttgttgggggtttagtatcgctttgactcgggtcttggccaatttctgggtctgccaccggaaaggaggtactctaatttttttaatacgattttaaaaactctatgaagtttttttctgtatagttgaggtgtttggatagaaaatttctactctaggttagagctggagccatgccaaacatgaaacaccccttatctctagtcaattttctgagagagatcaatcctttgttacaacaaaaaaagttatttattctttgatttaactaaataagattgtgtaaagtctaattaaatctaacaagattaggttaacttttacatgttgtttgtttgttagtacaatataccaacatgtttgctagtagcaagtatagcaatgaaaggagagaagagacaggccaggaagccaaaagccctcctctttggctgacgcggagcagatctttcgctctgctgggcttctcttgtcttccgggcactcctgcgcgatcaaatccgattcaacggccgagaaaaaaaccctcgaagaggaaaaaggaaaaaaagaaaacagggagagcccaagcctgagacgaacacgaagaagcaaggagcgaagcagtcacgagcgagcccatcccaagttcccaacccacacgaagctgcagcagcaggcagccgcctcgccacgcgcccgagcaacgccgccgagagagccgcccgcccgcccgcccgccggtgagcagcgagggcaattcgtcttcggctggtccccgtcccgctcccgcccgccaaccccaattgctcccctctcggaggtcagctcaattcctgctgtttctcggattcgattcggttgcaccgggcgcgtcgtctccctcgccggagatccagcaggtacgagctcgcctggggccgaggatcatgcccccattgctctagggtttgggtgggtaatccaattggctcgccaggcccgcggcctctatgcttgattcgggcctgccgcgccgctccctgggatctcgcggcggttggtgcggcgccagcggtgatgagatcccctccatggccggcgagctgggaattggggtacgggctcgctctctgcaggaagcggcgcaagccctaatggtttgatcctagctgggtgcggcgtgctatccccaattcattggtttctctactccgggtctgatattggggtttgctgcggtggtaactgcatggacacagtaagggaggaggcatggccagtggctgcaccgcggcagcagccatcagctccccaaccgcagcagcaacagcagaatggccgtattgatctcagggagctcaaagctcagatggagaagcggcttggtccggatcgctcgcggcgatattttggctacttgaatggctacttatcagagaggctcggcaggcaagactttgaaaagctgtgcctgcataccctggggcgggagaaccttcaactgcacaaccggctaatccgtgcaattctctacaatgcctaccagggaaagtgcccgccacctccactggatgcagggagacctgtaggagcatcagtaaagaaggcttatcaggctgctgaagtgttgaatgcttgcaatggtgatgccaggttgttacagattcagagattgaggcctgtggccagagcacaggatcatactttaaaagacagtacaaataacacgggtccaaattgtagggtggctgctgccaatcacaaccaagttactcacgatgcttctggatctctggagaatggtacactaaatcaacttgagttgaagagattgcgttttcaacaatgcgaacctgtagagccagtggcaaagcatccgcgtgtggaacagttgccacccaataatttgcctgtacagagaagaagcatgagcagcactgcagaacagtctgcagaaatattgagaagtcctgtacgagctccactgggaattccattttgttcagcaagtgtgggtggtgcaaggaaatttccacctccactaattgttgcaggtgaggatcacttcaacagctgttctgagcatgatgggctgttcagcactgaactgctgcatagacggatggagaaaacagcagaaacgctgggtttagctggtatcacaatggatagtgctgagcttctgaatattgctctggacaagtacatgaaaaacctgattaggtcatctgttgagttagtaggaggtagtgttcagagggatgcaaggaaagggacaccaacctacaagcagcaagcctatggaaagcagattaatggtgtccggctgccaaaccatgttcatatgcaatcagccagtggatcaccaggagccaagaatgagattggaagtaaccatttgatctccatcaatgactttaaggtagccatgcagctaaaccctcaacatctcggggagaactggccagtccttctggagaagatatgtctatgttcttcagaggaaaatgactgacagatggcacttttttacttcacagcgaagttttgtaccaatgtgcttactggtgcccatccgatgtacatttgagctggaagtggcaagattgcaggcacaacacaaaatatgcacatgtggggtcaaggcagaaatctgatcaacgttcagctgtcagagttgtactgaaagaaagacattctttttttcctgatacatcatgcccaaataaaggaaaacatcttctgttctggccatgcagcttaggcctcattagcacttacaaggtggatagtgttacatccaaaagtcccaacttctatgtaacatctggcataagggactggggcagcaaaatgcaagtgctgtcttgtaacttataggaaaatgttctgtaagtttctaggtcaggatgtacattattgattgcaaaaattttctaggtatcttcagtactaatttcagggatctcgaatgttcatttaattcttttgtaactctgctatgagaattatatgttagatctctacctttctaccttgatgtgcgcaagtgtctgccttcgggattaggttggtggtgcccccatacactttttggtgtttattatacccaagaaaaaaaaggagatgcattggatatcacagtgttctgtgatctcaacatgttgtctggacaaatggatcctcgttcaaaaatcttgttacttcggttctttctcttgtccaacttttatttttcattttgaacaatttcaatattttgtttcagagataagaaaagaaatttggtctctggtgtcatttttaggctgtcaaaagcattttcattattcttatactgttatatatcgcgagtatgttgtatctgaactagtgtacttattgatgttggagaggatcagagaaccctggatgctgaccgtctgaattccgaacgttctctgtattttatgtctgcggcaaagaggctcgccggcagtccaatacatcctggttcaatataatatctacttatgcaaatccatctctgctggtgtttaagattgcattgcaaaatctttgtttgttgctgggacattattggctgtttattttacctggaagatcccacattttttctgatatattctgttacagtaatgtgttaattgttaactttctgcaggccatgcagctttgatatattctgttacagtaatgtgtttactgttaattttctgcaggatacttgtgccgttttctttcttttgagacaccctgcatgcaaaatataaatgaacacttcttagttactcatttcattttatttcaaattataagatgctttggtttatctaggtacataacttatgctatgtaattagatgtaacttctgctgtgtacttagatatatattatgtttagatatgtaacaaaagtaatacatctaaaaaaagccaaaatgtcttataatttaggatgtgggagtagcaatattgtcttttcagacaggtagcatttagcctcaaagctaaaggaacaaaaaaccgtgctgctcttgtcaatgtttgtcttcaagtgcagtcgggtatgtatgccatgaccatcaaacccagtcataaatccatggtgtgcaaaactggtaagttggaaaactattatcactcggaagaaatagcgagaactactgggtaatttatttgtaattctctgttgtcaacttgtcaatggacgacagtttctgttttttgaatgcatagcagtgcactttacatgagccaggtttgctggaatttctagtggtttcagtcaaatcagttggcaactccgtcgagccgttccttcccaccactactaaatgcagaggtgctctgatcgtctgtgtgtgttcacttttgtgcgtcggtcaggcactctggctatcagtccaactgtccaggtttaaaccaaaacttctagaggtgacaccttgctcattcctaaaattctttgctgtttcattaatgtgtacaagttttctgaatcatataccgatcactaaagtttggcttgtcaattgtcgccctggacaaggactcagggcaggtaagggcctgcttggctgcttggacatgagaagctctcgcccaataccttcatcagaaattcaattctttcccaccccacgaggacaatggctgcggcaccgaaccaagtgcaaagggaacgtgttccttatgctctggtagggtgctcaggtgtatattttaaatttagaacgttcatttcaaatctaagagcaacactattttataaaaactccctcctaccatggagggaggtggaaagggttctttataaaattattgttgttaggtgtgagattagcgtcctagatttaaaatgttcacatgagcatcgtaactgtttaagcatcgaatacgttgccaagtggcctagctcgcaagctgttcgatgcaatgtgaccaggaatttgtgtcatggaacacagtgcaatgtggatgcaacggatgtgtttcaacgaatgcagagtaca

SEQ ID NO: 11561 - DNA, 2473 bp, Zea mays
  misc_feature (2456)..(2456): n is a, c, g, or t
tggtatacttcagcgaatcatgcagccttagctggtgatacatcagatttccattcaatgcgtatctccacgaatctctacacaaaggcatcgtttcttatcgttgaagaagttgtcatgtccctttcagtgtgttgtgtctcgcgtcgtcctcggtcaaagttggtagcctgaaaccagaacttgtatccaatagcaggctgcaggcctagctctttagtatatactacccttaggcctagtttgaatactttgagattagagtgttttgaagggattggagaggttgtaaatcttcgatagatcaaatactctctcaatacatctcaatccacttcaatcccacttattactagagtacctaaactaggcctcagttatcaaatatttgtcacccactaattcaattttgaagtaaaacgcgacaaattaaaaaacagagggagtataatcaattgaatcgaaacagtccaacatagctgctgtcctttcctttttctcctgtcactgtaactaataagaacagagaaagtgaaggcccacgcccacaaactgcgcagctagatcgaccaaacaagagcattttgttctttttttccgcggtaactttgataaagtccggttaagccaacatagcatttgaagtcaactgtaggttgggccgttggggtagacatgtatctagcctctcatttgtatcttctggaagtgggccaacacgatgtgcttgcaagattagtcgtttctctgagctgttgccagacgttcaaatgacaagttggagagactaccaggtgcaagattagcaatttgtttggagagactaccaggtgcaagattacaagttggagagactaccaggttcaaatgacaagttggagagactacaagttgccagacgttcaaatgacaagatttggttgcgttggaaattggaatgaggatgttataaccttcagagcttgtttgggagcaattaatggacttttatttagtcccctcaacctcaatccacttccgtatccattgacaaatgaaccaagggtcagctgctgaggagcacattcagttacagtttgatgagcatccttcaattcaatctagatctctgaccttatctgctacgttcagacttggtagagagaaaaggtcaactgttcaacgttcagcgccgtctatttttctttgagaacacttaatattaataatgtaacagaattgacgttggccggccgcacgagaccattacctagaacgtccctctcgaaaactccacctccaccaatccaaccaaccattggccattgcagagaagagattactttaagaatgggctactcgaagcgcattgcactggtacttgtagcggctgttgtagcgctccacgtccatgtcccgatggccacagcagcgaactccaacctcttccgggactacatcggcgccatcttcaacggcgtcaagttcaccgacgtccccatcaacccgagggtccgcttcgactacatcctcgccttcgtgatcgactacaccaccgcgacggagccgcccaccccgaccaacggccagttcaacatcttctggcaggactcggtgctgacggcgtccgcggtggccgccatcaagcagagcaacccgaacgtgcgggtggccgtcagcatcggcggcgccaccgtgaacgaccgccctgtgttcttcaacatcacctccgtcgactcctgggtccagaacgccgtctcctccctgaccaccatcatccagaagtacaacctggacggcatcgacatcgactacgagcagttccaggccgacccggccaccttcgccgagtgcatcggccgcctggtcaccacgctcaagagcaacggggtgatcagcttcgcgtccatcgccccgttcgacaacgccgacgtgcagcgccattaccaggccctgtgggcgacctacggaagcgtcatagactacgtcaacttccagttctacgcctacggcgccagcacgaccgaggcgcagtacgtcgacttcttcaaccagcagcttgtcaactaccccggcggcaacatcctggccagcttcaccacggcgcccaccaccacgtcggtgcccatcaacacgtcgctcagcgcttgccagacattgcagtcgcagggcaagctctacgggatcttcatctgggcagccgaccattccaggagccaaggcttcaagtacgacacacaagcacaagcactgctcgccaacgcccctgctggctactagtagatggctaccataccttcaatgcgtttaagttggatttggatttcattttcaggtgaacaaataatattattatgtatggaataaggctgtcattggaatataatacggggctatttctatattcctgtgttctctataaaaattaaacaattcttacaaaaaaaaaaaaaaaaaaaaaaaaaaaaaaaaaaaantaaaaaaaaaaaaaaaa

SEQ ID NO: 11562 - DNA, 1529 bp, Zea mays
gggtacctcgaggccggccgggaaataggcagtcggcagaccacgggccccttcgtcacctccggccgagcagtgccgactgccgccacctctgaaaaaccctagcaaaaaaaaaaaaaaaaacattgcccaatccaaatccccattccctccactcccaaaatttcgaactccgaatcgaagctatcatgtgcgagcgctcacctaccccacgttgactagaagaaccgtccgacttcaacttcccaattttgcctccaaaaaattcaaaatattattcgaccccgccgccatcccgtccgccctacaaatcccgccagcatgcgctccatgttcgccactaggtcgcttctcgccgctgccgcctccgcccccaccgtcctccgcgccagcgctttcccatcgcgttcgctgctcctctctctgcctttccctcggggtcgtgctgccagaaatatgcttggcgcggcgaggtcgatctcttcggccgccccgtcgcgagtcggaggccgtgcggctatggaggtccgggcggctcagtccggcgagatccatgtcatcgtgggccccatgttcgccggcaagaccaccgcgctcctccgccgggtccaggccgaggccggcaacgggaggagcgtggcactaataaagtccgacaaagacaaccgctatggattggattctgttgtgactcatgacggtacaaagatggcgtgctgggccttgtcagaactgtcaagttttcatgacaaattaggaattgaggcctataataaggtagatgttataggtatcgatgaggcccaattcttcgacgatctttatgatttctgctgcaaagctgcagatcgtgatggaaaaattgtagttgttgctggcctagatggtgactacaaacggagaaagttcggttcaattcttgatattgttcctctggctgactcggtcaccaagctaacagcacgctgtgagctatgtggtcgccgggcgttctttacactgaggaagacgcaggaaaccaagactgaactaattggaggagcagatgtgtatatgcctgtgtgcaggcagcactacatggatgggcagattgttattgaggccacaaggattgtgttggaccttgacagatccaccgtgacggcgaaagccttgaaataggccaatacctgacttctgcatgcagatttgcagtgtgtaacgatttatttatgatgacattggttgctgtcgagtgttgaagacgcacaccagttggtgaaaagctgttggccttgagatgctgccaccagcgagggaagccaaatgagttgatcccacaaagtactgttgagaagtttgtaaatatctaacagtgtttgggtttaaaatgcggacatgtatcgcttttcttatgcaattggcattgtcatttttattaagcaatcagatgcttggaatcagctgtacgaatttgtaccacaaaggaattgcattcaagtttgaaagtaaactaaggctatctccatcatgcaaaaaaaaaaaaaaaa

SEQ ID NO: 11563 - DNA, 1485 bp, Zea mays
cttcgtccacctccggccgagcagtgccgactgccgccacctctgaaaaaccctagcaaaaaaaaaaaaaattgcccaatccaaatccccattccctccactcccaaaatttcgaactccgaatcgaagctatcatgtgcgagcgctcacctaccccacgttgaccggaagaatcgtccgacttcgacttcccaattttgcctccaaaaaattcaaaatattattcgaccccgccgccatcccgtccgccctacaaatcccgccagtatgcgctccatgttcgccacgaggtcgcttctcgccgctgccgctgccgcctccgcccccaccgttctccgcgccagcgctttcgcatcgcgttcgctgctcctctatctgcctttccgtcggggtcgtgctgccagaaatatgcttggcgcggcgaggtcgatctcttcggcggccccggcgcgagtcggaggcggtgcggctatggaggtcagggcagctcagtccggcgagatccatgtcatcgtgggccccatgttcgccggcaagaccaccgcgctcctccgccgggtccaggccgaggccggcaacgggaggagcgtggcactaataaagtccgacaaagacaaccgctatggattggattctgttgtcactcatgacggtacaaagatggcgtgctgggccttgtcagaactgtcaagttttcatgacaaattaggaattgatgcctataataaggtagatgttataggtattgatgaggcccaattctttgacgatctttatgatttctgctgcaaagctgcagatcgtgatggaaaaattgtagttgttgctgggctagatggtgactacaaacggagaaagttcggttcaattcttgatattgttcctctggctgactcagtcaccaagctaacagcacgctgtgagctatgtggtcgccgggcgttctttacactgaggaagacgcaggaaaccaagactgaactaattggaggagcagatgtgtatatgcctgtgtgcaggcagcactacatggatgggcagattgttattgaggccacaaggatcgtgttggaccttgacagatccaccgtgacggcgaaagccttgaaataggcaaatagctgacttctgcatgcagatttgcagtgtgtaacgatttatttatgatgacattggttgctgtcgagtgttgaagacacacaccagttggtgaaaagctgttggcattgagatgctaccaccagcgagggaagccaaatgagttgatcccacaaagtactgttgagaagtttgtaaatatctagcagtgtttggattttaaatgtggacatgtatcgcttttcttatgcaattggcattgtcatttttattaagcaatcagatgcttggaatcagctgtacgaatttgtcccacaaaggaattgcattggaattgcattcgagcttgaaagtaaactaagaccatttccaaaaaaaaaaaaaaaa

SEQ ID NO: 11564 - DNA, 1271 bp, Zea mays
  misc_feature (27)..(27): n is a, c, g, or t
  misc_feature (44)..(44): n is a, c, g, or t
  misc_feature (46)..(46): n is a, c, g, or t
  misc_feature (1161)..(1161): n is a, c, g, or t
tctgtcagttaatacttattgtctagnccttcctattagcttcngntggccctgcatcccgttgttgtggtgatatttggttttgttgctgcacttcttatctggaatgcttgctggggtagtagaggtgcagttgggtttgttaatcgctatcctgatgctgatctcagaactgctaaagatggacaatatgtaaaggttacaggggttgttacctgtggaaatttcccccttgaatcctcgttccaaagggtcccgagatgtgtatacacttctactagcttgtatgagtacagaggttgggattccaaagctgccaatacagagcatcggcgttttacctggggcttacgctcaatggagcgccatgcggttgatttctatatctcagattttcagtccgggcttcgagcattggtgaaaacaggatatggtgcacgtgtgaccccgtatgtcgatgaatctgttataattgacatcaatccagacaacaaggatatgtcccctgattttttgagatggctacgggagagaaacctttcaagcgatgatcgtacaatgcgcctaaaagaaggatacatcaaggaaggtagcactgtgagtgtgatgggggttgtccaaaggaatgacaatgttctgatgattgttcctccatcagagcccatctcaactggttgtcagtgggccaagtgcgttctcccaaccaaccttgatgggcttgttttaagatgcgaagatacttcaaatattgatgtgataccagtttaactggcggtggaagggtagttgccaaaaaaagtgcctgttaaatatttgagtctattgtttcatggaatgctagttgagaaaaatgtgcaaatgttgggtgggtgtgattatggtaggctgagggtggttggttaagctggcctttggatgtatagttttttcttcttcttttaattgtgttttgttgtttctttttaattttcagttctgagatctgaaacttgtgtaaccacatgccttttaatctaaatctgcgtggcatttagattgaaaaaaaaaaaaaaagaaaaaaaaaaaaaaaaaaactcgagggggggcccggtacaccattcgcctatagtgagtcgtatacattcactggcgtcgttttacacgtctgactggaaaacctgncggtaccacttatcgcttgcagaatcccccttcgcagctgcgtatacgaaaggccgcacgatcgccttccacagtgccacctgatgcgaatgcattgtagcgttattttg

SEQ ID NO: 11565 - DNA, 4666 bp, Zea mays
gggcctgtcggagctcaacatccttgtatgtgcctcccttaaactataaaagggaaggcacacatcgttacaagggacacactcaatacaatttacacacagtggaggtagggtattacgctctagcagcctgaaccactataatccctcgagtcctcttgtgttcatccaaaattcaccaaacaggcaaacgcttaggccctctcctcatcttaggattagggcgggtgcattccgccacccggacggaggattttcccatcgacagcatcgtcctagaagcttcgagcttcaagaaggtgggcatgtgcgaggaggaaattggatttggttagtcaaatcgtgacgacttgtgtttatgtatgatgatcgatgcaatgatgaagaagcggcacccgacatgggaggagaaagagaaggaagaatgatttgctatagagaattacaaaaaaaattcttggctctagtaccatattaaggccccgtttggttccattggtcttaggactaaagtttagtccatggactaaattttagtccctaccctgtttggttgtagggactaaacatattctaaatacattaaatacaacacataaagaacaaaataccccttttttgtttgacgccagttttctagcaagggtaattagagtaaatgttgccctctagtcccttttagcactcatgtgagtgactagagactaaagccaattagtccctactttagtccttccgtttgacaaaatagagactaataaacgggactaaaaaccagagactaaagattagtccctctaaccaaacagagcctaaagtggtgcaagagactatgctttctttaagttgtactcatgtatacaggggaatgatttacatgactacacaagattagagaacgtagcttcgaatctttacatgataagatgataagtaacataagagggtacaactctaaatccaataaagttaagggcgcatgacccttttgaaccttgtacctttgacaggtattacacatgcacgtacttacagtactgcacggcgacgaatgaacatgcatgcatgtgtacgtacgtttttccctcggcgtcctctttgctctctcacggctttaaaagctgtgttgcgtcaatgcattgcatgttgatgtatgtatgcatgcatgagactttacagcagctagggctagctactcgttgaggtagcgtagcttagaactagcgctggccggtggtgttggctaggactaggacgttgctacgacgtgcaacagtttcccgttaagctccatcaagtttcctcattgggcccatgccaggtgccaccgtgtccatctccatcttttaacctttccgttccatacatatctctctctatttctctgggacaaaggaacaaagagcgagcgagagagagagagagagcagctctcaaggtcatggtcttatggaggacaggaggagcatggtggtgctacctagcaagagctccccactataaagcgcccccacacaccataccacggctcagagcttcttctcatcatcttgtagaaaagaaagagtgagagtgaggttggcaagggtatagggttcttggtcgatcaaatatctttcccctcttggattctcctcttcctgcttcgttctcgccagatcgatctcactacgtgcctgcgtagctagccactctgtatgcaccatcaccaccaggaccaggccatgggcgacgcgctgtgggacctgctcggggaggagatggcagcggcgggcggggagcacgggctgcccccggggtttcggttccaccccaccgacgaggagctggtcaccttctacctcgccgccaaggtgttcaacggcgcctgctgtggcatcgacatcgccgaggtggacctcaaccggtgcgagccgtgggagctccccgacgcggcgcgtatgggggagcgcgagtggtacttcttcagcctccgcgaccgcaagtaccccacgggcctccgtaccaaccgcgccaccggcgccggatactggaaggccaccgggaaggaccgcgaggtgctcaacgccgccaccggcgcgctcctcggcatgaagaagacgctcgtcttctacaagggccgggcgccgcgcggcgagaagaccaagtgggtcctgcacgagtaccgcctcgacggcgacttcgccgccgctcgccgcccctgcaaggtatgaactatagtacatgtaggagtacgtacgcagagctagctagattttcttgagttcctacaactaaaactgaaacggcgcagagctagctagattattactccatgaatgggttacttaaggtttcagggccgatcttttcacgctttctgttctgttctcaatgattcttcttttgaatgaatgcccgtgaaaacgcaacacagtgtgacagtagtagagatgtgatgccattgacaagagggtaggagatgcagatatgtcatatgagatactgctatactagtactgctgagtgctggctgcaatggatgtggcatgcatgcatatgcaccatagccgcagtacaaggaagatggcttgggtgacatttgcatgcagattgatagatgtgtgctttatgtaggagtactccttctgtgtgtgcattcatcaatggcactacaatagctggtgtaagcatgatgatgcactggtacaacagctagccacagtgtttgtgcccaggttcagcagcatgcatggccaggagtagttccatcgtctatctctgctcgaaatctatttgcactgacacataggatccatgccagccagccagagctactgatgcttctgtgttttgtttttgtgttgtgttgtgccttgccatgcatcaggggtgcatcatggatgtacttggcatatctacaaacactgacatatacctcccttccaaatctctgccgtaccatacaatgaataggatgtccccaagataaaaacatgagcatccaatgtgctatctgcagaagttgttcatccatccaggagggcactcaatttttttcagaaaaaaatatatacactgatgtactaccacactatgttctgcatgcctagagagtagagaccaccaccttctcagatactattgaatatttgatgaatcttctgccctggcgatggatcacaatcgacagaaaaaaaaaatcttttaaagtatatgtctacactcctactctggcctgactgatgatttgctgaatcttttcatgcacatacatacatgcatgcaggaggaatgggtcatctgcaggatactgcacaaggcaggcgaccagtatagcaagctgatgatggtgaagagcccctactacctgcccatggcgatggacccttccagcttctgcttccaggaggacccaaccgggcatcccctcccgaaccctagcggctgcacccccttccaccacggccacccccaccatagcatgcagccgccgcctccattgccgccgagcaaccatgctggcaaggccgtcttcaccggagcagcagcagcctgctgcatgcaacaagagccggcagacggcagcaacagcgccgtgctgcccatgccgccgttccctcccttcacccccatcgtcgccggcaagccggcggccccggcgccgccgccccaggttgtcaacgccggtccacaggagccaccgccacctacctggctggaggcctacctgcagcacactggtgggatcctttatgagatgggtgtgggtccaactgcagcgcccaggggcgcgtgatccggaccgtcggttccttagggttacccccctacgtacgtactgaaacactgatgatccatcgatttacctggtctgtaatgtgcggtgaagcttagtatttccaagtgacatatttcgacaagcacttgtagttattaaaaaagagttatcttgtattcggtggcatcattagtcgtcgttgttatgaaatcatgtgtgcttataacatgcatgaatgcatgcatttggatcatcgatcagagcagtcctgacctgggacgtgctacgtactgtgctcatgcatccatccacatgcaaagtggtgcttgctaaaatgtactatccaaatgtctgtttgtttagcatgcatgcaatgatatatctatcggaacttgtttcctttctagtttactgtttgtttcggattaatgtcagatgttcggactgctataactgtaatccatagagataaaacaccgtagaagctcgtagagattaaagccaagccaacagaatgacaacaatgaacaacagacgacatactacatcatactgccagcgcaacctcaatttaccacaagataggagagagaaggaaaaggagacgaaaatgcaagccgactacctctttgattaagtaggcgacgtcacttgaaactcttgaatttgctccagagtcttttgaaatttgctccaaagtcttcttgttccgttcgtccgaaatgttccgtggggaataaattaccatcaaaatcccttctgaaacgtttgcatctcatctgatatttcgtagcaagtccatgcacatatatagaacaagagccaaaaatgtttatttttccttcttctattgagtggggagagaagacatcagtataaatttgttttggactagatatatacctg

SEQ ID NO: 11566 - DNA, 1686 bp, Zea mays
ctatttctctgggacaaaggaacaaagagcgagcgagagagagagagagagagagcagctctcaaggtcatggtcttatggaggagcatggtggtgctacctagcaagagctccccactataaagcgcccccacacaccataccacagctcagagcttcttttcatcatcttgtagaaaagaaagagtgagagtgagattggcaagggtatagggttcttggtcgatcaaatatctttcccctcttggattctcctcttcctgcttcgttctcgccagatcgatctcactacgtgcctgcgtagctagccactctgtatgcaccatcaccaccaggaccaggccatgggcgacgcgctgtgggacctgctcggggaggagatggcagcggcgggcggggagcacgggctgcccccggggtttcggttccaccccaccgacgaggagctggtcaccttctacctcgccgccaaggtgttcaacggcgcctgctgtggcatcgacatcgccgaggtggacctcaaccggtgcgagccgtgggagctccccgacgcggcgcgtatgggggagcgcgagtggtacttcttcagcctccgcgaccgcaagtaccccacgggcctccgtaccaaccgcgccaccggcgccgggtactggaaggccaccgggaaggaccgcgaggtgctcaacgccgccaccggcgcgctcctcggcatgaagaagacgctcgtcttctacaagggccgggcgccgcgcggcgagaagaccaagtgggtcctgcacgagtatcgcctcgacggcgacttcgccgccgctcgccgcccctgcaaggaggaatgggtcatctgcaggatactgcacaaggcaggcgaccagtatagcaagctgatgatggtgaagagcccctactacctgcccatggcgatggacccttccagcttctgcttccaggaggacccaaccgggcatcccctcccgaaccctagtggctgcacccccttccaccacggccacccccaccacagcatgcagccgcctccattgccgccgagcaaccatgctggcaaggccgtcttcacgggagcagcagcctcctgctgcatgcaacaagagccggcagacggcagcaacagcgccgtgctgcccatgccgccgttccctcccttcaccaccatcgtcgccggcaagccggcggtcccggcgccgccgccccaggttgtcaacgccggtccacaggagccaccgccacctacctggctggaggcctacctgcagcacactggtgggatcctttatgagatgggtgtgggtccaactgcagcgcccaggggcgcgtgatccggaccgtcggttccttagggttacccccctacgtacgtactgaaacactgatgatccatcgatttacctggtctgtaatgtgcggtgaagcttagtatttccaagtgacatatttcgacaagcacttgtagttattaaaaaagagttatcttgtattcggtggcatcattagtcgtcgttgttatgaaatcatgtgtgcttataacatgcatgaatgcatgcatttggatcatcgatcagagctgtcctgagcttgtacgtgctacgtactgtgctcatgcatccatccacatgcaaagtggtgcttgctaaaatgtactatccaaatgtccaaaaaaaaaaaaaaaag

SEQ ID NO: 11567 - DNA, 1190 bp, Zea mays
aaaaaagtaccactacgactccgcctccggctccgagagcagcagcctcagtaccaccagtccagtccagcctccagctaggggaagaagaagaagagcgaaggaaggggacgggggcgaggaaggagccagagcagacccaatccctcaatggcttcctctcgcgctctcgctctcgctctcttcctcctctgcgccctgctgcccgcgccccctgtctcggccacattgctgttcggcggcggcgagtcggccaagaaggcgggcgtcgacgcggagtggcggccggccactgcgacgtggtacggcgaggcagagggcgacggcagcgacggcggcgcgtgcgggtacgggacgctggtggacgtggtgccgatgaaggcgcgggtggggtcggtgagccccgtgctgttcaaggacggcgagggctgcggcgcctgctacaaggtcaggtgcctggaccgcggcgtgtgctcgcgccgtgccgtcacggtggtcgtcacggacgagtgccccggcgggctgtgcgcgttcggccgcacccacttcgacctcagcggcgccgcgttcagcaggatggccgtcgccggggccggcggccggctgcgcgaccggggccagctgtccgtcgtgtacaggaggacggcctgcaagtacggcgggaagaacatcgcgttccgtgtgaacgagggctcgactaacttctggctctcgctgctcgtcgagttcgaggacggcgagggcgacataggatccatgcagataaagcaggccaactcggtggagtggctggacatgcggcacgtgtggggggcaacctggtgcctggtgcggggcccgctcgtgggccccttctccgtgaggctcaccacgctgtccgcgcggaagacgctcacggcccgcgacgtgatccccaggaactggacgcccaaggccacctacacctcgcgcctcaacttccagccgtctctctaggtctaggacgagggagggacccaccgcggcgactggggcccacgttttatcggccccggacactgccctgtgggcccgttgcaaaacgaggaatcagtcagtccagagtgtttttttttttttttccctgtatgcagatgcaggcaaccttcgtatggtttggtttttatcttatcgtagtcgtagctaaaaaaaaaaaaaaaatcatggccatc

SEQ ID NO: 11568 - DNA, 1906 bp, Zea mays
tggcaatggtcaggacgaaaccgcgtgccgcgcgcgaggtcagctggtcaggtcagcagagtcgctagaattccacgagagcccagcccggtcagtcgggcaatattgacggacggacgcctcggtgaattgtatatatgcagaataagtgtagccgtatctaccacggcttattatataataataatggttagcatatagttgcagcaaaatattgtcccgagatgccgtagtattcagtctgagaagtcgggcttgcgtgctagctagctgcaactgaagaagatggcgaagcaagctgtcctccttcccatggctgcactggcactggttcttggagcacttgcaaccattcctgcaggtgtgcgatccatcggcgtgtgctacggcatgaacggcgacgacctgccgtcggcgagcgacgtggtgcagctgtacaaggacaacggcatcgactcgatgcgcatctactccccggacaccgacgtgctccaggcgctgagcggctcgggcatcgccgtcaccgtgggcgtccccaacgcggacgtgggcggcctcgcctcgcgcccctcggccgccgccgcctgggtccagagctacgtgctggccttcccggccgtccagttccgctacatcgccgtcgggaacgaggtcgtcgcgggggggcgcgtcctgctgcccgccatgcgcaacctcgaccgcgcgctctccgcggccggcctcgccgacgacatcaaggtgtccacggcggtggcgacagacgtggtcggcagcagcttcccgccctccgcgggcaccttcgctccgtctgcgggctacatgccgcacgtcgcgcggtacctgcagagcaccggcgcgccgctgctggccaacctgtacccttactactcgtacatcagcgacccgagcgccgtcgacatcaactacgcgctcctcgccatgcccgccggcacggtggtggtgcaagacggcgggtacagctacgacagcctgttcgatgcgatggtcgactgcttctactccgcgctggagaacgccggggccgggaacgtcaccgtcgtcgtgtcggagagcgggtggccgtcggccgggagcgacgcggccaacacgaccaactcgcaggcctacagccagaacctcatcaaccacgtcggccagggcacgccgaagcgccccgggcccatagaggcctacatattcgccacgttcaacgaggaccagaagcttggagacgacgagacgcggcggcacttcggcttgttcaacaaggacagatcgctcgcgtaccccatcgattttgtcaacccataacagcaggatcatcaatctcgttctctcttcaatgttccaaaattggtgatgtgcactttttgttaaaaccagtagaaatgcacgcaggttcgtatgtctacatgaaaacaaaattaaataatattaagcaatattaaaaaaacctttttggaaagccaatttatgtagtgatagtacataaaaatactactacaccattctcgaatatttatcacctgctagctcatttttaaacaaaaacacaataaataaaaaaaagaacggagcaattattagccagcccatatagcccatgatgacactaaaacataaatagatgtaataagcatatttgtggaagcgatgatttcatcgtgcaatttgtaacagtgtataatttaagttgactttataatttcattgcggtcaagagaacataaggcttttttcagcacatcttctattccatctcctatcacacctcctatttagaacacacacagtcaagcaccaaagaggtgttggccatgcaatgtagatgcccattcttaaaagctcgcgaacagcaaacactttctaagacccaacgccaatgaatcccatcaagtgaggtgtt

SEQ ID NO: 11569 - DNA, 1905 bp, Zea mays
tttagatgtgatgcttacacggtggttggaagtttctgaagaatatggtcccccgagaggtggtctatactctctgtttagtaggaaaatggtagaggacactaagtgaaatgcacagtgggaaactctagactctagaggatctcaggcagttatatctgccatatagggaagttaaacaattgcttctaattgcaccattatgtataaaccatatatgcaagtgacattcttcaaaggagttcaaaggacatgatatcatgtattcacaactatgtttatggctgggcacctgtgtatgccaggatgctaactacaacttgatttgcttgtaatatgggttaagaagaacaggatggatatccatagagttcacatgaggcaaggatgtattgtgatttctatctagttggttattatcttcttgaaagaaggaaattacttgtaagggacacgtccttgtctggcagacgtgtaagtgcacacagcataaaaccattgacatcagctttcaagttgaacataataactggtcggtacttgatgataacgatgccctggttgcttttgttcctgcacaaactcaaggtagtactgattaagtcattgagtcatgccaaacagctcaatctaagctaatatatatgatctgttaatgggcatgcctgccacactatcattactcattaaagttaatacatataggaatttctgccacactaccatttacttgcattgctaattaaacaacaattcaagcctttgagcttctgaaaggtactgcaaaaggcattttgcacttgtctagcactcttgttttgtgtttgtgtccggtcacatgctgcagcaagttgacatgcttctgtcatgcagtttatgtatttgccaagaccggcaaaagagaccaggaaaagaaaaatgctcagactactgccgctgcagcattgtcatccccagcaagtacatctgccgaggctccagatcctgctcctgcacctgcgcccaaatcggttctcccacctctatccgaagatgagcagtggaatctgtacaaatggattctggaagaggagcggaagatcaaaccacgcaacgccactgagaagaagaagatcgacgaggagaaagctcttctcaaggagataattcgggacaaatctctccctcgtttgtgatggttacatcggctgtccttctgatcttgattttttttcttctctctccacctgcagtccattgaggacaacatctgaaactatgtgccctgttagttagcaaaaccgttagcatttctttgcactatcacatctcttcatttgacaataagaaggtcgagttgttttgctctgatgagaacttattgtgttcggggatgcttgggagatgttttggaagaagcttattgccttgtgaaacgttctaattgacctgctgataatgggcccagctagctatgctctgctattcttatgtaagatgtgaattgagctattcaactgctagtgtttttacataaaaaaaaccccccttcatatggatcatccagaccctgccaatgctcctcgccttgctctgttagggcatgttcggtttgatctggagtgagggagattagagggattaaatcctctcctattcaatttaatccccttcaatccagataaaactgaacacattcttaaggatggtcaggtagtgtttggttccaaagtatagtagaatggaaccgctctgttttagtactgagactgtttggtttgaatcaaaatggaatggaacagttttaatattagaatattctctcaagatattggatctctgggctaaaaaaaaacagccggatccgagcgctcggcaagcgatcaacgctcgtcgcggcttcctgcgtgattatatatatatata

SEQ ID NO: 11570 - DNA, 1249 bp, Zea mays
aaaaaaactcccaaacaggaccccgcgtccgccccgccgcccccggttgaactgtccttgcttctaaacggagtgagtagcgatagtgacgcagtcgtcttgccgccgccgtcccaaacgtccgcgcggtcgtcctcgatcttcccgtaccatcccgacgcgatggccgccggcgcgaagcccgataccgccgcgcccccgcaagcgccttcggcggcgaagggggtcttcatgcgccgcatcttccccttcctcctcgcgacgaacgtcttcatcggagtttatgtatttgccaagacctacaaaagagaccaggaaaagaaaaatgctcagactactgccgctgcagcattgtcatccccagcaagtacatctgccgaggctccagatcctgctcctgcacctgcgcccaaatcggttctcccacctctatccgaagatgagcagtggaatctgtacaaatggattctggaagaggagcggaagatcaaaccacgcaacgccactgagaagaagaagatcgctgaggagaaagctcttctcaaggagataattcgggataagtctctccctcgtttgtgatggttacatcggctgtccttctgatcttgattttttctttctctccacctgcagtccattgaggacaacatctgaaactatgtgccctgttagttagcaaaaccattagcatttctttgcactatcacatctcttcatttgacaataagaaggtcgagttgttttgctctgatgagaacttattgtgatcggggatgctcgggagatgttttggaagaagcttattgccgtgtgaaacgttctaattgacctgctgataatgggcccagctagctatgctctgctattcttatgtaagatgtgaattgagctattcaactgctagtgtttttacatattccttgccccttttcatatggatcatccagaccctgccaatgctcctcgccttgctctgttagggcatgttcggtttgatctggagtgagggagattagagggattaaatcctctcctattcaatttaatccccttcaatccagataaaactgaacacattcttaaggatggtcaggtagtgtttggttccaaagtatagtagaatggaaccgctctgttttagtactgagactgtttggtttgaatcaaaatggaatggaacagttttaatattagaaaaaaaaaaaaaaaaaaaaaaaaaaagaaaaaaaaaaaaaaaaaagcggcc

SEQ ID NO: 11571 - DNA, 1283 bp, Zea mays
cctcgaggccggccgggccggaatctataaacagagtgagagactggtagcagcccgcatgtgctagagctagacagaagtcagtctccttcccctctctagtgctcaccggctccttccgtcgccatggacgtcctcctctgctgctgcctgctgcttctcctggcctccgccgcgtccgccggcagcgagcggtgcgtgcggcaggggaaggcggcctactctccctcgctctccccggcccctcacggtagcagcggagcgtgcgggtacggcgccatggccgccgagatcaatgggggcttcctcgccgccggcgggcccaggcagcaccgcgggggcctcggctgtggccgctgtttccagatgagatgccgagacgcaaggctgtgcagcgccgggggagtgcgggtggtgctgaccgacttccacaggagcaaccgtacggacttcctgctcgccgggccggcgttcgcgggcctggccaagcccgggatggcccaggagttgaacaggcgagacgccctctccgtagagtacaaaaggattccctgcgagtacaaggagaagaacctgtcgatccgggtggaagaagcgggcgacaggagccggggcaagctggtggtgaagctgctgtaccagggcgggcagaccgacgtactggcggtggaggtggcccccgtggggtcgtcgtcggagtggcggttcatgacaagggcgtacgggccggtgtggagcacggaccgggcccccgccggcccgctgcagttccgcgcggtggtcacgggcggctacgacggcaagtgggtgtgggccgagcaggaggtgctgccggccgactggcgccccggccaggtctacgacaccggcgtccgcatcgtcgacgtcgcccgggacgcatcccgcggctgcaccgccgccgccatggacgactggaagtgaagcggctcgagggctgggtagattaaaaatacgtatgaatacatactaacacgtcgccacatcggtgctgcgacactctggtaagaagaggacagcatgcaatggctccaagaacagcatcccccccaagcgcgtccggctgtccagaggagaggaggaagaagattggagtagctagcagctagggtgctccggtctttgtttgtttgctgcacgtgtaattgtgtatgcaggatcttctatcaaggtcgatccgattagatgcaggcaaaaaaaaaagagctgggatccagtcgacagttcttatggggcatggcgtcatgccatcctggctgtaccac

SEQ ID NO: 11572 - DNA, 1337 bp, Zea mays
gacctgcagggttctttaaatgatgttggaagtgtagatgtcttctcttggataagctgtttggatcttcgcactctcgctgtgctgacaaattccaccctgtccagctcaaggttctgtatctcgtgtatttcagtaattattaggaatgtgatcttgtacaatcagatttgattatacaaaatcttatcagtcagtgtacaaatatctgataggtcataatgtgcaggccagtagggcccatgtgatggagcagccctgggccatgcacagcagcatagttttttttttttttttgcaaattactagcaatgccatggtctgttcatgcgcttctgctggttgccctaggattagatatgatatcgtaaataatattagattgagttggttcttgattctagagattggtctcttaagaatcaaatcaccccatcaacataaggatatgattatctcgcttttggttagaaaagaactagatcaagagttcctaattcctatctccttcctatgccattatggattggcttccgggcttcggcatggttgtgctgcttgagttcatgggcataatgctcatgacagagatcattttttttcctgcatgactatttcaactttccatgtcatgttggatagtttttcatctatgttgtgctagtaatgatataaaactaaaattcgatgaatgaattatgtcaccagcacaacttttccctctctttgtttggcagtgatccacataatatatctttccattacttaatacctgaaggaggcaacgataagttgtcctacctcaagctaaaagtcttgctacctgattcagatctcactgttactaggtgagcacacaaattagcatgacccttcttgtatcttgtcactgtggacattctcatatttgtgccccttgcagtcagaagcaaatcaaggacaagctaaacgttgccactccagaaggaaattttctttggttattccacactgaactgtcaccctttcttatcgcaaaatctcagttgtcgaaaaagagatttgtttatatcgctgcaggcatgccatcataaaggtactagatatccacttgatctatttactcaaacctatcattgaactctattgaagtattgatctccacctttctctttcaaataaagcgcccatgcatgtgaacattatcttactgatatgcataatcaagagtttgcgccaaaaaatggttcactagcatgagtggtactgtcagatgatcagacatttttagtcttagctttaaaacaaaaagagaagctgttgaaaatcttcattgtgacaaaagtccttaggaataa

SEQ ID NO: 11573 - DNA, 1920 bp, Zea mays
gcacgagaccattacctagaacatcctaatcgaaaagagccattcctcgctatccctccttcctcccgtcaggcgcaggatccatcgctccatggaccccgcaccggagccgcttgccggaggcggtggcctccagcgccgccccgcggccgccgcaaggagcggagtgggcgcacaggagccgccttcgcgcgggcagcgcgccatccacgctgacgtcgaaccgccgccgcggccgtggcccgggatgcagaagctggccatcgtcgccatcgtcgtgctcggatgcctccagttcctcccggccacgcacttccgggaccccaacgacccccagcgcaactggatccccttcgacggctcgcggaatccaacgggttctttaaatgatgttggaagtgtagatgtcttctcttggataagctgtttggatcttcgcactctcgctgtgctgacaaattccaccctgtccagctcaagtgatccacataatatatctttccattacttaatacctgaaggaggcaacgataaattgtcctacctcaagctaaaagtcttgctacctgattcagatctcactgttactagtcagaagcaaatcaaggacaagctaaacgttgccactccagaaggaaattttctttggttattccacactgaattgtcaccctttcttatcgcaaaatctcagttgtcgaaaaagagatttgtttatatcgctgcagattccatcataaagggcaaagtcgaagatcttggtcgcatggaactaggcggttacgccattggcgctgttgaagattgcagcaagcgtctcagcgattatatcagtatggatgttcttagtgccatacaaagagcgggagctgcattcagttgggtgcctaaagaaccttataacgaggatgcatgcctacttgattttgacgtgctattgatggagcctcgcaagctggagaaaaccctgattacttccatcatgtggtgggctgatgccattcgtttagccaatcaaagggacctgattagactggccgtaactctgtccttcaatggcaagtacacgaggctcccttcaaactggaagcgcgcagatgatgacaacgctgatatcctcaacttcgatggacccaagaacgtctgttctgaagatgggcgccagcatgagcaaccaggctacggcgcaacctggcagcaataccttcatcagaaatctgaagccatactgagcacctaaataacggcacttcgccggacacaaattttccactgtcaccgagtggaagctgactgttggtattgacctgtaaaccctccatagaatgcattttgtactccagtactctattccagcacagcggaagcatgctctcgcttccgtatgtataattcaggatacaagagattttttttttggcggctgacgccggaaagttttcctggttccagttcagtttactcttttttttccatcgtagaacctcactaaaagcctaaaaggtggatcaattaccacgcccatatgagcaaatattgtattaaactgtatgataattgtgcagaaccatgccatcttaccgaccgcccactgcatccttggctccttgctatgcccggatccagcagtacccattcctggttggaattgacgagtgcgctagaattctattttgcttcaataagtcatgtggctcgatgcatcatatggcttggtgcaagaaaatcatttgttgttcttaaatgattttggatatcattggacactacaggagggtcaaccctgagcggaatttcaatctcctcaggttccagcaagacttgtaacaggtttatcagataatgcactgattatacaaaaccgaataccaggcactgcaggtggtaacaaaccttgtctagccttttatttttgtttcc

SEQ ID NO: 11574 - DNA, 966 bp, Zea mays
tgggtacctcgagggccggccgggatcactacccgaacagcacgacatagatccatccaatagcaactcaccaagccattccagattccaaaggacaagtaagcgaagcgcaaacactagcagccagctcggaataatcggaggagccagtccccccacctactttgctctgctctgctcctccatggccagcagctactactccctcatgctgctcctgctgctggcggccacggccgtagcagaagaagcagccgccgaggcgtccggaggcggcggcaacgcgaccgagacgtcgccgacggcgtacgagatgctggagcggtacggcttcccgcggggcatcctgccggcgggcgtgacagggtacgagctcggcgcggacggcgccttcgaggtgtacttcccgcgggcctgcgagttcctgctggcgaggacgtggctggtccgctacgaggcgcgcgtgtccgggtccgtcgccgccggctcgctcacggcgctgcgggggatcagcgtgaaggtgctgttcctgtggctcggcgtcggcgaggtggaccgcgccggggagacgctcagcttctacatcggccccgtcgccacgtcgttcccgatcgacgacttcgccgagagcccgcgctgccgcggctatgatgccgaggcggcggcctcgtcgtgactcatgacgcagccttcagccggcggtgattattaggactgccttgctgatttagctggctatatatacacttgtgcatcgatcgagtcggagccggcgattagctatttttcctcgtcctttaatttttgtttatttcgcggactttgagcaagctatttgcggtgatcttgttgccccgggtgggttggtttgtaggaatttcggaaaaatcatataagattttttacagaacagtttattttcacagaaaaaacgcaacccaggaagtggaaaaaatcttgcaattc

SEQ ID NO: 11575 - DNA, 843 bp, Zea mays
attccagattccaaaggacaagtaagcgaagcgcaaacactagcagccagctcggccgaatcggaggagccagtccccccacctactttgctctgctctgctcctccatggccagcagctactactccctcatgctgctcctgctgctggcggccacggccgtagcagaagaagcagccgccgaggcgtccggaggcggcggcaacgcgaccgagacgtcgccgccgccgccgacggcgtacgagatgctggagcggtacggcttcccgcggggcatcctgccggcgggcgtgacagggtacgagctcggcgcggacggcgccttcgaggtgtacttcccgcgggcctgcgagttcctgctggcgaggacgtggctggtccgctacgaggcgcgcgtgtccgggtccgtcgccgcgggctcgctcacggcgctgcgggggatcagcgtgaaggtgctgttcctgtggctcggcgtcggcgaggtggaccgcgccggggagacgctcagcttctacatcggccccgtcgccacgtcgttcccgatcgacgacttcgccgagagcccgcgctgccgcggctatgatgccgaggcggcggcctcgtcgtgactcatgacgcagccttcagccggcggtgattattaggactgccttggtgatttagctggctatatatacacgtgtgcatcgatcgagtcggagccggcgattagctatttttcctcgtcctttaatttttgtttatttcgcggactttgagtaagctgtttgcggtgatcttgttgcccctgatgggtgggttggttcgcaggaatttcagaggaattatataagaattttacag

SEQ ID NO: 11576 - DNA, 2024 bp, Zea mays
  misc_feature (1217)..(1217): n is a, c, g, or t
gacatagcacattgattttgatttcactaacatttcataaaccaagtttgtgttatttagttttaatttttataggtattcacccctttaggtgctctcataaatactattctatggttttgcaatagaactgtaaaaatacgtggctaccaatactcgaacagggcctaatgtgtaggcatggcactaggttcgatttgggcctaaacaggctttggtgggacatccacatccttgtccgcggcgaaacaaaatttcccacagtgagcgaggttcccctcccgactcggtgatggcggcgccggcggcggacgaggcatggtgccggaagacggtgccacgggtgatggaactggtgtgtccgcgccttccgcagcgggacgcatgcgcgctgctcgctgtcagtccctggtgctaccgtgccctcgttgctaactccaggctctgggaggtacttgatctacgtgagatgaagaatgctggaaaccgacttatttcagcactttcactggcaaggtatcgtcacctcaaagtattaaaccttgaatttgctcaagatattgaggatcgatattttgttcatctaaaagaaacgagtggcatctcactggaaaatttggaattcctgaaccaggtgcgcatcgcttgacaatccctaacttccggttctgcttctgttaccagttttagctggtttaattggaatcgttgctgtcgatgtttaagccctcactcaccttagctttggccgaagattattttttttaacacgaggccaacctctattccattaacggctcatttggatccttggaattgaattccattctaataacatcccgtttggatctttagaatcgaattccattctaataataataatttaggcacatatcaattaagctaatttggttttatactaaatatatttatatactattattagcaagatgtcggatatatttatgtgctatatttttactataaaggagtgagtcaataaaggagtaagtcaaagagtgtcctataagttgtagagtagaaacaaattctactgagacataaaatcatttcgcatcttccacccatgaatttgagataggcttatatctgaactttagaaagtggtgggatattaaatttcaagctaaaaaggttactttattaagtaaattccaattcctctaaaatgaataaatccaaacgccccgtaatantaatttaggcaaagttcaattaaaataatatggtttacttttatgtgaaatatattagcaatataagggagatgtttacgtgctacatttctactgtataggagtgagcataagagcgttttataagttatagagtagaaacatatttcgttgatgcataaaatcatttcccatattttaccccattaatttaagataagtttatatcttagctttgaaaagtggtggaaagtcaaattctaagcgattactttattaagtaaattttaattccttcaaaatgaataaatccaaacggcccgtaacagaaaacggaaattcagaaatattcaggtttagagacagaaaacagaagcaagccatacagagtgtccctgagcagctagagatctgcctcagacaactagctacacaagaaaaaagcctgcaacaagtgagagaagtttgatatgcttaaccgactgctacacctgagcaacaaagcacccaaaaggccaaaagtgtgttctgttacaagaagagcaagataagagaaagcatcagccacactagcgattcccaaagagagagatcttgatgaagttccgaaccgccagtcactattcttcatccctttcagcaacatcctccaactgcattacgtgatctgcttgacttgactccatcaatagccttgtagaaacacccaacatcgtgtccacatcttcaatcatcagcttgcgttctccttcaggaggcaaacctgtccaacatctgattagtgacaagcatggcaaatgatctcataggaatgtttcgtgagtttat

SEQ ID NO: 11577 - DNA, 1399 bp, Zea mays
gtgtaggcatggcactaggttcgatttgggcctaaacaggctttggtgggacatccacatccttgtccgcggcgaaacaaaatttcccacagtgagcgaggttcccctcccgactcggtgatggcggcgccggcggcggacgaggcatggtgccggaagacggtgccacgggtgatggaactggtgtgtccgcgccttccgcagcgggacgcatgcgcgctgctcgctgtcagtccctggtgctaccgtgccctcgttgctaactccaggctctgggaggtacttgatctacgtgagatgaagaatgctggaaaccgacttatttcagcactttcactggcaaggtatcgtcacctcaaagtattaaaccttgaatttgctcaagatattgaggatcgatattttgttcatctaaaagaaacgagtggcatctcactggaaaatttggaattcctgaacctaaatgcatgtcagaagatctctgataaaggaattgaagctgttaccagtctttgtcctaatcttcagcgccttgctatctattggattgtaggactgacagactcaagtattgggcacattacaaagaactgcaagcatctagtgcaccttaacttgagcggttgtaagaatatcacggataaaggaatgcagttgattgctaataattaccaaggactaaagacattgaacataaccaggtgtgttaagttgacagatgatgggcttaaccaagttcttctgaagtgttcttcacttgaaagcctaaacctttttgccctttcaagttttactgacagtgtttatagggagataggatcattaagtaatcttacatttctagacctatgtggtgctcagaatctaacggacgatggccttgcatgcatatcaagatgtggacgtctaacatacctcaatttgacttggtgtgtacgtgttactgacgctggcattttagctattgcgcaaggttgtcgagccctcgaactgttaagtttgtttggaatagttggggtgaccgatgcatgccttgaggctttatcaaaatcttgctcgtccagcctcacaacactcgacgtaaatggctgcataggtattaagaggaggagccgggatgacctgctgaagctcttcccatcactgagttgcttcaaagtgcacagctagcaggcacggtggttctcgatggctttgtattctacatctaggaaggggaagggagatgttgaggtgtgtcttgacttcatgttcttgtgttagtatatactttctttgtttcggattttctatgttcgttgattttgctatgtatggagacattgtgtatatctaagttcgtatcaagagaagttctacagcagctaaaaaaaaaaaaaaaaaaaaaaaaaaaaaaaag

SEQ ID NO: 11578 - DNA, 1049 bp, Zea mays
gtacaagcctttggagacatcgtgtccgtcagttatttctcttcctcctccaaaccaccgatgtcgctaccggttctatccctgcgctgccattgctcgtccgcatcctccttggatttccctcccaggaaggttagggttttctgatgcgctcatacatggggcagcaagaagatgggatgtctgatggcttgtacacttacaagcatcaccgcgagcgaggagctgatatccacaccatctttgtgaagaagagcaaattcaggattctgctgtcatttatcggcacaacgttccttcttgtgtctgtttgctgcgccctgttatcgaaggatggtttatgtctttgttccctttggagcatttcatttgccagtgtaattgcgaaatgcctgcgatgtgaccctgtgaagaaagagtcattggtgatcatgccgacttttggaattcaattagagcaacacttttggagtggaagagttcatcgcaaatttgtgcccattggcaagattctaagaccagtgctgaatgagcatgtgacccctgtctcatgctactggagcttggccttgcttgtacgcgaagaatatgagctcatgcttgttttcaagagcttgaatccaccagtcaagatgttggttccaatctggaaagcgttatgtgcattcgtagactccaattctctgggcaattctgcattgcctcaacccacatgattacatgaacatgcttaaacaagttggtgggtggcctgtgtgcagcccccgatgattatttcgaacatatgggttcgctggagactttgctgactgacaacattatgtttgagttttcgatacaaatgatgatggcaggtacggaatgttaccgacactggggctcttacgtcgggtgtgaattgtgaaaggatcgtgatgcttaagagtgcactctgatcgctacccgatgccgatcacaaagagtaataaacacaaactctcgcttactctaagctcaatgacatcattggatgcacactaattactctcttatacattaatgatgtcgct

SEQ ID NO: 11579 - DNA, 779 bp, Zea mays
  misc_feature (724)..(724): n is a, c, g, or t
  misc_feature (732)..(733): n is a, c, g, or t
cgtgtccgtcagttatttctcttcctcctccaaaccaccgatgtcgctaccggttctatccctgcgctgccattgctcgtccgcatcctccttggattttccctcccaggctgatgtgagctgtgcaggaaggttagggttttctgatgcgctcatacatggggcagcaagaagatgggatgtctgatggcttgtacacttacaagcatcaccgcgagcgaggagctgatatccacaccatctttgtgaagaagagcaaattcaggattctgctgtcatttatcggcacaacgttccttcttgtgtctgtttgctgcgccctgttatcgaaggatggtttatgtctttgttccctttggagcatttcatttgccagtgtaattgcgaaatgcctgcgatgtgaccctgtgaagaaagagtcattggtgatcatgccgacttttggaattcaattagagcaacacttttggagtggaagagttcatcgaaaatttgtgcccattggcaagattctaagaccagtgctgaatgagcatgtgacccctgtctcatgctactggagcttggccttgcttgtacgcgaagaatatgagctcatgcttgttttcaagagcttgaatccaccagtcaagatgttggttccaatctggaaagcgttatgtgcattcgtagactccaatactctgggcaattctgcattgcctcaacccacatgaacatgctntaacaagnntggtgggggtgggctgttgtgcagcccctgatgataattcgaacat

SEQ ID NO: 11580 - DNA, 2477 bp, Zea mays
cttccaaaacaacaaacagaaccgaagccgactagcgcgaccgaggaggcagagacgggtggaggaaaagggcaaagtcgccgcccgccgcccgccgctgatcggtcggtgagctcgatgcgctgtaccgctcggcctcgtcgtgttcctccgcgctgatctccgcctcccgcgacgcccgattccagaggatcgcttcttcggtttggccggccggtaggtgcttgggggttcaggaggcggggtctcggcggctgcaatgcatgctcgcatctcgtggcggcgtttcatcgcttcggtccgtttgtttttcggcttgttgcgctgaaattgagcgattcgtttccttgattcaaggactactagagggcgggggcatcctgcgtggtggctctggctgtctggtctgtatctgtatgatagtgggcgttggcagttgtgccgtcccggctagctgcggacttgtcttggcctagcagggaagtgatggagcacaagaaagctagagcagtggaggatcctgcccggttgatttgcgacgatgccctcaccgaggtattccgcaggctgcctgcccgtgcgctcgcggcctgcagactggtgtgcaagtcatggatgtccgtgctcacagatccacacttcatccatgagcacctgagccgtggccagcagaagctgctgctctttgcgactgacaggggaaacgacaggtcgctcgccatggtgctcgcggacaacaacgcatccatgtaccagctgtcaaggcccgcggcgtctcggagcgtcttcgtgcacaattcttgcaatggcctgctctgcctaggtgacagcacaggagctgtcgaggtgctgaacccaacgactggtgaatctttaatgttgccgatgccaatgtacacggcagggagcagccagttctcgtcatgcaattggcactgcttggggttttgcccacaaaaaagggaacacaaggtggtgcatttctatccaggagctcacaatgacccgttcaaggtacactgtgagatatacacgattggagtcggtgtctggagacaagttgggagctgtcatggtgctccgactgacagaggggtgcatgtgaatgggatggtatactatctgacaaagttccgctacattgcttcatcgcgtatcaactgcttgaatcttgagagcgaaaaatttgatgtgatgatgcttcctccacacaaatcttatggaggtcattgctctttggcagagcttgagggaaagctatgcttgttgattgtcgatggtgcattggaaggtccgcctcgtacaatggacatactgatgctcaatagccatgataagcagggctggactcacagataccacttctccttgccttggttgatgccttcatgttattttactccaaaacacacactcttccacggtggaaaaatttgggtgcagttgttggctaggaatctatattgttttgacccaagttcaagttcagaagaactgacaacagcctggccagagcttgacttttcctttagcacacatactttcattgagagcatagttcctctgcgtaaagactactacttcaagcagatacagtgacagtggtgtgctgccccttgctttcaaggtggttctcagtttacatctttacattatcttttatcttatcgtttcttttttcttatatgaacgaccaagctgttacgtgttagtcagcttaagatggtgtgctgttctggattctaattagcgataataattgcaattttcagacatcttaacttaaaaaaaaaaaaaaaattaattgatctggccatttctctttatgctgagaagttgataggccaagttcagaggatcatttcattagttcttatttcacagcttaggtgattattgatgtaaacactgaacctgtattttatactgcctccgaaaagtttcttgtaatctgatgggatataaattaaaaagtatatgaataccgtgtgatgttttctgctacacttcaacacttcgttgataacaaattttctagctgtgcctgttaaaagtctatgaataccgtgcatctgatgaaattagtatttgcatggaaatattttctttctaggtagatgaagttcaatacctggaatagtatctgaagaattgttggctagctgcatcatttgctgtgatgctcactatgcacgtacagttacttccttggacttggagtattctttacaaacatgattttttttccgtaattgctatcggtttgttctgattttccttatgagctttttattacttccttgactcagatgtgctttgcttttcaaaaattgctgccccagatatcttatttaaaattgttagtatggaacactgccatttgttctgtttttcatgctctagtgttgaaggaaaatacttttctagtttgggtcatattcggggataaattggctaagaagcttgaaaaagatatt

SEQ ID NO: 11581 - DNA, 1408 bp, Zea mays
gggtcgggctcggcaacttcctggagatggggccgctggacgtggacctgaagccgcgcaactcgacgtggctccacaaggccgccctcgtcgccggccgcaacccggtcggcacagggtactgctacgtggaggacgacagcctgctcgtgaccagcgactggcagcaggccgccgacatgacgacggtggtcagggcgctggcgaaggaggtgcccaccctggcgagcagcccgctgttcctggtcgccgagtcctacggcggcaagtacgccgccacgctcggcgcgtccatcgccagggccgtccgcgctggcgagctcaacgtcacgctcggaggtgtggcggttggagatagctggatctcgccggaggatttcacgctttcctacacaccgctgcttctgagcgtgtcgaggctggacgacaacgccggcgacgaagcaaacaagaaggcggagacggtgaaggagcaaatcgtggcggggcagtgggccgcctcgcagaagtcatggggcagcctgctagatttcatcgacacaaagagcggcaacgtcgacgtttacaatttcatgctcgactccggcatggacccggtggcactgcccgtgggttcttcatcactgatgagcagcttgcaggcgatgaagtactcgacgtacggccaggactcccagcctggctccaacaccattgacggcatcatgaatggggtcatcaagcaaaagctcaagataatccccaagaacttcacgtgggggcagcaatccgactcggtctacaacgcgctggtcaacgatttcatgaaaccgcggatcgatgagattgatgagctgctgtcttatggcattaatgtgacggtgtacaatggccagctcgacgtaatctgctcgaccaacggagcagaagcatgggttcagaagctcaaatgggatggtctgaggaccttcctgagcctgccaaggcagcccctctactgtggcgccagcaagggtaccaaggcctttgtcaggtcccacaagaacctgcatttctactggattcttggagcagggcactatgtgcctgcagaccagccctgcatcgcgctaagcatgatcagcagcataacccagtcgccagcaagctagttgactgactctatgtggtgtatgccaagaacaaaggaggcgttgaagcaggtagcgcaaggtcccggaggaccattcggcgttcttgaagtgcggtataggttggatacctgaaagacgatgcagttgacaaggacatttttttttacagaaaaagatccgataaaaacatatatgatctacgtattacaaaatattgtaaagaggccggaacttgtttttttaataatagaaatgtatctggcttcatcctggcaaaaaaaaaaaaaaaagcggcc

SEQ ID NO: 11582 - DNA, 904 bp, Zea mays
cattgggaccctcgaggccggccgggacccagcgcgcctcacagcgacacccaccacgcccccggtcgtgcatcatcatcatcgctcgcgtcttcgagttcgaggacatggacaggccgcgttgctactccccgcttgccctgcacctcctcctctgcctcgtctcgctccgcgcctgttccgccgcgtccatcacagccggcacccccgacgagtcggagctgtgggggtacgtcgaggtccggccaaaggcgcacctgttctggtggtactacaagagcccgcagaggacgtcgacgccgtccaagccatggcccacggtcctctggctgcagggtggcccgggcgcgtccggggtcgggctcggcaacttcctggagatggggccgctggacgtggacctgaagccgcgcaactcgacgtggctctacaaggccgacctcatctttgtggacaacccggtcggcacagggtacagctacgtggaggacgacagcctgttcgtgaccagcgactggcagcaggccgccgacatgacgacggtggtcagggcgctggcgaaggaggtgcccaccctggcgagcagcccgctgttcctggtcgccgagtcctacggcggcaagtacgccgccacgctcggcgcgtccatcgccagggccgtccgcgctggcgagctcaacgtcacgctcggaggtgtggcggttggagatagctggatttcgccggaggatttcacgctttcctacacaccgctgcttctgagcgtgtcgaggctggacgacaacgccggcgacgaagcaaacaagaaggcggagacggtgaaggagcaaatcgtggccggggcagtgggccgccctcgcagaagccatggagcagcctgctagatttcatcgaccccaagagc

SEQ ID NO: 11583 - DNA, 1213 bp, Zea mays
gtccctagaaaccaaacaccccctaaaagcaataaaggaatggaaatatattcggcttgatcaatgtgtttagaagtacaaatgattgctcttttttttcaaccgcaacttttgtataataaaaaataaattaagatgaaaagggaggcagctggcgcgcacggcgcaccgcacatgaagctgttggcaagtcaattattgcgtcccactcccactcgtacttttatgtttgcgacgccggcgggccggccccgggaaaggcccaaaaggcaggcagccatcacgatggcgcttgcccacctccccttcgtcctcctcttggtgtcgtccgtcgccgctttcgccgccgccgaccacggcctcacgcacatccacctgtacgtgcacgagacgtacaccggggcgaacgccacggccgccgccgtgctgcagtccccgctgggcgccaactcgtcgttcgggagcatgggcgtggtggacgacgagatacgcgtgggcccggaccggtcgtcgcagctcgtcggccggtaccagggcgtcttcttcggcacgagcgtgcagctgggcgccggctacctgtcgtccatcacgctggtgttcaccgccggcgagtacaacgggagcaccctgtccgtgcaggggcccctgctcgggttcacgggcaccatcgagcgcgccgtggtcggcggcaccggcaagttcaggctggcgcgcgggtacatgcttttcaagatgataagcaagccgacgccggagacggacgtcaacgagatcaacctgttcgtgctcatgcaccccgctggcaagtactagcgcatacaccttgagacgagtgagtggctactggctactaccgcattgttgttgggcaggttggatgaagtgtctatgtccaatccaactctttcagatttgtttctcttggtgaaacccaataaatatgcaatttcttcgtcctatgagcaaaaaaaaaaaacatcttcttggccttgacctgtttcttggccaatgacttgtttgggagtgagaataccgaagttaattggaggaattaatttttcttttgctatttaaaattaaatagctaggagattttagccactccagtcttccatccttgcttccaaacaagttcctcgagcctggggttagtttcgtagagctctttcagctctaaattctctgtcgaagttgattctttgtgaagagtgat

SEQ ID NO: 11584 - DNA, 1274 bp, Zea mays
  misc_feature (467)..(469): n is a, c, g, or t
ccggccgggccgggagtagaaagcatagtcacctgcctatctatctagcgagagagagagaggaaagctagctagctagcatggagtgcggcagcaagaaggcagcaggcggtgtgttggcgctgctgcttctccagctggtgttagctccgacgacggcgacggcccgcctcctgcaggcggatacctccaccgtggttggcctggacatcatcgcgagggagtttggccatccagtgagaggcatcctctgtggtgaaacctgtgtcttcctaccatgctatacggcagccatgggttgccaatgcattggccaaatctgcatgatgtgatatctggactagcgctatttgtaatttgtgttgggagaaacacaaggacggtacggtggtgttcaacttattgcatgtgtatggtgatctaataagtaaagtataataaaaagggatatgttggatgtgtacccnnnaaaaaaaaaaaaaaaaaaaaaaaaaaaaaaaaaaaaaaaaaaaaaaaaggggcccctcgcgcccggcgggcccggaaaaggcccccttcgtcctcctcttggtgtcgtccgtcgccgctttcgccgccgccgaccacggcctcacgcacatccatctgtacgtgcacgagacgtacaccggggcgaacgccacggccgccgccgtgctgcagtccccgctgggcgccaactcgtcgttcgggagcatgggcgtggtggacgacgagatacgcgtgggcccggaccggtcgtcgcagctcgtcggccggtaccagggcgtcttcttcggcacgagcgtgcagctgggcgccggctacctgtcgtccatcacgctggtgttcaccgccggcgagtacaaggggagcaccctgtccgtgcagggccccctgctcgggttcacgggcaccatcgagcgcgccgtggtcggcggcaccggcaagttcaggctggcgcgcgggtacatgcttttcaagatgataagcaagccgacgccggagacggacgtcaacgagatcaacctgttcgtgctcatgcaccccgctggcaagtactagcgcacacaccttgagactcgagtgagtggctactaccgcattgttgttgggcagaggttgggtgaagtgtctatgtccaatccaactctttcagatttatttctcttgttgaaacccaataaacatgcaatttctttgacctctgagcaaaaatgtaggccattttcttggccttacccgttaaaaaaaaaaaaaaaaaagcggccaggccc

SEQ ID NO: 11585 - DNA, 791 bp, Zea mays
gaggctcggccggggcaaaggcccaaaacgccaaaaggcaggcagccatcacgatggcgcttgcccacctccccttcgtcctcctcttggtgtcgtccgtcgccgctttcgccgccgccgaccacggcctcacgcacatccacctgtacgtgcacgagacgtacaccggggcgaacgccacggccgccgccgtgctgcagtccccgctgggcgccaactcgtcgttcgggagcatgggcgtggtggacgacgagatacgcgtgggcccggaccggtcgtcgcagctcgtcggccggtaccagggcgtcttcttcggcacgagcgtgcagctgggcgccggctacctgtcgtccatcacgctggtgttcaccgccggcgagtacaacgggagcaccctgtccgtgcaggggcccttgctcgggttcacgggcaccatcgagcgcgccgtggtcggcggcaccggcaagttcaggctggcgcgcgggtacatgcttttcaagatgataagcaagccgacgccggagacggacgtcaacgagatcaacctgttcgtgctcatgcaccccgctggcaagtactagcgcacacaccttgagactcgagtgagtggctactaccgcattgttgttgggcaggttgggtgaagtgtctatgtccaatccaactctttcagatttgtttctctcggtgaaacccaataaacatgcaatttctttgtcctctgagaaaaaaatgtaggccctgtttgttgccgaaaaaaaaaaaaaaaaaaggccctaaaaaaaaaactc

SEQ ID NO: 11586 - DNA, 1593 bp, Zea mays
atcaaggcactatttgcaaactcttttgtctctgccatgatcgagttcaagcatagctgaaaaaccagaaggcttaaacagcgacacatatcttttctcgctatatttatcagagcaagctctgttcaattaggatacacaagatcggattcagggaaaacaaagcctacatctgcaagtcagcttcgtcttcatccataaactgcaactgcacgggtccaagcagcatgtacaccatagccagttgcctcatctgcctgtacctggaaacaagcgagcgccagtccggtgagtccttggcgtcaatgctgattaggtcttctgggcgcaagttaccggcacccggcagatacttgaggttcgagtaaccagcaggatcggagaggtctatcattaaatctggtgagagcgagcgccccgtcacttggacatggcagacacatatgtaatacttatcatctgtaaattgtttctgtatcctccccagtagttcaatcttcactataccaccaatgcaaagagccgggcgtggaagcttgaaggtttgcaacacattttcctgaagcataggaaactctggcgacgtgtatgtccacatgtagttctcatcagcgatcgcagtcaggttctcatcctcatccgaaacaaaagtctctcttccagggtcaagcttggaatgacccagccggattctcaccgccttcgaagagtaaatcggatggccatgctgaaaagtagcttcgaacgggcgtatcctgatctcctcgatgacgcagagatcagaggcgagcgtgtaggtcaagctctcggggacatcggggtcgtcctcgccgccgctggaccagtaggaggggcggaagttaaccatgtcgtgcggcacgagcgtgttctcgatggtctcgtcggggaagttgtcggtgctggaggcgccgacgcagcgcatgacgaggtccgtggcgggcttgccggagacgagcgcgccggcgaggtaggagtaggccgcgtgctccccatcgcgggccctgcactcggcgacctggctggactcgcacgcggcgtgcgccgccggcggcggcggcggcggcaatcgggccaccacgaccgcgcgggtgaagctggcggcctccggacatatctgcctgcacaggtgcttgctgaatttgttcacggcgacgaatcggcgccaggagcgggagacggcggcgacgcgggcgaggtccgcggggtcgtcgaggagctggaagatggtggtggagatgtccgggccgagccagtcgaggaagtcccacccgacgctgtcctccgtctccatcgggcgcatcgaccggattggaagccgatgccacaggacagggggggagcaggttgctgcgcgcgggcgcccgccgctgggagagggcctcctggccggttcagatccgcgtgccgtgcccgtgcgggaggcgggaccgcgggaggggaggttagggcggtggaggaaggaagcaaggaaagggaagcgagcgagcgacggacgggaccgggaactgaagcgggggaaccgagcccccttccggggcgccgttcctgtgcgagcccacttttgcctgcctg

SEQ ID NO: 11587 - DNA, 1533 bp, Zea mays
atcaccaaacgggagggcgaggggcaacaggacacacacactgacctagcaccagctcgatctcacaggatggttacgctatgccatccgattcggatccgagcaagcgggagcaccgcgagctggcggaggagaaatgcggcggcggcggcgaaggtcctctgctccgtgcagcaaatgccgccgccgccgccggcggccacggctgcccagagcacgatcaaggtcgttatcgttggggcaacgaaagagatcgggaggacggccgtcgttgcggtgagcaaggccaggggaatggagctcgcgggcgcgatcgactcgcagtgcattggcgaggacgcgggacagataagtggcatggacgagccgctggagatccctgtgctgaacgacctcaccatggttctgggctccatagcgcagtcgagagcaaccggcgtggtggtcgacttcagcgagccttcagctgtttacgacaatgtcaagcaggcagcggcgtttggtctgagcagcgtcgtctacgttccgaaaatcgagctagagacagtgactgaactgtcagcgttctgcgagaaggcaagcgtgggctgcttggttgcgccaacgctgtcgattgggtccgtgctccttcagcaagcggctatacaggcctcgttccactacagcaacgttgagattgtggaatcgagaccaaacccatcggatcttccatcgcaagatgcaatccagattgcaaacaacatatcagaccttggtcagatatacaacagggaagatatggattccagcagtccagccagaggccagctgctcggggaagacggagtgcgcgtgcacagcatggttctccctggtctcgtctccagcacgtcgatcaacttctctggcccaggagagatgtacaccttacggcatgacgttgcgaatgttcagtgcctgatgccaggactgatcctggcgatacggaaggtggtgcggttcaagaacttgatttatgggctagagaagttcttgtagtgaacaacaaacaaccaatgcaaaacatcgacaggcaacaggcaaggcagatatcatctgacgtcgcaacaaccaaaacgacagagatttggaaaataaaggctgcacagaagacgtctggggttttgtgtgcaccaggctgcgcagagaacgtctgtcattttgtgtgcaccactacggcactacctgctgagcgcgatttttataaaaaaggcatgggagggagatcatacacaggaaaagtcacgaaggaaaaaggggtcacatggacatacaggtattggtagcataaccaaaacaatggatctgattctgcgattcggttccatcggcatatgcttgttcagaagaaagttgcatcgggacttgaagaaaaggagggtctagtttgcgttttgtaaccgagactgcgtaattcggcatgcgtatggcaatccaaattgcgccagactaatccagattcaattttataaaatggataaaacataaaaaagacgtacaaaaaaaaaaaaaaaa

SEQ ID NO: 11588 - DNA, 6379 bp, Zea mays
ctgcctatcatatatatgtgcccaccaggtcgttatcgttggggcaacgaaagagatcgggaggacggccgtcgttgcggtgagcaaggccaggggaatggagctcgcgggcgcgatcgactcgcagtgcattggcgaggacgcgggacaggttcttcttctctcactcacatgatcccatgtactccttcacatgcactgcatgggtggcattgcattgccggattgcccctttgtttatatctatctcatacgagctgtatgcgaatgctgggcactgcacgggcgtcgtggtccagataagtggcatggacgagccgctggagatccctgtgctgaacgacctcaccatggttctgggctccatagcgcaggtacagaccccgctcagctcgctgggggccgggcgaccgtgataaatccccggcgggcttcgggcttcaggacttgcatctttgggctaactgcacactgcctgtccttccattccattccagtcgagagcaaccggcgtggtggtcgacttcagcgagccttcagctgtttacgacaatgtcaagcaggtacgcacggcacgtccactgcccacctacgacatggaaaaggacatgcgagctgcatgcaatcaatgaacggcgaggtggcttaagcccaaagctaaacctaaacaaaacactgttgttttcttcaaccctgtatggtttggtttggtttcacacgctgcgttggagaatcccagcgaggggtttaggagcaaactagatcagggtgtcgtcagctgatgcagatcagcgatgatcctgacaaggacagagacaagcatgaattaatggcgttgatgactaaattaaccagctaacgtaacttttcaggacaagatcaacaacctactcatgtccagactctatccgcaactgcttcagattattattattttttcttctcatgttcggaattctttgaaatggtttattacgtaccatgagcaggcagcggcgtttggtctgagcagcgtcgtctacgttccgaaaatcgagctagagacagtgactgaactgtcagcgttctgcgagaaggcaagcgtggtaataagctgcaactgctcaccgtcgttagggctgcttctgaaacttaccacaccgccatcaccattttgagcttggcagccagactaataataatatgaacttgcgctgtggtttcctggtcattaattagggctgcttggttgcgccaacgctgtcgattgggtccgtgctccttcagcaagcggctatacaggcctcgttccactacagcaacgttgagattgtggaatcgagaccaaacccatcggtacgaccgtacaaagagagatgaactgttgtcaacctatagctatgatatcaggaacctgcagactgatacagcactaattaattttgacattgacaggatcttccatcgcaagatgcaatccagattgcaaacaacatatcagaccttggtcagatatacaacagggaagatatggattccagcagtccagtaagtgtcgacagttgcaattatactacgttgcgtgcatttctttctctctcttttttttttggtcacatgtacaagtacaaagaaagagtgaactgactgacaagtgttttggaaaaaggccagaggccagctgctcggggaagacggagtgcgcgtgcacagcatggttctccctggtctcgtctccagcacgtcgatcaacttctctggcccaggagaggtactggtaacctcacactgacatgatatgcttgactgaaacagcacgctgaatttgactgctgcatcacactccgacaacacttttcagatgtacaccttacggcatgacgttgcgaatgttcagtgcctgatgccaggactgatcctggcgatacggaaggtggtgcggttcaaggtaacctggaactactcatgcatgggttctcttctgtgtcacagggtcgcttcgcttcactctctctggtctggtttgctgctaactaggattttgtttatttttgcagaacttgattttatgggctagagaagttcttgtagtgaacaacaaacaaccaatgcaaaacatcgacaggcaacaggcaaggcagatatcatctgacgtcgcaacaaccaaaacgacagagatttggaaaataaaggctgcacagaagacgtctggggttttgtgtgcaccaggctgcgcagagaacgtctgtcattttgtgtgcaccactacggcactacctgctgagcgcgatttttataaaaaaggcatgggagggagatcatacacaggaaaagtcacgaaggaaaaaggggtcacatggacatacaggtattggtagcataaccaaaacaatggatctgattctgcgattcggttccatcggcatatgcttgttcagaagaaagttgcatcgggacttgaagaaaaggagggtctagtttgcgttttgtaaccgagactgcgtaattcggcatgcgtatggcaatccaaattgcgccagactaatccagattcaattttataaaatggataaaacataaaaaagacatataacattcctctccccccgtttcttattagcgttctataattttttataccgctgcaaaagcgggcatgtttgctaggcaaacctgaattgcgaaacctggtttcgacagcacgagagcgtccttcatgttgaaattgttcgctacccatttaaaaaccaccagatggtaattattaatcacgatacagaatatggtctatttgcaagataaagggggctgcctccaaattatcaatgcactatttgcaaactcttttgtctctgccatgatcgagttcaagcatagctgaaaaaccagaaggcataaacagcgacacatatcttttctcgctatatttatcagagcaagctctgttcaattaggatacacaagatcggattcagggaaaacaaagcctacatctgcaagtcagcttcgtcttcatccataaactgcaactgcacgggtccaagcagcatgtacaccatagccagttgcctcatctgcctgtacctggaaacaagcgagcgccagtccggtgagtccttggcgtcaatgctgattaggtcttctgggcgcaagttaccggcacccggcagatacttgaggttcgagtaaccagcaggatcggagaggtctatcattaaatctggtgagagcgagcgccccgtcacttggacatggcagacactgtcagcgtgcaaaaagaaaacaaagctgttaacgtcgcagagatgacgcatatccaagggaatgcttcagacgtgctaaagaaagctaactctactttataagtggacaaagaaatttcaccatccaagatggcatgtgtctgcacagacaagcaatacataaaccatgcttggacacaaggatcaagacaaaattacaggaaaggtaattaggatcacatagagaatgatcttctgtagacaaactacttttaggctgcagcgaaaataagtagcacacactcctttagttctatcccagcgcgaaactgtacattatacgcaagttcaaaattcatataacaaattaacggccatgcatgtttccttcttgtaactggattgagacaatgttaacgagcgcgcgtgaagggaaccatgaaggaaaaaacaggtgaccaaccaacaccaacatcagaagttgagaactcaccatatgtaatacttatcatctgtaaattgtttctgtatcctccccagtagttcaatcttcactataccaccaatgcaaagagccgggcgtggaagcttgaaggtttgcaacacattttcctatcacaccaaaataagatggcagtcagtaaagttgctaaatcatccattcagtaaaacaaaccggaggagagccgccagttaaatattagtaaaaagaaaggaagtcctgggacactgtacaagaaaggctggagtctagcaacaatacagccacacacaaaggagcaacaagatacaggagagaagctagtgaatctgaaatccacaggcacctaatgaagtgttttgctcctgccgcgatccacatctttaattttctgcagcacgcggaaacacgattgatttcaccccgccggctccctggggtcgccctgcagcactgtttcaaatgttggcgagtggcgatagagtaggcaaattctatggtctggccaccctcgagcttccagtctatcagtagtgcacatttgattctgaatcgcgacccaaccgtaaattttcagttgtaaccgaggggaaagggatacaatgcttggatattcggtaccaagccccttttgttaagactattcgaccagtgagatactcatactactgtacccccaaaaaatgatagacaagccacaacaacttgtgcactgaattgtcattgatactaaataaattaaaacctaagctgttccatctttgaaagtgaatacaataatgaccggtaggttcggatttatattcaaaactgtagcaaaaccacatagcaatatcctatcttaaaagaagattctggtggatagaacagtcaacaagagaggagaaggaagcgttcaactcacctgaagcataggaaactctggcgacgtgtatgtccacatgtagttctcatcagcgatcgcagtcaggttctcatcctcatccgaaacaaaagtctctcttccagggtcaagcttggaatgacccagccggattctcaccgccttcgaagagtaaatcggatggccatgctgaaaagtagctggcatggaaaaacaaaacaaaaccaaacaaaaaaggccatgtaattcacaggatcagtcagcctccctgaaattgaaaacctaattgtagggcattcgaaacatcctgacagactcaatcagctgcatgccgtcctagcacgcaccttcgaacgggcgtatcctgatctcctcgatgacgcagagatcagaggcgagcgtgtaggtcaagctctcggggacatcggggtcgtcctcgccgccgctggaccagtaggaggggcggaagttaaccatgtcgtgcggcacgagcgtgttctcgatggtctcgtcggggaagttgtcggtgctggaggcgccgacgcagcgcatgacgaggtccgtggcgggcttgccggagacgagcgcgccggcgaggtaggagtaggccgcgtgctccccatcgcgggccctgcactcggcgacctggctggactcgcacgcggcgtgcgccgccggcggcggcggcggcggcaatcgggccaccacgaccgcgcgggtgaagctggcggcctccggacatatctgcctgcacaggtgcttgctgaatttgttcacggcgactgcacgggaggcggggagaggggggagcaaaacagcggaggcgtcgagctcagcgaccggcccaaggacagggacgataacggggaactggggagcaggaagcgtaccgaatcggcgccaggagcgggagacggcggcgacgcgggcgaggtccgcgcggtcgtccaggagctgcaacatggtggtggagatgtccgggccgacccagtcgagcaagtcccacccgacgctgtcctccgtctccatcgggcgcatcgaccggattggaagccgatgccacaggacagggggggagcaggttgctgcgcgcgggcgcccgccgctgggagagggcctcctggccggttcagatccgcgtgccgtgcccgtgcgggacgcgggaccgcgggaggggaggttcccgcccgggaggaaggaagcaaggaaagggaagcgagcgagcgacggacgggaccgggaactgaagcgggggaaccgagccgagttccggggcgccgttcctttgcgaggccacttttgcctgcctgcctgcctgcctgcgcccggccgggcgggcggtctcgcgagtgtgttttcttttctggagctttccggcgaacggacgcgggtgggtgagtgagtgcctgccgaggtcctcgcggccccgcgcggctttcgtgcctgccagacacgggtggcaaaacctgtggccgggaccggtttccgtggatgcggccgccaaatcgaaacgaacccgccggtcgcgtcgcgtcccagaaatcgtgggtgtggtcacagtgtcacacgtctcgcgtgcaggcgtgctgttcgagccctggcgtgagtgacggtcggggggtccggaccgccgacctttgcgtcggtggcggcgagcaccgacggcgaggggttggcatgcgggacgggagcagtaccgccaacgcacagcacagtcagactgtcttcagcgtctcaccctcccctagaactatagcacctgtagaggttacagtgctccgctaaatcctgcag

SEQ ID NO: 11589 - DNA, 2120 bp, Zea mays
caaatattaaacagaggatgtataccaaaaaccctaaaccctttatcaattcgtgacataataataatgcataataatggtccctctgatctgatgatcccgtcgattatctcgcttgcacagttgtacacgtggtccgtcgatgactcaagctagcgaaccgaagttgccaaggcaacatcaacttggacaacagattagttcgcgtcatgtatgacgctaacgagaagtttctttcacccatgtgcccggtaagctcgcccaggaacctgcctgggcgccgcccgtccggacttgagagctgaaaggtcaacaagcacccccaacccaaccatcatcaggaaatccctgccttgcgctgtctgagtacctaatgctgacccgcatcctctctcgtcaacagaccacatcaatatcaatactagtactaggattcatcatcagtagtatataaaatgaaccagaacaacctatctgtctgcaaatgcactcgtttcaggcctgacgtccgtctccaactcgactactatactaccgccgcgctctgctcctgcaccagccgggtcagctgaactgagcatcatatcatggagggaggagccgttcccaagccatcggagaagaggtgcactgtgcacacatagcgcgacatgagagcttctgtcgtccgaccggcagcaggcagcagctgagttcatgcgcgcttatttgcttccattttcttgtgcgtggtcagggtggccctcgtcacgggcgggaaccggggcatggggttcgagatatgccggcagctggcgtccagcggcctcaccgtcgtcctcaccgcgcggagcgagacgcggggcgccgaggcggcccgcgagcttcgcggcctcggcctgccggacgtcgtgtcccaccagctggacgtcacggagcccaccagcgctgctcgtctggctgatttcgtcaggaccaagttcggcaagctcgatgtgttggtgcgtacggcccctccgatccgtcgacttctgagttctgaccgtcgtcgacttcgtgcgcataaactggttcacaaatcacacgctgcaggtcaacaacgcgggaatcatgggggtgacgatggaggttggcgacgacgaggcagccgtcaaagaaatggtacgtaaataaacagagatggaaattaatgccagcatatgtataccgtaactgtaactccatagcagctgagctgggtatacatttgggtggtgtaagttagtgttagacactaacgcaattttggctggctgcatcgaaacagatggtaggcaaggaccagaacgagattgcagagtggctgaagcagcggaccacgcagagcgccgagcaagcggaggaatgcgtcaggatcaactaccacggcaccaaaaccgtcacggaagcgctcctcccactcgtgcagtcgtcctcctcctcctcctccggcgggaggatcgtcaacgtcacttcatccttcggcctactcagggtacgtgcggacgtgccctgccctgctcatacacaacacaagagaccatgaccatccagtccaatgcaatgcaacattcatcttgtaccctgcgcttatttccggtgcagtttttcagcggcgaggagctccggcaggagctgagcagcgtcgacacgctgaccacgcagcgcctggacgagctgtcggcgctgttcctggaggactacaggagcggccggctggagccccgcggatggccgaccgaccgggtgtacgcggcgtaccaggtgtccaaggcgctcgtctccgcctacgccagggtcctcgccagggacaaccccgcgctgcgggtcaactgcgtgcacccgggctacgtccagacggagatgaaccgcaacaccggggacctcacggccgcggaaggcgccagggtatccgtcgccgtcgctctcgccgaccagggcggcgtcaccggcgcttacttcgatcgcactcaaatagcttcgttcgtgtaatcctcgagtgctacgcacgcgtagagaagaacacgcaccacgtttaccatgtatttctaccgcaaataatagagctctatgcttgatgcttcacattcaaaaaaaaaaaaaaaaaaatgaaaaaaaaaaaa

SEQ ID NO: 11590 - DNA, 1196 bp, Zea mays
cattgggtacctcgaggccggccggggcaaatgcactcgtttcaggcctgacgtccgtctccaactcgactactatactaccgccgcgctctgctcctgcaccagccgggtcagctgaactgagcatcatatcatggagggaggagccgttcccaagccatcggagaagagggtggccctcgtcacgggcgggaaccggggcatggggttcgagatatgccggcagctggcgtccagcggcctcaccgtcgtcctcaccgcgcggagcgagacgcggggcgccgaggcggcccgcgagcttcacggcttcggcctgcctgacgtcgtgtcccaccagctggacgtcacggagcccaccagcgctgctcgtctggctgatttcgtcaggaccaagttcggcaagctcgatgtgttggtcaacaacgcgggaatcatgggggtgacgatggagattggcgacgacgaggcagccgtcaaagaaatgatggtaggcaaggaccagaacgagattgcagagtggctgaagcagcggaccacgcagagcgccgagcaagcggaggaatgcgtcaggatcaactaccacggcaccaaaaccgtcacggaagcgctcctcccactcgtgcagtcgtcctcctcctcctcctccggcgggaggatcgtcaacgtcacttcatccttcggcctactcaggtttttcagcggcgaggagctccggcaggagctgagcagcgtcgacacgctgaccacgcagcgcctggacgagctgtcggcgctgttcctggaggactacaggagcggccggctggagccccgcggatggccgaccgaccgggtgtacgcggcgtaccaggtgtccaaggcgctcgtctccgcctacgccagggtcctcgccagggacaaccccgcgctgcgggtcaactgcgtgcacccgggctacgtccagacggagatgaaccgcaacaccggggacctcacggccgcggaaggcgccagggtatccgtcgccgtcgctctcgccgaccagggcggcgtcaccggcgcttacttcgatcgcactcaaatagcttcgttcgtgtaatcctcgagtgctacgcacgcgtagagaagaacacgcaccacgtttaccatgtatttctaccgcaaataatagagctctatgcttgatgcttcacattcaaaaaaaaaaaaaaaaacgt

SEQ ID NO: 11591 - DNA, 2494 bp, Zea mays
acgcccacgcgtccggtttatgccatatatttgggtcatgctggtttcgtttggtcaaacatggaccaaaataaatgactccatgtattctctctccgaaaatcacgccataaagactctcctctccgacgactgaccgttccccgaatctctctccacatcagttttggtcccaaattcagcctgagagctgcagcagcgaagagccgaagaaagccagcctcgccttccccctctccccatactaatcatcatcaagggcctgcgattccaagttgcgtttcctgtctggggattcagggtggaaggagatgaaatcgccattgcgcaggttccggggcttcgcccttcatcaccaccaccaccacagggagaggaaggaccaccgcccgccgtccgccaagctcgacgagctcgtctacgccgcccaggaaatggaagatatgaggaactgttacgatagcttgctttcagctgcagccgcaacgacaaatagtgtatatgagtttgcggaagccatgggtgaaatgggaacttgcttgcttgaaaaagctgcattgaattatgatgatgatgaaagtggtaaagtgctgatgaagctagggaaggcccaatttgaactacaaaagtttgtggatgactatcgtacaaatattataaatacaatcacaaatccatcagagtcccttctgaaagagctacaagtcgtagaggaaatgaaagaccaatgtgatcaaaaaagagtggaatatgaagccatgcgagcagcctatggggagaaaggagggcgattgaggcacctaaaaaatgaatcattctcattgggacaactgcaaacttcatttcttgagtaccaagaggaggcggcattgtttatttttcgcttgaaatcactaaagcaaggtcaatttttaagtattttgacacaggctgctcgtcatcatgcttctcagttgagttttttcaggaaagggctgaagcatctagaggctttggagccttgtgtcaaagcagttgctgagaagcagcacattgactaccacttcagtggactggataataacagtgatattgatgattacagctcttaccaggataatcatagtgatggcagtgagttaagttttaactatgagataaatgacagggacaaggacctccccactttcagaagtccaatggatatggatcaagctcatccagtgagttccccaagacctctgaaggaacagcaggaaaatgctgaagaaataaaggcgactttaggagttcctcatatgaagcctgagattggtacccaatcagcaccaatttttgctgagaatgttcctgatccatctatgagattccggaaaatgaacttgttaaccagaactgttcactcctacaaactcccaacgccagctgatgacaagaaccctgcttcagtaattgccaacaaatcgcctcattcagatcaacccgagagtaaatctcacgtggcagtaaatttgtggcattcctctccactggctaaagattttatgccgaattccatgcacagtggacctgttaagatgccatcaagtaacgaaggggtatcactagcttattcctactccacgacagattttaagaaagtgaagagggaagctttttctggcccaatcccaagcaaggtaggattgagcacccccctgatttctgcgactgatcgcaaaccgtcagggaagcggccttcctatgtgttgccaacaaggcctcctggcccaggttggcagtcatctgtgcctccaaaagctacgcccagggtgacctcgctcccaacaacgactcccaggataagcgagctgcatgagctgccccggcctccagcaaatgctggtttggttggatattctggccctctggtttcaaggcggccgatgcctactgctgtatccaccacccgtgtctcacccccatcacatacggcgtcgccactcccacgaccacctgctgccatgactcgtagctactccataccttcaaacagtcaacggactcctattattaccgtgaacaaattgttggaggctaggcatagcagggagagtagcgaagtttcctcccccccagtaacacctatatcactggcagacgtttcccgcagaccaacaacagaagcagctgtttgacaaaaaggataaaggaatccttgtgagcagttgcgcaactgaacatgttgataatcttaggaaattttgtatgtggttgactgtattctatgattccctccataatctctcgtgttccctgcgaaaggaaaaaaatgtaaataaggttccattatgttatcgccttgatatgcttgtccgaactacctcttggatatagtgtaatagtctacaagagagagtttagatatggacgctgttgattcagtggtcatctgagctaattttttggactctggtgtgtagctctacccataatcccgccctgcccgaactgatatttgcaaaaaaaaaaaaaa

SEQ ID NO: 11592 - DNA, 1315 bp, Zea mays
ttccgccccaaaagcatcatctctcttcagcgagataccaaacatacgagtagtaacaatcatccgatgatggggtggtgcgaggtaggcatgatgaaggttctcgtcctcagcctcgtggccggcgccgtcgccgccgtgcggccgagcaagctgctgccggcggcggtgcctgcggtgtacgtgttcggggactcgacgctggacgtcggcaacaacaactatttgcccgggaaggatgtgcccagggctgacaagccctactacggcatcgacttgccgggctccggcaagcccaccggaaggttcagcaatggctacaacaccgccgacttcgtcgcccaagctctgggattcaagaagagcccccttgcttatctggagctgaaagcgcggaagatgctaatcccgagcgctgtcacgagaggagtaagctatgcatcggcaggagctgggattctggattccactaacgccggaaacaacatcccgctgtcgcagcaggtgcggctgttcgagtcgaccaaggccgagatggaggccgcggtgggccagcgcgcggtgcgcaagctgctttccgcttccttcttcctcgtcagcgccggcagcaacgacttcttcgcgttcgcgacggcaatggcggagcggaacaggacggcgacgcaggccgacgtcacggccttctacggcagcctcctctcccaactactctgccaccatcaccgagctgtacaagctgggcgccaggaaggtgggcatcgtcaacgtgggcccggtcggctgcgtgcctcgcgtgcgcgtgctgaacgccaccggcgcgtgcgccgacggcctgaaccagctggccggcggcttcgacggcgcgctcaggtccgccgtggccgcgctcgccgcggaccagctgccggggctggcctactccgtggccgacagcttcgggttcacgcaggcgtcgctggccgacccgctggggctggggttcgcgagcgccgacagcgcgtgctgcgggagcgggcggctgggcgcgcagggcgactgcacgcccgcggccacgctttgcgccgaccgtgaccgctacgtcttctgggactccgtgcacccgtcgcagcgggccgccatgctgggcgcgcaggcctactatgatggcccggcccagtacacctcgcccgtcagcttcaagcagctggcccgcatgaggataggctgatttctcattttttgttgtattcttgtggcccatatagcggcaataacggtaataaagtcagtgtaacaagtgaaaaaggattatctgacaaaggtcttccaacaaaaa

SEQ ID NO: 11593 - DNA, 2518 bp, Zea mays
cattgggtacctcgaggccggccgggacggcctgtcccgattcattcggatttccttccgccttccgacagcggctgtctcggcgacccaaccccagcctgaccccacctcccgccgccgccgccgccgccgccgcgcccttcgtcgtcaggagaagggtcccggtggctgcgtctctctcccctgcccccctgctccacactcggttcacgcgtcggctcgctaccgcaggccctcgactcgtacgcccgtccccggcggcgatccggccggcaccgtaaccctaggactccgacggagcaggaatgatgagtcatgaacaacaaattgtccctcctagtaagggttctgtgaatgggttcccccatagaaaactggataaggagggcagtggaacgcaaagtagaataaatttggtgaggtcatcctctggtggttttactaattcagggcatggaagccattccagggaccggctaatctatgttctaacacaacttattgggcatcatgtggacgtgcatgtgaataacggctctataatctctggaattttccatgcaacaaaccctgacaaagactttggcgtcgtcttaaaaatggctcaggtcataaaggatggttctgccagaggacaaagatatcctgctgttcttgtaaagaaacctgagactatgataataccggcaagggagcttgtacaagtttttgccaaggacatagaacttggcggcgagctgccaaaagttcctggcaatgacaaaaggaaggacttgctgattgattctgctattacccgctatcattatctcgaagagagggaacttgagcgctgggcaccagatggaggagattcagagtgtattgaactggagaagtatgaccggaagggaaataggagctgggaccagtttgaaaccaatgcagcattatttggggtaaagactactttcaatgaagaaatttataccacaaagcttgagagaggtcctcacatgagagagcttgaaaagcatgcttcgagaatagctagagaaatagagggagaagataccagagatattcaccttgcagaggagagaggcttattcctgggtgatgacctggaccatgatgaagagataaaatattcagcagtgcgtagagacaccgataacagcaagtacaagccaccatttactaaggtcccaagcagtacatgccatgttgattcgtttaacaggacagtcaatattgatccgaatgattcactggcatgttcatcaacaatggacaaagaatcatcatcccacatatttgatgacactgatgcatctgccactatccatacaaatagcgttagccagccaacatctgattatctgtcagatagacccttgtccaatgatgaaaacaggttggacagaaagctgaacaaagagagtaatgaaaacatggataacagaaagttgcaacatgaggataatttacctgatggtgccagacctcttatttcggaagcgttggatgggcgatcctcaagttcacatgcatatgaaccgtctttttctggtcaaggattcaaatctccagaaacacccgattcgacagtgcctgtcaagcatccttctgcgatggaacctgtgacttcctctcaaagacctggcagctcaacatcgtcaacatcagagcgcattggtgcaaactcagccgcgggtgctcctggcttgtcaccaagctcttcaataggatctcttaccgctgaaaaatcgactttgaaccctaatgctaaggaattcaagctaaatcctaatgccaagagtttcactccgtcagcatctctgaggccaccacaccctacatcatctgatgcatcatattactatcctaataacatgccggcgatgccacttggacccggtttgcctgtgggcatggggttcccaccggcatatggcgcccagcctgtcatgtacaatactcaacctggagcatcaccgcacggttacatgcatcctgctggtccacagtatgggcaacaaatgacgattggggggcagactcgtcctgtttattattatgcgcctgagatgcaacaatacagaggaagaaacttttagatataccattctgaactgctcttagatggaagtcgctgcaatccccacaagtgggattttgaccagcaaaaaccgctattacaatggaaaaaactggtcctgttgtgttgctcggattggttggacaaaaaagcgcaccgactttgtgttgctcggattgcctggtcaaaatgctcttcattgtcctgtatcagtgttgctcggaagcaggttcactggaatttcatattatttttgtcagactattgatgttgtaaattgaattgcgggtcatctgttcgacccggaaatgacattcataaatgtgtgaggttgccccatgtaacatttatgtgttccttaacgttgttctgatgtaagatttggacgaaatggatcaaattgctgacctgaaaaaaaaaaaaaaaaaaggggcggcc

SEQ ID NO: 11594 - DNA, 1527 bp, Zea mays
cggccgggtcccgattcattcggatttccttccgccttccgacagcggctgtctcggcgacccaaccccagcctgaccccacctcccgccgccgccgccgccgccgccgcgccttcgtcgtcaggagaagggtcccggtggctgcgtctctctcccctgcccccctgctccacactcggttcacgcgtcggctcgctaccgcaggccctcgactcgtacgcccgtccccggcggcgatccggccggcaccgtaaccctaggactccgacggagcaggaatgatgagtcatgaacaacaaattgtccctcctagtaagggttctgtgaatgggttcccccatagaaaactggataaggagggcagtggaacgcaaagtagaataaatttggtgaggtcatcctctggtggttttactaattcagaaaatggcatcaaactagggcatggaagccattccagggaccggctaatctatgttctaacacaacttattgggcatcatgtggacgtgcatgtgaataacggctctataatctctggaattttccatgcaacaaaccctgacaaagactttggcgtcgtcttaaaaatggctcaggtcataaaggatggttctgccagaggacaaagatatcctgctgttcttgtaaagaaacctgagactatgataataccggcaagggagcttgtacaagtttttgccaaggacatagaacttggcggcgagctgccaaaagttcctggcaatgacaaaaggaaggacttgctgattgattctgctattacccgctatcattatctcgaagagagggaacttgagcgctgggcaccagatggaggagattcagagtgtattgaactggagaagtatgaccggaagggaaataggagctgggaccagtttgaaaccaatgcagcattatttggggtaaagactactttcaatgaagaaatttataccacaaagcttgagagaggtcctcacatgagagagcttgaaaagcatgcttcgagaatagctagagaaatagagggagaagataccagagatattcaccttgcagaggagagaggcttattcctgggtgatgacctggaccatgatgaagagataaaatattcagcagtgcgtagagacaccgataacagcaagtacaagccaccatttactaaggtcccaagcagtacatgccatgttgattcgtttaacaggacagtcaatattgatccgaatgattcactggcatgttcatcaacaatggacaaagaatcatcatcccacatatttgatgacactgatgcatctgccactatccatacaaatagcgttagccagccaacatctgattatctgtcagatagacccttgtccaatgatgaaaacaggttggacagaaagctgaacaaagagagtaatgaaaacatggataacagaaagttgcaacatgaggataatttacctgatggtgccagacctcttatttcggaagcgttggatgggcgatcctcaagttcacatgcatatg

SEQ ID NO: 11595 - DNA, 1285 bp, Zea mays
ggatgagggaaggaaaccgcccctttctctgggtccaggcccacacggcccaactacttatccccgtcgtcgtcctctattgtacccgagctgctcccctctccgcccgcccgccgcccactgccgcctcgctcgcctagggagacaacttctactagcttcctcccctaccgcctgccgcccaatcagccatggcggatcccactgagagggaccagttcacggacgacgaggaggaagaagactacctggaggacggcgagcaaggccttggaagcgaggacgaggaaggaggaggagcggggggcaagaggaagcggctgggaaataccctgggtgggatcggcaagcgtggggtgtgctacctcagccgcgtcccgccgcacatgaacccgtcgcacatccgccagatgctttccaagtacggcgaggtgctcaggatttacctcgtgcccgaaggtcaaggtcatcacaagcatactagtgttaaagcgaaggcttactcggaagggtggattgaatttgcaaagaagagtgttgccaagagagtggctaatctgcttaatggtgaacaaataggcggtaagaagagatctccattttattatgacatttggaacattaaatacctcaggaagtttaaatgggatgatctggttggtgaaatggctgagaaaactcatatcagagagcagaaattaaccttggagatagcagcagcaaagaaacaacgtgatcactacctgtccaacattgaaaaatcccgcgcgttgaaacacattcaagagcgcaggaaaaagaagcagaagacagaaggagcagaagccagtaatgtcccagaaacaaaaactgcccgttcaattcctcaaaagaaaccagttgtggagacagatgccaaaactaaatccacgctttcaaaagacattttggctggcgttttcgggggttcatcatgaccacctcctatctttcggcatggattggtgcatgccaaactgaatggagtgctgcaaaggatcatcgagttcatattctacttcgaatttttgtagatgaagtcagttttttttttcttgggggtaagtaggaactttcagaaacattttgttctgctgacattgccccggaagattttctgggacctgaccattttgatgtgaaaggactgttgattgccagcgctgtttgaacaggaatctttgtaaaactgaaacacatgttctcttctagttgaacaaatatcacgaggaactgccattggcgttatctcttcaaaaaaaaaaaa

SEQ ID NO: 11596 - DNA, 1464 bp, Zea mays
aaaggtttgatactcctctagctagctagtcctgcatgccgctaatgttcgtcttgcctgtttatttgttcttaataagggctgcctatctattatattttgcacctgttttgctgtgttcttgttcagcgcgcagttaagcatagcaggacgaccacgacgatgtatcacccgcagtgcgagctcctgacgatggcgcacgaaacgccggacctggacgccggccagccgcacctaaccgtctccggcgtcgccagcatcccggcagagctgagcttccacctgctgcactcgctcgacgccgcggcggcggtcaatcccgtcacggcgccgccgcagtccaccatcgactacttcctcggcggcgccgatccccaccagcaggccatgcagtacgagccgctgccgcccgccgcgggcggccaccaccagtacaccatggacaatgtccggagctactgcgacggccactaccccaccgccgagccgtacatccgcgggacaatgactggagccctcgtgttcggggccaccgacgacgacgactcggccgctgcctacatgcccggggggcactttgagacctccccgccgccgccacgcgccaccggccgcggcaggaagcgaggcagggcgctgggcggcggcttccatgctgtgctggccaacggcgtcgagaagaaggagaagcagcgccggctgcggctcaccgagaagtacaccgccctcatgcacctcatacccaacgttacaaagactgatagggcgacggtgatctcggacgcgatcgagtacatccaggagctggggaggacggtggaggagctgacgctgctggtggagaagaagcggcgccggagggagctgcagggggacgtcgtggacgcggcgccggctgcggtggttgctgccgccggtgaggcggagagctcggagggcgaggtggctcctccgccgccggccgtgccgcggcagccgatccggagcacgtacatccagcggcggagcaaggacacgtccgtggacgtgcggatcgtggaggaggacgtgaacatcaagctcaccaagcgccggcgcgacgggtgcctcgcagccgcgtcgcgcgcgctggatgacctccgccttgacctcgtccacctctccggcggcaagatcggtgactgtcaaatctacatgttcaacaccaagattcacaaggggtcttcagtgtttgcgagtgcagtggccggtaggctgatggaagtggtggacgagtactaggctaccatgcacttgaatttctagctagctctacgtaccgcgctgctatgaatctagctatagcgtttcttggatgaaagaatagttagttgttaccttctatctttgcttcaattaaatccgcttgctcgttacagactgagtttgtttctaaatgtcaaggttgttttggtcaaattgaataaattggcacactggcctgtg

SEQ ID NO: 11597 - DNA, 472 bp, Zea mays
  misc_feature (371)..(371): n is a, c, g, or t
agtttaataaccttgcactgccgcagtagcccttaactgctgctatatatctatctcttttctgaaggaaaaaaaagttcagcgcgcagttaagcatagcaggacgaccacgacgatgtatcacccgcagtgcgagctcctgacgatggcgcacgaaacgccggacctggacgccggccagccgcacctaaccgtctccggcgtcgccagcatcccggcagagctgagcttccacctgctgcactcgctcgacgccgcggcggtttcaatcccgtcacggcgccgcccagttccaccatcgactacttcctcggcggcgcattccccaccagcaggccatgcagtacgagccgctgccgcccgccgcgggncaaccaccagttacaccatggacatgttccgcgactactgcgacggccactaccccaccgccgagccggtacatccgcgggacaatgactggagccctcgt

SEQ ID NO: 11598 - DNA, 585 bp, Zea mays
  misc_feature (568)..(578): n is a, c, g, or t
cgtggaagccctcatggccacctgaggccgggcaaccttccccagtttggaagggacacaagcggatccgagcaaccacgccctccgccgccactatcgtccacaccgctgccatccgctctgctgccgctccatcgtcgtccttccccgacgcagtcgcgagcgggacgtgaggcggcagtgccctccaccaccgccaccgtctcggatttgtcgccctccgccgccatctctgccctcggttcactgtcctccaccgtcgtcttccgcgacacgatgtacaatacaatgttgtctccaagacacagtacatggtcttctccaagatccagtacaaggtcgtctcctccaagatccaaaccccaacgctagtgagcagccgaagacttcttttccgctatgcttgattgagagggctgtgtctacacccagttctgcctgtggcttgggctagtattttcttcttactgcgcttcttaaaatttggctctctcgagcttgtacccccggtattgtaataacctttatttaaactctgtactatttgaagttaaggaataaaaaaaannnnnnnnnnnaaaaaaa

SEQ ID NO: 11599 - DNA, 1398 bp, Zea mays
gcgggcccgcgccacagcgccgtcccccgccgtcgccccgcgcgcgctcgcgccaactgggccgaaatcccccccccccccccggcccggctagctggaaaatcctttctctttttcctttcccatttctttttcccattttcacatatatatttagatgctaatattttatgcaccaaaaatagtctaaataaattatagggcacaaaaataataaagtataagaacgtttgcacaccccacaaaggtcactatgtttgatgtattgtttttatctgtgtttaattagcggaagagggatccgatcctccggaactcttagctccggaagaagggcaggaacccgacccctccgagattaaccttttgtgccaggaaagcttcgacgaaggcaagtccatccttcccttgatgcattatttacctatttctctctaccactgcctaagcctggattatgggatgggaatcgaattgcatggtaagcatgagagagcccgcattaactattacttcgattaaaagatatgggacaagtaaaaaggggtacaagtgaaatgttttccaaaaagagtgcgatgaagggtactcaccctcatcacctggtgaagtaggatgatcagggactccctggtttaggggagggcctaaggtgttggctcagctggtttaggcgtgagcagaaggatcgtcctctcatataaggaccggtttgtcatctttcattacctgtactctcaaaaagtacaaccactcgaggctgtgtgggcagccactcaatctgaactcgtacggtcccaccccagggttatgaaggctggggtagcaccgggaggataaggaaggggaatgttttgtccggtttggacatggtggtggcctgactccttccggtataaccgttaaggttcggacgtacaaggaaggaaagagtttcggattcgggtctcattggccatgagatcgcagagccggactagtgggtaaagtgtacccctctgcgcagagtctaaacctattcgaatagtccgtgtccactggtatggacgagtctggtatggtatgacaattagtgtttctactacaactgggaacagggaaatgtgtgtgtatgttctggaaagaaagtagtaccacgggagcgggaagctcagtggtggtcaagcaagtgttacttctattgtcttgggaaaaccctaaccattgagtactgcctttctctgaaaaagtatgagtgacttcaactccaccatataaagcatgtacaatataggtcactttctctttacgggagccgggtgggcttgcggaatacctagtgtattcacccagatttatttatgtttttcagcagctgatgtcggcggccctccgctgccggagggccgcggctacagg

SEQ ID NO: 11600 - DNA, 1157 bp, Zea mays
cctaccatttcgatcatatatgaggcatgcagtatttcatatcataagttgcaagatttcatgtttttgccaattaacaacaaatttgtgcgtaaaatttaaaggctgcgttttccagtaataactaataagaactaattaagaagctcaagttattaaaaaaattcctgctaattagtagtcacaaattggcagccttgaacgcgggatgcaagagccggccgagctcctcgtcagcggcgtccagcggcccgccagtgtcgtttcggacccgccgcacggcggtggtgttgagcgaattgtgctcgaacccgtaagggcttgtttgtaaggccatttcctcgcgggaaaatcatactttttcccgggtccaaagctcacgtggagatctaccccgggcatactttttggcccatttggaagacaaacaccctggtccagctctccccccccccgggccggcccccgtggaagcgctcccggccacccgaggtcgggcaagcttccctagtttggaagggacacgagcggatccgagcgaagcgaccgcgcgtccgcgccctccgtcgccaccaccatccgctccgccgccgctccatcgtcgtccacattgctgccatccgctctgccgctactccatcgtcgtccttccccgaagcagtcgtgagcgagacgtgaggcgacggtgccctccaccaccgccaccgtctcggatttgtcgtcattcaccgccatctctgcctcagtttgctgtcctccaccaccgtcttccgcggcactatgtacaatacaatgttgtctccaagacccagtacatggtcttctccaagatccagtacaagatcgtctcctccaagatttgaaccccaacgctagtgagagtggaggcaacacatgaaaccaacatggagaagaaaaatgaaatggcattccacatgaagcttgtgaaaaagagttaaactcgtaatttattctagtgcagaagttcctaaccaagagatttgtattccattttttatattatattgtctatctatatgtgtgaataaaggtgaccttatatgatgtgatgatgtatgaattagcttcaatggatattatatggtattcaaattaaactttacataattaaaaaaaaaaaaaaaaaaaaaaaaaaa

SEQ ID NO: 11601 - DNA, 2724 bp, Zea mays
cgtcaaatcccccccatcatcagtcagatgaacttttgatcgaattgaagttgttcttctaattcggccccagcagcgcccatgcatctggttttatttgctttctgttgggtataatatgcaagaccttttgttgctagggcaaggctgcaaccacatgcgtgtactgaactcatgatgtaactcatcctttttgtttgctcacagaatcactactctactgcacttccttttcatccgatccgcaatcttttttttcttttacatgctttagttttctctctttcttgattacaaacatgattactggaactttcttaggctgccttccccttccttggatctgctttagttttcttttttgggctaccgcgcgcggcttatttgagtttatcacttgctgcatatacataatatatatatacatgcatgcgatggcccgcagtaagtagcccttaactgctgctatctatctcttttctgaaggaaaaaaaagttcagcgcgcagttaagcatagcaggacgaccacgacgatgtatcacccgcagtgcgagctcctgacgatggcgcacgaaacgccggacctggacgccggccagccgcacctaaccgtctccggcgtcgccagcatcccggcagagctgagcttccacctgctgcactcgctcgacgccgcggcggcggtcaatcccgtcacggcgccgccgcagtccaccatcgactacttcctcggcggcgccgatccccaccagcaggccatgcagtacgagccgctgccgcccgccgcgggcggccaccaccagtacaccatggacatgttccgcgactactgcgacggccactaccccaccgccgagccgtacatccgcgggacaatgactggagccctcgtgttcggggccaccgacgacgacgactcggccgctgcctacatgcccggggggcactttgagacctccccgccgccgccacgcgccaccggccgcggcaggaagcggggcagggcgctgggcggcggcttccatgctgtgctggccaacggcgtcgagaagaaggagaagcagcgccggctgcggctcaccgagaagtacaccgccctcatgcacctcatacccaacgttacaaaggtcgtaccaaatcctcctcttatgttcgtccatcgtttcaaattaagttaaaaaattaattcacggttcttgttgtttattttttgcgcactgcagactgatagggcgacggtgatctcggacgcgatcgagtacatccaggagctggggaggacggtggaggagctgacgctgctggtggagaagaagcggcgccggagggagctgcagggggacgtcgtggacgcggcgccggctgcggtggttgctgccgccggtgaggcggagagctcggagggcgaggtggctcctccgccgccggccgtgccgcggcagccgatccggagcacgtacatccagcggcggagcaaggacacgtccgtggacgtgcggatcgtggaggaggacgtgaacatcaagctcaccaagcgccggcgcgacgggtgcctcgcagccgcgtcgcgcgcgctggatgacctccgccttgacctcgtccacctctccggcggcaagatcggtgactgtcaaatctacatgttcaacaccaaggtacatacgaatacgatacgtagccattgatcgatctgtaattctgtagcctgacgattccgaggtttctggtgctaaaaaatgcatctttttttctcagatgacaatgctttctgtctttgttcaccgcagattcacaaggggtcttcagtgtttgcgagtgcagtggccggtaggctgatggaagtggtggacgagtactaggctaccatgcacttgaatttctagctagctctacgtaccgcgctgctatgaatctagctatagcgtttcttggatgaaagactagttagttgttaccttctatctttgcttcaattaaatccgcttgctcgttacagactgagtttgtttctaaatgtcaaggttgttttggtcaaattgaataaattggcacactggcctgtgaggttattatatatatttatgtgtttattactggtctattaatttgtcttattattaatgtattgcctgtcaaggaataaatggtatgatgaccatatttatgcatagataggatcggatgagtaggttcacttgcttgagttcaccggtataattccggatacatctggttaggtcatcctttggtcagctgcccgcaagcttaactccgtgcgatatacaatatacagattttattatggttttcccctgaaccttcgtgactaactatgttatcatttttatagctttatagtctacaaactgttttatactcagcttgataagtacattctggtttggacgatggtttttttttcttgcaaaatgaatttgtcttcagcctttacgactacatacagtttagtttgtattaattgataccggaagatcagattcggaccacatataaacaaggaatatatagcacgtactcgctgaaccttaaatatagtcaggaaaatagagggttaactaaaccgatccagaaaccaattacattgatattgactctattcttcgtttagagactactagcactactacaaacatataatcttctttgacattttgattatgtcacagatagaaggttttctttttgtcatagttttgttgtta

SEQ ID NO: 11602 - DNA, 1700 bp, Zea mays
attcagaagcagtgaagtgagagaggtaaaacaagctgagactctaacttcaaaggaagatacacacacaaaggacagtgagaaggaggccaagaagcttgctcgcaaggcgctagggaggaagaagacaaccacgcactattgctgttgcttgtgcttagtgtgtgctcgcggctagaagcagacaagcagctgcgggagcataagggcggcatggcttcttgcggtagcttctactttgttcccatgctcctgctgatgctcctgctcgcttctcccgccactgctgcactggtgacatcctcccagcctggcggcaatgccactgctgcaaggccgaggccggggatggagcagctcaagcgcaagaggatcagggctctgctcaccaagcttaacaagcctgctctcaagactatccagagctcggatggcgacatcatagactgtgttccctctcacctccagcccgcatttgaccacccaaagctcaggggcgaaaagattctggatccgccggagaggcccaagaaccgcaacttcacctttggcggcagcggcagaagcagggtcggcgaggtggtggtgcaggcgtggcacgccaccggcgaggcgtgtccagaggggaccgtgccgatacggcggacgacggagaaggatctgctcagggctagctccctcaggaggtacggcaggaagccagcgcgccggggtgttcgccgtgattccacaagcagcggccatgagcatgcagttgggtatgtaaactcagaacagtactatggggccaaggccagtgttaatgtgtggtcgccaaggataggtgacccatctgagttcagcctgtctcagatctgggtcctctctggctccttcggcaatgatctcaacaccatcgaagctggatggcaggtaagcccagagctatacggagacagtaacccaagattcttcacctactggacaactgacgcgtaccaagaaaccgggtgctacaaccacaattgccgcggattcgtgcagacgacgaacaagattgcaattggggcggctatcaccccggagtcggtgtacaatggcaggcagttcgacatcactctcatgctatggaaggacccaaagcaggggcactggtggctggagctgggcccgggcctcgtagtcgggtactggccgtcgcacctcttcagccacctggctcgccacgccaacatggtgcagttcggcggcgaggtcgtcaacacccggccgtcggggtcgcataccgcgacgcagatgggcagcggccacttccccagagagggcttcgaccgcgccgcctacttccggaacctgcaggtggtggactgggacaacaacctcatcccggcggccaacctgaaactcctcgccgaccatcctggatgctacgatatccagggaggcactaacagctactggggaagctacttctactacggaggacccgggaggaacgccaaatgtccctgagatcaattcggaccggatgtctctttcttgttcgatgttcttttttcgttgccctttctaggatttggtaggtcttatacgtctttaacgaaagaatgcatccacggttgagacttgggaggaatttgtaaatttggcaagtacctgttatatttaatatccctatggctcatattttattttatttatttaaaaaaactctaggtaca

SEQ ID NO: 11603 - DNA, 1502 bp, Zea mays
cccacgcgtccggttctagatcgcgtcctctcttcgtcctcactcctcgacgtttcgtcggggtctctcgccgtcgctctctctgctctccaccatcctcctccccctcccctcgacctctcatcctcctcctgcttccccgcccggtcaacccataatccaaggcatccctgtgctgatggatcgattggaaatgcaggacgactcgaagagatccaataggcccaaatattctaagtttacgcagcaagagcttccagcatgcaagccactgctaactccagcaattgtcatttccgccttcttactggttggcatcctattcgtcccaattggtctcgcatcgctttctgcgtcacaagagattgtggagctggtagatagatacgatacaagttgtgtgcccgtggctgacaaagttgggttcattcagaacactaaaacggacaaatcatgcacaagaactctaactatccctaagcatatgaagagcccaattcaaatatattaccagatcggtgacttctatcaaaaccatcgacggtatgtgaaaagtcgcagtgataaacaattgcgatataaagatgctgcacacttgacaaaagattgtgagcctgaagtttatagtgctggcggtgccccaatcgttccatgtggcctcgttgcttggagtttgttcaatgatacatatacaatttcggtcaacaagaaagctattgtagtgaataaaaaggatatagcctggcagagtgacaagaagaaaaaatttggcagtgatgtttatcccagtaactttcagaacggaaatcttataggtggcgctaagctaaatgagagcataccgctaagtgagcaagaagatctcattgtttggatgagaactgctgccctcccaactttcagaaagctttatggaagaattgagacagatattatggaaaatgatgaactcacagtggttatacagaacaactataacacatacagttttggagggtcaaaagcactggtcctctcaactacatcttggattggaggcaaaaataatttcattggtttcgcatatctgattgttggtggtttttgccttttccttgcactggtttttgtagttctctacatgattaagccaaggactcttggagacacctctttcttgtcatggaataggggtaccatggactatccaagctaatacatcgaaacattctctttataaaaatagtggaaggacccattgccaattggactgcactgcagagtctcatgcattgctcacctcaaagaatgacactgcaaacaaaggtggaaacgatgttactcctatctgttacggatgcactacctgtgtctgataaaggaaagtacaattctagcatatgatacctcaaacttgattaattatagataaaagaagttcagcttgtgtttcagaaacgtcatgctgagtacaattctagcatatgataacttactgcagcttggcaaaaaaaaaaaaaaaa

SEQ ID NO: 11604 - DNA, 2057 bp, Zea mays
  misc_feature (152)..(152): n is a, c, g, or t
  misc_feature (176)..(176): n is a, c, g, or t
gcgggggggggtttttttgcacataacattgaagggggggggggatgaagtatctaaaatcagcccttgggttgagctttacaatacgagcaatcctgaagataaagcacagaagtgactctcagaaagaaaaaaaaattgtaactcacatntacaggaggggagggggtgggctnccatcaaattcagcccccgcttgtgccttgctctttgggaaagttctgtgtggttttgttgttactggaactggagaaattgaacaatcaacaaataatgtaagctattgtatctgttagtacatactcgattcctgagacaaacactctttacaaggcatatactggattaagttcagtatctgagagctcggtattgtcataccaagaacttgagccacttcttcttgacatcttctccttttttctaatcttcctttggcgctttgatttcaccacatagtatgtcatagtaccaagtacaccggccattgtgacaccacctatcaaagataccaatattgctgcccactggaaatggcggcctagcacaatatagcacgaggcaatgaaagatattgtagtacaaaccgatgctatccacataagcttgttgatcacctcaacaacccttcgctcagacttggtttctcccctgacaactgttatttgaactacgaccactgccaatgatgtaaatagagccacagcattgaagatgaagaatatcttaaaggacgtagtctggacaacaactgcaagtccattattgtcatttccaccaggtacggtgaatatagctgcaaaagcaactgttgcgaacagcacagcaacaacagttacagagtttgtagcgttgttgatgccttctctgtgcaacttcctgagttctttagcaatgccatgaacatttttgttggtttttcttgtttgttccagctgtgtgtggacatctttctttatctctgtcactgtcttccgtagctcatctcgtggctgattgagctccctggatctgagcgcaccatgttgagataaaatatccttaatttcgcaagactcctcacatactggtaacccttcagctatatcaaaggcagtcttgtggtctctggttagtgcattgacatgagtatctggtagccgcaaaagaacactaactatctctgctctcttttttcttgttgcaacatgcaaagccgtgttgccatttttatctggcagcattacaattgctggatcagcatccactagggctctaagaacatcacagcttgttccctttacggccatatgaagagctgtttgacctttcttgtcatttcttcttgctaactgaggatccttctcaagtagcgctttgacgattccagtatgtccctgtcgagcagcaaaatgtaaggcattctttccattatctcgggccgcttccaccaatccaaagtcatcttgttccagcaaaagttcaacaacttcaatatggcctctcatagctgctgatataagtggagtagtatttgcagggccaaatgttttggcaagcatcctatcatgatgtaacatttcctgcacaacagcatgacgcccttctctggcggcgacgtgcagcgcgtcgtagcccgacctgttcttggcggccagtccctccgcgtcgaggtgccggagcagctccacaaccaccccgaggtggcccctctccgccgcggcgacgagcggggtctccccggcctcgttgggctccgcggccaccgcacgccgcgccgcctcgaggtcctctggcgcctcccccgtggcggccacggccgcagcggcgtccaacagcgcgcgccgcagcgccgcggcgtccccgccccgcgcggccacgtggaggtcggtgtcgttgtgccgccccgtcacctgccgcacgtaccgcccccgcttcccgctcccggaaacagacatcaccttcgtcgccggacgtgcaccagacgccccaccatcctcctcgtggatctcgagcgacattgcgagaggcgcagttggggccccgtggcgtaagaaggtttcccggccggctcgagg

SEQ ID NO: 11605 - DNA, 1605 bp, Zea mays
gttgctcctcaagttcacgctgcggctatataaagccacgcctccattaccctgcttggccaaagcaacaacagaagcaaacataattaagcagttggtggtcattagcgtactgcacagagtgcctacagaaaagctagagaagtaaacaaaatggctgcgtcctcgtacttccttcttgctgcttttctagcggtggttgcttcccatgccaccgcttccgatcctagcccgctccaggatttctgtgttgcggacatgcactctcctgtgaaggtgaatggatttgtttgcaaggactccatggccgtgaccgcagatgacttcttcaaagcagccaatcttgataaggctagagacaccatgaagagcaaggtgggatccaatgtcactttgatcaacgtcatccagctccctggcctcaacactcttggcatctccctggcacgtatcgactacgcgccattgggcgagaacccgccgcacacccacccacgtgccacggagatcctcacggttcttgaggggacactctacgtcgggtttgtcacctccaacccaaacaagctatttgccaaggtgctcaacaagggtgatgtgttcgtattcccccaaggtctcatccatttccaattcaacccggtctataacaagccggccgttgctatcgcggcgctcagcagccagaaccctggggttattaccatcgccaatgcggtcttcggatcaaagccaccgatttcggatgatgtcttggcaaaggctttccaggtggagaaggggacaattgattggctccaggctcaattctgggagaacaaccactactaaataaatcacatatagcttatcgtatcaaagaatgcttttaaatatgcactttgagtaatacaactacatgatttgagttttcatggtaaaataggccctaaaataagaaggtagaatttcgagtgttttgggtgctattttgtatcgcatgcttcttggtgcaatgacctctatggaagttcgaaataataatctttgttcttgtcgttgggttagatttcactaaaaaaacccaacaaccaacgtgtgggtccatgtatgagttttttgtggcttaagtactcagaacatgacgggtttatatcctaattcgagcacttaagctctatgtatagtggtgatgttctccatattagaatgcttattggagttcttacatatagagagaggtggtaggagagcactaagttactggtatatgtctttgattggataagatgggtctgatcacttggtttgtggttcgactatttgatttgtagactgttaggatgtctctttagagttggttgtcccagccatatgtccccttccatctctataaatcagttattggtagacgtggctaggaatgcgagctacctctacaaatgaacttctagaggaaggtgggatctctagccacctctctaaataagtttaaaagatgcatctgaaaagaacaatcgtctttataagtctatttgtagagatagttgtcccatccacacgcttctatttttgtgtcacacctggatttaagagacaaaccccaggtgtgtctcaatatatgcg

SEQ ID NO: 11606 - DNA, 1552 bp, Zea mays
ctgcagtcgatgtgaggatgtccagtgtcgttctatgaactggatcggttgattcaggcattcagccaggtgccggctttggtaaaaaatggaatgtttgagagggcggcagtgcaaaagacattcattctctcgagccctctgcccccgtcttctcccgggtcagccaggcaggtcctcaaaagggcagcctccgcggcggctgctgcctggtgcctgctgccactgcggcctctgacccactgccgcaaatcccaacaaagcaagggcagaaaggaagcgggcaaaagcagccccgccttcccttctactactacacaaccacaacccgccggtcctcccctctgccccgctctgtcatctttgactgcccctgtccggttcctcccctccatcccactccacgccacgccacccccaccggccaagcaaacacgctgcacatttcagttcagacggtccaagaacagcaccaagaaagactccttgccgctcttcttgcttggctactgactaggagagctccctgccgctggttgatcaacagaggcaggcggacggcatggtcagctctatgccgctgtcctcgctgctgctgctgctctccgcagccagcttcggcggcggcgtaaggctcggcgatggtggctacgaggactggaggctcggcaccgccacctacgtcaaggagttccagtcacaccctctcaatgatggcggtggcgcctgcgggtacggcgacctggacatcttcaggtacgggcgctacacgacggggctgagcgcggcgctgttcgggcgcggcggcgcctgcggcggctgctacgagctgcggtgcgtcaaccacatccagtggtgcctccggggcagccccacggtggtggtgacggcgacggacttctgcccggccaacatgggcctcgccgacgacgacgccggcggctggtgcaacttcccgcgggagcacctcgagctgtcggaggccgcgttcctccgcgtcgccaaggccaaggccggcatcgtgccggtgcagttccggagggtgagctgcgacagggcgggcggcatgcggttcaccatcaccggtagcgcccacttcctgcaggtgctcatcaccaacgtggcggcggacggcgaggtggcggccgtgaaggtgaaggggtcgaggacggggtggatcccgatggggcggaactggggccagaactggcagtgcgacgccgacctccgcgcccagccgctgtcgttcgaggtcaccggcgggaggggcaggacggtcaccgcctacagcgtggcgccggcggactggatgttcgcgcagacgttcgagggcaagcagttcgccgagtagagatcgacgccgaaaaccaactctccggcggtggtgatgtaagtagaattatacggatgtcttcttgctcgcgagtcgtgaccggcgactcgagaaaacgagacgtattgaatggcgaaaggatttccagtcacaagaaagtggcagtacaaaaaaaaaaaaaaaaaactcgtgaggatggatcgtcggtaacggtacaag

SEQ ID NO: 11607 - DNA, 751 bp, Zea mays
aatttttcttttctgtcggaatgggatatgagtgggctgggccgaatgccggccgggtcgtctggtgctacactgctactctttccacgaccccatggcaaaatagcaaatttctctcgattgtgatatcagcccacatagatataaccgtttggggaaaagaatcgtgggctgtgacctgtcgtcttcgtctccggcagagcaaagcggcggcgaggcgggagatatagaggagagacgagagcgggatggggtacctgtggagggtgcggctgtcttcatttgctgccggcgcggcgacggcttcggcggcggggttcttcctcctctacaaggaccacctgctcgcccgcgctgccatcatcagccaggtggaggacatcaaggaaacttctgaaaagcattatgcagccctaaataagaggatatcagcactggaaagcagaagagaaccaggaactatcaaagaggcatcagattaattctgagttgggcttatgtcatggttacatctgcccatgtgtttttgattgctgcaggcggtataaactgcagcattttaagctgtactattgtgttgttgaaattctatgaactctgaatttgaattgtgttacacttcttgtctatgtcgtctttatgagatggacaagatcaaataaaatacattttttcttgatagaataagaaaaaaaaagggagcgatatgggtcgttggcgcagtatggggtgccaccactgagggtccttc

SEQ ID NO: 11608 - DNA, 3777 bp, Zea mays
ccctcgccctatagccacagcggcacacataacaagatgttacggtttcctacctaatgtttttgtcgtgcatcatgtctcccacctgctcccgagtgtatgggtccacttgtaaggacccaaaatgatatcgacgaggctccacgtaaagatgtcaattagggtccatatgaagtgctttatttgaaggtgtcgacaaggttttgtgtgaaggtcttggtatgaagatgtcgatatgatgaggcttgatgtgaagatattgatcaatatggccttgtgaacgaatgataaaatgcatatagtgtgttagctttagaattttaaaggccatgttttgttttgttttttaacgaagcctccgacatgtaccatgttagcacaacaaagcttttttttatttgcacggggttttcgacctgtcggtctgttttcacttttgcttgttgttcatcgatgttgcatatattttattacaccaagatttggttacaagaatttgttgtttggttctgaggcatgaatcgtagtcctggctgcatgcctggcccacaccatcctctattaaaccgattttaatatcaaaatgttatagacattaaatataataataccatactgtatgatggaaagagactcgatcgtaaaagtatggagttttataagaataaaagtttcttttttaaaaacaatatgagtgtgttttggcattaacacactgacgagacgacggccttttatatactcggtacctcggggccggccggcacttcatcccaaaccagttcagcttccaaaaaggcaaagcagagcccgcacgcggagaggctacagaagggtatgggtcacctccgcggcctcaccgccgcgcggctcctcgcggcggccttcctgctctccgttgccgtcccggccgccagagcccaggaagaaaccgagcacgaggaggagttcagctacgtcgtcggcgacgagaacgggccggagcactggggcagcatcaaggcggagtggggcaactgcagcgccgggcggatgcagtcccccatcgacctctcccacgagcgcgtctcgctggtgcggtccctcggctacctcacccactcctaccgccccgccgaggccgccatcgccaaccgcggccacgacatcatggtacgtgacgcgacggcaagggggggaggggggttcgctagctggtggtgcatcatggtgggaagcattggtgcgtggcgtggctagtgccagctgactgtttggttgcaggtgaggttcaagggcgacgccggcttcctggtgatcaacggcacggcgtactacctgaagcagatgcactggcactcgcccaccgagcacaccgtcgacggccgcaggtgagaacgaatgaatggtggtctgctggtctcgtcgtcgtcgttgagagccaataatataataaagactcgacgtgcgtacgtgtggaccgcgtaattcctcattactgcttgctttttatagatcgtcgatcgaattatgtagcatgttggtaatagataggagtggtaagtaacgactggtccgatcgagatgctcgctcgctcgcaggtacgacatggagctgcacctggtgcacgagagctcggcgaacaaggcggcggtgatcggcatgctctacgagatcggcgccgaggacccgttcctgcaagcgctggagccgtccatccaccggatcgccgacaggcaggaccgggaggaggccatcggcgtggtggacccccggcgcgcgcgcggcagggccagcgtctactaccgctacgtgggctccctcaccacgccgccctgcaccgagggggtcatctggaccgtcgtcaagagggttagtggccgtggccccgctgcgcaattttcttccccgaattccaaccaaacggcatcattcgatcgatcgtgagtcgtgactatagcgctgacgtccgaacaaccgtgttttaaaacgagccaacatgtctggtagattttgtagcatttttttttttggctgaggttgctgagtgtactttaatttcgcgcatgcaggtccgcaccgtgtccaggcaccagctggagctgctcagggaagccgtgcacgacgtaagttcatgacgtcgcttgcttcttagtcccaaatgtgtttgaccagcattctggatggaatggaaggcgccaggaaagctggttttagtttgtttgttttttctcagcctgatttttatttattttttgtctcgcgtgtgtttacctgcttcagggcatggagaagaacgcgaggccggttcaggacgtcaacgacagggacatcagcatcttccgcccaaagccacacaagcactactagtactagctatgctataggttgcacagtccagcggcgcgcgtagttggttggtatcgatcagtagtgatgcacgagctagctgacgcggttcagtgttggggagaggtgtctgctgtatatggttacggttttgttttataattctttccatctatgttataggacgaaataaacagacgaggatcaccttcaggtccactcttcagaagaagaacaaaaaaaaaaggaaaagagaacatgtcgatgcgcatgtggctcgatcgatttgattattgttgttgagtagttggcactcaaacatgacctatctaactggcacggtcttttgttaaaaaaaatactatgatttgattgtcgtttagcaggacgagtcacatgtgtacagtataagcctatatatattcttcagccagctagatttgtgtcaagaaatgtttcacaagtagtatgtcagtcaaatcaaagaatgatactaaccataaattaagcccaaaagtttcaattatcgattcctcttctgtccgccgcagccctttaaccagcagctagctgtaggcttgctgtagcaaagccaaggacagcaagatgcacgaaacaaggacaggaacaggacagacaccgcgcaacgaaacctgacgaccacgcgggcccgcgccatgcgcagctcagctgtgcttttcggaccatgtccattgtccagtgcgccggcccattctcgttcatgcatgtctggtgatccgtgtatgaacggtgaagacaacggcaagtgtgacgagttaccgttggccagagagacgacaaaaatgcgtgattccgcggttggtggaacgacgaacaagtgttttgatgaatctgaaagagaaaaactgcagtggtggaacactcggtccactcctggaccgatgccaactctctaagatcacataccatgtgtttggttgctgtagaagtcgaacaggccagcataagtctagccagtattggtagaaccagagtgagttcatacaagcgcttctgtttggttgtttgtatagactcgtgcagattaaaggcagactttgtttggttatttgcactaaaacatgtattagagaatggtgcataaataaattttcaaatacgatatagtattagtggtctaattttgttcacaaaagtcttagaaacacaaatataaaatctgctcggtgattaaatattttaattagaagatttactagaaaaacaatctaaaaaacattctaggtatgcgtgtccctgcataagcagggcctgcatgcaggttgcacgccggcgtacgcagcaattggccatctccgtggagcctggctcaaccgcattttttgcatagagagcgcctgtatcgactcgtcaggctaccaaacataccgcgctttaaaaccccacggatgcagggggatgcttta

SEQ ID NO: 11609 - DNA, 1176 bp, Zea mays
cattgggtacctcgaggccggccgggaattcatcccaaaccagttcagcttccaaaaaggcaaagcagagcccgcacgcggagaggctacagaagggtatgggtcacctccgcggcctcaccgccgcgcggctcctcgcggcggccttcctgctctccgttgccgtcccggccgccagagcccaggaagaaaccgagcacgaggaggagttcagctacgtcgtcggcgacgagaacgggccggagcactggggcagcatcaaggcggagtggggcaactgcagcgccgggcggatgcagtcccccatcgacctctcccacgagcgcgtctcgctggtgcggtccctcggctacctcacccactcctaccgccccgccgaggccgccatcgccaaccgcggccacgacatcatggtgaggttcaagggcgacgccggcttcctggtgatcaacggcacggcgtactacctgaagcagatgcactggcactcgcccaccgagcacaccgtcgacggccgcaggtacgacatggagctgcacctggtgcacgagagctcggcgaacaaggcggcggtgatcggcatgctctacgagatcggcgccgaggacccgttcctgcaagcgctggagccgtccatccaccggatcgccgacaggcaggaccgggaggaggccatcggcgtggtggacccccggcgcgcgcgcggcagggccagcgtctactaccgctacgtgggctccctcaccacgccgccctgcaccgagggggtcatctggaccgtcgtcaagagggtccgcaccgtgtccaggcaccagctggagctgctcagggaagccgtgcacgacggcatggagaagaacgcgaggccggttcaggacgtcaacgacagggacatcagcatcttccgcccaaagccacacaagcactactagtactagctatggtataggttgcacagtccagcagcgcgcgtagttggtatcgatcagtagtgatgcacgagctagctgacgcggttcagtgttggggagaggtgtctgctgtatatggttacggttttgttttataattctttccatctatgttataggacgaaataaacagacgaggatcaccttcaggtccactcttcagaagaagaacaaaaaaaaaggaaaagagaacatgtcgattcgc

SEQ ID NO: 11610 - DNA, 769 bp, Zea mays
gcaaggaggaggaggcaagggaagccgccgccgccgccgccgccgccgcccccgccccgtccctcctcgccggcccgccgccacaggtttcaagatgtcaacctgcacgtttgcgacctcctgcgtgctcttgggcaatgctcggacaaccgatgtcccccagaaagcgctcaagagccgtgtgagcttccttggccgaggcgcgctgcagctgccgagcctgaggtcctcctcaaagaagaagctggatgtctcagcggcggccacgtacaaggtgaagctggtgaccccggaaggggaggagcacgagtttgaggcgccggacgacgcctacatcctggactcggcggagacggcgggggtggagctgccctactcgtgccgggcgggggcatgctcgacctgcgcgggcaagatcgaggcgggcgcggtggaccagtcggacgggtcgttcctggacgacgcgcagcaggaggagggctacgtgctgacgtgcgtcgcctaccccaagtcggactgcgtcatccacacccacaaggagggcgacctgtattaggggtctcacctctggctcccccggttgtgttgagtagaaccttgatgctctgtaaaaccaatcttgatggttgtttatcccctgcctgcccgcctgtgtgctttggtcgttagtcggattgttgggtgaacccccccatggagatggagatggagatggagatggaggagaatgagaaataagggactaaaatgcagtttcatggtttttgcg

SEQ ID NO: 11611 - DNA, 2145 bp, Zea mays
gggtacctcgaggccggccgggacttttccctcccctacctttcttccttcttccccaagaccgcgagtaaaaatttcgcttaaatttcgattccacgaagcagcaatcgcaagttcgaagctctaaaataatctcttcccgacgtctctggaaggtcagcatctgaacccaggtagcctccagcgctggagacgtgccgtactcaaaccctagccaccaatggcagccggcggcggggctccgtgggcggagcgcgcgcgggtggtggggacgcagatccgcaacaggttccgcgtggcgcccgtggaccaccggtcgctgtggctgcgggcggacggtcgtgtcgccactgaggcggtccggcggtggtcggatcgcgttcgggccctgctgcagaggggccggagcgcggatcggaactccacatcgacggagacatcacctgaggcggtggcaaagccttcgtccagcgttttgagattctacagaaagagagtgggcaaagaagttaatgggattgaagactctgttattttccgttcgcttcaagcattggctgttcctcttattggcaatgcatgctatgtttttatgcatggtcttaactcagttcaggtttatggtgtagagaagcttcatcaggcattacatgggagacctaaaggcaaggctcttctaacggtcagcaatcatgtggcagcgatggatgaccctttcgtaattgcctcccttctcccaccatctgttatgctggaagcacaaaagctgagatggacactgtgtgccactgatcggtgctttacaaatccagttttgtctacattcttcaggtctgttaaggtgttacctgtttctcgtggtgatggcatctaccaaaaggtatccatcttatgaaaacatcagtatggcctaaattttttaatgttgatgaaccgatttatccacgcgattcatattgtgaaagcatcatgaataatgggggcaatacataaggaaattgaacaccaggcttcacaatattttgaatagggaagttgcaaccggaggtgtgctattctttaagcaattagcagatgtggatttgtgatttattcttatagaattgcttggtttaactttaacgtaagaaattagatgacaaacataacaaagtctctggtagttaaagcactatagtgagtcctaaggtatttatatattggtattccttgctgcatgggtttacagacttccttttgccctcttctcagatatacaatgttaatgccttcatgccttgaatatcataagtcatcctttccaatctaaatcgtgaatatgatcgattacatttggactattgaatgaaatgcatcaccagatccactcttcacttgtacccttttttgttttctttgttcagggaatggacatggcactttcaaagcttaacagtggtggatgggttcatatattccctgaaggaagccgttcaagggatggagggaaaaccattgctcctgccaagagaggtgttggaagattggtaatggatgctgacagccttccagttgtaataccctttgtccatactgggatgcaggatataatgcctgttggaaaacgaatccccagagcaggaaaaagggtgattgtggtcgtgggtgacccaatcaactttgatgacctgctcatcgacaactgtggtgacacccaagatatccctagagggatcttgtacgacaaagtgacacagagaattgggcagcgattgcaggaactcaaggtcgaagtcgcggactgatggagtgagtgacgttcctctctgcctgcttgcaagagcacacgactaagaagaactactaagaagaattattttctccctctctctttctctctctcgcaaattattatttttgtccactcctttctcgatctaccttatatgacgaaggtggtaagaattggtccaggagaaaaaaaaaggtttggcgaacgatgagaatgttgtaaactgtaaatcttgggtaggggaatagctggcgatgtgattgccttggatcaaatcgctgctgttgttgtcatgatggtggtgcaaacaaagggagtttctgttattccaaaacataagcttggtgaactttcggttcagcactgtagactgt

SEQ ID NO: 11612 - DNA, 2742 bp, Zea mays
actactgtaactataatacatagaaactaaaacgttgtagaaatagtagaaaccggtacgaattaaagtcaaacgaatagtctagcatattgtctagagaggttagtcatatcctctgaataatcttcagctcatgaaatccagtacgacgattatcccacactattctcctagaagtacaagaatttttttcccaaaataaatgagagggaatgatgaagagaaatacattatcagttaatggacacttctctctcttttattttgaactaataactgttttagtgcggtagtgccatcctgtcagctcgcattcacacacactccccagtccccactcttgctatattggcctcgtctcgtctcgtctccgtttctggccggccccacccccaaatctcccatggcttcttcccctccccagccactcacccgcaccgtcctcgccgctaccctgctcctcctcttgcacaatgccgccgccagagccgacggcgcgtcgccggcggtgaacccattcacggcgaaggcggcattcatccgatactggaaccgcaaggtgcccaacaaccgcccgcacccggccttcttcgtcgccaaactctccccgctcccggccgctgactccgcctccttcccatccgcgctgcccgacatccgcgccagcctacccgcgctctgcaccaaagccgcgctcctctgccccgggccggctactactgatgcggcgtcgctgacatcgggccgcaggggcgggggacctttcaagggctacaacaacgccaacttctccaactacggcaccggcggcgtagcggggaccgactcgttccagaagtactccccggacctcaacatcgccgccgacagcttccgccgctacggccgggactcgtcgggacgcgccgacagcttcacctcttacgaggccgacggcaacgtcgtgaccgccaacttcacctcctacgccggcggcgccacgggtggttcgggctccttcgccgcctacgccgccgagaccaacgtcccggactccaccttcaccaactacgacgccgccgccaacggccgcggccggagcttcgcgtcctactcccaggaggcgaaccatggggagaacggcttctccggctacggcaagaacggcaacggcgtgcgcgagacgttcaagtcctacggcaatgagtccaacgtgctggcctccggcttcgccaactacgggcagtccgccaacggcgccacggacaccttcacgggctacggcgtggaggggaacgtccctgagaacaggttccggagctacggcgccggcggcaacgctggcgtcgacaccttcaagaattaccgcgacgacggcaacgtcggcgacgacaggttcacctcctacgccaagggcgcaaacggcggcgcggcggagttccagagctacggcaactcggccaacccgggcagcaccatcttcaagggctacggcgagggcaccaaccccaaccaccacattgggttcaaggagtacgccggcgagaacaacaccttcaagggctatgccaagagcggtgtggacttcaaggggtaccacaacaccaccgtctccagctccaccgccgcggcgctgacggtgtcggcggaggcagcggcatcgatgcatcacgagcacctgaagtggtcgccggagcccgggaagttcttcagggagcgggagctcgtggccgggaaccgaatgccgatgccggacatcagggacaagatgccgcccagggcgttcctgcccagggccatcgccgcgaggataccgttcgagcccaacgccgtgtcggaggccttcgggctgcccctcgacacggcgctggggaaggccgtggcgtccacggtggcggagtgcgagcgcgcgccgagcaagggtgagacgaagcggtgcgcgacgtcggccgaggacgtggtggacttcgcggtggaggtgctgggcgacgacatcgtggtgcgcagcacggcgtccacggcgggcggcggcgggcgcgtccagctgggcgccgtggccggcgtggacggcggcagggtgacgcggtccgtgtcgtgccaccagagcctgttcccgtacctggtgtactactgccactccgtgcccaaggtgcgggtgtacgaggccgacatcctggccgccgatggctccggctccggcgagaagatcaaccgcggggtggccatctgccacctggacacgtccgactggagcccggcgcacggcgcgttcgtggcgctcggcggcaagcccggcgaggtggaggtgtgccactggatcttcgagggcgacatgacgtggacagtcgcggactgatggagtgagtgacgttcctctctgcctgcttgcaagagcacacgactaagaagaactactaagaagaattattttctccctctctctttctctctctcgcaaattattatttttgtccactcctttctcgatctaccttatatgacgaaggtggtaagaattggtccaggagaaaaaaaagggtttggcgaacgatgagaatgttgtaaactgtaaatcttgggtaggggaatagctggcgatgtgattgccttggatcaaatcgctgctgttgttgtcatgctggtggtgcaaacaaagggagtttctgttattccaaaacaaaagcttggtgaaatttcatttcagcagtataaactgtaaagtgggtgtgcttcaagtacgccgtgtcattttcggtgtgtgtg

SEQ ID NO: 11613 - DNA, 2889 bp, Zea mays
gtcgggtacccccgggtttcgggtttgcggattaaattgccatccctaggtgcacgtcgaggggtgttttaaaaaattatcataagaatttacatggcaaatggttagtttgcacttgataggttcccaaagggtaatcaatcttcaaatgaacaaacatataattatcagatataggagtgtaccgtactaccgtatcaaaggagcttcagcaccttgcttcttggatgaatgtttgatccattccatacgatccaagcaaaatggttgcggttgtggaatactccctccagttttctattagttgtcgtttaggacaacacgatctttaaaatagtaaaatataactttgactaatgattttttgttaaaatataaataaactcttaatatatttatacttttataaaattatttttaagacaaatccgtgcatataaatattaggtttcaaaactaaataataaaatagttattttagttaaaaatttataagtttgtctctttccttttcgtaaacgataactaatagtacaccggagtgagtacgctatgtctgcccagcccacgttggcctttgaggctttgacgctgtccacgatacagtcagcagcacgccagctagtactggcagcaggcaatatgctcagcgcctcagtcgctctttcaacgaaacgccacaaagcaaacaaatccgatcaacccagaattcttgaaacgggccttttgaacatcgtcattcggcccattggaggcacacagagttcagcatagctcgccagcccaagtgcggtgagggaatagtttctccaccaaaaaaatgtagtagagccagaggaggaggagcagggggaggacgaggctagggttgctcggcgatggcgtcggcggcgaagacccttgcacgggttggatcatccctcttcggccgcattctcgcgtctccgtcctcgtccataccccgcgccgggctgccgctagccaggctgcagccacacgtcccgccgccggcaccggcgggggtggacgcttacgaggcggagaccgtcgccaggctgagctcgctccccggcgagatatccttcccttgcggcctcccctcgctccgcttcttcatcgacgacggtacagcttctctctcacacacgcactcatgaacggattgggccgcgattgagtattgaagttgggctcggatcgctagtcactgccagtttcagaaatggggaatagggggactgggatcaatgtttttcgtaaaccgttcgttgaatatagagattgtagtgtcgttgaatatagaaattgcagtgtgtgactactcgaaactcgcatgatttctgttgtaatgcgcattttctgtgatttgcagttataccatttcactattaagctttgctttttgcggacttgggaagaattgccaagatttcatacagttaccttatttgggggcattgttttctgaaaagtcatggttgccttcatcaatgctgatgtgttacttttatctggcttgtgttgaaagttactaagtgattgatcaaccttgagaagtcacgtttctagtgttattgatgctcttacgcatagaagaacacgttgcttgcaatacagtactcagtatttaaagttccttgatgcctttttgttccttaaatagtaggtggcagaacctaaagattgatacactgcataaattgtttgtggatcatttgacagcctaaaactgagattgtgtggagcttaggaaattctgctatgatttatgttgaaattaagtctggtagaaagtgcagtagaaatactcaattacccaagtctccttttgctaagactgtttatttgcagagtgccaaatggtggccgtttcttgttccagctgctgctgattgtcctaaaattgggtagaaagtgtatgacaaatactcaagtacatgcagttcgtcctgctgttcctggattgtttccttacatggtcccaaacagtgaatgttccttgctacttctgttgctggaaatattgccgtagttatatttggtgaatactagagtcttgattatgatatgtaggctttgggttatgacctggcagctaggatcaacttttatttttgttagtttgatgtctttttctaatccgttgcttctgttctgctatttgtagtcgaggatcctgttcctaatgacccctttcagttgctcccgaaaagaacttaccagcccagtacaatcaagcggaaaagaacccatggatttcttacacggtctgtctctctagcttttccctggccattattttgcttccctcgtccttcattgaaaaaggaagatgggtttcaagttggtattatcaaattctgtttccgttcatgtttgcctttggcacctcatcatttagattaggaaggtagtttatctggcatgattgtggttcagtgccctcatgtccttgttacattggttctgcagcaaatcgaccaagggtgggcgcaaggtgattgcccggagaatcgccaaaggcaggcacagaatctcagtttagctagatctcgctcgtagcagccctggatgttttctgtaacacagattcgtatcgtgttctttctatggttagcactctgctgaaggtgagcccccgcgcaagcagcagtccatgtatggatttttattgtgaaacttttttttgggtggtttcagtcctggccatccgtaggatatgccctcttccattttacgtggcgctttgctctccctggtcggtgcggtgcagccgtacgcatcagtggcggatgcagaacaaaattctaggtggggccgatagtgcaagagacaaatcaccagactagaccataaatatagattaatgataataatatgaatgttaaa

SEQ ID NO: 11614 - DNA, 869 bp, Zea mays
gccggccggttccgggaaacggaccttatcagcatcgtcgctcggcccattcgaggcccacagagtgaggaggagtcgaggagcaggaggctagggtttaaggtgcacggcgatggcgacggcggcgaagaccctagcgcgggctggatcctccctcttcggccgcattctcgcgtccccttccataatccgccccgggctgccgctcgccgggctgcggccgcacttcccaccgccggcaccggccgggttggacgcttacgaggcggagaccgtcgccaggctgagctcgctccccggcgagatctccttcccctgcggcctcccctcgctccgcttcttcatcgacgacgttgaggatcctgttgctaatgaccctctccagttgcttccgaaaagaacttaccagcccagtaccatcaagcggaaaagaacccatggattccttacacgtaaatcgaccaagggtgggcgcaaggtgattgcccggagaatcgcaaaaggcaggcacagaatttcagtttagcaagatcccatagcagcactggatgttttctgtactactacagattcgtatcgtgttccttgtgtgaacgacgtattttaagccttttgaagtttttgcatgccaccctgctgaagcatgaagctgagcccccgcgcaagcagctgaaacaaactcttgctgcgaaataaacaagtcaaaggaactgggaaaattgccgcgccgaatgagttcatttggagcagctgcgtgccgcatttgtgtttgtttgtgctgggattgccacgtaacagaaatgcctgcgttgtctgaatgtgggcccaataacaacttggcttgttttcaaaagggggggcaagggggg

SEQ ID NO: 11615 - DNA, 795 bp, Zea mays
tgtgcggtcgctgagggaatagtttctccaccaaaaaaaagtgcggcaatgtagtagagccagaggaggaggagcagggggaggacgaggctagggttgctcggcgatggcgtcggcggcgaagacccttgcacgggttggatcatccctcttcggccgcattctcgcgtctccgtcctcgtccataccccgcgccgggctgccgctagccaggctgcagccacacgtcccgccgccggcaccggcgggggtggacgcttacgaggcggagaccgtcgccaggctgagctcgctccccggcgagatatccttcccttgcggcctcccctcgctccgcttcttcatcgacgacgtcgaggatcctgttcctaatgacccctttcagttgctcccgaaaagaacttaccagcccagtacaatcaagcggaaaagaacccatggatttcttacgcgcaaatcgaccaagggtgggcgcaaggtgattgcccggagaatcgccaaaggcaggcacagaatctcagtttagctagatccggctcgtagcagccctggatgttttctgtaacacagattcgtatcgtgttctttctatggttagcactctgctgaaggtgagcccccgcgcaagcagcagtccatgtatggatttttattgtgaaacttttttttgggtggtttcagtcctggccatctgtaggatatgccttcttccattttattttgcgacgctgtgtgcgtgtgtgatgatactatcatgatacttgttggacacaaaaaaaaaaaaaaagggcccct

SEQ ID NO: 11616 - DNA, 1882 bp, Zea mays
gccggccgggctgcgagcagtccgagaggcgagcgaccgaatcagcctgctctctcgctcgagaagcctcctccgctccgccgtccgcccctcgcctcaccagtccgcattccggcgcacacgcccattaaaataccgcgtccaatctccgccctgcgctcgtccctcatgcccgcctcgcggctcacagtgcgcgtgtgccaccatgctcggcgcggcgctccgcctccgcgtccgcgtgctccgccgccgccgctcccaccgcgggcgccgtcgaggcaggcggtctctcggtcgggtcggggatgacgacgacgacgagggaggccgggagccggtgctgctagtgtccgggatgggcggctccgtgctgcacgcgcgccgccggtccaactccaagttcgacctccgggtctgggtgcgcatcctcttcgccaacctcgacttcaagaagtacctctggtcgctctacaacgccgataccgggtatgtggagccgctggacgacgatgtggagattgtcgtgccggaggacgaccacggcctgtttgccatcgacattcttgatccttcctggtttgtagaacttctccatctgtctatggtgtatcacttccatgatatgattgatatgctcataaactgtggatatgagaaagggaccacactatttggatatggttatgattttcgccaaagcaacaggatagacaaagcgatggctggtttgagagcaaaacttgagacagctcataagacctctggagggaaaaaagttaatttaatctcacattctatgggtggattgctagtacgctgcttcatgtctatgaatcatgatgtattcactaagtatgtcaacaaatggatttgcattgcttgtccattccaaggtgcccccggatgcatcaatgattctctacttactggattgcaatttgtttatggttttgagagcttctttttcgtatctagatgggcaatgcaccaattgcttgtcgaatgcccatcaatctatgaaatgttaccaaatccagaattcaagtggaaggaaaaaccaattattcaggtttggcgtaagaaccctgaaaaggatggaactgtggagcttgttcaatatgaagcaactgattgtgtgtccttgttcgaagaagctttaaggaataatgagctcacgtataacggaaagaaagtagcactaccattcaatatgtcagtcttcaaatgggccaccaagactcgccaaatcctagacaatgctgaattaccagatactgtgagcttttacaatatatacgggacatcttatgaaactccatacgatgtatgctatggctcagaaagctctccgattggagatttgtcagaagtgtgtcacacagtgccggcatacacttatgtggatggagattgcacggttcccatagaatcggcacgggctgatgggttctctgcgaaagaaagagttggcgtcaaggcggaccaccgtggcctgctgtccgatgagaacgtattcaagcttctcaagaaatggctcggtgtgagcgagaagaagtcagagtggcgttgcgtgtctaaatcctactccaaagtgacctaattgggttgcctgtagttcttcaggaagactgttattttggcctttcctcctgaagagaagatgaaacaaaattctggtgattgtattgtatgtctgcacgatgtaaatctctgcaagctgcacggaacaagggattagtgcccttgtacgatgtatcattgccaggcatttcttttgaagcctagggtcatatattcattgccccttccaactctggagcatagtaaaagaataatatgaaatcgatcataatttcaaaaaaaaaaaaaaaaaaggccccta

SEQ ID NO: 11617 - DNA, 1152 bp, Zea mays
cccacgcgtccgcgctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttttgctttggcagatcctcttgaccttctatttatcaggcaaggtaatctatcccaaagaaagtgctcttatgttgtaattggaagggttattttcagcattttggggatattcatggctgcggttgtcacatatactgtcatcactgatggactaccttttaggaaggaattgttgacaccgtggatggcggcaaccttaattgatttctacataaatgtctttgcgatatcggtctgggttgctcacaaggaatcatcatggatatcaactaccatttggattgtcttgctgatatgctttggaagcatcacaacatgcggctacattgtcatccaacttttcaaagtatcatatcaagatccaatctaccacgtgctattgaactcccacagcaagaagatttgaaaatttattgaagttttatgtgcagcttggctggtaatattaaaatgttccttctatctatatgtaaggtaccacaattaaggggacaggaggatagcaattagacaagttgttttactttgaataaaataactcatgtgctgagttctctgctaaatgaactgtaacgtgaaatcctttattgtatttctgattgaaattgcttgaacaataatctcctttgttatggtttcattgcaaacaatttagaagatcgagtgatggtttaattttgaatggcggactagaagtcagcagctcagtctcagcattcagttgggcagattagctcagggccaagccctttgagaatggaccgaggccaagcctctttcagttgggcagatttagcaatgatcagatcagcaacaggaggatcaggaggtgagagccccctccagggggcaggaaaggaaacaaaaggttgttctgcctcgaacaaaaattcaagaaaccaaagatctctagagaaactcgtatggcactacaagcagtaatacgaacaccgagaacatgaggggt

SEQ ID NO: 11618 - DNA, 969 bp, Zea mays
  misc_feature (194)..(194): n is a, c, g, or t
acaaatttgaggaaatagatcacatcattttttataattttcgacgatgtacagaagacaacttcagtgtcttttgcttatgtgaaagaaaggacaaagaatctcggatttaatcacaaaaaacagaaatacattttatgctctataagagtttgaaaccaatgcagcccgtttctttcatgggcctcaaactnaaatacccattctcggactaagccattttgctttggaataccaaatgtgcgatacgtcatttcctgcttcctggccgttgtctggcagccggacgaaatccgaaaacctaccgagtaactgacaatctcgatccccgcagtcatcgcgggatcggcccgtcctcgccggcgactcattcccgcaactcacctgctctcaaccgcgaactcggcgccctgcacggcctccaagtcgcacgatgcggcggcgcccacatcctacgtggctgcgtctccgcctccgctttcgccgcgccgacgtgtcagcttcccgtccactacagagtccacattgtcctcctattacttgctccgccggcaactattcgcccctccccagtcgccactaaatccgctgccgtttcttctcgagtgtgaccatggcggctcagggatccctcgtcatgtggagggcggtcttcgcagcgctgggcttgctcatggtggccacgctggtgtacaccttggccaccgacggctcgccgttccgccttgagctgtttacgccgtggatggtggcaacactggctgatttttatgttaacgtttctagcttcttatgtgctcggatttgtaggaacccacagcgattttttggaaacgggtattggtgagggttgtggaacttgtctgcccgttgatcatttcaaagtatcaacgagccactcttacagttacagtcctattaccttacgttgtctggtgactggtgttaagcagtaagctgcatattacg

SEQ ID NO: 11619 - DNA, 1050 bp, Zea mays
  misc_feature (2)..(4): n is a, c, g, or t
  misc_feature (6)..(8): n is a, c, g, or t
  misc_feature (11)..(12): n is a, c, g, or t
  misc_feature (15)..(15): n is a, c, g, or t
  misc_feature (18)..(18): n is a, c, g, or t
  misc_feature (20)..(20): n is a, c, g, or t
  misc_feature (23)..(23): n is a, c, g, or t
  misc_feature (25)..(26): n is a, c, g, or t
  misc_feature (32)..(33): n is a, c, g, or t
  misc_feature (36)..(45): n is a, c, g, or t
  misc_feature (48)..(49): n is a, c, g, or t
  misc_feature (51)..(52): n is a, c, g, or t
  misc_feature (54)..(56): n is a, c, g, or t
  misc_feature (58)..(58): n is a, c, g, or t
  misc_feature (60)..(60): n is a, c, g, or t
  misc_feature (63)..(63): n is a, c, g, or t
  misc_feature (65)..(65): n is a, c, g, or t
  misc_feature (69)..(77): n is a, c, g, or t
  misc_feature (79)..(79): n is a, c, g, or t
  misc_feature (82)..(82): n is a, c, g, or t
  misc_feature (86)..(86): n is a, c, g, or t
  misc_feature (95)..(96): n is a, c, g, or t
  misc_feature (111)..(111): n is a, c, g, or t
cnnntnnnacnnatntantnttntnntttccnnccnnnnnnnnnnagnncnntnnntntnagnangatnnnnnnnnngntcnggangttgaaacnntccggcccccctcgntcagccgcgtgccccgccgcccctccccagtcgccactaaatccgctgccgtttcttctcgagtgtgacaatggcggctcagggatccctcgtcatgtggagggcggtcttcgcagtgctgggcttgctcatggtggccacgctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttttgctttggcagtgctgtcacttgcgcttatattgttaagaaacttcttgaagtaacatctgcagggtcatcccaagatcctcttgaccttctatttatcaggcaaggtaatctatcccaaagaaagtgctcttatgttgtaattggaagggttattttcagcattttggggatattcatggctgcggttgtcacatatactgtcatcactgatggactaccttttaggaaggaattgttaacaccgtggatggcggcaaccttaattgatttctacataaatgtctttgcgatatcggtctgggttgctcacaaggaatcatcatggatatcaactaccatttggattgtcttgctgatatgctttggaagcatcacaacatgcggctacattgtcatccaacttttcaaagtatcatatcaagatccaatctaccacgtgctattgaactcccacagcaagtaccacaattaaggggacaggaggatagcaattagacaagttgttttactttgaataaaataactcatgtgctgagttctctgctaaatgaactgtaacgtgaaatcctttattgtatttctgattgaaattgcttgaacaataatctcctttgttatggtttc

SEQ ID NO: 11620 - DNA, 1474 bp, Zea mays
gcacgagaccattacctagaacatcctaatcgaaaaatttcctgcttcctggccgttgtctggcagccggacgaaatccgaaaacctaccgagtaactgacaatctcgatccccgcagtcatcgcgggatcggcccgtcctcgccggcgactcattcccgcaactcacctgctctcaaccgcgaactcggcgccctgcacggcctccaagtcgcacgatgcggcggcgcccacatcctacgtggctgcgtctccgcctccgctttcgccgcgccgacgtgtcagcttcccgtccactacagagtccacattgtcctcctattacttgctgggcccccgaggccgggccggtccccagtcgccactaaatccgctgccgtttcttctcgagtgtgaccatggcggctcagggatccctcgtcatgtggagggcggtcttcgcagcgctgggcttgctcatggtggccacgctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttttgctttggcagtgctgtcacttgcgcttatattgttaagaaacttcttgaagtaacatctgcagggtcatcccaagatcctcttgaccttctatttatcaggcaaggtaatctatcccaaagaaagtgctcttatgttgtaattggaagggttattttcagcattttggggatattcatggctgcggttgtcacatatactgtcatcactgatggactaccttttaggaaggaattgttgacaccgtggatggcggcaaccttaattgatttctacataaatgtctttgcgatatcggtctgggttgctcacaaggaatcatcatggatatcaactaccatttggattgtcttgctgatatgctttggaagcatcacaacatgcggctacattgtcatccaacttttcaaagtatcatatcaagatccaatctaccacgtgctattgaactcccacagcaagtatggaattccaacttcactgtgataattcatcttctatgatcctggttagcttacagttgtctaaacttcagcttgtcatctggtcattgatttccattcataattcacttgtttgaaatgtaggaagatttgaaaatttattgaagttttatgtgcagcttggctggtaatattaaaatgttccttctatctatatgtaaggtaccacaattaaggggacaggaggatagcaattagacaagttgttttgaataaaataactcatgtgctgagttctctgctaaatgaactgtaacgtcaaaaaaaaaaaaaaaattctgattgaaattgcttgaacaataatctcccctggtttggtttcatttcaaac

SEQ ID NO: 11621 - DNA, 2400 bp, Zea mays
attactagcatcgtcgccttgtaggttaagtttcgctaaacgacaataacattagtttacgtattactcatccaaatcagtgaaagtgtaattactcattgtagattaagtggccttacttttgataaaaatatatttaccttcagtggagttctgtagcatagggtggtaatttggtcatctgttccgatcagattatgggatgcattgcttttgaaagaggctcataacttgtgtgttcagaactggagacagcaacctttcttgttttcattttgcgcaccttggcaccctcgaggatctagcaagcctgattgcaccgcaactgatcagaccaattgcgcggtggccattctatgccttcttgggaggagccatgttctgcctcctggccagcagcacttgccaccttctctcctgccattctcgccgcctagcatacattatgcttcggcttgattacgcaggcatcgcagctctaatcgccacatccttctaccctccagtatactattctttcatgtgctaccccttcttttgcaacctgtacctcagtttcataaccatcctaggagtggcaactatcgcgttctctctacttccggtcttccaaaatccggagttcagaaccatcagagcatgcctcttctttggcatgggtgcatctggcgtgatacctgttcttcacaagctagtactcttctggcaccaaccggaggcattgcacacgaccggatacgaaattctgatggggctcttctacgggctgggagcattggtatatgcggcacgggtacctgagcgctggatgcctgggaagtttgacatcgccgggcacagccaccagctgttccacgtcttggttgttgccggagcctacacacactaccacgcagggcttgtgtacctcaagtggagagacctgcaaggctgctgaaaggtactgcatcgttgaggatgtggatagattgtagattccgtgaattcaggctgaaggtcatggtctgttgtaaattgtaacagtaatcatgaaacaattgctacaagtctaccaggtagtcgggcttccattaataatcaattgaagactagtatttatgctattactaaatgttcgtgtgactgatgcgatatttcattttcagtctcttttctgctaattcatgtacagttgctagcagggccgcctccttgtattgtatgtggttcatctttgcattagtgtttttggtcatttgtcaggtcggatataaaacaggcaagatgcacaatttatatgtgctttgtgtattgctatgaaccaaatggagtgggccagtagctaacagcggggctctaaatcgtacaaagaaaatagtttagttggttcctgatgtcatcaccaaaatttgttttagttaaggaaaaattggctttagtattgatacatgtgattagatatccatatcatctcggaatttggatttgtcaaaagtctgactatgtattagaaggtaaagtggtaaaattaatcatgtatgatgagtctaatcatgcatgcaggtcgtggtggcggtagtgaataaagcgcggtagatagattgtttcggttgaatatgttagttgggccgtgattgtaggtcgggcggtattgggcccatatatgcatgagttggctgaactaaagtctggtgtgtcaaatagaagaaggccatgaaataaaaaaaataacataaactctctcctacctttctctctatacctgaaatcttcttctttcccctttctcgtgctactctctggtgatcgccgaactttatccacgtcggtcgtgacaaattggtatcgaagccggtacgacgacttgattatccggttcgtggtcggattactctatagatgttgagtcgagagggaagaaatcggatttggaggtttcctgatcaggtctcggatccctaaagattgaagccacgccactaaattgtcagtccatgtaggcgcgacaattggtttcggcgatcgaggttgtttagaaacgcttgacggagaagtttcagtaggcgttggacgtttcgacttcaacgttggtcgaactctcggagatggatggattgagtctgctaccgaacaagctatcggagatagagaaaagacagatggaacacgacaagttggtgcggtacttacagaccaagatggatttatctatgaaatcgttagctcaggtcccataggattaggatggactagggtatgcagtctctaatgttgttggaggaacgaaagagcatggaaggacatcttcaggtgacgggttgatgggatcacatccaccattgagaactgcccaaacttaggtattgtgaaattcatctcctacgattcctatagttgatggcatagagttgaggatggaac

SEQ ID NO: 11622 - DNA, 1776 bp, Zea mays
ccaccaccggatcgacacgaaacacccaggccccactccccaggcgcccagcaggtagcagccgcgccgccaaaagcgatcgcgcggcctcctccgtctccgtggctccgtccaaatccgctgggtcaagcggagggcggccctcgcgccccgccggccgggcccgacgggccgacgcaaacccaggaaagaaacgaagcgagcggcaccaccggcgcgtcctcggctcctcgcgtgcgtgcttaccccggcgaatattcgaccacggaagccgcataacctccgtccatcccatccccgctcgcctctcctctcctcgccccgctctagacgatcgatggccgcgacggcggcggaggagatggagaggatggtggaggcggagtgggaggaggggaagcaggggatgaggaagaggaagcggtacgggctggtggagtaccgggcgctgccggcttacctgcgggacaacgagtacatccaccgccactaccgctgcgagtggccgctcccgcaggtgctgctctccgccttctccatccacaacgagaccctcaacgtctggacgcatcttataggatttttcatctttctcgctctgaccatatacacagcaacacaagttccaaatgcagtagatatccggagcttgcagcatttgccagatgtactgagaaaggctgatattcataagattcaggcagagcttgtgtcatgtcttccgtcgttacctcacctttcagatctacaaaagctgaaggatgagctgaagacctcttggaattctatggaggttcttccatctctgtcccgttggcatctcttggagttactcgcaaattgtctgccacacagatttacccatcccaatgaaacaagtttgtctgttcttcaaagcatgaaggaggatctagcaagcctgattgcaccgcaactgatcagaccaattgcgcggtggccattctatgccttcttgggaggagccatgttctgcctcctggccagcagcacttgccaccttctctcctgccattctcgccgcctagcatacattatgcttcggcttgattacgcaggcatcgcagctctaatcgccacgtccttctaccctccagtatactattctttcatgtgctaccccttcttttgcaacctgtacctcagtttcataaccatcctaggagtggcaactatcgcgttctctctacttccggtcttccaaaatccggagttcagaaccatcagagcatgcctcttctttggcatgggtgcatctggcgtgatacctgttcttcacaagctagtactcttctggcaccaaccggaggcattgcacacgaccggatacgaaattctgatggggctcttctacgggctgggagcattggtatatgcggcacgggtacctgagcgctggatgcctgggaagtttgacatcgccgggcacagccaccagctgttccacgtcttggttgttgccggagcctacacacactaccacgcagggcttgtgtacctcaagtggagagacctgcaaggctgctgaaaggtactgcatcgttgaggatgtggatagattgtagattccgtgaattcaggctgaaggtcatggtctgttgtaaattgtaacagtaatcatgaaacaattgctacaagtctaccaggtagtcgggcttccattaataatcaattgaagactagtatttatgctattactaaaaaaaaaaaaaaaaaaaaaactcgagactagttctctctctctctctctcctcgtgc

SEQ ID NO: 11623 - DNA, 1390 bp, Zea mays
  misc_feature (1261)..(1261): n is a, c, g, or t
ttgcatgcctgcagccaccgcccaccactaccaccaccgatcgacacgaaacacccaggccccactccccaggcgccctgcaggtagcagccgcgccgccaaaagcgatcgcgcggcctcctccgtctccgtggctccgtccaaatccgctgggtcaagaggaggacgggtcgcgcggccccctcgccgagacccacggcccgacgcaaacccaggaaagaaacgaagcgagcggcaccaccggcgcgtcctcggctcctcgcgtgcgtgcgcaccccggcgaatattcgaccacggaagccgcataacctccgtccatcccatccccgctcgcctctcctctcctcgccccgctctagacgatcgatggccgcgacggcggcggaggagatggagaggatggtggaggcggagtgggaggaggggaagcaggggatgaggaagaggaagcggtacgggctggtggagtaccgggcgctgccggcttacctgcgggacaacgagtacatccaccgccactaccgctgcgagtggccgctcccgcaggtgctgctctccgccttctccatccacaacgagaccctcaacgtctggacgcatcttataggatttttcatctttctcgctctgaccatatacacagcaacacaagttccaaatgcagtagatatccggagcttgcagcatttgccagatgtactgagaaaggctgatattcataagattcaggcagagcttgtgtcatgtcttccgtcgttacctcacctttcagatctacaaaagctgaaggatgagctgaagacctcttggaatttctatggagggtcttccatctctgtcccgttggcatctcttggagttactcgcaaattgtctgccacacagatttacccatcccaatgaaacaagtttgtctgttcttgtaagtagtctacaactcgctgaattacttgattacattcttttacttttgctacaagggtactactgttttgcattaaggtcaagggaggttaatttttctgaagttggcgaagatttcacttctgtaggtctatatcagagaaaatctgaagatcaatgtgatagatctttctgaccttaggaactagccgattccctctcttaacctgtctcaattctttctaataaattgtagatttataacttgtgcactagtgaggtagagaaggagagagagggagtacgaggagccataccttcgggcctgaggtggagagcagccgcggtggtagtcggngtcgtagatggctttggaagttgagcgcctccgtcctgatttatttctcctccatatgtgtttggaccttggggtggagcattagtggccggcacatagaactattaggtctacaggcgccatgggtag

SEQ ID NO: 11624 - DNA, 1337 bp, Zea mays
tcatcaatgctagttctattagctactactaggcgttggcctcggggccggccggctgccccccatcattactagagtactcccggtgccatctcctccatctccctattcctcctcagctcctggaccggccatggccgcaccttccggcacgatgcgcgccgtgcagtacgacagatacggcggaggagcacgggggctcaagcatgtggaggtgccgatcccgtcgccgaagaaaggcgaggtgctcatcaggatggaggccaccagcatcaacgtcgtcgactggaagttccagaacggcttcgcgcggcccttcatgcccaggaggttccctttcatctctggtttcgacctagcaggagaggtcgtagagttgggtgctggagtgagcagcttcaaaccaggggataaggtgatcgccatcaacttcccgaacggcggagggctcgccgagtacgcggtcgcgtcagcgtctcgtacagccgcaaggccgccggaggtgtcggccgtcgaaggtgtctgcgtgccgatcgccgcagtcaccgcgctcgggtcgctgcggacagccggggtcacagtcacactggacgacccggctcgcgcccccgccacgcccaagaacgtgctggtcaccgcggcctccgggcgccgtcggccacttcgccgtgcagctcgccaggatgggcggccacaacgtcacggccacctgcggcgcgcgcaacctcggcctggtccggagcctcggcgccgacgaggcgctggactacaagacccccgagggcgccaagctgcggagcccctccggcaggaagtacgacgcggtggtgcactgcgccgcgaaggggctcccgtggtccgtgttcaggcccgtgctcgccgcctcgggcacggtcgtcgacatcacgccagggttcgtggccgtcgtcaccgcgatcctccaggtggcgaccttctccaagaagaggctggtgccgctcatagtgacgcccaagaaggaggagatggagctgctgctgggcatgctgaagcagggtaggctcaagacggtcatagattcccggcacccgctgggcagcgctcacgaaggctgggccaagagcatgagcggccacgccaccggcaaggtcgtcatagagatcggagccgcgcaaccataataatagtgcagcaatatattgattcaaaaaataattatgaattttgtaatttttagatctataatttctatatttttttgttcatgaattatgtatttttatttaaaatttatgaatcatgtatttttatttttatatgaattatgtatttttactagatgaatgcacgtgcgttgc

SEQ ID NO: 11625 - DNA, 864 bp, Zea mays
gggaaacgaaaaagcccccagccgaacaccactctctctcactctcccggacttcagaggccgaggacgctggagcacgcgtcggtccggcgcccccatggacccagcctgcgaggagctcgagcgccgcagccgctacctcagcgcgctcgtgcgccgcaccaagctcgccgacccgccccagcccgagccggaggccaaggcggacgtggagcctcctcagctgaaggcgccgccgcacgtcggcggtgagggtaagggagggaaggatgaggccaaggcggaggagaggacgccgattgaagaagccgaggggggaagcggcggcggcggaggcggaggggaggaaggtggcggtgtgcgtgcgggcggcggacatgccgctgccgctgcagcggcgcgcggtgaggatcgccctcgaggccgtcgccgccatgccgcggctcgagagcaagcgcctcgcgctcgcgctcaagaaggatttcgatacaacatacgggcccgcatggcactgcattgtcggcacaagctttggctcctacgtcactcactcgttggggggtttcctgtacttctccgtcgacaaagcctacgttctcctcttcagaactgccgtccagccacttgtccagctacaatgagacctgaaacatgttttactcgaactggtgtagatgcagcgcaaatgtaattttgaacagaatagacgacgctcagcacaccgtgtcttgccgcgtttgagtagcagaggtaatttgatctgtacacaatactgtagaacagccgtgcctctaacgttgtactgcccgaagtcctgctttgtaaaaaaaaaaaaaaaacgttcttgtgcaatcgtttggagtt

SEQ ID NO: 11626 - DNA, 870 bp, Zea mays
acgaattcctggagcagcaaccaaaaccccgaggaaaacgaaaaagctgctccctctcccggacttcagaggccgaggacgctggagcacgcgtcggtccggcgcccccatggacccggcctgcgaggagctcgagcgccgcagccgttacctcagcgcgctcgtgcgccgcaccaagctcgccgacccgccccagccccagccggaggccaaggcggacgtggagcctcctcagctgaaggcgccgccgcacgtcggcggtgagggtaagggagggaaggatgaggccaaggcggaggagaggacggcgatgaagaagccgaggggggaagcggcggcggaggggaggaaggtggcggtgtgcgtgcgggcggcggacatgccgctgccgctgcagcggcgcgcggtgaggatcgccctcgaggccgtcgccgccatgccgcggctcgagagcaagcgcctcgcgctcgctctcaagaaggatttcgatacaacatacgggcccgcatggcactgcattgtcggcacaagctttggctcctacgtcactcactcgttggggggtttcctgtacttctccgtcgacaaagcctttctcctcttcagaactgccgtccagccacttgtccagctacaatgagacctgaaacatgttttactcgaactggtgtagatgcagcgcaaatgtaattttgaacagaatagacgacgctcagcacaccgtgtcttgccgcgtttgagtagcagaggtaatttgatctgtacacaatactgtagaacagccgtgcctctaacgttgtactgcccgaagtcctgctttgtaaacgttcttgtgcaatcgtttggagttacagacgcggcctgtcagat

SEQ ID NO: 11627 - DNA, 995 bp, Zea mays
cagaggttgaagcactctctatggcacaacatgagaatcttgtgccactatggggttattgtatccagggaaactcgaggctcctcatatattctttcatggagaatgggagtcttgatgattggcttcacaacacggacaatgccaactcatttctagattggccaacaagactcaagattgcacaaggagcaggacggggcctttcttatatccacaacacctgcaaccctaacattgttcaccgtgacgtcaagtccagcaacatcttacttgatagagaattcaatgcttatgtcgctgattttggccttgcaagattgatccttccttacaacacacatgtcacgacagagctagtaggcactcttggttacattcctcccgagtatggacaagcctgggtggccaccctgagaggtgatatatatagttttggagtggtcttgcttgagctgctcacagggaagaggcctgtccaggttttgaccaagtcgaaagaacttgtccaatgggtaagagagatgaggtcccaagggaaggatattgaggtcttggatccagctctcagaggaagaggacatgacgagcaaatgctgaatgtgcttgaagtagcctgtaagtgcatcaaccacaatcctggattgaggccaaccatccaagaggtggtgtactgcctggaaaccatagttgagcccctgcaggtgcaagtgcagctgtagttaaaggagaacatattgtaggtggtgatattgtactccacccgactaggtgtaacttcagtagaaggaagagtttctaacaaagagcacagtagtgtacatttctgaaagaaaagcctcgctccctcgctgtcatgaggccctcccttatacaattttacttattccttccgtggaaatattgcacctcctagttcaaacaattgaacatgaaaagtgcaaaaaaagagcatggggctcttgtcaaaaaaaaaaaaaaaaaaaaaaaaacgg

SEQ ID NO: 11628 - DNA, 3092 bp, Zea mays
gtcggagagagcgagcgagcgagcgagagtggtggtggtgtgtgcgcgagcgcaacagggagaaaaagagcgtatttcttcttcctcaccctcctcgaggaagagagagggcagctccggagccgcacgggcgcgagcgaggcaggcagtggctcctcccccctcctttcgatatcagctcatcgattcgtcctatcacacacatatcattaccgctcctcttcctcacctatgcttgtcctctaactcattggcagaagagaaaaaaaaagtccttgttgagttgttgtatcgggttctggtggtgactgttactggggtttccttgcccggttcttgatttgcgcaaggacagatttgccgtcctctcgggttccgccgtgcggtgctgaatcctccttccctgttcccttcccttaggtttggatcggggatagggatggaagtggacagaaagaagaatttgcagattggatccaaggggaaggaggttcagagcaagaatccgaggcgggaggagccgctggcatcgtcggaggtggacatggatgagccagacgctcctgagagcggtgacatgattgttgatggcaacaatggcagctccagagagagccccttgcagcccatggattccaagaattccaagggctgtgcggtcaagaagccaacatcggtgagctcagacttcggtgaggagctggacttggaccttggtggggagaagagtgggacgcagcaggagaggaagctctcaaggcaagaccgggttgagctttgccggtcgttccagcttgcagtgagctcccatgattgggagagcgccgaggggctggtaggaatggctgatgcacaagggctcaacgatgtgctgtgtgtggcagtggatgcgatttggttcttgagtgatagggatgagctgcttgctattgtggggttgatcaaaagggttgtgtctgagggcgcaaaagattttacccgtgctgcgctccggacatcattcctcgcatcgtgtgtatcagcatgtagggggcggtcgactagccttgctgatgcagtgagcttcatgggccagaaattgcatgaacgacttcaagaatcccaaggtgatgaggtattgaaagcagaagcaagtgcaaaggtgcacaggtttacagaatgggctctaaagtgtatcgggctgcattcacgtgttcgagagaacaggggcaaaggaaaccacgacactgtaattgaggttcagcttcagttgtctgctttcaagatatttcttgatcttgctgataatgagcttaccgggaaggattttacggaggcttttgatgctgcatgcttccctcttacactcttttcaaccaccttcgaccaaggatgggcatcaggaatatcagcagctgcagtacaaggccttttagagttgttggtagagggtggtgcagacaatgtgaaccaatgctttcttgaagctgcacgctatggcagcactgagctcgtgcggatcttacttcaggttgctcaaagaaacagcttggacattgatgtggacctagcccttggctttgccgcacactatgggaagatcgaaaccatgggatgcttggttgaagaaggtaatgctattggctttcttggccctttgatgcgtgctgctgaacgtgggtgcctccaagttgtggaatggtttgtcaaccacgggtgtcgagaaatggagctttgcctagcccttactgctgccacctctaatagccagattgcagttgctgcttatcttcttcctcttgtcccgcaacatgttcttgcccccctcagcattgagattatcaaggctgctggtgagaggactacgggttccctgcagggtgtggattttcttctccgctcggatttcctcaatgacccagctgccacatatgccgtggcagacagtattgcaagatgcaccgatgaagctgtggacgcaaagcttaggtctttcatgaatgagcactggagcgaggcagctttttgtgcgggattcgaatctgcacagcagcactttgttaatttcatgaggataatggaaaggggtgaatcaccaatccgcttaggggacctcccacttgagctggtgattgccatggcctacctgccgctctataaggaatgcatgaattccaatgggcgacttttgcctcaaaggcttagaggtcagcttgtggaggctgcaagcaggctcgaggaccggcaagtggaaagggatagccaaagcagagaactcttggccatcttggagcaccacataccacgattcatgatccaaacttgaaggtaagcgcaggcatccactctgaaccactgctgtcaatgcaagcaaaaaacaacttacaagggcaatccacgccgtcttcagtgccgccaccatgttcctgcttggggggacatcaccaaatgatagcatcttgagttggctctcctgcaggcgatcttcggagagtatataattctggggaatggtgtgtgccttgtcgaggcatgtgtcggagtgttttactgggaccgtaatcttccatgaaaaaaatgatataagccttcggtatgtaatcctgagttttcggtgtaattcaaaacgctggtcttgtgacaacatgtcgctagttttggctagcgacttttttgatcatggcttcaaaaacaaaacgaagggagtatattcatactgtgtggagattgccttgatcgtgagatgtgacatggttctgatgaggtacaagtttgagcaactctgatagcttcaaaaaaaaaaaaaaaagcatcctacttgtcagaatgtggtttacttcattgcgtttaaacaaggagaattagacatcgcgcaacatagaaaatgcaggtcatgcctctcgaggaagatagcaccgttgatggctttcatctacaaaatactatccctcggtacaaaatactctctctctctctttatcttggcaagaacaaagttgacgtttttttagaagtcaaacgattttaagttcataaaatatatatagtaaagtactaacatttatgataccaactaattataattaaattaattattaatatattttaatagt

SEQ ID NO: 11629 - DNA, 1269 bp, Zea mays
  misc_feature (1269)..(1269): n is a, c, g, or t
tccggttcccactttattgtgtttaaacacctagaacatcctaatcgaaaacttcctgtacctgtcctcaaggtcgcccccgcgctgcccatccccctccccctcctccttcctcggcagctcgtggcgctccagtccacagaggagaggacacgacacgacgaggggccgggcagcaagctctgctcagtccgttccgcgggccggtcggtcggcgatggcgcggcacgcgggcacggcgctcctggacctggtggcggggcaggtggacccgggcgcgccggggttctggcgcgacttcctggtcggcatgctcaagccggcggcggccacggccgtggtggccatggccgtcgggctcagcttctcgcagcgcctggggctcgagggcgagatgctctacgccatcgcacgcgccttcctccagctctccgccatcggcttcgtcctccagttcatcttcgcccagaagaacgcgctctggatcctcctcgcctacctcttcatggtgacggtcgccgggtacacggcggggcagcgcgccaggcaggtgccgcgcgggaagcgcatcgcctgcgtctccatcctcgtcggcaccgccgtcaccatgctcctgctcgtcctcctcgacgtcttccccttcaccccgcgctacatcatccccgtcgccggcatgatggtcggcaacgccatgaccgtcaccggcgtcaccatgaagaagctccgggaggacgtcaagatccagaggaacctggtggagacggcgctggcgctgggcgcgacgccgcggcaggcgacgctgcagcaggtgaagcggtcgctggtcatcgcgctgtccccggtgatcgacagcgccaagacggtggggctcatcgcgctgccgggcgccatgacggggctcatcatgggcggcgcgtcgccgctggaggccatccagctgcagatcgtcgtcatgaacatgctcatgggcgcctccaccgtcagcagcatcctctccacctacctctgctggccggccttcttcaccaaggccttccagctcgacgacagggtctttgcagactaagatacatgctggattgtaatgtaaccgagtcccagttgtttgagccttttgagggagaaacagagctaagagctgtggctttcggtgccaaaaaaaaaaaaaaaaagcttatcgattccggccaccccgagggggggcccgggacccaaattcgccccatagtgaagcgtattaagcgcgctccctggccgaccattttaaan

SEQ ID NO: 11630 - DNA, 3346 bp, Zea mays
ggggtctggtgcggtggcaccgctgcacccgcagggccggtcctgtatgtatagatggatattgtttgcatcatatattgtgatatgcctatgggcttgggaggttaagcccctaacacgatcgatgcctgaccggccctcaagtttgaccgctcttcggcccaagcccaacccttctccttcagcgcgttctgctcgtgtgggcgcctggccgcccggtccagcccatgtgtgagagcttttgtccgattaatttggttgcggtttagctttcagttttgcaacttttggctttggcattctaaaaaaatcattttattgtttttttacaaagaacgggaagatggcattgctgtaagttgcgtgctcttggcccggaccgcgatttaaaatttcttaattggggagaggcccttttcacgcctgcatcatgatcaagtgcgcgatgaatggtgatgggcaacttttgatattatttttatatatcgatgggagaaaagggggagtacatgttgtggcacgcctagtcagctcagcgtcatcacttctttctttctgtggccctcctcggctcggccgctcggcacagagcagcagcacaacgccacagccaccgcaggccagccgagcgggacggacgggacacgtggcggcacgtgtctgttctcggccaccgtcgccgggataaattttccgaacccagttgacccgaccgccgatgaaccctggccagattcctcggcacgtgggcccacctcaccagcctcagctgccgcctgcctgacttgggccctgccccttcctgtacctgtcctcaaggtcgcccccgcgctgcccatccccctccccctcctccttcctcggcagctcgtggcgctccagtccacagaggagaggacacgacacgacgaggggccgggcagcaagctctgctcagtccgttccgcgggccggtcggtcggcgatggcgcggcacgcgggcacggcgctcctggacctggtggcggggcaggtggacccgggcgcgccggggttctggcgcgacttcctggtcggcatgctcaagccggcggcggccacggccgtggtggccatggccgtcgggctcagcttctcgcagcgcctggggctcgagggcgagatgctctacgccatcgcacgcgccttcctccagctctccgccatcggcttcgtcctccagttcatcttcgcccagaagaacgcgctctggatcctcctcgcctacctcttcatggtgatgtatgtattcatggtatgtatgtatggtacctaggggtatggtacctgctgctcagcctccaaatctctctcttgcaggtgacggtcgccgggtacacggcggggcagcgcgccaggcaggtgccgcgcgggaagcgcatcgcctgcgtctccatcctcgtcggcaccgccgtcaccatgctcctgctcgtcctcctcgacgtcttccccttcaccccgcgctacatcatccccgtcgccggcatgatggtcggcaacgccatgaccgtcaccggcgtcaccatgaagaagctccgggaggacgtcaagatccagaggaacctggtggagacggcgctggcgctgggcgcgacgccgcggcaggcgacgctgcagcaggtgaagcggtcgctggtcatcgcgctgtccccggtgatcgacagcgccaagacggtggggctcatcgcgctgccgggcgccatgacggggctcatcatgggcggcgcgtcgccgctggaggccatccagctgcagatcgtcgtcatgaacatgctcatgggcgcctccaccgtcagcagcatcctctccacctacctctgctggccggccttcttcaccaaggccttccagctcgacgacagggtctttgcagactaagatacatgctggattgtaatgtaaccgagtcccagttgtttgagccttttgaggtagaaacagagctaagagctgtggctttcggtgccaaaaaaaaaaaaaaaatcttggggaggctctcgggcgggtatcgcgcgttggatccccatttgaccaaacagtttgtagataatggaaaaaatcaaaaatcatccgaccttggcctcaaatgagcctcaaatagcctcaaatgaggttaccgccaatttgaccaaacagttaggtgtgctttcaatacaaaaaggaactttacaaaagcgcttctaaaacttagttcaagtttgagtttgaaaagtatgtacaatgttcttagggaagggtttagatttcgaaaatagttttaaacgttagacgagctaagccatatgtttcgaattttagctcaaaaagggactctaaaagtttcatgctttgactttcaaaatttgattgaaagtagtttcaaagaatgatttaaaaaaaaaagagtttcctagatatgattgaaaaacaggagacatttatttttatacattaaaattagtttgtaaaaagttgaagaattttcaacttaagtagtttcgaagatagatggaaggatggttaaaaagcatgtggtataaaaaaataaaaaacaattaacatctcttaacacaaccggaatttggttatttgccgagtgtcaaatgtttttgccgagtgttttttttgacactcggcaaaaaaactatttgccaagtgttttatttttgacactcggtaaaaagcttttttgccaagtgtcaaatatataacattcggtaaagagcttctttgcagagtgttttttttcaacactaggcaaaagacagtttaaaaatcacattttaaagcagtaaattaactcaaataaaaagttttcaactacaaatttatataactcatcatgatgtataatttatattttgaatgtttctttatatgacaaaataaaagtaaatttgttcataaaacatatatatctctcgtagtttatgaaactacgagagagatgtattagatttgtgcatattgttagaaccatcatatgagatgaataaatgaccaaacaatcgaaataaactttgtagatcttaagaagttataaaattttgtagttcacaatcttttcatttgaagtcatcttgtcaactaaaactacgtctaaatttaaaaactttaaattttgaattttgaagtcatattgttagaaacgttgatgctgagttcttggggggaggctctcgggcgggtatcctgcattggatccggccatttgaccaaacagttaggagtgctttcaatacaaaaaggaactttacaaaagcgtttctaaaacttagttcaagtttgagtttgaaaagtatgtacaatgttcttagggaagggtttagtttccaaaatagtttaaata

SEQ ID NO: 11631 - DNA, 1342 bp, Zea mays
  misc_feature (334)..(334): n is a, c, g, or t
atacgcgctctcatctctggctggctcagaaaacagccgccaagcgcacacaccactctctcatcatgacctccatataggccccctacattctttgatcagtgatcactctcgctgggtctcaccccctcccgcagacggccaaacagaacccacgcgtgcgcgcgcgcccacgagcgagcgatgcctcccctccgccgcgcgcgctccatcctgctcctcctccactacgtggccgcctcccacctcctgctgcgcgccgccgcggccacattgccggaccccgcgccgctcgacccggcactggtcgcgaccccggtgcagcccgccgccnccgttccggggggcacgatcccggcgttccccgcgcagtcggactcgctggcgggttcctcgtccacgtgcccgctcgccccttccccggcgctcctcccggccgtgcgggcctcctgcgccgccgccgcggcgctgccgccgaggctgcgctgctgccccgcgctggccgcgtggctgttcgcggcctacgcgcccgccgcgctcgcggagcggccgcccgcgaggcctccggccgcggcggcggccgccgtggacatgccgctgccgcccgacgactccgaggcgtgcgcgggcgccgcggaccgcgcgcttcgtgcggcgggggcgacgctgccccgccccaccggcggcaataacgggacgtgcgacgtggcgttctgctactgcggggtcaggctgaggcggctgacgtgcggacccccgccggcagccgagggcgggctgtgggcgccggctgacgacgcggcggcgaggaggctggagagggactgcgcgcagccgggcgtccccggctgctccaaatgccttcttgctctgaccatgataaagaacactagtcccggcggtggcgccgccgcggaggcagcgagcaaggagaagcaggccgccgtccggtcgggcgagagtgaccgggactgcgagctcatggggctcatgtggctgctgcagcgcaacgccacgcgctacggagcgacggccacggccgtcatccaggcgctgatggccgtggacgaggcgtccgccgcgggtgtcgcggtggcggcagacgcggggccggccgcggcgtgctcgctgcccgtggacgacatgcccctcccggccgaatacgcgcaggtcggcggggccagcgacgcgcctcgcggcgtctgctgcttcttctgcctgctcgtgctgttctccgttctaagcttccgctccgtgtactcgctgtagcaattttgtggttcaattgaagttcgttatatgctcaaaaaaaaaaaaaaaaggggccgctcgccgatctaga

SEQ ID NO: 11632 - DNA, 2110 bp, Zea mays
acaatatttaaattattataggttgcatttgcgttattcctttgcctatggtattcagtcattttaagtgatttcatattatttaaatcattctatattatttttaacttattttagattatttaagttattttttaataatggattgcatatagcagagatagatgagacctattttagtctggagctttcttggtcaacaaacagcgcacttgaacttgtcctccttgtcctcctcgaaaacaccagccggcggccgactcgactcgactacttcattccgtcggccggcccgccaaaaaaaaacagcacgctctccctctccccgacggctgctagctagcgacaacagatcgacggcaacaccgatgggcgaggccaacgccacaggcacgccagccaccgcgacggtgcgcgtgctggccgtgtcgcgcgtcgcgccggcgccggcgccggcagcggcggaccccgtcgtcgtcaagctgtccttcttcgacacgccctgggtcgtgctgccgcccatccagcgggtgttcctgtacgagctgcctggtggcgacggtgagttcacggcggcagtgacgcgcctcaagagctccctcgccgccacgctggcggtgtacctgccgctggccgggaagctggcgtacgtcgccggcaccggggacgtggtcgtggactgcgtcgacgaccccggggtggccttcgtcgaggcggaggcggacgccggtatcgacaccatggacgtccgccggctggcgagcgacgaggcgcacgacatcccggcgttcctagcgctggtaccggagctccccaccaaggtgctcccggcgccggttctgtccgtgcaggccacgcggatccccggcggcggcctcgcgctcggcctctccgtgcaccacgccgtcgccgacggccaggccgtgtggaggttcatgggcgcctgggcctccgccgcccgcgacggatcccccgtcaccaagtccctccccgcgccgcactatagccgggaggccgtccacgtccccaacggcgacgagttcgcgcgccagatgctcaagatggtcgcgcccaacctgcccgcggtgcgctcgcactatagccatgcacggaacacctgctgcaccatttttctgtgcctcggtcacggaacctcttgcatgtgtgcatgcaggcgggcaccgttgcggcctacgacttcagccagcgcttccgcctggcgcgccggacgttctacctcggcggcgacgacatcagggcactgaagctccgcatctccgcgctcgccgaggccgaggccgaggccgaggacgacgtcgtcgccgacggcagaagcaagaagaagccggtgtcgacgttcgtggcgctgtcggcgctgggatggacgtcgttcgtgcggtgcaagggcctgggcgccggcgacgacacgtacctggtgttcctggcggacctgcgcgcgcgcatggacccgcccgtggcggacggctacctgggcaactgcatcaaggggtgcctggcgacggcggacgccggggacctgctgggcgagcgcggcctgctggtggcgtgccgcgcgatccaggcggcggtggcggagatggaggcggcgccgctggccggctcggagcggtggatccagaagatgatggggctgccgttcgcgcgcctcgccaacgtggcggccagcccgcggttccgcgtgtacgaggcgtccgacttcgggttcggccgccccgcgcgcgtggagctcgtgtccatgaacaacgacggcgagatggtgctcgtcggcggcaggggcgacggcgaggtgcagctgtccgtgtcgctggaccccgcgcgcatggaggacttcaaggcgcacgtcttcgccacctccgcggcgccgtcggactcggcggcggcggcggccaactgatcgatggaggcagaggcgtgtggtggacgagaggcatacggatcatgtgagcagattatgcatgtgtgcagctattgtcgatcgaacgaagtattttccacgaacaacaaaaaaaaaaccaagtatttttcagtttacgttggatatatatatatatatatacaattatatacaagaatctttcaattatttgtt

SEQ ID NO: 11633 - DNA, 1839 bp, Zea mays
attatccgcattgttcactcttgcgctcgagagccacggccaccacaacaccagcactaacaaatcccaaaaaaaaaagtctagccacagcccacagcacttcttctccacaacgaccccacagagggccagagcaagacatccgcaccgcatcgcatatacccagagctgtgatcgctgccattaattctcccctcataggcctccaacaaggtcgatggaggaacaacacatggctgggccgccgtaccgctaccggcttcggcatctccggctgatggacatagcacccgcaagcgcgagcaacgacgattcagggcatcacggctccaacgggatggccatcatggtgtcgatcctggtggtggtcatcgtctgcaccctcttctactgcgtctactgctggagatggaggaagcgcaacgctgtcaggagagcgcagatagagaggctgaggccgatgtccagctcggacctgccgctcatggacctgtcctccatccacgaggccaccaacagcttctccaaggagaacaagctcggcgaaggcggtttcgggcccgtctatcggggcgtgatgggcggcggcgcggagatcgccgtgaagcggctgtcggctcggtcgcggcagggcgcggcggagttccgcaacgaggtggagctgatcgccaagctgcagcaccggaacctggtccgcctgctgggatgctgcgtcgagagggacgagaagatgctcgtctacgagtacctccccaaccgaagcctcgactccttcctcttcgatagcaggaagagcgggcagctggactggaagacgaggcagagcatcgtcctggggatcgcccgcggcatgctgtacctgcacgaggactcgtgcctcaaggtcatccacagggacctcaaggccagcaacgtgctcctggacaacaggatgaaccctaagatctccgacttcggcatggccaagatcttcgaggaggagggcaacgagcctaacacgggccccgtggtcggcacctacgggtacatggctccggagtacgccatggagggcgtcttctcggtgaagtcagacgtcttcagcttcggggtgctggtgctagagatcctcagcgggcagcggaacggctccatgtacctccaggagcaccagcacaccctgattcaagatgcctggaagctgtggaacgaggacagggcggcggagttcatggacgcggcgctggcggggtcgtacccgcgggacgaggcgtggcggtgcttccacgtggggctgctgtgcgtgcaggagagcccggacctccggcccaccatgtccagcgtggtgctcatgctcatcagcgaccagacggcgcagcagatgccggcgccggcgcagccgccgctgttcgccagcaggctcggcaggaaggcgtccgcgtcggacttgtcgctggccatgaagacggagacgaccaagacgcagtccgtcaacgaggtgtccatctccatgatggagccacggtgagacgaggggggccttgcttgatcgtcaaccaacaagtgtccgtctccgtcccatccgcatgagaaacccttactcggggagccgtcgtgatttgcttggttctttgatcagcaacgggatacgctgtgcgtcgtcgtagtcggtgcgcgcgtgtatgtgtgtgatggttacggatgtcttgcgagccgtaatcgcgctgggaaagtcccaggccccagcctttgtcgcgggaaaaatcttgtagccgtgacatgtgcagcgagaaaaacgctttgagactagaacaaaaaaaaaaaaaaaaccacggtcgaggcaagaagatgagatgacac

SEQ ID NO: 11634 - DNA, 698 bp, Zea mays
cggcgggcggggccccccgcccccgtccacagatcggaggagagcactggcttgtatccctctctcgtctctccagcgacggcagcgggcgagggttacgcgaaggcgaagcggagtagtggaagcagaggcggcagccatggccgtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtggttgcaggtgtcaccggcaagaaaaagtagtgaacttgcattgttttctcatgccaatgttgccccacattttcttccccgtgttttttctggcgaccagattggaaggcttttcccaagagtcacggtcttgaactctagatggtatccgcggaataatcattgtacctgaatcatatactgcaatgtggcagttttgaaaatgtttcccctcctacaaaggttgatagaatgccataccctttgaactgtgttcgagatgtcaaaaaataggaattatagacagagccgggcccctttcgtttaaggtgccgttcggttgtttgggattggtgggtcggaacgattcctaaccggattgcttctttaatttatataaactttgattaggtag

SEQ ID NO: 11635 - DNA, 761 bp, Zea mays
atgtaaatgggctaggcgtcgaagcctctccgcataagacacgggcctacgtccagtcgtcgacagatcggaggagagagcactgactcgtctcccttctcgtctccagcgacggcgaaggcgaagcggaggagcgggagcagaaacagaagaggcagccatggccgtgatggagaagctcaagatcttcgttgtgaaggagcctgttgtcgcagcttcctgtctcatcgccggattcggtctctttcttccagcagttgtccggccaatcctggattcatgggagaccgcagaaaaagttcctccaccacctctaaatgatgtggttgcgggtgtcaccggcaagaaaaagtagtgaacttgcattgttttctcatgtcgatgctgtcccacattttcttccccatgtttttctggcgtccagattggaaggctctccaaagtcacggtctccaaagtgacagcttgcttgattttaaacagtatcgacagtgttttgtctctacacagattgcagatatagcggtttaaacagttcgctttaatccgaaacgaacaggctattttacctgaatcatatactgcaatgtgtcagttttagaattttccccctaaaacaaaggttgatagaatgtcatcagcaccttttgaattgtgttcttcgttaccaacttaccataattctcagaagctattaaggggtgattgtttcaacttaaaaaaggatattgcccgtgagaacagccaaaggccccctgcgc

SEQ ID NO: 11636 - DNA, 1042 bp, Zea mays
aagagcactggcttgtatccctctctcgtctctccagcgacggcagcgggcgagggttacgcgaaggcgaagcggagtagtggaagcagaggcggcagccatggccgtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtacgtgatttcctcttttttggttgttttatgtgtactattttcaaggacatataaatgataaacactgtttacattcaatttctcatcatttctaaatccagaatgtttatgttagcagccatgttcttgatgaaggtgatgaggagcacaggaaaccacagaacccagcaaccccctttggtttcccacgctcctcgtcggcatcagcaactattcgatcacatcccctatttcaaactttactcggtaaacagtgtaatatacaatacaaatcccctattttacacaatctgctgcggacagccttcataaataaattttctattcatattcaatggaaaaaaggactccctatttgtcacttcaagctagcctgtctaaaaaaaagtctcattttcataaaatgagctctaaatttgttagtggcaggtcagagtagattgccgggggcaggggcgaattcagagaggtttatcggggtcagccgaccccgataaattttataaatcctttagcaaaacaccgttaaagtttataaaaaggtgtatagtatagtaaagtttgaaataggggatgtgatcgaatagttgctgatgccgacgaggagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaaaaaaaaaaaaaaaa

SEQ ID NO: 11637 - DNA, 1041 bp, Zea mays
gataccattccatccccctctcctctctatcatcctcggcatccgtcccgctttgcccttgtttaattccaaaggtttcattttctgcagggataacatttgtggggggtggtgagccggccggccctatagaatcctgctcctgcgccaacgcctgcgcccgcccccttttcatgttgctttccctttcctcctcctcctcctcctcctcttcttcctcctcacctcacctcctatttagccgtccgaattgcttgtcagcatcttcccagcttcttcttcttcttccaaccgcgctactctctctcgtccccgttgctcggttggattcttcttctctcttcataggaaggaaggattggctaccgagatattcctactagggctgtagtgcagccagtaccagtaccagtaccagtaccccagcagccggtgaggagaggagacggagagagcgagcggaggagggccatggaaggcgacagcttctccggcggcgccatggcgaacggcggcggcggaggcggcggcggcgggcaggtggtggacgggaagctgatccacacgttccacaggagcttcgtgcaggtgcagagcctgctggaccagaaccggatgctcatcagcgagatcaaccagaaccacgagtcccgcgcgcccgacaacctcacccgcaacgtcggcctcatccgcgagctcaacaacaacatccgccgcgtcgtcggcctctacgccgacctctccgcctccttcgcgcgcaccatggaccacgcgtcctccgagggcgactcctccggcaccggcaccggccgcgccggcgccggcgccggccacaagcgcgtccgccccgcctagctagcttttagtttttttttgtcttcttctgctgggtctagcttggtgtggcaatcctaggtgttgccattgccactaggaggcgtatttagtctttttctcttgcggttcttcttgttcgccttcttcctttgtgctcgctagctgcgacgaacgccggtgattagtgtatggtaatttagtgac

SEQ ID NO: 11638 - DNA, 1560 bp, Zea mays
ataaaatgatttcttttatagagtgggcagtcgcaagtcgccgagccgtcctaacacagcgagagggtttcgaattggcgccaagccgccaaccatttcccccaatcccgcctgccagccctagggtttctgctacgccatggcgggaaccgccgccgccgctcccatggacatcgacgcagccgcgccgcctcccccgccgcctggtgcggcggccaagggcaaggcgccgctctccgctggcggcagggcagcgccctgggtcgagaagtaccggccccagtccctcgccgacgtcgccgcccaccgcgatatcgtcgacacaattgacaggcttacaaacgagaatagacttccacacttgttgctatatgggccacctggcactgggaaaacatcgacgattctggctgttgcgaggaagctatatgggtctcagtatagcaacatgatcctggagctcaatgcgtcagatgaacgtggcattgatgttgtcaggcagcagatccaggattttgctggggcacgcagcctctcttttggagcaaggccttctgttaagctggttctcttggatgaagcagacgcaatgacaaaggatgcacaatttgcattgagaagagttatcgagaagtatacaaggagcacaaggtttgcactcatatgcaaccatgtcaacaaaattatccctgcgctacaatcaaggtgcaccaggtttagatttgctccactagatggcagtcatgttagagagcgtcttcaacatataataaaatctgaggggctcagtgtagatgacggtggcttgacagccctagtgcggttaagcaatggtgatatgaggaaggctttgaatatattgcagtcaacgcacatggcatcccaacaaatcacagaagaagctgtctatctttgcacaggaaaccccatgccaaaagatattgagcagatagctttttggctattaaatgaaccattttcaaccagcttcaaatatatatctgacatgaagatgagaaaagggctggccttggttgatatcatacgggaggttactatgtttgtgttcaaaatacaaatgccatctgatgttcgtgtaaagctaatcaatgacttggctgatattgagtacagactaagctttgcatgcaacgataaactgcagctgggcgcactgatctcaactttcacggacactcgcacggctatggttgctgctgccagctaattccagtaatgtgaaggatgtttctgctgctccctctggaatctgaagatgaagcgcagctacattatggggtcaacatcttgcctgtagttagcaagctgaaaggtttggtgagggttgtcttagatcatctgtatgtctgctggacgtgatgtggtaactgcctggaacttgggagtactcgtatgactgaacgctgccaggcgttctcatgttatgcgtgtaagattctatccagtagtataaaccctagtgccgttctttgacgaagttacatattattgcaaatgccacgcagatttatggtgttaaaaataaaaaaaaaaaaaaaa

SEQ ID NO: 11639 - DNA, 4669 bp, Zea mays
  misc_feature (1123)..(1123): n is a, c, g, or t
aacgagcgccacactggtggcgtgggaagtgtggcgggcggcggcggcttaggcggccatccaaacatcccctagaccttaaccaaacattcctcccttctcgcttgtgtgtaacacccactccgtatttttcaccagcgccaccacggtaaagtgcacgctgttcctgcgggacattactacaaaaccaatcccccgtcttgcgaggtcgcgagtctctccaactccgtccctctggcctcagcacaacgccagaccgcctgcctgtgcttgcagccaggccggccagctgcctgcctgcctgttgtcgtctgcggcgcgacggcggccgcccggtcgaccgcccgcattgggatccccagagcagcgcttggcataggggaatgtcccgggtcagccaccgtcgcctctgcgctgcgaaagccccgcatttacttgccacctagaagggggcacccctcgcgagacccagcgccagacagagccagcaatggctgctgctgctgctcctcctcctcctatatagcggggcccgtgccgagcgctcgatccagttcttctgatctctgacttctgagcgaggagtggacgagtggtgtgccgtcgtccggttcccgttggtttggcgatgaggcgcgctcgcggtcgccgcgggctgctgcttctcctcggcgtggcgctctcggcggctgcgctgctccgtggctgcgcggggcagcaaggggaggacggctcggacgcccctgcggcggcggcggcggagacggcccccatggaggagaaggagcgcagggcgctgtacgccgccatcgagagcttcgtcggcaaggggtggaacggctccgggctctacccagacccctgcggctggtctcccatccaggcgcgtccctgcccttcctgcgctttccctttcgcatcgatctatgttaccgtgctgttcgattttctggcccgcgtatgttcgttcatcatgttcgttcttcagacgcgcgaagctttcctctttggttttttcggctttgcccgtcctcgtcacacgccctttctcggtgctcccctgctgcctgctttgagctccaatccaaaaaccgtttgcgagcgaaaggaggagcaagtcggnagcctccgaaatgaaattggtgccctgtttggggatgcaggacgcacgccaagtcgccaccaaatctcctgctgtaatttcccgtgttaaaaccttcctcgtctcgcttccagaatttctggccttccggtagcctctgctgtttttgtcttgtgttcgtccttcgtcgcactcgtgccctgcccctcccctgttgcttcgagattgtggcactgttttgctgtgcgccgctgcacattcagttcactgttggacgagacctctgcttgatccccttgtgtcttcgcatctcagccttttgctcgatatggtaggaggatctgatctcttgggcaggaactttccactcacatgaaaagaacctcccatgatttgaaatggcatgctccgcccaagatttttctcatacagtactactactctctagtatagattttagtagtaccttgacatcttcttccttttgctcgcgcccgagaaggaatcagtcctactactccataggagtttttgctctaacaattactggaatttaccgcatatttatcttccttcacacggtacactggaatttcattctggttgttacagtaccagtaaagttaagaaggggccaaatttgtactagggtgcacctttaagaaatgtcgccatcttggatcatcctcatccatgtctgttattactgctagtagttactgttgagcttgtgtttactttccgagtaggacactctcagattgcagcgtgcttgcctgcctgttaaaattaaggggattcaatttcagtggattgagcagatgtggttcttggatgccaaaaacctgtgcagggggtgtcatgtgatctcttcaatggcctgtggtacccaacagtgatgagcattggcccagtccttgacaactcgctgcagtgcggccccgacgccaagttcagcgcccagctgttcgacctgaggcgcctccggacgctgtctttctacagctgcttcccggcgagcaaccccacggccatcccgaccggcagctgggagaagctggcggggacgctggagacgctggagttccgcaccaacccgggcctgaacggcgccatcccggcgtccctcggccgcctggccagcctgcagtcgctggtgctcgtggagaacaacctgacggggcccgtgcccgcggagctgggcgcgctgtcgaggctgagacggctggtgctgtccgggaacgggctgtcggggccgatcccggtgacactcggtaacgaccgccgcgccgacgagctgctgctgatcgtggacctgagcaggaactatctaaccggctctctgccttcgtcgctaggtggcctcacggggctcctgaagatggacctgagcagcaacctgctgcagggcagcatcccgccggagctcgcggggctcaggagcctcacgctgctggacctcaggaacaacagcctcaccggcgggctgccccagttcgtgcagggcatggcgtcgctgcaggacctgctgctctcgaacaacccgctgggcggcggcctgccgcagtccggctggggggcgctggcgggcctggccacgctggacctgtccaacgtcggcctcgtgggcgccataccggggtccatggcggccctgacggggctccggttcctggcgctggaccacaaccgcctgacgggggccgtgccgcccgagctcgcccggctgcccagcatcggcgcgctgtacctgaacggcaacaacctgacggggacgctggagttctcggccgggttctaccagcgcatggggcggcggttcgcgtcgtgggacaaccccgggctgtgctacaacgtcgcggccgtggacgcggcccacgcgccgtcgggcgtggtggtgtgcaaggacctgcaggagcccagcgtgggcggcggcgcgcgggacggggacggggacggggacgcggaggaggacgggacgaagcccgaggcgggctccagcctcgtggcctcctcgtcgtccggcatgccggttggcagtgtcggtgggctccggtacctggtggtggttcggggaatggcggctgcggttcttgggttggtgtccctcctacaatagcaagcaagcaggttcagaagaagaacacggagaaacttgaagtaatgctaggtaggttagcacgaagtagtttctgcgcgttctctgtgatcttttggcatttgtttttggctgctggtggcttaccatcgtcagatggtgacggaggaaggagggaacatggatctggatggtgtgagccacagattacattacagtagtagagtaaactatgagagttcttgtggactgaaggtgtgtagtggtggatagggtagcttctccggggttcttttgtgtgtaattagcctgtgtcgccctgtggtgtcatgttacaacagcaagtggaaatctaagctggttcgtccgttgttggagaatcagaaaaaaaaaaaataaacgtgcttcattcacatcacatggatacacagtttcctgttcttggagcagaagaactggaaagatctctcgttatctctatttgctatagaaagaacatagcggcggtatctgcagacgatacaaatggaagaagagcgggcaagcagcacgacaggatggagcggcggcgccgccgcatatgtccggctgccgcctgccggcgatctcggtgtctcctgctgccttttgcctttgcgtgttctcgagtctgaaaataaaatcaaaaatatggaccgagacgctgattgcgcagggccccgcgctcgcagaggagtcagaaacagaaaggacctgtcaccttggaaagctggcggccggagcggagccctcacagacaggctgcgctctgcctctctggcactggcaggcggcagcggcagtagcgctagtcctctacaggtggaggctggactgcacctcgacgtgtaggaactgtagcgtcattgtggtactccggcgtctgtaccggtctactctacacttttccatcccagtacgctttgaaatatttacaaaaaataaatgtatttaatgatgatatcactagctctagttgtctttttttttattttatcttctcttaaaatacaacaagtacactattatagatatataatttatcactaacattatttattttgaaaacgagggagcaccggagcagtactctgtactcctagtgctacgcaatggcgcggtggcaccacgcaccaggcaccagcctgcgggtgcaggtataggcgtgctagcacctagcagtatggggttgggctgcacgtcgcagtactagcgcgtagaagcaatcgatgctctcgccgaaaaacaaaggcacaggatcagtggcacagctcgtaatacaattgtcgtttcctccaaatgattttggatttagttaaattataagaaatgctaacagttagcaagctgtttacttggctttaatccaaaatgacctcaactgtttatacagtattttgtctctatatattgcagttgcagtaattcgaacaactggttttaatccgaag

SEQ ID NO: 11640 - DNA, 1935 bp, Zea mays
gcacgagaccattacctagaacatcctaatcaaaaacgttcaagttcttctgatctctgacttctgagcgaggagtggacgagtggtgtgccgtcgtccggttcccgttggtttggcgatgaggcgcgctcgcggtcgccgcgggctgctgcttctcctcggcgtggcgctctcggcggctgcgctgctccgtggctgcgcggggcagcaaggggaggacggctcggacgcccctgcggcggcggcggcggagacggcccccatggaggagaaggagcgcagggcgctgtacgccgccatcgagagcttcgtcggcaaggggtggaacggctccgggctctacccagacccctgcggctggtctcccatccagggggtgtcatgtgatctcttcaatggcctgtggtacccaacagtgatgagcattggcccagtccttgacaactcgctgcagtgcggccccgacgccaagttcagcgcccagctgttcgacctgaggcgcctccggacgctgtctttctacagctgcttcccggcgagcaaccccacggccatcccgaccggcagctgggagaagctggcggggacgctggagacgctggagttccgcaccaacccgggcctgaacggcgccatcccggcgtccctcggccgcctggccagcctgcagtcgctggtgctcgtggagaacaacctgacggggcccgtgcccgcggagctgggcgcgctgtcgaggctgagacggctggtgctgtccgggaacgggctgtcggggccgatcccggtgacactcggtggcctcacggggctcctgaagatggacctgagcagcaacctgctgcagggcagcatcccgccggagctcgcggggctcaggagcctcacgctgctggacctcaggaacaacagcctcaccggcgggctgcccccagttcgtgcagggcatggcgtcgctgcaggacctgctgctctcgaacaacccgctgggcggcggcctgccgcagtccggctggggggcgctggcgggcctggccacgctggacctgtccaacgtcggcctcgtgggcgccataccggggtccatggcggccctgacggggctccggttcctggcgctggaccacaaccgcctgacgggggccgtgccgcccgagctcgcccggctgcccagcatcggcgcgctgtacctgaacggcaacaacctgacggggacgctggagttctcggccgggttctaccagcgcatggggcggcggttcgcgtcgtgggacaaccccgggctgtgctacaacgtcgcggccgtggacgcggcccacgcgccgtcgggcgtggtggtgtgcaaggacctgcaggagcccagcgtgggcggcggcgcgcgggacggggacggggacggggacgcggaggaggacgggacgaagcccgaggcgggctccatcctcgtggcctcctcgtcgtccggcatgccggttggcagtgtcggtgggctcgggtacctggtggtggttcggggaatggcggctgcggttcttgggttggtgtccctcctacaatagcaagcaagcaggttcagaagaagaacacggagaaacttgaagtaatgctaggtaggttagcacgaagtagtttctgcgcgttctctgtgatcttttggcatttgtttttggctgctggtggcttaccatcgtcagatggtgacggaggaaggagggaacatggatctggatggtgtgagccacagattacattacagtagtagagtaaactatgagagttcttgtggactgaaggtgtgtagtggtggatagggtagcttctccggggttcttttgtgtgtaattagcctgtgtcgccctgtggtgtcatgttacaacagcaagtggaaatctaagctggttcgtccgttgttggagaatcagaaaaaaaaaaaaaaaa

SEQ ID NO: 11641 - DNA, 1116 bp, Zea mays
ctcgcgcccgcccggcggcccatttacctgcacacgtccatacccagtaagtgagacttgtcgtccattctgaagtccggcggcggcggcagcggcgagggcgaggcctctgcgacttccagatctccccgacgaggaggaagtctctacagcggaggggagggagatgtcgtacatgcggggtgacctgctgacgaggatgcggaagctggtgaagggcctcgccaggcccgagccccggtggctcaaggccttggaacgggctccgccagtgacatttcctcgcccagaggggaagatcaagactctggtgcttcctgaggatgtgtatgtcacgaagttcaacagaatacatccagattcgctttaccatgatgcaatcaagataagtggatttgatccaccgccagctcgagtgtttgcttggcgtgtcctggagttgaaagagcaaggagtcgatgaagatgttgcaatggctgtagcagataacgagtaccggacagagaagaaggcaaagaagaaagcgtacaaggagctgaaagaaatcgcccgcagcgaagggaggaagccacctccgaatccatacccgagtgccataaaggaaatacaagcggaggaaaagaagtatgtcatggaccgtttgcataacccgaaggtaatcgagattgcgaacaagatgaaggaggagcgagacaggatgttgagggatagagcagcaggtcagcggtagtcgtagcagcaggtaatgtttggactggccgactgggtgttgtcgtttacgacatgggccaactggcgtcataaataatggttgttggagattgatatggcaaatatgaaactcgtgtttttgttattcgtatttctgggatttagatggcctctggaatgcaatgttgattgggatgtgtttttgccagcaagctggtaaattgagacgtgttttgcttgctccaggaagttctgcttatagctggtacaaggctagaccgaatcagcagttgcattgtgatatgttagcagaatgccagttccccttctattcgccccttgcatgttaatttctgcctatccctgtgatgagcgttttagtaatctgagtgagtgatcattcag

SEQ ID NO: 11642 - DNA, 1494 bp, Zea mays
aaaaagggtcatccgagttgccagccaattttgcatccccaccaccaatccaccaccccacacccagtgacagagacagaaggccgggcagggctacgcgacgcgacggagatggagcacacgaatcatcgccgccgccgtcaagctttggccaccgtgtcggcgacgacgacgctcctgctgcttctcctctgcctcgcggcgttgacgacggcagaggcgctgcgcgagcacagggacgagggcggcgctagcagcagtggcggaagcggaagcggctgcggcagcaacgccgccggcggcaagcaatcgccggccgtgtgggtgttcggggactcgtacgcggacacggggaacctgggcgacctcgggcgggagctgacccgcgagtggtacgacccgtacgggaccaccttccccggccggcccgccggccgcttctccgacggccgcgtcctcaccgacttcatagcctccgcgatgggagtgccaacgccggtggcgtacaagctgcgcaggggcgccgcgcgcgggctcgtggcgcgcggcatgaacttcgccgtcggcggcgcgggcgtgctggacaccggcaacttccagcgcaacatcggcgagcagatcgacctgttccaggcgcagcgcccgccgccgccgtcgccctccgcccgcggctgcgacgccggggtcgccgtcgtcgtcgtctccggcaacgactactcctacgccgccgacaaggacaacagcacaagcgccgcgatcgcctacatcccagcggtggtgcggcagctccgggagcagctgcggcggctgcgcgacgaggcgggcatgcgcaaggtggtggtcaccaacctgcaccccatggggtgcacgccgctcttcacccgcgctctcaactacacggcctgcgacccgctggccaacgccggcgccgcgcagcacaacgcggcgctccagtccgtgctcgccgcgctcgacccggccaaccgtaccttcctcctcctcgacctcaacacgcccttcgccgccttagtcgacggcgcggcggcggcgacggcggaggagaggttcgcggagccgaggcggccgtgctgcgagagcttcagcgccgacggccactgcgggcagcaggacgacagcggcaggcggcagtacacgctgtgtagcgacccgagcaagcatttttactgggacgacgtccacccgacgcaggccgcgtgggccgccgtctcccgaacgttcaggcccatgattcaagagttccttctgtctacctgatcacagctttgtttcgatcagatgagataaaaactagcactacttatcaaaagaaccaatcaatcaagggtggagagctaaccgagttgttggattagtgaaattctcctgtcattgttactctaaaaatggctggattttttgtattaaaaaaaatccacggtgcgagatgttggaataaaaaagcgatcttcagttcagtgaaaaaaaaaaaaaaaa

SEQ ID NO: 11643 - DNA, 1765 bp, Zea mays
tgcggccgatcgaggccggccgggcttgcgatgcgatcataccagcactaaagcatcgcatcccatcagatctccgaagttaagcgtgcttgggcgagagtagtactaggttgggcgaccgccggcccggtcccggagctctcacccatccacgtcttctcattcctcgacaatggagatccaggcacgacagctactggtgtctgtttttggcattctgatagcgataggtttcgccaatgccgcgctgggagagacagcaccgccggttgttgtcggcttggccaagtgctcggactgcgccaggaggaacatgaacgccgaggcagctttcagaggtcttcaggtggccatcaagtgcaagaacagcaagggggcctacgagagcgcagccgtgggacaggtgaacaagtccggggccttcagcgtcccgctggccgccgacgccgtcggcgaggacggggagctcaagtcggaatgcttcgcgcagctcatccacagcgcgtcgagtgcgccgtgccccgggcaggagccctccaggatcgtcgccgcgccacccggccacacggcccacaccaacggcaacgggaagacgttcctcgcgctcggcggcagggtctaccaaccgtcgcccgagtgcgcctcggcgttcctctgccaccctttcttccacagcatgcaccaccatcacgtaggagtccacacgcctgtggttatcccgcacctgcccgttcacggccactccgtgccgcctgtcaccaagccgccgccggtagacgttcctgagcacaaaccggcgccggtgcccgtgccggaccacaagcctccgtcgacgccgccggtagacgctcctgagcacaaaccggcgccggtgcccgagccggagcacaagcctccgtcgacgccggcgaacgctgcaccgtcgacgcccacggagccgtcagcgccggttaattcgccgccgaagccagcccccatctaccacccaccggcaaggcacgacgctgccactggcccgtagctcttcaagaggctgctcccgttcttcaagaagttgcccttctttcctccttctgcgatggagagtcagcactagaatgtttggacagtgtttcttggcttttgcaggttatgcagtttcctcggaataatttgtgacgttgattagttcagcatgaacgttgggtcagtttaagagtgtgtgttctacttccgtctaatggaggcaatttcatgtcaactgttttatctagcacgcctgggaaccgatgtagacgccaaacatcgggagatgaactggcggtactctttgcggagacgcgaacggtccgtggtacaggaccggacggtccgcgacctgtacgcgggagcgcctcctctgcgtacgtccggacggtccgtgtctgggactcggacggtccgtgatagcatagaggattgtattcttcacaacagacctagaagcctcccagtagggatccagtaggagagatcttagagtgtgtcttagagtcggcacactacccaagacgcctctagtcaacatagagtcgaatgtgggtgaagatttgaagcagagaaaagctaaactaaggctactcctaatgcataaggtaaaaacgataagtagaattgattggatcgattacgagggctcaatcgaccgtggcccttcatctatataaagggaggaggcctggacccgttagagcatctccaacaatgcctcaaattagtgtctcaatttgaaatatagggctctacg

SEQ ID NO: 11644 - DNA, 4319 bp, Zea mays
ctccactccacttgctctggagtatcccgcccggagtcctctccttgctctgccattgttctggtgaaccacaccaccttcccaacaaatccgagctattagctaaagcaatacccgcaccaccatcgccattgccgacccctcctcttcttaacctccatgcatgctgcatgccacggcttcacctcacctccaccgccatggccggcaccaatggcgcccctcgccttctccgcctccctaccactgccactaccagtaccagctcgacgccactgctgcgactactagcgctactgcagctactatccctcgcctcggcgcttaaccaagacggcatactgctgctgtccttcaagcaatccctcgcctccgaccccctcggctccctctccggctgggggtacgccgacgccacgccctgcgcgtggaacggcgtcgtctgctcgccggactcgcgagtcgtcagcgtcgtcctgcccaacgcgcagctcgtcggccccgtcgccagggagctcgccctcatcgagaacctccgccacctcgacctctccggcaacgcgctcagcgggaccatcccgcccgatctgctccgcgcgccggagctccgcgtgctctcgctcgctggcaacggcattaccggcggcctgccggagcaggtcggccagctgcgcagcctccgcgcgctcaacctagccggcaacgctctctccggggccgtcccgcagaacctcaccctgctgcccaacctcaccgctgtctcgctcgccaacaacttcttctccggcacgctcccccgcgggggcttcccggcgctgcaggtgctcgacgtcagcgccaacctgctgaacggcaccctgccgtcggacttcggcggcgccgcgcttcggtacgtcaacctgtcctccaacggcatcgccggcgccataccgtcggacatggcctcgcgtctgccggccaatgtcaccatcgacctgtcctacaacaacctcaccggcgccatcccgtcggtgccgccgttctcggcgcagaggcccacggcgttcgagggcaacgccgagctctgtggaaggcccctcgacagcctctgcggcttcacgtcctcctcctctgctgccgcggagccccagcccccgaacgctaccgcgaagtcgccgccggccatcgcggcgatacccagggaccctaccgaggcgcttcctggcgatggttccagcagtgccgcaggcgcgtcggcgtccggggagcagcgcggcaggatgcggcttgctaccatcgtcgccatcgccgccggtgacgtggctggcatcgccgtcctgttcgttgtggtcatgtacgtttaccaggtgaggaggaagaggcagcgtcaggaggtggcggcaaagcagaggacgggcgtcgtgttcaagaagccggatcccgacgactctccggacgctgtcagccggagcctttcctgctgcctgcgcaagaaggccggcgacgacagcgactactcggaggaagtcacggacacgtcgccggcctccttcgcagatcacaagaacggcaaggcggccggagctgaagcggcgagcaataagaagatgggcggggacggcgcggtgctagtgacggtggacggcggcgcggagctggagctggagacgctgctgaaggcctcggcgtacatccttggcgccgccggcagcagcatcgtgtacaaggccgttctggccgacggcgcggcgctggcggtgcgccggatcggcagcgagtgttcgggggtccggcgcttcggcgagctggacgcgcacatgcgcgccgtggcgaagctgcggcacgacaacatcctccgcctgcgcggcttctactcgggccctgacgagatgctcatcatccacggcttcgccatcaacggcaatctcgccaaccactccgttaaaagtacgttatctaatctattcggaattcggtccatcatcatcacccaccccgggccgttgcccaaaatgacaataaatggccgcatgcagggaagcaggggtcgtcgccgatcaacctcgggtggagcgcgcggctccgcatcgcgcgcggcgtggcgagaggcctggcgtacctccacgacaagaagtgggtgcacggcaacgtgaagccaagcaacatcctgctggacgcggacatggagccgctgctggcggacctcggcgtggaccggctggtccgcagcgcggacggcggcgggctgacgaagccgtcgtcggcggcgctggcgggtcggttcggcgggagcaaacgttcggccaagagcctccccgacctgtcgccgccgcccagccacgtaggcggcacggccgcgcaaccggcgagcccggccgtcgacacggcggcgcactaccgggcgccggaggccgtgaggagccccagggcgagcggcaagtgggacgtgtactcgttcggcgtgctcctgctggagctggtggccgggcgcgcgctgacgagcctggagctgtgccagtgcgctgcggcggaggggaaggcgcaggcgcaggcgctcggggtggtggaccccacgctgcgccgcgaggtggaagggcgggaggaggaggaggaagcggtggcgagctgcctccggctgggcgccgcgtgctgcgccatggtgccgagcaagaggccgtccatcagggacgcgctgcaggccgtggagaggatgatacctgctgcggttgcttcgtcgtcaacatccacggcagcatcacaccgtcattgaaaaaatagaagaagaaaggacacgtcttgcgtcgaaaaaattgcttgccatggatgcatgcatgcttgtagcttctcgtctctgtaccataccatcgtcattcacggttttgtaagtaccagctccgatcctgaaaggaattggtttgcatggttgcattgcatctcactcggattttggaggcgattcttctagttcatacagcaatggccccctcatcgatcaatcctgcctgcaaatacgcccccaatgcgacaaatgttatcttcagtcttgcagtataaacaattatgggaggcaaggcaacacatgaaggcgtcagagcgccccgccggccggccggccggcccgtgatatggattcctcttggagcgcggcaaggcggaaggctccaaataggtgtccggggtgcttgacatggcatggatgcgtttggcgccaaccccacccgcaaggcaacaaaacatacatctgctgtctgctgcccaccacaccactccctcctctactctgtacgggagatgccaccctttcatatcatacacttttatatattttacatgtcccggatatgttccggacttccggtgtgtgtacgtgcagtaagccagtaacatccttttttacaaccaactttgcatagtaaagaaaacgctgcagctttataagcaagcaaagttgcgtgcatgcgtggcccaaagctaaaactatcgattccgtcaccacacagcactgacagaatgcagctaatgatgaggtggttctgctactctatatatctattatcagcttgcaccacatcagcatcgatccagttaccgactcctattaaggtacttttggttcaccaaatataactaaataataatagtaataattggcactcgagtattaacaacgagtttaaataagccaatattattatttgattacggttggatttaaacaaacatgatttaacattattaattattcattacgttacaaatatgttaaccaaacaacacccaacaaacttttaattaatataaaacatatgttttattaaataaaaatatatttgattacataaataagtaaataaaattatataattcataaaaaataattaaaaatatataacataaatatgaaaataaagctatataattcacgaatatatatgataaactagtactcttctttgtattactcttgcacctcttttctggtttatttctcctccaatttaagttgcttcatcaactttttaaggtcaatctataagcccttttcatgtctttgtccaagtcgatgatagaacaacccaacaatttgttagattgttcaaacaatttagtttaagaaagcccctcactagccttttagagcttctttaacatgtctttctatgtagatagagactagctcctacttgatgttgggctcttctacttctgttgagctcttaccctatcatggacaatagggcattgtgcgcccacactttcctatgacaccgagttatgatcgttgtccaagttgaaatgggatctttagctctcatcactcaaggcatcaatattgtgct

SEQ ID NO: 11645 - DNA, 3493 bp, Zea mays
cgctcgccttctcagctccttgctattgctaccagctcgttgcctctgctgcaactattagtgctactacagctactatgcctcgcctcggcgcttaatcaagacggcacactgctgctgtccttcaagctatcgctcgtctctgaccccctcgcctccctctccggctgggggtacgccgacgccacgccctgcggatggaacggtgtcgtctgttcgccggactcgcgagtcgtcagcgtcgtcctacccaacgcgcagctcgtcggccccgttgccagggagcttggcctcatcgagcacctccgccaccttgacctctccggcaacgcgctcaacggaaccattccgtccgacctgctccgcgcgccggagctccgcgtgctctcgcttgctggcaatggcattaccggcgaccttccggaggaggtcggccagctgcgcagcctccgcgcgctcaacctagctggcaacgcgctctccggcaccgttccgcagaacattaccctgctccccaacctcaccgccgtctcgctcgccagcaacttcttctccggcgcgctccccggcggggctttcccggcgctgcaggtgctcgacgtcagcgccaaccagctgaacggcactctgccgtcggacttcggcggtgccgcgcttcgctacgtcaacctctcgtccaaccgcatcgccggcgccataccgccggagatggcgtcgcatctgccggccaatgtcaccatcgacgtgtcctacaacaacctcactggcgccatcccggcgttgccgccgttctcagcgcagaagcccacggcgttagtgggcaacgccgagctgtgcggaaggccgctggacagcctatgcggcttcacgtcctcctctgccgtggaacccccgaacggtaccgcaaagtcgccgccggccatcgcggcgatacccagggacccgacggaggcgatccctggcgatggtaccggcagtgtcactggagcgtcggcatccggagggcagcgcggcaggatgcggcttgccactatcgtcgccatcgccgccggcgatgtggctggtatcgccatcctattcgtggtggtcctgtacgtgtaccaggtgaggaggaggaggcagcgtcaggaggtggcgaagcagaggatgggcgtcgtgttcaagaagcccgagccggacgagtctccggacgcagtcggccggagcctttcctgctgcctgcgcaagaaggccagcgacggcgcggaggaagtcacagacacgtcggcctccttcgccgccaaggagggcaacacagacaggaacagcaaggcgggagttgacgccgcagcgtgcaagaagaagggcggtgacggcgcggtgctggtgacggtggacggcggcccggagctggagctggaaacgctactgaaggcctcggcgtatatccttggcgcggccggcaggagcatcgtgtacaaggccgttctggccgatagcgcgcccctggcggtgcgccggatcggcagcgactgcgccggcattcggcgtttcagcgagctggacgcgcagatgcgcggcgtggcgaagctgcggcacaacaacatcctccggctgcgcggcttctactggggacctgacgagatgctcatcatccacgagttcgctgtcaacggcaatctcgccaacctctccgtcaaaagtacgttattatctactgtactaattaatcaatcccatcatcatgcccgttggccaaaatgctagttggctaataatactaatccaccccatcatcatcaattcatcatcgatccgcagggaagccagggtcgtcaccgatcaacctcgggtggagcgctcgtgtccgcatcgcgcgcggcgtggcgagaggcctcgcgtacctccacgataagaagtgggtgcacggcaacgtgaagccaagcaacatcctactgaacgcagacatggagccgctgctagccgacctcggagtggaccggctgatccgccgcgcggacggcgggttgatgaggccgtcggcggcggcagttcggttcgggagcaagcgttcggccaagagcctcccggatctgtcgccgccgcgcagccacgtaggcaccgcgccgtcagcgagcccggtcgccggcgctcccgccgacactgcggcgcactaccgggcgccggaggccgtgagaagcaccaaggcgagcggcaagtgggacgtgtactcgttcggcgtgctgctgctggagctggttgccgggcgcgcgctgacgagcctggagctatgccagtgcgcagcggaggatatggcgcaggcgctccgggtggtggatcccgcgctgcgcggcgagatggaagggcgggaggaggcggtggcgagctgcctccggctgagcgccgcctgctgcgccatggcgccgagcaagaggccgtccatcaaggacgcgctgcaggccatggagaggatacctgcagcggccgaggcttccgcctcgtcgtcctcaatatccacggcagcgcagagtcatgactcatgagtgaagggggaaaaaaacgtcttgcattgccgttggtgcggttgtggttcgtgcagtcaaaaattttattttctaggaaccaggatgcatgcttagcataccaccatcgatcaatcgtgcgccattatagtactatagtagtactagaaattatacggctccttgcgacaaatgttgtcatcagtcttgctctaaacatggttcgagcgcccgtcatggatggattcccctacgagcgcgggaatgtggaaagattcctcctcgagcgcgggaatagggaaagccaagtggtaggctccaaattctgttggtatgggtctgcagatcacgaatgtgagggaatgtaatcgaatgagtttgtattacaaataattttttaaaggttatttgcttcaaattaaagctggagcgagctgtaatttatagagacaaaaatactcagtagaacagatacggtttaaaggcaagctaacaggttgtaaattctccccctcctaggtacgacagatgccattatttcatatgacacacctccttgcatttcaccatataccataccaagtaggtatggttgtagcctagtatattgctggatttggacaatgatgaggtcgattcggagattattatggtaggattgtattattaggctatccgcagtagatcatgtaaaatataagatttgtattatagatgatactgtttgtagagtgaagtttttaatataggacaagataggggatgagatatgagaggttggagagctgttggagacagccttacccagtaacggtccaaatagagagtgagttctacgtagaaatttcttactacatgctactaaggccacgtttgtttctcttgctaaagtttagctactaaggatatctccagtagatcccatatctgatccctttatttcaaacttcactatgcaaacaatgtcaaacagtgtcatctatagttccgca

SEQ ID NO: 11646 - DNA, 3884 bp, Zea mays
  misc_feature (1335)..(1335): n is a, c, g, or t
cgatcgccttcacagttgacatctccgcgtgcaggcgagtcaacagataggctcggtctggtggcacaatggaccgatctggtgcccgccagatgaagaaggcacacaattagatctagattgggggcacatggacctaatccggtgcgccgcaaacgacctaaatctacatttttacaaggaggcaacgactccttagcgtcatggggctataaatagagcccccctaggcgcctcaaaccagtacctaagtactctaagagcacaacaacacttcgacactttgcagtatagcgttctaagaccaactccagcagactccctctccgtatccctaaaacgcgtggccaacacattctctctcctctccgtctccgtttccagcaacactccccatcccactccgcatgcagtctatgacacctggggcccgcgagcagccgcgcgcgcacgcagagagctgcggagagaagagagaaagcgtggaaatggggagtgcagggacacggcgtctattttgcggagacggatgcggagcctgctggagagcgcaatagtgcctcagaccgtgcaaaatgcggatgcggagtgggatggggagtgttgctggagttggtctaatgatttagtgagatttaagtgacaatactgagctgttcttgtgtctttgtgcaatcgtgatgttccttcttgcgtgtgttgctgtgatttgctcttgtatgcgtactttttttctctccactttactattttgtaaggctgtaagagactccagtttgtggagattccttgcaaaccggaacacacttgttataaggaagtattgtggcactcaagtttgatgtacatgatcacttgaaaggggctgagtgcaacccttgtccaaaagagtacaccacaacgtggatgtaggatttgttgaaccatgggataaaaatcatatgtctcacttgtcttttactttcttgcgatttgtcttcttcccaagttctctgcgaacataaggttgatttgtctcttatggttcggcccgatgatgagtgattatcaatgggtagcgtctcagatcgacccgatgactgaccgaggtgtgagattatgtatgcgcaatcatgtcagtcggcttgtggtgtgcagacagggtggagggccccattgtggcctattatgtcccatgccatatcgtgtcttgtaatctgctacaattaatccgaaggagggtggttggttccaccataggttttggttggtcgtcacctagtttcgcagtggggttgacctccgcgcttctatggaccttccctaggatatgggtgaaaacgggacgaatacagncggatataaagtcatcatcctgtatcctaccgggcaaggtgagaggaaggggagaggtttttttgtttttatattaaaaccctaacgagcgcttaataatgggtctaaacgttttctatttttttaatgggttaaatgagactaaatttaaatacgttgtgtattagattactcattttctcatattatatatatttatatatttaaatttttaaaatttggattgaaattttaaaataaaccggtggtgacggctttgacctagtgcggtgagtggcgccaggctggcacccggcacccatcgtgccacgcgccacactcgtattggcagacccccacaggcacctcgtcctcctgtccagcggccccctgcggagtgcggacgacgcagtctgcggtcgtccaagccgacgccgacccaggcagatacgaccgggccccctgacgccttgcgcggcccgtcggccgcctccaccagtcggcgcctcgcccgcacgcaccttcccgccgcgccaagggacaacgggaacggggagctttgccctttcggcggaaccagactggtccgcggggccccagcgtgtctggacgccccgcacgctggcctgacatttattatttttacctcaacttcccttggaaaaccgaggcgcgcgaggttcgccgcgccggcgtccgggaggaaaaaggtgaagcagaggaggaaatatcggcgacgccggcgtgttggagcgtgacgtgactcaatgacgctccccctccattgaggtcagtcaggtcgcgccgcgcactcagttcgcagtggacctgagacgtggctcgtggctcgtggccagcagacggcggcacaatcgatgcggacggtgggattttctttttgtagtttggttgtgaaaaaacaaactattagtactccctcggcctacctagcgcagtggtcgacttgtatgtagccccctcgtgcccacccaccaaccacgaacgcatacgttatccctcggccgacatgcatcatcgaggagccacgaagtggagaattaggactgctccactgccaccttcttttacccctatattcatactctacaaatagaaaattaaacatacgggcagaggaggacgggggctggagtaggcaatttcgctcgctccttccgagcggacccgtcggcatcgggcgttgtccgtccctacgatcccgtcgcgcaacgccggccgaacggatgcacagatctgcagcagcgagactttccaaaccacgcgaccgtatcgaagggtgatgacgacgacgacgacgtctcgattactcaaacacaagcagtgaacccgcggcgccgtttcctgccaccgcgcacgtgccaccgcttttgacgctttcccggttcccgaggcccgtcgcgatccgagaaaaagcgcggggaacccgggtggcccgtttgcctatcgcaccggcaccagcccacctccagctccccctccgcctccctcccagcccccaggctcttctttataaaccccgccccctcctccgctctcggcctccaccacaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgccgccgagggctcgtgggtgcccgaccccgtcacgggccactaccgccccgccaactgggccgccgccgtcgaccccgccgacctccgcgccgcgcacctcgcccgcacctacgcccgggcctgagcggccccggctcccttcaccctgctccgcctcgtctcgtatgacatacgcgcaccgtaccagggtgagacgaggtgggggctgggggttcgtgtggcgaacggcgtgttgagccacgcgcgcgtgcggccgcgctctgcgacgcccggaacgttcttgggagagcgcgagcgaggtcttctgtcttctcggtgcgggtcgctgtgccatgagatgtgacgctgggtcgttttgggtccgaccaacgggagaagagcggcctgtggtcggtggtcgccgccgtgtgtgggctggatggcctgctctcttgtgctcctcctatatatcagatgtacttcctccgaggagcagggtttcgccctttcgctaccttttcgtactcgctagtcgctacagctacagctagtacgtactatactatactaataaaagctacagtttcttccggtaataaaaaaaaaaatcacgtcatctcgattacgtggtgaacttgtatgcagtatgctgtatttttttcatcggacaaaatatatctttttttattgaacaaaaaaaaaaaaaaacaaaaaaaaaaaaaaaaaaggccccta

SEQ ID NO: 11647 - DNA, 1361 bp, Zea mays
gtgcggcgctcgaggcggcaatcacatttccatctccttcacccctcgcgcctttgacccctctcccttgctcctcgaggacgcgcgcccatcactcagccaccgccgccgccggagtgatggattcccgcggattcgattccgccggccgcatcttctccagtgccacagagatgtggacggaagagctcggttccagcatcacggcttccaccgcgggggaagctgaattcaccccggcccccgccgccgccgccgaagccagcgaggaagggggcggagacggaaaacgcaaggagtggtactccaaggctatcgcctactggcaaggcgtggaggcgtcgaccgagggggtcctgggaggttatgggtgtgtgaacgacgcggatgtcaagggcagcgacgccttcctccgccctctcctcgcagatcggttcggcaccgcgaagcgtcatctggttgcgcttgactgtggctcgggtattggacgcgtcacaaagaattttcttcttggtcatttcaacgaggtagatcttgttgagccagtatctcattttcttgaagcagcacgggaaaatcttactggatgtatggaccaaggagaagactcacacaaggctgccaacttttactgtgtgcctcttcaggacttcactcctgaggaaggaagatatgatgtgatttggattcagtggtgcatagggcaacttcctgatgatgatttcatttcattttttaatcgtgccaaggtcgggctcaaacctgatggtttttttgttctgaaagagaacattgcaagaaatgggtttgtgttagataaggtggataacagtgtcactagatcagacgcatactttagggacctatttaaaaggtgtggattatatatccttagtgttaaggaccaaaaggaactcccgaaggaactatttgctgtcaaaatgtatgcactggtgaccagtcaaccaaaaatccagaatagtggaaagagaagacggcctagaaattcacctcgtatgatccgctcttgaagaatgcccggtactaggtggccattgagctgctgggcctgtctggtcatgtattgccactggattgtgctaaaagttgctgggacatcagtttttgcggtgattgttttgtttctatacattttatttctttacaagcacaaatttcttttgggtgagcacgttcacattattctgagatgaatatgctgaagttctgaattgggatgattgagatgtgttttcccgtcccatctcgtaacatgtctaaatgtaatgaactatcgcagaacagcgcttatatcgtgagaaataaacatgcgattggtggatagaaaaaaaaaaaaaaaa

SEQ ID NO: 11648 - DNA, 1359 bp, Zea mays
ccccgcgtccgccccgcgtccgacacacacaccttccaccgggcttggctttaaagctgtacttactatttatttctccctccccccacaaacctcatctcttctctcccgccgcgcgccactgaaaaaaacaaaacaaaagaagagaaaaaaccctccatgtgttccatatttccttcgcattcagtcatcggcgtatcgtcgcaggcgcaggctgctggcggcggcggcggcgggtttcagagcccagagagcagagccagcagcatgagcagcggcagcggcggcggcggctctctgccctccccttccggcggacctgcctgctccagatcatggtccatcagcgaggactcgctgcggaggtacgtgggctacgcgagcgagagctgcatccaggagctgctggcggcgtcgtcggactccggccgcggcggcgacgacgacgacgggtggaaggtgctggtgtaccacaacggcgtcgagatatccaagcggcggacggggccggcgcacgtcttccggagcaggtggctgctgcaggacgtctcgccggagcagttcatggccgccgccagcgccgtcgacgcagccaagcagtgggagtcggaccagctggtggagtcttcgtacatcagggagctcggcgacgacctgagcatcatccacctcaagttcggcgacgcctcctcctccaccaggaggcccgcccggcgccgtgacctggtcgtctatgagcggcgccaggccatggacgacggcacgctggtggtcgcggtggcctcgctgcccaaggagatcgccgcggggctgctaccgccgcccgcggccaccggcaagggcggcggaggctccgtcgtcggccgcagcctgctgctgcagtccggctgggtcgtcgaaaggctcgacggcgacgccggctcctgcgtcgtcacctacgtcgtgcagctggacccggccgccgggtggctgccgcggtgcatcgtcagccggctcaacagcaagctcgtcatgatcatcgccaagctcaggaggatcgcgcaggccaccgtgcctgccgccgccgcagaggtgtgacgtgcatagctaccagcaagtgatcgaaatcgaactagcagcatcgggtcagctgcacgtttagttgcattgtgtgtgtgcctaagtaaatactccctagatatatacgtactatatgtcttctttttgtagggacagagggcatgcgtctatcttgggatgcacccgcatctgtatacgtactgctacaagactatgtcagtgagaattactatgtgtgcacgttttagtgttatagaattcgcctacacgactgttgatctttcaaaaaaaaaaaaaaaa

SEQ ID NO: 11649 - DNA, 1944 bp, Zea mays
gaggctgttctcttcacgtgtctatgacatctggtcctactcgtcaaagtcgatctatctcacatcgcatgtactccatgtagccaccaagtccagccctttttcccaaaaatcgacttccaatcccgacgaaaccctagaaatcctccggcatgatgtccgccgccaatccgcaggtcaagtccacgccgctgcctccgcccgcggcgcccaccgcggcgtcgcagaacccgcaggtcgctgcctccaaggcgtcgtcctcttcgacgtccgccgccgaccccaacccaaacaagcggaccaacccgggcaacgccgctgccgcctccgcgcccccagagcctaccccgagcgtcaacggggaggccagccgctcgcctctggtcccctcgccgctccctcaccctcacgagcagcaccaccctccgcccggcgcgtcgcctcttctgccgcccctgcccccgtcgcggccgctgctcaccgtagccgcggtggaggcggtgatagcagccatcccgccgccaccgcggtacgggctggaggacctcgaccgccgcaccgtcgcgctctctgacggcaccgtgcgcacctacttcgctctcccgcgcgagccgccgccgcagctccgccagccgccgccgccgatacccgcgcatctcttagcgccgccaccgcccccactgcccctgccgcgcccgtccctcgagcggtgggctcctccgccacccatgcctacactcctgcccgctgccgggctgcttccgctgcctgttccgaaacggaagtgggaggatcaggtcaatggtgttgtgccctgggagtcctccgtaagcacgctgcagaagaagtctgaggcgcatgctgcgaagcagatgaaagtggagaagcaggtgaaggtggaggagacgggggtggacccgaaggtgctgaagagcgcctttcttaagatggtgaaactgatgaatgagaatgaagcggataagaagaattactgggccaatgggaagctttcccagctgaagtgccctgtatgtcaaagggattctgtagatttgcatgcactcctcaatcatgcatactatgcaaagaatcaggagcatcgtgctgatcacttagggtttcacaaagccttatgtgttcttatgggttggaattattccgtagcccctgttcacaaaaccgcttaccaagcattatcaactgtcgacgctgaagccaatcaaggagaccttatcttatggccaccaacagttataattgagaacacatacaagtcaaagaatgatggagaaaaggatgtcatgagtgataaagaggtggagagcaagcttagagaaatgggctttgccggtgtcaatgtgcagccgctccctgggaaggacgggcagaggtcggtgcaagctaagttctccgccagcctcgatggtctgaacaacgcgtcacggctcgccgagttgttcgagcgccaaggccacgggcgagcagcctgggctcgcgtccggagcgccgtccccacaggcggtgggggcgataacaaccccatgctggtcaaggtggatggcaagggagagcggacatgggtcctctacggttaccttgccacggcatgggacttgaatgtcctggaccctgagtcgaagcagaacgccactgtgaagagcaggaaggaactggatttagattaggacccacctgaatacctgatcctgctagagttgtgcatgttacctgacgagttatgaatccatggacagtgtgattcgagtgtttgtgttcacggcacagcatttaagttcgagaagaaattctttgctgaggaatcagcttcgtggataccgctgtgcaaataatgaccctctatatgtcagttattcgtagtgtattaatctactttggtagcaaaaaaaaaaaaaaaaaacttctcagggggggggcccggtaccc

SEQ ID NO: 11650 - DNA, 1006 bp, Zea mays
  misc_feature (12)..(12): n is a, c, g, or t
  misc_feature (20)..(20): n is a, c, g, or t
  misc_feature (34)..(34): n is a, c, g, or t
atcgacccacgncgatccgncccacgacgtccgncctgcaaaatcgtcgcccccggccgggacccacttccgctctgctcacgtgccgtgcccgtgtgcatcggggaaaaaacagcagcaggggccgaatcggagctccgccgccggcagatctgcgccggccggtctgctccgcccagcggacatggaccgcgacggccgcccggggtggctaccgtcgctgggcttcgccttcctcagcttcaactgcgggatggccgtctaccgctcctgggacgacccctacgccgtcgccttcgtcctcgccgcgtacgccgccctcgtcctcctcttccgctgcctccaccttctggagcgccgccgggaccagcgcctcaagctcgccgtctggggcctctccacgctcctcacactcatgttctcgtacaagatcgccgccgtgatgccgccctgggcccagctgctcgtctggggcatggggatcctcaccgtcgttgcgggattctacgccttcttcgtcgcccgcccggaggagccctgacccttcgttcgtctccatgccgccccccccgacatcaacatggatacctgatgagcatcactcaccgcatcggtctcagttatcttgtgtagtacgtatgtctttttgcagcatgccgaagaagttgacgaacgtaccgagaggcgcgtagcaagactcatcactcttttgaatgcaagagttggtagtagaataaagtaggggttccgtgtgtgtgtgcgtgtgggagagagatcgtgaaaaacggtttgcatctagcggtgacctctttacattggtttttccagtgcctgttgcggttagctatgtgttactaattggaatggatgcaagtaagtgaggatagagtcgttctaaacccactctccaaatcacccatgcatcatcatttgaacaaggtgctccataaaaaattgtttggggccttaatacatgttttagtttcttaaaaaaaaaaaaaaaaaa

SEQ ID NO: 11651 - DNA, 2327 bp, Zea mays
ctccgccatggccacctccctcctacgcctctctcgcccccgccgcgcgctgctcgccatctcctccgtccgccttgcgctctccacccagccccacgtcccatctccgtccccatcccctaccccctcctccgcccgccgcctcccgcatttcctctccttcctcgccgccgccgccgccgctgggggagcaaccgtcgcgctctgcgactccggcctagatcaccgggtcgggggcaaggacagcgccgatctggtggttcgtggggagcggaagttcgtgccgcaggagttcatcgacgagctcgcgtccttcctcggggacaacatcactctggactacgaggagaggagcttccatggcacgccacagaacagcttccacaaggcggtcaacctgcctgatgtcgtcgtgttcccgaggtgatgatgcttactaagaactccagtggtcatcactctgttgaaatcaagggcttgtaggagacgttatatgtttcaagcgttttgcctagaatggtctctgacttgtctgacccatcttacaatgtcatgtatcggcacttgatgttgggatccgctgaatgtaaagcctaaatcctccaacaggtcacacgaatacaggatcacacaagaacgcacacggacacaagtggtttggtgattggaatgacaaaggcaggctgtgatagcctcctaataaatgcagaaattcactcacccaattagcctattaatccatgctgaagtttagctaaagtaaatgctatgaacctagacacacatgattatttacgacactgaacctgctccatatctcaagcatgtattgattgaatgatctatttcttgtaatgaagtgatgcattcatcgtctattttccagctcgcaagatgaggtacaaaagattgtgatggcctgtaacaagcacaaggttccaattgtaccatatggtggggctacctcaatagagggtcacacactggcacctcatggtggtgtttgcatcgacatgaccttgatgaagggcctggggccaccattggaggaatgtgtgctactcgttgttctggttcattagctgtgagtttgtaggtatggaacaatgcgggataatgtgattaatcttcgggctgttttaccaaatggtgatgttgtcaagacaggctcccgggctcgaaagagtgcagctgggtatgaccttgctcgtttgatcattgggagtgaaggaactttgggtgtacctcccgtgcgcccacgcgtccgccaaaagcttccatctcattctgtagttgcaatgtgcaatttcaaaacaattaaggatgctgctgatgttgccattgcaacaatgctttctgggatacaggtttcaagagtggaattgttggacgaggttcagataaaggcaataaatatggcaaatggcaaaaatttgcctgaagtgccgaccttgatgtttgaattcatagggacagaagcatatgctctggaacaaactctcttggttcaaaaaattgccactgaacaccatggatcagattttgtttttgtcgaggagccagatgctaaagcggaactatggaagatcaggaaggaggcactttgggctggttttgctatgaaacctgatcatgaagctatgataacggatgtttgtgtccctctatccagacttgctgaatgcatatctacatcaaagcgattgcttgatgcgtcgccattgacttgtctggttattgctcatgctggtgatggaaattttcacacaattatcctgtttgatccaagccaagaggaccaacgaaaggaagcggagagactaaaccatttcatggttcatacagctctgtctatggaaggtacatgcacaggagagcatggtgttggcacagggaaaatgaagtacctggagaaggagttgggcatcgagtcactcaggacgatgaaaagaataaaggcggcgctggatcccaacaacatcatgaatccgggaaagctgatcccgcctcacgtctgcatatgaccgtcacctgactggaggatcgatccccccatggccatcagtgggcttgttggctcactcatcaaaagctttggttccgcgaggcgtgacgcggtgctctgctgacagttgcaataatgcgctgaactgctctgtgcctgtatggcatgcgttggaggcaaatgcacgtaggccagcgtcacatcaaaactataccggtaccaaaaaaaaaaaaaaaaacccccccccgcctcagggaagggatggaaaataatggagcaaacattcgtctcctgacgccgttttaacaggagaacccttttt

SEQ ID NO: 11652 - DNA, 1988 bp, Zea mays
gggaccctcgaggccggccagcacaccactctgctccactccgccatggccacctccctcctacgcctctctcgcccccgccgcgcgctgctcgccatctcctccgtccgccttgcgctctccacccagccccacgtcccatctccgtccccatcccctaccccctcctccgcccgccgcctcccgcatttcctctccttcctcgccgccgccgccgccgctgggggagcaaccgtcgcgctctgcgactccggcctagatcaccgggtcgggggcaaggacagcgccgatctggtggttcgtggggagcggaagttcgtgccgcaggagttcatcgacgagctcgcgtccttcctcggggacaacatcactctggactacgaggagaggagcttccatggcacgccacagaacagcttccacaaggcggtcaacctgcctgatgtcgtcgtgttcccgagctcgcaagatgaggtacaaaggattgtgatggcctgtaacaagcacaaggttccaattgtaccatatggtggggctacctcaatagagggtcacacactggcacctcatggtggtgtttgcatcgacatgaccttgatgaagaaaataaaatccctgaatgttgaggatatggacgtagttgttgaacctggagttggatggatagagctgaacgaatacctgaagccctatggcctattttttcctcttgatccagggcctggggccaccattggaggaatgtgtgctactcgttgttctggttcattagctgtgaggtatggaacaatgcgggataatgtgattaatcttcgggctgttttgccaaatggtgatgttgtcaagacaggctcccgggctcgaaagagtgcagctgggtatgaccttgctcgtttgatcattgggagtgaaggaactttgggtgtaattacagaagtgactttacgactccaaaagcttccatctcattctgtagttgcaatgtgcaatttcaaaacaattaaggatgctgctgatgttgccattgcaacaatgctttctgggatacaggtttcaagagtggaattgttggacgaggttcagataaaggcaataaatatggcaaatggcaaaaatttgcctgaagtgccgaccttgatgtttgaattcatagggacagaagcatatgctctggaacaaactctcttggttcaaaaaattgccactgaacaccatggatcagattttgtttttgtcgaggagccagatgctaaagcggaactatggaagatcaggaaggaggcactttgggctggttttgctatgaaacctgatcatgaagctatgataacggatgtttgtgtccctctatccagacttgctgaatgcatatctacatcaaagcgattgcttgatgcgtcgccattgacttgtctggttattgctcatgctggtgatggaaattttcacacaattatcctgtttgatccaagccaagaggaccaacgaaaggaagcggagagactaaaccatttcatggttcatacagctctgtctatggaaggtacatgcacaggagagcatggtgttggcacagggaaaatgaagtacctggagaaggagttgggcatcgagtcactcaggacgatgaaaagaataaaggcggcgctggatcccaacaacatcatgaatccgggaaagctgatcccgcctcacgtctgcatatgaccgtcacctgactggaggatcgattccccccatggccatcagtgggcttgttggctcactcatcaaaagctttggttccgcgaggcgtgacgcggtgctctgctgacagttgcaataatgcgccgaactgctctgtgcctgtatggcatgcgttggaggcaaatgcacgtaggccgctcggcgtcacttcaccgctaccccggtacccaaaaaaaaactgaactgcctcagggaagggatgggaaataatggagcaaacattcgtctcctgaccccgtttt

SEQ ID NO: 11653 - DNA, 1312 bp, Zea mays
acccatccatcgtccccgcctgcacctcgcgagcatccaaagctgtacttgcggcaagttctcgcaaaatcctactcccaccgccgactcgtacctccgctcccctcctccccaacccttccacgcttgcttctccgggagggaaggcacacgggaggtcgccccgccacccatcgcaaaagccacgcgccaccaaactcttttttccctcacccagtcgctttcgcgttcagcgcgagctgagccagccagtgggtcggtcgctggaggcggagccataaaggcgtcagcgacggcagcatgatgagcggcagatcgggcgggagggacgccgagggcgagtgggaggttcggcccggcgggatgctggtgcagcgcagggacggtgaggcggccggccccgtcatcaggatcagggtctcccacggcgccaacttccgcgaggtcgtcgtgccggcgcaggctaccttcggtgagttgaagaggatccttgttcagactactggcttggagcctgagaggcagaggctcttcttccgtgggaaggagaagagtgacagagagttcctgcacacggcaggtgttaaggatggagcaaagctgcttctgctcgagaagcctgcccctgccaacatagagcagaaggttgagcctgtgattatggatgaaagcatgatgaaggcatgtgcggctgttgctcgtgttagagttgaagttgataagctgtctgctaaggtgtgtgacttggagaagaatgtactaggagggagaaaggttgaggataaagaatttgttgtcttgacggagctgcttatgatgcagctgctgaaactcgatggcattgaagctgaaggagaagcaagggcacagaggaaggctgaggtgcgccgagttcagtcccttgtggagaccttggataagctgaaagcaagaaatgcaaaccccttcagcgatcataataaggctgtttcagtaacaacgcagtgggagacgtttgagaacggcatgggcagcttgagtgctccacctccccgtgtttcttcaacgcaagctaacactgactgggagcagttcgactaggctcagatgaagctgttgatgtatcatgaaatctgtgagatcggtatggacattcctttccgaggcagcgaggtgttgtgtatatgcaccacgtttgataacttttggcgtcccaagtgcctgtgattctgtgaatgttaccagatcgtgccactgccatactaccatgtgaattgcatcgctcattgagggtcatattccaatatgctcctgccagtgccattcgcgtgct

SEQ ID NO: 11654 - DNA, 1549 bp, Zea mays
gagaaagttctgccgtccatccatcgtctcgtccccgcctgccattcgcgagcatccaaagctgtagttgctgcaaagctctcgcaaaatcctactcccaccgccgactcgaacagtcgaacctcggctcccctcctccccaatccgtcatcttccttctacacttgtttctgcgggagcgggagagaaggcaccagggaggccgcccccgtcacccatagccaaagtcacgcgccaccaaactttgttctctcacccagtcgctttcgcgttcagcgcgagccgagcccagccggtgggtcggtcgctgaaggcggagccataaaggcgtcggcgacggcaggatgatgagcggcagatcgggcggcagggacggcgaggcggccggccccgtcatcaggatcagggtttcccacggagccaccttccgcgaggtcgtcgtgccggcgcaggctaccttcggtgagttgaagaggatccttgttcagactactggcttggagcctgagaggcagaggctcttcttccgtgggaaggagaagagtgacagagagttcctccacgcggcaggtgttaaggatggcgcgaagttgcttctgcttgagaagcctgcccctgccaacatagagcagaaggttgagcctgtgattatggatgagagcgtgatgaaggcatgtgaggctgttgctcgtgttagagctgaagttgataggctgtctgctaaggtgtgtgacttggagaagaatgtgcttgcagggagaaaagttgatgataaagaatttgtcgtcttgacggaactgcttatgatacagctgctgaaactcgatggcatagaagctgaaggagaagcaagggcacagaggaaggctgaggtccgccgagttcagtcccttgtggagaccttggataagctgaaggcaagaaatgcgaaccctttcagcgatcataacaacgctgtttcagtgacgacgcagtgggagacgtttgagaacggtatgggcagcttgagcgctcccccgccccacgttccttcggagcaagttaacactaactgggagcagcagttcgactaggctcagctgaagctgttgatgtatcgtgagatcggtatgggcattccttttcccaggcagcgaggtgttttgtgtatatgcaccgcgtttggtgcctttggtgtcctaactgcctgtgaatgttaccagatcatcataccatactaccatgtggattgcattgcaccgctcattgagggccatgtttcgctaaaaaaaaaaaaaaaaccaatgccattcgcatgatatttattggctaggttcagcaaggttggtggtaacggccctggccagatccctttacagcagtagctcatccgtgaatgcaattgaatcagtcatgtacacgttgacgctgtagctgttccgaaagtcctgtacagcactagctcatcggcgaatgcatctgtaccatgtacacgctgacgctgtagctgcatttgtagtgcccctttgtaatgcaggaatttaagagaaattatacaggaatttcacag

SEQ ID NO: 11655 - DNA, 906 bp, Zea mays
cattgggacctcgagccggcgggactgcgctcccttgtcatatacaccgtcgcgaaacaaacaacgggggaaggagatcaagaaacgtacgtcaggccgagcttgtcgccatctggtggcgagccgtcgacaacggatcatgggtgtcctcggtacccaataattcttttctgctgcgccgggcaggccaggggtgatgctgctttatcctctctacgcgtccatgcgcgccatcgagagcccttcttccctggacgaccagcagtggctcacctactgggtcctgtactcgctgatcaccctcttcgagctctcaagctggaaagtcctgcagtggtttcccctgtggccgtacatgaagctgctcttctgctgctggctggtgcttcccgtcttcaacggcgcggcctacatctacgaggcgcacgtccggcgctacttcaagatgggcacctacgtgagccccagctacggcgagcgccagcgccgggtgctgcagatgatgagcctcgacgcgcgcaagtccgtcgagcgcttcatcgacacgcacgggcccgacgcgctcgacaggatcatcggagccgctgaagaggaagccaagagggagaaacctgaattgttccgggtggaaaccgaagcaagtctcccatcggttgggtagtcacttgtgcagaaatcgtatcgtatgcgtgtgtgtgtggttgatcattacgtcgggcttgcccagcagttggagaagagatgcccggcgcccatgagagcatgcatgcatatatggctttgaaagaagccgcgaaatttggtgtacttgttaatgaaaatttggcttggacctgtgaaagccaaaaaagctaaaatacgtctggtctgatcctgaatgcaaccgcacaagagattgatctgtct

SEQ ID NO: 11656 - DNA, 2282 bp, Zea mays
atcgaggaatcgcgggcccgccgcggcaccaaggccccccgcaccccgtccccccccggcgtcgctcccttgttctcccccgagccgtccgcgaaccaacccgtgctacctccgattccctcgtcgttctttctagaacctccgctccgcctaatcccttgaccgggtcaagcccgaacgagactagggaggttccagcgccgccggtgggggagatggcgctggagctgagcctggcctcggcttcgccgccggcgggcggcggcttggcgcagccgccgcccctcgccccacccgggaaggagcagcaagtggccggcgtggggattctactgcagatctccatgctcgtgctctcgttcgtcctcggccacgtcctgcgccgccaccgcttctactacctccccgaggccagcgcctcgcttctaattggcttagttgttggtggcctcgctaatatttcaaatacagagaccaacacaaggacgtggttcaacttccatgaagagttcttcttcttgttcttattacctccgataatattccagtcgggtttcagcttatctccgaaaccattctttgcaaactttggggctatcgtaacttttgcaattcttgggacattcattgcttctgttgtaacaggagttcttgtctatcttggtgggctgacatttctaatgtacaaacttccactggttgaatgccttatgtttggtgctcttatatctgcaactgatcctgtcacagtgctatcaatattccaggaactgggttctgatgttaacttgtatgctttggtgtttggagaatctgttttgaatgatgcgatggcaatttctctttacaggacaatgtcatcagtcagaagtcatgcagcaggcggcgagaacttttttatgatgattctccaatttctcgaaacctttgttggttcaatgtcatcaggtgtgggagttggatttatctctgctcttctattcaaatatgctggattggacgttgataatctgcagaacttggagtgctgcctttttgttctctttccttacttttcgtacatgttagcagaaggacttggcttgtcagggattgtttctatattattcacagggatggttatgaagcattacacatattccaatctttcagacaactcacagcgctttgtttctgccttttttcatttactatcatctttagctgaaacatttgtgttcatctatatgggtttcgatattgccatggaagagcatagctggtcacatgttggcttcatcttcttctcaattatattcatagttgttgcaagggctgcaaatgtcttttcttgtgcatacttggttaacatgtctcggccagaacatcgccgtatacctgtaaaacatcaaaaagcactttggttcagtggtcttagaggggccatggcttttgcacttgctctccaatctgtgcatgaacttcctgaaggacatggaaaaacgatattcaccaccaccactgccattgttgttttgacggtacttctcattggagggtcgacaggaactatgcttgaatctttggatgttgttggagatgaaaacacatcaagagaaaattacgaggacaacaatggttacatgcctccaagttatgaagaaggaacatcctctggaggaggattgagaatgaaactcaaacagtttcacaaaagcacaacatcattcactgcccttgacaagaactatctcactccattttttaccagtcagacagatgatgataacgatgacgacttcagtcagcaaccccaaaaccgaagactagctttttatgatcaatagcggaatttgatactctacatatcaagctaaatacacggagcagaactgacgtgcatgactatgtctatgtgtgattgggtcgaacaaaatatagcaggagcatacttagttgagtagcatatggcagagcatatctgtataccgtaggacaaaaatcataagggttcgaatcagttgttcccatgggggatgaggatgatgatagccaggcagcatgtatatatttctaggcttccttaagaacttagtggggctccagatgaaaagcagtgtgttgttggaattttatagaccctacctcgtgttaggttaattttaataaacccgaccgtttgtccgctaagtcggctattaaaaaaaaaaaaaaaatgacgcgttgcaccagttgccccactggctggttgcaccagtgggaaattgacgcgtaccatatataatgttgacatggctgattat

SEQ ID NO: 11657 - DNA, 1812 bp, Zea mays
gcacgagaccattacctagaacatcctaatcgaaaagaagggaaagaggaggaagaattcgagtccaagtcttggagctctcgctttaggcggccagggtggaactgccccttgcccgtggttggtgaggcgattcgtggtcgggagcttccgtttctcttcggaggtgaagtggatctgacctactgtaggggaaagagcaaagtacattatcttgtacaaatgtgcattacgctacctttatcataaaccaaatcatctctgtttctgggaacagcaaccagtaatttcccatgcaacctcttggttgatggatgttcttcctgttgggtcagaaagagaaagtcaaacagatagtcaccctttactcatggagcatgcgattggcatcccaaggcatgatgttgcttctacttcgacacctcatcgagacaataatgatggcatggatcaactgccccgtgattcagaaagttcttctggaacaactgatgcatcttactctccgaatgctcctctagcaaggagagatgataatcgccttcggcgtcagcaaagtctaaattctggcttctggatatcaattgaactagctgtaaatcttagccagattatagctgctatctgtgttctgtctgtgtcaaagaatgaacatcctcatgctccattgtttgagtgggtcattggttatacaataggctgcattgcaactcttcctcatctatactggcgctatctccagcgcaaccagctggccactgtgcaagggtcaaatcagaactacgttccagacaacagctttgagagtagttcttttactgggatttcgccccctcctgtgtctgaagctggtgttgtaactgtatcaaatggagtcttgagaaacaatgtggttatcacaaatccaagggcccaagcttttgctgatcacttcaagatggcgctggactgcttcttcgctgtatggtttgttgtgggaaatgtgtgggtgtttggtggacattcttccgcccatgacgcacccaacctgtacaggttgtgcatagccttcctcactttcagctgcattggctatgcgatgcccttcatcctctgcgcgctgatatgctgctgcttaccctgcataatctccctgatgggcttccgggaagatctggacgaaaacagaggtgctacttcggatgcgatcaacgccctgggcacatacaggttcaggtcaaagaagcctcgtaacggggaggcaaacgaaggtggcggtggagtctttgctcctggaacggacaaggaacgcgctgtttctgctgaagacgccgtttgctgtatctgcttggcgaggtacgtggataacgatgatctccggttgctcccttgcgggcacttcttccacaaggactgtgtcgacaaatggctcaagataaatgcgctgtgcccactctgcaaagctgagatcgacgtcgtcccgaggaccgctcctccagccattggctttgggcgccgcgacagccacaggagggtaggaaacgacattgaatcacaacggcttccatgatgtatagtgagacagcaacttgccttgggcgtgtgtgtggcttccagaagagcaccttgtaaattatatagtgagagagagaaagagattatgtcatggaccaacgagtccttacatgatccagcaagtaatcgcctgactgaaaaatgtgtcgttgttgtcaatatgtgtgaatgtgtccctgtagctgtagctttgttcactccaaaatgtaccttgtcatagctaccgtgacgtcaattaactaatctattttataaagt

SEQ ID NO: 11658 - DNA, 1662 bp, Zea mays
gcctgcaggcagctctgtgtccacaagtcatggtacacgtacacgtgatgagtccccacgtgtgccctttgcaatcaccgctggcgcctgacgtggcgccagaagctgtcgcccctggaagcttggggccctcgtggccggccgccaccgatcccgattcggatccgattccgcggcaggcggcattcccagcctcccaaacccatttccctctccgatcaaatcaaatcaaactcaaaccgacacgggacccacgccgcatctccgcctccgcagatcgccgccgcctactcgcgcccctccgcgcgccgatggccgccgcggacccgccgccgcgcggggaggccgcgcccgcgctgaagcggagcgccagcatcgaccggataccggcggacgcgcgccgcatcctgcaccgcctcgccggggacctctggggcggcgacgtggaccccggcgcgctggccgtgtcccagctcaggggcgccatgaccaacgaggtcttccggatcacctggcccggcggcgaggccgagggcaacggcccgcgcaaggtgctcgtgcgcatctacggccggggcgtcgaggtcttcttcgaccgcgccgacgaggtccgcaccttcgagtgcatgtcgcgccacggccaggggccccgcctcctgggccgcttcgccaacggccgcgtcgaggagttcatcaacgccaggaccctctccgccgcggatctgcgcgacccggagatgtccgcgctgattgccaggaagctgcgcgagtttcacgatctcgacatgcctggacctagggacctctcggtccgggcagaggctcaagcggtggcttggggaggctcgtgacaggtgttctgaggaagagtctaaccaatttcagctgaataaactaggtgatgagatttcagtgctggagaagacgctctcggggctccaacagtcagtaggattctgccataacgatctgcagtatggaaatattatgatatatgaagagaccagacaagtcaccttgatagactatgaatatgcgagttttaacccagtcgcattcgacattgctaatcacttctgtgagatggctgctgattaccatacatcaacaccacatgtgttggattttacgaaatatcctgacactggggagcagagaagattcgttgaggcataccttagctctgcaggtaaaaagccaacggatggggaagttgaagaactgctagggttgatagcaaagtacactcttgcgagccatctcttctggggcctgtggggaataatctcggcgcacgtgaacgaaaatatcgacttcgcgtacaaggagtatgcaaggcagcgcttggatcagtactggcaaacaaaacctcgaattcttggacccaagtgatgagtcgttgctttttgtagggggtccttggccagctagtcatgtgaattctgtttgtcagtagcggctagtagctgccagtttttgactgcagattgttcagctcgctgtgacctgtgtcgtgaccatattcttgacttacggggtgtaattattttgcctggtcttaggctaaggtaaccagtctttctatcctaatgtaaatagtacagtctataatgaccttatcctcacatggttctgaacacaaaaaaaaaaaaaaaagcggcc

SEQ ID NO: 11659 - DNA, 1420 bp, Zea mays
ttggggacctcgaggccggccgggtgcttggcagttggccacatgccttgccttgcctttgcctacctgttgatcgagccgagcgagcagggagagacacggcaccgagtgaggccgccgcatcctcctcctctccgatccttagtccagtccgcctgctgcctgcctcaacggatcgacgcgacaggagggagggaggaaggagacggtcgatcagagtctgagacggaggccgatccaccaccgcagcgacgagcgggaggagatgaagatcatcattgacacggatcccggcatcgatgacagcgtggccatcctgatggcattccagatgccgggcgtccaggtcctagggctcaccaccatcttcggaaactgcaccacagagcatgccacacgcaacgccttgatcctgtgcgagaaggcaagccatctagaggtcccagtagctgagggcagccatgagcctctcaagggaggaaagccgcacgttgctgacttcgttcatggacctgatggcctcgggaacgtagatcttcctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattcgtgaaaaacgttaagaagatcgttgtgctgggtggagcgttctttgcggctggaaatgccactccttccgctgaagcaaatatccacagtgatccggaggcagccgacatggttttcacttctggggcggacatctacgtcgttggcctcaacatcacaacgcaagtcagcttcacagataaggatctcctggagctaagaaactcgcaagggaagtacgcacagttcctatgtgatgtatgcaagttctacttggactggcacaccgagtcttatggtgctcctgtgattttcctccacgatccggtcagctttgccgcgctagttcgtccggagctgttcacgttcaagaagggcgtggtgagggtggagacgcagggcatctgcgtcgggcatacttccatggacatgttgctgaagaagtggaactcagagaacccgtggactggctactcaccgatttcggtcgcatggacggtcgatgtgcccaaggtggtcgcgtttgtgaaggagctcgtcaccaagccgtgaaccaagttaactaacgtgttgtggtctcgcgcaccagatgtgcagcaaatttgagatgtcgatatatttactcacattcgaagcactgcaaacactattatctcaatagttggttcctgtggaggattgcaaatcaatttgagatgttttaaattgcagcatgtgccttcggccattgaatggtatgatgttttttttttcttcata

SEQ ID NO: 11660 - DNA, 822 bp, Zea mays
agggcgagtagctaggcgacctccgtcctccgacctgtccatccaatccaaccctagctagcagcagcagccgccgtcgagcaaggagcaccagtccgccaccgcgccacgtcgccgtcctgtcactgccgaccatcctgcaccgagccgcgtacgacgacgcccagctgaccgccgtgccgaccgcggaggcgcccaggctgatttgcgtgagcccagcacggtgccacggtgcacgcccgcgacttgcgctcgactgcccggtgccgagctcgtggtgtagtgaagccaacattgaagaacggcaccaacatcagaggaatcttgcaacatttaattgaagaatttggtgggaaaggaaaagggaaagaaaatcctaccacttccaagtctcaatcaacgccaagcagcattagatgccctccctctaaatctgatgaaagacctgctacttaaggctgtagcctttcatacattggtcatgcaatggaggtttggagtttggaggttgcagcttacaagttacaagatcacaaaaagcctggaggttgcagcttaccagtccacggtcagcaaagagttgtgtgaggctgtgagcctgtgactgtgagctgtgtgcctgtgtgtaataacttgacagttgagaacttgagactgtatgtctgtatgtgtgatttgcctgtagctgtttgtctcactgtctgtagcattttattgcttgtaggctgtagctgtggacctgtggtttttttattgctgctgttgtgctgtctgtagctgtgttaaatggatttattgcctggaaagacatgttattgctaa

SEQ ID NO: 11661 - DNA, 897 bp, Zea mays
cggccgggataacctcaatgcccagtcgtatatatcgcgcacctcgagacgccggccggggtgcttggccagttggccacatgccttgccttgcctttgcctacctgttgatcgagccgagcgagcagggagagacacggcaccgagtgaggccgccgcatcctcctcctctccgatccgtacgtttcctcctccctagcaatcgcaacccgttcagccaatcattgccgtctccaccaactccgttcccctattacctagttagtccagtccgcctgctgcctgcctcaacggatcgacgcgacaggagggagggaggaaggagacggtcgatcagagtctgagacggaggccgatccaccaccgcagcgacgagcgggaggagatgaagatcatcattgacacggatcccggcatcgatgacagcgtggccatcctgatggcattccagatgccgggcgtccaggtcctagggctcaccaccatcttcggaaactgcaccacagagcatgccacacgcaacgccttgatcctgtgcgagaaggcaagccatctagaggtcccagtagctgagggcagccatgagcctctcaagggaggaaagccgcacgttgctgacttcgttcatggacctgatggcctcgggaacgtagatcttcctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattcgtgaaaaacgttaagaagatcgttgtgctgggtggagcgttctttgcggctggaaatgccactccttccgctgaacgcaatatccacagtgatcc

SEQ ID NO: 11662 - DNA, 1564 bp, Zea mays
ataaatgcacccccacttgtcccttttccctcctcctccagctcctctctgggctgtggtggctgtggctcccaagcacacggcccgcacgagcagttggaacagattcctcgaccgcgtcgccccggaacccagttcttggcatccggtgcctagcttcgtcgcccctccggcaaagaccacctccagccctccacctcccgcggtagcgcttgctgctagtgagctagtatatttctgaaaccggaaacccgcgacacgggaccgagttcttgggagcggattcggctcgctgcaggctgaggctaccggcgcgctcttctccacggcggcggagagccagccagtagttgcgaccggaggcgggcatgggcgcgggcgtgtcgggcctgccgggcgcggagcccggcggcaaggtggcgcgcggcgccgggctgggcgacctcccggagctgtgcaccgcggaggtgctgctccgcctcggcgcgccggacatatgccggctcgcgcggctcaacctagcgttccgcggcgccgcgggcgcggacttcgtgtgggaggccaagctgccggggaactacgcccggctcctgcgcttcgtggacgaggccgaggaggagggagggagtgggcgggattggagcgcggtggggaggaaagacgtctttgcgaggctcgccagacctgtgccgttcgacggtggcaaaagggaattctggctggagaagaacgaaggtgggatctgcatggccttgtcgtcgaaagcgctggtcattactgggattgacgatagaagatactggattaacatgccaacatctgaatctaggttccactccactgcatacctgcagcaaatctggtggttcgaggtggtgggagaggtggacttctgcttcccggcggggacggcctacagcctctacttcaggctccacctcggcaagtcctccacgcgcttcggccgccgggtctgcagctcggagcaggtccacggctgggacaagaagcccgtgcggttccagctctccacgtcggacggccagcacgccgtgtcccagtgctacctggacgagcctggacgctggatcctgtaccacgtcggcgatttcgacgcgccgccgagctctggtcagccgaccaggctcaagttttcgttagcgcagatcgactgcacccacacgaaaggtggcctctgtgtcgattcggtgctcgtgtatcccaaggggtttcagccggaacgggtggtcagggctcggaaatgaccgtgtgtcggcatttggtagctatagaggcactgcgcattagagcgagctgtcgagagatatgagtagcctgccatttttttttagcttgggctaattgtattctgaaagcgtttatacatagcatagtagcacactggacttttttttttgtttgatagcattagtgtgtgcgcgttactttgccatttctcatgaaggccatggcaaataaggaacctttgtacgtgtacctagctccggtacatcgcgtttgcatcggcacacaatgaagccaggaaggtctcctgttttatttc

SEQ ID NO: 11663 - DNA, 1045 bp, Zea mays
acgccaagcccgcaattaaccctcactaaagggaacaaaagctggagctccaccgcggtggcggccgctctagaactagtggatcccccgggctgcaggaattcgcacgagaccattacctagaacatcctaatcgaaaaaaattccttccttctcttgtgctcttggcatctcgtcctctctagctatcttcttgcttcctatattcacaaggtaggtcgtcgatcagagggggtgtgtgtggcagcttaattattggacgacgacaggagagatcgatcgagcatttgcaattaatggcggccatgggcatgaagaagggtgtgctgatgctggctctcgggctcgcgatggccgttacctcgtcggccgtcgtctacaaggtcggcgacgcctctgggtggacgatcctcggcaacgtcaactacaccgactggacttccaagcagaacttccgtgtcggagacaccatagagttcacgtaccccccgggcatccacaacgtgctggaggtgaacaaggccgactaccacagctgcaccaactccacgccgatcgccacgcacacctccggcgacgacaagatcgtcatcaagagccccggccaccgcttcttcatctgcggcgtgcccggccactgcgccgcgggacagaagctcagcatccgcgtcctcaagacgcgctcctctgacgccccttcccctgcgcccgccgcgcgctcagcctcggcggcgtcgcccagccccagcggcagcaccagcaccgatccgagcggcgccggcgcctcggcgtcgccgcctgcgtcgtccacggacagcacgcccgacgcgacgaccaccaccgcgcccgcgcccgacgccaatggcgcgggggtcagtgcaggccaccgggccgtcgtcgctgccatggcactggcggcggccgcctccatggcgatgctgtactagatcaccaagcactcctcaccccaagtggccgtgagcatttgtctacatgggattcttttgttatacatgatgcctatatgtggatattttcttgttac

SEQ ID NO: 11664 - DNA, 1605 bp, Zea mays
cattgggtacctcggggcccatactcgatcagacggtcgatctggctctgcgaagatctcgacagcaccgttccgtttccatccccatcgtcgtcgtcgccgccgccgccgccggagatgggccatgcgccagcgaacggcaagcgctcgccgcctccgcctcctctcggacgttgccacttctggctccccaacaagcgccgccactgcgccaactcccccctcccgtcctctcagtattgcggaaaccacctccccgagtccgcccccggggctggccgccgcgtcccctgccccgtcgacccctcccacacggtgctcgaggagaaccttgaggcgcacgtcggcaagtgccccctgaagaagcaggtcgccgcgctcaccgcgcagccgtactactccaagggcatcaactccggtacgcctgatgcgggctgcggtgtgacgtcggcggagaagcgtgcggccgtgtacaggcttaccgaggaggagttccgccttctgctcgggaagatccggtcggtgcacgcggcggtcgcagcgccgatacgggagtccaacctgatcaccgctgcttgcgacaagtggatgagcggccaggttgataggaagatgccgtaccaagagaagcatgtcgcgcagcaggcgtccattgttggaaacatggaggcatttggcttgctgcagaaggctagccatgaggtggttgatggggagaatgcggcggtgagtgctcaggcagttgtggagtttggagctggaagagggtacttgactcaggtgctggtggactgttatgggattagaaatgtcttcttggttgagaggcggtcctacaaacttaaggctgatcgaagcttgcgtcaaaatgaagatgttaccttggagcgtttgagaattgatattgaggatttgaaactgcacggaattgaggcattgagggggctccaatatctagcaattggaaagcatttgtgtggacctgccacagatatgaccatgatgtgctgtcttcctgaacgatatgaccaaacagaagaaaacggcaaacgtagtcttcaaggccttgctctagctacctgctgccaccatctttgccaatggaagcattacacgaataaatctttcctctcgggactaggtatcacagaagaagaatttcatgccatgacatggtttagcagctgggctgtggatggtgatcatagctacccagatgctcctgtggaggttgcagacacacactctgaagtcagaggaccagagaagcttgatcaggaggccgtcggaattgagagagtaatccgaagtataccagcaggggagagggccactctgggatccatgtgtaaagatatcattgatacggggaggctactatggcttgggcagaagggtctgattgctgatcttgtaagctatgttccatccagcatttcaccagaaaaccgtctgcttatcgcaaaatgcacatcttgattataggctgaaaagcaagtgcacgcatttcagccctgcaaatttgcaggaacttggattgtataagatactttcaactaatacaatcttgagtttttcaaaaaaaaaaaaaaaaaacggcacgag

SEQ ID NO: 11665 - DNA, 1161 bp, Zea mays
ccttataattccctgccgcactcacctcccgttgcgcgtgcatgcggtcgacggccgggcaggatcgccgtggtgaccggcgggaataaagggatcgggctggaggtctgccggcagctagccgcctcctccaccagcggcgtcgccgtcgtcgtcgtcttgactgccagggacgaggcgaggggagcagctgccgtcgggaagctcagaggcctggggctctccaacgtcttcttccaccagctggacatcacggacgccccgagcatcgctcggctggccgatttcttgaagtcccggtttgggaagctggatatcctggtgaataacgccgggtttgttggccttgagtacatccaagatcgtatagatggcacttcaacgacgagcgaggagttttgtggcatggacatggacaagaggctggagctgctgctgaaatggtgcctccgggagacttgcgatgctgggaaggaatgcatgaggataaactaccacggcacgaagcaagtcacccgagcactcctgcctctgctgctggcctccgacagcggaaggatcgtcaatgtctcctcggtgcttgggcagctcaggtttttcggcagcgaggcgctgaagcgggagctggacgacgtggcgagcctgaccgaggagaggctggacgaggtggcgggcgcgttcgtggcggacctggaggccggcgccgtggaggcgcgggggtggtggcccgccgggttctcggcggcgtacatggtgtccaaggcggcgctgaacgcctactcgcgcgtcctggcgcggaggcaccccgcgctgcgcgtcaactgcgtgcacccgggcttcgtcaggaccgacatgaccgtcaacttcggcatgctcacgcccgaggaaggcggcagcagggtggtggccgtcgctctgctccccgacggcgggcccaccggcgcctacttccaggagcgccagcaggcgccgttcgtgtgacgcgctctgcctctgctctgcttccttcaccacccgatgcttgatagctatgtatctcttgaagttttcgcttgataatagttgatacacattcaatccccgcgcgtaatctctccgttgcaaaaataatggaatcctaagttttggacaagtaaaaatttctcaacttttgatcaacct

SEQ ID NO: 11666 - DNA, 1569 bp, Zea mays
cacgagaccattacctagaacatcctaatcgaaaagcgatctcagctcccaaccaaccttcatcaatccagtaccatcggaagcgtacatgcatacataccatacgtccataccatacggccggaccacgcccagcaaccaatcaataatactcctagtccgccaccagtcgctccgcctcggcgccatcgcacggaaagcttgctgttgctggcgacctcgcggcggggcgccggagcagccatgcctatgcacgccgcccgtgcccaccccccccttcgcgccctatcagccgcctcccctgcctccggtcctctcccgcctctctctctctcttgcacacacacgacgtcgtacgcggcagctagcagcacgcacgatcgatcgccacagcgtacgtactagcacagaggacgacgaccgacgccatggcggcctccttcgcgcgcggcggcgtggcagcggcggcggcgacggcgctggtgatggtggcggcggtgctggcggtgtcgtgggccggcgtggcccgcgcggacttcgcccaggaccgcgccatgtgcgcggaccggctgatggggctggcgacgtgcctgacgttcgtgcaggacaaggcgacggcgcgcgcgccgacgcccgactgctgcgcggggctcaagcaggtggtggccgccagcaagctgtgcatgtgcgtgctggtcaaggaccgcgacgagccggcgctggggttcaagatcaacgtcacccgcgccatggacctgccctcgctctgcagcaaccccgccaccttctccgactgccccaagatcctgggcatgtcgcccgacgcccccgaggcggagatcttcaaggagtacgcgaagaagcacgagagcaacaacggcaccaccattcctgccgctgcaaccggcgccgccgcggcgaccgggaagagcacgagcgcggcgccgacggcggacggcgccgggaggcagcccggcacggtcttcttctacgtcgtgtcggcgctgctcgtctccgtcgcggtcctgctgtgctgatggcttaacggccggccgcggcagcgcatgcattcatggccggccggccggcagggagatggaggtgctactgcacgctgcacgactggaaggaagcccggagacacaattcaagtctttgagatgagcaaactaaaggacacgagtactctttttttttctctttcctgtagcctttttgtgtgtgtgtggcgtgttgtggggagtttgtgagacgtcggcttgtgctagtgctgacggtgcaccagcgacgcagctctgtacttcccagctgttgggctgtggccttccagcctggggattttaatgtggtggcccgggactgccgacctgtctgtctgaatctgatgattctgacccattatgttggcacttggcacattgtatgtttggtttctttggttttagttctcgtcttcttgcttttttttatttaaagtaatttctgtaagcaacatgatgcatgtaactagaaggacctttgtttgtatacgctcaagaaacagttttcccgccaaaaaaaaaaaaaaaa

SEQ ID NO: 11667 - DNA, 2125 bp, Zea mays
ttgggaccctcgggccggccccaattacccgccttccgccatctgacgttctagggtttggcggctcctctatcctttctccatccgctagcaggcgcgaggcgccccctccgaccgacactgaatcccgcctccaacctccgctcgaaacccataccttcggtctcctccgtctgtccgtcgcccatccggccgcctcttctcccaccagccgccgctgccgcacgttagctcctcctgcatcgtcgccggacctccgctacgcccccgtgcatccttgccttggcaggcaggatctggccacctttcgccggcaacagttgggcgccgcataggtaaccgcctacccccgaggcaaggcagtaccccgtcgcccagcgtataagcgcggaaggagggcgcggaatagcgccttttctaacactaatggcaacggcggcggcggatggcccccctgtggaaccgcagtctctgaagaagctgagcctccggtcgctcaagcggtccctggacctcttcgccccggcgcacgccctcctcttcacgcccgacgccgagagcaagcggattcgtactgggtgcaaggtgagtgcggagtacggtgcggtgaaggacctcacgccggagcaggggcgcggtgggcagggcaagggtcctgcgccgccatcttcaacagctttggcattgccaggaacacaagatacaaaagatgctcacggagaaggctctaggaatgccattgtccctgcaccacttatgctgccaaaagcacctgaatctaccatacctggcaaaaatacaactctgtcaattcctggatcatctgacagattttctacatccgcactgatggaaaggatacctagtagatggccacggcctacatggcatgctccttggaagaactatcgggtcatcagtggtcacttgggatgggttcgatctattgcatttgatccagcgaatgaatggttctgcactggttctgccgataggacaataaagatatgggatcttgcatcaggaaccctgaagcttacactgactggtcatattgagcaaattcgtggacttgctgtcagccaacgtcacacttatttattttctgctggtgatgacaaacaagtaaaatgttgggatcttgaacaaaacaaggttattaggtcctaccatgggcatctgagtggtgtttactgcctagctctccatccaacaattgatatcttactgactggtggccgggattcagtttgcagggtgtgggacatcagaacaaaagcacatgtttctgctttaacagggcatgacaacactgtctgttcagtgtttgctcgtcctacggatcctcaagttgttactggttcacatgatacaactattaaattctgggatcttgtagctgggaggactatgtgtacccttactcaccataaaaagtctgtccgagctatggcgcttcatccaaaggagaaagcatttgcatcagcatcagcagacaacgtaaagaagtttaaccttcccaaaggcgaatttctgcacaacatgctgtcgcagcagaaaacaataatcaattcaatggctgtaaatgaggatggtgtcttggcaactggaggggataatggaagcctgtggttttgggactggaagagtggtcataactttcaacaagatcagactatagtccagcctggatcactggagagtgaggcatgcatatatgccctctcatatgacgtgagcggatcaaggcttgtgagctgtgaggcggataagactataaagatgtggaaagaggacttgacagcgacgccagagactcatcccatcaatttcaagcccccaaaggacatccgaagatattgatgctcaaatcccacaagtagcaagctagtggatggttggagcctccacaattgtgtgacccaaactcgcttcttccctgagcccaattgaaattttgctagggtttgctctattgtataatctgatgcctgtactccaccagtctgatgccttggtccaacgctttgaaacccttagactgtttctttgtgatctttgcgttcgatttgattataacctaccttagtaccaaaaaaaaaaaaaaaaaaactcgagaaaaaaa

SEQ ID NO: 11668 - DNA, 1079 bp, Zea mays
cctcgaggccggccgggaaggctttgctggtagttgtagcacacacggcacaccacacggtttcgtcctcgtccaccatgctatcgtcctcgcacctcgttaagctgcccctcctgccgcgcggcctcctctcgtacctccccgcatccatcctcccgagcgggcgcgagagcaccgcggacgcagcaccctccacgccgccttcttccaagaagatgtcgtcgtccgcgcagcagcagcagcagcagcaagcgggcagcagcaaggcggagtcggcggagctggcgcgcgtgttcgagctgttcgacaaggacggcgacgggcgcatcacgcgggaggagctggcggagtcgctgcgcaagctgggcatgggcgtgccgggcgacgacgagctggcgtccatgatggcgcgcgtggacgccaacggcgacgggtgcgtggacgcggaggagttcggggagctctaccgcggcatcatggacggcgccgcggaggaggaggaggaggaggaggacgacgacgacgacatgcgggaggcgttccgcgtgttcgacgccaacggcgacgggtacatcaccgcggacgagctgggcgcggtgctgtcgtcgctggggctgcggcagggccgcaccgcggaggagtgccggcgcatgatcggccgcgtggaccgcgacggcgacggcagggtcgacttccgcgagttccgccagatgatgcgcgccggcgggctcgccacgctcgggtgatgggtgaccgtcgccggccggtgctgcctgcctcctgctcctgcacctgggcctggccatggagcgccgggcacctttttttctgcatctgcgtgcttgatttcgtgtgctagaaagaacctgtagatagatattgcttgcttggagcgaggggggagctcacgtcacgtaaccgcgttgttccgtcttcgttctgttgatttggttctttagaattgatgggcttgctaattaactgttgtatacttgtatgtactggttgttgccctgcccttaaggattgttcggggacaaggtttcccctgttttaaaagaaaaaaaaaaaaataaatc

SEQ ID NO: 11669 - DNA, 3767 bp, Zea mays
ccggccgggatggcggcggcgccacctccggactcgacagttctaattgaagacctcgtcgaggagttcctcctccgcattcccccggatgaccccgccagcctcgctcgcgccgccctcgtcagtaggcactggcaccgcgtcatcaccggccccgtcttccgccgtagattccgtgagttccaccgctcgccacctttgcagggctacatctccaacatccacaattccatccacttcgtccctatatcgtcgttccgcccgcgccatgctgacctcgacgacgtgatagcgatccactcaagccctggccgcgtccttctctgtcgcttccccgggaagggtctggatgtcttccccgggaagggtctggatgtcttcctctccgtgtgggatcccatcaccgatgagctgcgggatttgcccgcgctgccgctgcaggtggtcccaggcccgtacacatctaactgggacgcggccgtcatctgcgccgtaggcgagggctgcaaccatatccattgcggcttcaaagtcgtctgcgtgggaacttctcaaaggagggacttctcctgtgtctattcacccgaggctggtagctgctggagtgatctcatctttgctgcttcaggggaacacacgagctacattgacatggggacctgtgtccacgctgggagctccctctacttcctgagtcgattcaaccatgaaatcgtcaaatatgacttgctgacggatcgaatgtctaccatttgcttcagagtagaccctgacgcccaaattaacggcatggccactgtgcttattgccacagaggacggcaggctaggagttgccaaaacaagcaattcaacgcttggttgttcaacacttcacctgtggataagggaccatgaaagatgggaagaaagaaggcccattgagcttcgtatgctgctcccagatgatgccctacgcgatcctcaattcccgcctgaattttttccagacaagccttggctggctggctttgcagggacaagagctggtgtcattttctttaagacacgtcttgggtattttgttgttgatctgaattcagggacgagcaagaacataggcgagtgcttaggttggggttgcattattccctatgtgagcttctgcactccaggtaccctgctttcactctgtattttgctcatttgcacttgcacaataagtagtagttcagctgtgtaagggctcagcaacattgtgtaatacttttttattggtaaaagaacaatgtctgtcaaagtgtgatacctggacgacctcatgaaccggattactcctacctatatattacctacataaaaggttaggttctcacgtattctacggtgcaaacattagtctcatcatgccaacctttaattatatatgttcctcaaccatctcttgtatactaatttcacatgataacgtcgtagaaaaataaataggataaattcctagatgtagtttgagttcatcttgatgctgttatttacatgtgttgaagcttgtgaaattctatctcttacagctgatacaaaacatatatatacacaagactcttgggccacacagtaacggccgccagacacggcccaacaatatgtgaccattaactggataataaatcagtgctgttttttttggcttttgtgtgatttgtgtttgcccaatattcattgttatcatagattcatcatattttgtatttgtgtttcttatgcagcgccaggagcaatatccacagatgagggaccagaagctggtctcgagggctaggatctggcttgtgaagtgaataagaagctctaaatcaagaaggatatttactagaccagaagcatggtttgggtgggacggatatctctacatgattttgttgctgttctgaccttgtttgtgctcctgaacttgagtttgcatattgcaatcaaattatgataatggtattggctctcatatgaaagcatggcacatggaatttaatactgtgtatgactgtggacaattttcctcttctacgttttaacataggaccaagggataaaatcagcttactccaatccagttttatgaatagttcatttgatagctttgttgaatattaaggactacttttttatgcactacatcatttcaaaactgcatttccaaacaggccctgagcatgcatgggctttcgaggcttttgactgatgacaacacagataaaattgaggatagtacatcagttttagttgcagcactaaaacaatgctagtctactaatggctttcagccaagagaactccaggtgctagcagtagacctaccctggtcagctcattttagatatctagcatgctctgcaattttggtgctcacccttacgagtatgacctcagtcctattttatcttgggtccgtcactgcttttataattgtataagggaaatattattcaatataatgtcctaaaaattggcaatatctctctgaaaatcgttatgaataggatgtaaacagagctactctctgtccatatataacgtcacacaggaagaaggacaaaaaattcggtcagcgagaacggcaaataaaaaccatattattgttgcttgccgacataaatttaagtctacgacaaaaaaaaaaaaaccacatcatattacatcctatgggcttacctgcagacaaacatgaaataaacgtgtgcatgcatggtacgaacgtttggatagactctgagactccgagtgtggtccgacgtggaatcacaacacacgacgacacatgtgaccgacaagggcaagttgaagtctatgcatgcatgcatgcatgggcctgagcgccgcgctgaatgaatctggacggtgtggtaggggcctagggcttctcggtgggcaaaacaaaaaaactccgtgtgctgggaatctttgcatgcagctgtgtgctgaactgaaacccttcgctctatctatctatctatataaacagatgcccttcgctctcgtctcagcaagcagcatcgaccgacgccaacgacagagaagagagtccatctgctcgttgccttggtaattcatcatgtagcatcagctagtatttatctcaagtatatatacatgtgcggccgcatcgtggcgccgcccggccggcccgggaagcagcatcgaccgacgccaacgacagagaagagagtccatctgctcgttgccttgattttgtggaacgaagcgatggctcgcagcggcgccatggtttcctgcatgctgctcctggtggtggcgcaactgctcatggtgatggccacgcagacagcggcggcggcgggcgaccaacgcggagctggacgccggctgctgtggcaggtgacctgccactacagcgcctgtaactgccgcacttgcccgacatatggctgggcgtgctgcagcacttgctgctagctagctagctagtgtgagttcttccgcgcgcgcgcagccttttgcacacccctcttgcttagctcatgcatgtccagtagtagccggttgctgcactcgtcgtcggcggcggcggcggcggcgtcatctctggcgtggttacgttctcatcagcgacttctaatggcgctctcgatctttatttcctgcagtcctttttgtaataagaagccaattgatgtgtgtgcacgcgcaatcctaataataaatagatcttctttgtacaaaaaaaaaaaaaaaaaaaaaacctacttaaaacaaaagtaaaaaaaaaaaaaaaaa

SEQ ID NO: 11670 - DNA, 752 bp, Zea mays
ccccggctgcaggaattcggcacgaggcccaagttttgttctcctctcctagctagccagcacctgcagatctgctcgttgccttggggctccttgccttgggctacggatttggtggaacgaagcgatggctcgcagcggcgccgtggtttcctgcatgctgctcctggtggtggcggcgcaactgctcatggtgatggccacgcagacagcggcggcggcggcggcggcgggcgaccaacgcggagctggacgccggctgctgtggcaggtgacctgccactacagcaactgtaattgccgcacttgcccgatatatggctgggcgtgctgcagcacttgctgctagctagctagctagctagtgtgagttcttccgcgcgcgcaagcagcctttgcataccacccctcttgcttagctcatgcatgtccagcagtagccggttgctgggctcgtcgtcgtcgtcgtctgcggcggcggcggcgggggcgggggcggcgtcatctctggcgtggttacgttctcatcagcgacttctaatggcgctcgctcgatctttatttcctgcagtcctttttgtaataagaagccaattgatgtgtgtgcacgcgcaatcctaataataaatagatcttctttgtgccataaaaaaaaaaaaaatatataataaaagtcttcgttgcaaacgtaaaaaaaaaaaaaaaaaaaaaaaaaaaagtacctaaaaaactcgagagagggcgccggtacc

SEQ ID NO: 11671 - DNA, 3966 bp, Zea mays
  misc_feature (2432)..(2432): n is a, c, g, or t
  misc_feature (2574)..(2574): n is a, c, g, or t
  misc_feature (2607)..(2607): n is a, c, g, or t
  misc_feature (2700)..(2700): n is a, c, g, or t
aattaaagcttggttaatttatgtcatattctataccagtagtaatgtttcgttaatatctttggatccaagagtttgattgtggtaattctagttggactaattgcataattttatccagatgaattttttaaaatttgaagtcgacccgagttccggattttggtcaatgtagtttttactaatgaaacataggtctatccagatttagaaaatggttagattggtctggtaattaggagagaagatgattatttttaagcttgcacaatccttcaacccctctcattaccaatccttagtttaccatgctacacttttctttctctctttccttagtgtcataaaaaagcaatgcaacactgttaaaaataataaagataaaacacgttgcaacgatctccctagttatattttgatagttcatttattttgtattatattgctattataaagctatggtcattggactgtacatctgatttcagagcatgcactgaacaccttattatgtgttgtgaaacatgatgaaaactttaacagcctcctgaacattggcatccaatattaggttatgttcccagaaatgcacaatagcatcgatggatctgcctgaattatgctaacatctgaactacgaacgccaaacgtgtggtctgtaatgtaactcagtacattcttgtcaacccttggtacttttcagtcaaaacccaagaaacacgactgatccccttgaaggtttcctggtaattttttttttgcattctttccattcaaaacctcggattcttgaagtgctacaaaaaaaaggtgcatactctgctctgaaaccatcggaatccaattacaaccagaatagaattgcaaggaatgtggagaacctatcttctatccagtgcagcttcagattccaaggaggaagggaaggaggggttttaatttgctcaaaagcttggtgttcgttccacttctgaatctccttcgcatctctgaatgtgctgcatcctacgaccgccttggatttggttagggttcacctcgggacacgaccagcttggatttggttatggtcagtggtcacgaccggctgctctgcatggtggtgaagtggaagccacaacgggggcagcgcacctggtcgggcgtcggattgcttaccgtcgacgctgcttcagagctctcggcgcccgcgcccgccgccctcatcttcttgcgtgctggcgaccatgtcaacaagtcctcattgtccacctccactgggttccccttgtggccgagcggcggcgcggtcgtggtcgtggtcgcgccggataccttgtcgtcgcccgccaccatgctgttgagaaggggcggcgctatcgtccctgtagccgtggctccgccgtccgagttcttggctttggaatagtcgtggcctatcggctggctcttcccgcacgaaaacgtcttttccgcgcacggtgatacgccgggcaccacgtcgtcgctgcccccgtggatgcgccggttgcggttgcggtacatcttacacaggacgaggccctcgactttgcccccgtagccgtgctcgtcgtagctgtggtggaggtggaactcggtcatggcccagcctgaccgagcgtccgcaccggcggcgtccctcctcatgaaggaaaagttctggcggtagccgacgtggcggccgccgtccaggaagtcgatgacgttcttgaccccggagtcgctgcgccagcaccccgtaccgtcggcgacggtgcgcaccttgcgcggatcgtgggggctcttggggcgcagcgggctgaggaagtaccacgtgcactggccgtccagagagacctccggctggtaccctcgcgccagcttctcagggtccgcggagtagaggtccaccgcgtgcacgccgcccggcatggtgatgcccaaggtcacccagggccacaggaaggcattcacgagcgtcgcgtcggaaggctgcgcgcgtcgcgccgcagccggcgatggcgaaggcgagtcggagcgggacatgggtgagccgtgagcctaggccctagcccctaggggaggagttcgtcgactcgtcggtttcggtgttggcgtcgtgcgacgaaggcgtcgtgcggtgagtttatgggtcgtggctaactgcgccacactttgtctaaggttaggcgttcgaattgaaaaactaaccttatatagaaaagtttaaagtgtggcaagttagacagtgaaccaaacagaccttatatgttccgcgtacgccacgcgcagaccggatgggcctccgacagtccgaggtcgggaagggcccggattctctcgctttccatgttttactattaggcctgtttgatcttcgtcagggctggcctcactgtgaagtccactagaatttagcaggcctgaatctttttacctcatttttttttctnttctctgccccaaacgcacaagccctagccgccgaccaccatggcggcggcgccacctccggacccgacggttctaattgaagacctcgtcgaggagttcctcctccgcattcccccggatgaccccgccagcctcgctcgngccgccctcgtcagtaggcactggcaccgcgtnatcaccggccccgtcttccgccgtagattccgtgagttccaccgctcgccacctttgcagggctacatctccaacatccacaattccatccanttcgtccctatatcgtcgttccgcccgcgccatgctgacctcgacgacgtgatagcgatccactcaagccctggtcgcgtccttctctgtcgccgccccgggaagggtctggatgtcttccccgggaagggtctggatgtcttcctctccgtgtgggatcccatcaccgatgagctgcgggatttgcccgcgctgccgctgccggtggtcccaggcccgtgcacatgtaactgggacgcggccgtcatctgcgccgtaggcgagggctgcaaccatatccattgcggcttcaaggtcgtctgcgtaggaacttctcaaaggagggacttctcctgtgtctattcacccgaggctggtagctgctggagtgatctcatctttgctgcttcaggggaacacaccaactcctttgagacggggacctgtgtccacgctgggagctccctctacttcctgagtcgattcaaccatgaaatcgtcaaatatgacttgctgacggatcgaatgtctaccatttgcttcagagtagaacctgacgcccaaattaacggcatggccactgtgcttattgccacagaggacggcaggctaggagttgccaaaacaagcaattcaacgcttggttgttcaacacttcacctgtggataagggaccatgaaagatgggaagaaagaaggcccattgagcttcgtatgctgctcccagatgatgccctacgcgatcctcaattcccgcctgaattttttccagacaagccttggctggctggctttgcagggacaggagctggtgtcattttctttaagacacgtcttgggtattttgctgttgatctgaattcagggaggagcaagaacataggcgggtgcttaggttggggttgcattattccctatgtgagcttctgcattccaggtaccctggcaccctgctttcactctgtattttgctcatttgcacttgcacaataagtagtagttcagctgtgtatgggctcagcaacattgtgtaatacttttttattggtatttggtatcatgaaccagattactcctacctatatattacctacataaaaggttaggttctcacgtattctacggtgcaaacattagtctcatcatgccaacctttaattatacatgttcctcaaccatctcttgtatactaatttcacatgataacgtcgtagaaaaataaataggataaattcctagatgtagtttgagttcatcttgatgctgttatttacatgtgttgaagct

SEQ ID NO: 11672 - DNA, 1610 bp, Zea mays
aactccgtgtgtgctgcctgccttggaatctttgcatgaagttgtgtcttctgtgtgctgaaacccttcgctctatctatataaacagttgccctgggcgcccgcgtcgggtggtggcatcgtctcaagttttgttctcctctcctagctagccagcacctgcagatctgctcgttgccttgtgctacagattttgtggaacgaagcgatggctcgcagcggcgccgtggtttcctgcatgctgctcctggtggtggcggcgcaactgctcatggtgatggccacgcagacagcggcggcggcggcggcggcgggcgaccaacgcggagctggacgccggctgctgtggcaggtgacctgccactacagcaactgtaattgccgcacttgcccgatatatggctgggcgtgctgcagcacttgctgctagctagctagctagtgtgagttcttccgcgcgcgcaagcagcctttgcataccacccctcttgcttagctcatgcatgtccagcagtagccggttgctgcgctcgtcgtcgtcgtcgtcggcggcggcggcgtcatctccggtggttctcatcagcgacttctaataatggcgcgcgctcgatctttcctgcagtcctttttatttatttataataagaagccaattgatctttcctgcagtcctttttgtttgatatatataataaaagtcttcgttgcaaacgtacatattttttatttaggaaatgcattttttactaccgctttccggacggcatgcaggcctcaagtgctgtaaaaaaaggtgcaagttgagagagccgtttcatgtcacgctcgaaatccagtggactcgttttgagagaatttcttacccaccaaccatctaaggagttgtttagtttttaaggactaatttttagtccctacattttattacattttagttctaaaattatcaaatataaaaactaaattttattttagtttctatatttagcaatttttatagactaaaatagaataaaatgaagggattaaacattattagtccctagaaactaaacacccactaaagttaacttggtgctcctttttccgcgatagtagtagagctgcacatcgttgtattaagaatacgaaaacacgatacaaccaaacaaaagaatagaacaaaattaggctctaaaaggaagaagacaaaaattaagcagtgacgataaaagcgtaacagaaagaaaaagaacagtttgaaaggctaaagcaagtaaaggtgacgaaatgatgtccaccaatccgataagtctgtaaccttgaaagaacagtttgaaaggccaaagcaagtaaaggtgagctaccatacttcgcgagaccacgaactagccatcagataaaccaacatatctgcattgaaccacagtgtaacaaacatctcataagctgattttgcgttgtacaaatgtattcttgagtcaatatataccgcggaccaagccttcgtcgactggtctccagtgtaccacactacctgacgacacacagctacaattcagttcccaacccaggtgctggccaggtggacgatctcacgtggaggtgattccgtggagcaagtgctggtg

SEQ ID NO: 11673 - DNA, 1901 bp, Zea mays
gtcgaacgtctggatagagtctccgagctgagtgtggtccgacgtggaagtgttcgtctcaacacacgacgcatgtgaccgacaagggcaagttgaagtctatgcatggatgggcctgagcgccgcgctgaatgaatctggacgggtggtagggcatctcggtgggcaaaacaaataactccgtgtgctgcatggctgcctttggaatctttgcatgcagctgtgtgctgaactgaaacccttcgctctatctatataaacagatgcccttcgctctcgtctcagcaggcagcatcgtctcaagttttgttctcctctcctagctagccagcacctgcagatctgctcgttgccttggtaattcatcatgtagtacgtagcatcagctagtatttatctcaagtatatatatacgcatatgtgtcgtcgcagtactttcccttatctctctatacacactacacgcatacataccaataccatccgtcttaactcttaatctttgcctgcatacgtacactgcacgtacgtactgcagggctactgattttgtggaacgaagcgatggctcgcagcggcgccgtggtttcctgcatgctgctcctggtggtggcggcgcaactgctcatggtgatggccacgcagacagcggcggcggcggcggcggcgggcgaccaacgcggagctggacgccggctgctgtggcaggtgacctgccactacagcaactgtaattgccgcacttgcccgatatatggctgggcgtgctgcagcacttgctgctagctagctagctagctagtgtgagttcttccgcgcgcgcaagcagcctttgcataccacccctcttgcttagctcatgcatgtccagcagtagccggttgctgggctcgtcgtcgtcgtcgtctgcggcggcggcggcgggggcgggggcggcgtcatctctggcgtggttacgttctcatcagcgacttctaatggcgctcgctcgatctttatttcctgcagtcctttttgtaataagaagccaattgatgtgtgtgcacgcgcaatcctaataataaatagatcttctttgtgcaaaaaaaaaaaaaaaaaatataataaaagtcttcgttgcaaacgtacatcttttttatttaggaaattcattttttactaccgctttccggacggcatgcaggcctcaagtgtgctgtaaaaaaaagtgcaagttgagagagagccgtttcatgtcacgctcgaaatccagtggactcgttttgagacaatttattatccaccaaccatctaaagttaacttggcgccaccttttttccgcgatacgtagtattagtagagctgggcatctttgtactaagaatacgaaaacatcgtacaaccaaacaaaagaatagaacaggctaaggaagaagaagacaaaaagcagtgacgataaaaagcgtaacagaaagcaaaaagaactaggtcgaaagcacaagttagcagtcaacgcaacggtcacgatggctccggctgaaaattcgtgagttgcgctccctccggatcaccagcaagtcgcggcgaaaccacagtcgaaagaacaagccatcagataaaccgtggactcctctgattcatcgcaaagcgagcacacacagttgttgcctccaccaaccaaaccatgcatgcctacgaaatttgtcggcagtccataggcgatgacgacgagccaccaaccaaccacagggaaattagaatcttgagaggcatccaagaccgccaaatgtattcttgacccaaccatctgcattgaaccacagtgtgtaacatctcataagctgattttgcgttgtacaaatgtattcttgagtcaatatataccgcgtccgaagccttcctctatgggtctccacttcgc

SEQ ID NO: 11674 - DNA, 699 bp, Zea mays
gccggccgggccccgccacgcggcgtcgtctcaagttttgttctcctctcctagctagccagcacctgcagatctgctcgttgccttgggctactgattttgtggaacgaagcgatggctcgcagcggcgccgtggtttcctgcatgctgctcctggtggtggcggcgcaactgctcatggtgatggccacgcagacagcggcggcggcggcggcggcgggcgaccaacgcggagctggacgccggctgctgtggcaggtgacctgccactacagcaactgtaattgccgcacttgcccgatatatggctgggcgtgctgcagcacttgctgctagctagctagctagctagtgtgagttcttccgcgcgcgcaagcagcctttgcataccacccctcttgcttagctcatgcatgtccagcagtagccggttgctgggctcgtcgtcgtcgtcgtctgcggcggcggcggcgggggcgggggcggcgtcatctctggcgtggttacgttctcatcagcgacttctaatggcgctcgctcgatctttatttcctgcagtcctttttgtaataagaagccaattgatgtgtgtgcacgcgcaatcctaataataaatagatcttctttgtgccattgctttgtttgatatatataataaaagtcttcgttgcaaaaaaaaaaaaaaaaaaaaacccctaa

SEQ ID NO: 11675 - DNA, 3952 bp, Zea mays
  misc_feature (1872)..(1872): n is a, c, g, or t
  misc_feature (1912)..(1912): n is a, c, g, or t
  misc_feature (2142)..(2142): n is a, c, g, or t
  misc_feature (3081)..(3081): n is a, c, g, or t
taccctcgggcctgccgcgagattagcaggcctgaatctccggcccgcatttttttttctattctctgccccaaacgcacaagccctagccgccgaccaccatggcggcggcgccacctccggacccgacggttctaattgaagacctcgtcgaggagttcctcctccgcattcccccggatgaccccgccagcctcgctcgcgccgccctcgtcagtaggcactggcaccgcgtgatcaccggccccgtcttccgccgtagattccgtgagttccaccgctcgccacctttgcagggctacatctccaacatccacaattccatccacttcgtccctatatcgtcgttccgcccgcgccatgctgacctcgacgacgtgatagcgatccactcaagccctggtcgcgtccttctctgtcgccgccccgggaagggtctggatgtcttccccgggaagggtctggatgtcttcctctccgtgtgggatcccatcaccgatgagctgcgggatttgcccgcgctgccgctgccggtggtcccaggcccgtgcacatgtaactgggacgcggccgtcatctgcgccgtaggcgagggctgcaaccatatccattgcggcttcaaggtcgtctgcgtaggaacttctcaaaggagggacttctcctgtgtctattcacccgaggctggtagctgctggagtgatctcatctttgctgcttcaggggaacacaccaactcctttgagacggggacctgtgtccacgctgggagctccctctacttcctgagtcgattcaaccatgaaatcgtcaaatatgacttgctgacggatcgaatgtctaccatttgcttcagagtggaacctggcgcccaaattaacggcatggccactgtgcttattgccacagaggacggcagggctaggagttgccaaaacaagcaatttcaacgcttggttgttcaacacttcacctgtggataagggaccatgaaagatgggaagaaagaagccacattgagcttcgtatgctgctcccagatgatgccctacgcgatcctcaattcccgcctgaattttttccagacaagccttggctggctggcttttgcagggccaggagctggtgtcattttctttaagacacgtcttgggtattttgctgttgatctgaattcagggaggagcaagaacataggcgagtgcttaggttggggttgcattattccctatgtgagcttctgcattccagcgccaggagcaatatccacagatgagggaccagaagctggtctcgcccgcgcggccctctggcttgtgaagtgaataagaagctctaaatcaagaaggatatttactagaccagaagcatggtttgggtgggatatctctacatgattttgttgctgttctgaccttgtttgtgctcccgaacttgagtttgcaatcaaattatgataatggtattgactctcatatgaaagcatggcatatggaatttaatactgtgtatgactgtggacagacttgtcctcttctactttttatcataggaccaagggataaaatcagcttactccaatccagttttatgaattgttcatttgatagctttgttgaatatgaaggactacttttttatgcactgtgtctttgagcaagatcggtgaacaacactgagcatgggcttttgaggcttttgactgatgacagcacagataaaattgaggatagtacatcagttttagttgcagcactaaaacaatgctagtctactaatggctttcagccaagagaactgctggtgctcagtttagtttctgcaaggctatcctttccaacatcagcaagcttttccctacttaatgcagagggnatgctttgtatatcttcactaattttgttttattaggatnccgcaaaggccaaagggttgatctttcatccctccatttattttgcccacttgcatttgaaaaaaagaaaagggtgtcgatgtttagaacggaggtagtaataactagctgcttaatctagttgtcaccatggatggagaaatcagataaacctgcattagcactaagcacaaatgtgtatgtatggttatgtaatggtagcatggagcatgattttcatttttcatatnaacatagagcatatataataatatgtgtaagcaccaaggggtaagatgtgttctaaccttactcaaatactaggcttaaatctagagcaagcactatataagtagaagtctatctaacctaggcactttataaaacacctacgctaattaggagtgattcttttgaacaattgggtatctggagctactagagataagcgttaactttcttaatattttccttaattacctcccatacatcttaaatgtctagtggtagcatatatacctccaaagtccaaagctagttgtaagtgacacaaaaaattatgcgtactcattgaacatatctgttacactcactaactagacatgtttagtgcatctacgttagctagttgcagaccccaatcctatattgttcataaatttttatcataaggttccctgctgcaatttagatatccagcatgctcttcaattttggtgctcacccttacgggtatgccctcactgccttttataattgtataagggaaatattattcaatataatgtcctaaaaattggcaatatcaatctaaaaatcgttatgaataggatgtaaacaaagctactatctgtccatatataacgtcacaggaaggacaaaaaattcagtcagcgatcgagaacggcaaagaaaaaccatattattgttgcttgccgacataaatttaagtataggacaaaaaaaaaagccacatcatattacatactatgggcttaccagacaaaatgaaataaacgtgtgcatgcatgcatgcatggtacgaacgtctggatagagtctccgagctgagtgtggtccgacgtggaagtgtacgtctcaacacacgacgcatgtgaccgacaagggcaagttgaagtctatgcatggatgggcctgagcgccgcgctgaatgaatctggacgggtggnagggcatctcggtgggcaaaacaaataactccgtgtgctgcatggctgcctttggaatctttgcatgcagctgtgtgctgaactgaaacccttcgctctatctatataaacagatgcccttcgctctcgtctcagcaggcagcatcgtctcaagttttgttctcctctcctagctagccagcacctgcagatctgctcgttgccttggtaattcatcatgtagtacgtagcatcagctagtatttatctcaagtatatatatacgcatatgtgtcgtcgcagtactttcccttatctctctatacacactacacgcatacataccaataccatccgtcttaactcttaatctttgcctgcatacgtacactgcacgtacgtactgcagggctactgattttgtggaacgaagcgatggctcgcagcggcgccgtggtttcctgcatgctgctcctggtggtggcggcgcaactgctcatggtgatggccacgcagacagcggcggcggcggcggcggcgggcgaccaacgcggagctggacgccggctgctgtggcaggtgacctgccactacagcaactgtaattgccgcacttgcccgatatatggctgggcgtgctgcagcacttgctgctagctagctagctagctagtgtgagttcttccgcgcgcgcaagcagcctttgcataccaccccctcttgcttagctcatgcatgtccagcagtagccgggtgctgggctcgtcgtcctcctcctctgccgcggccgccgccgggggcgggggccggctcatctctggcgtggttacgttctcatcagcgacttctaatggcgctcgctcgatctttattccctgcagtccttttttgt

SEQ ID NO: 11676 - DNA, 737 bp, Zea mays
gccggccgttcaaaagctctatctatctatctatgcggcccctcgcgccggccgggtccgggagcaagcagcatcgaccgacgccaacgacagagaagagagtccatctgctcgttgccttgattttgtggaacgaagcgatggctcgcagcggcgccatggtttcctgcatgctgctcctggtggtggcggcgcaactgctcatggtggtgatggccacgcagacagcggcggcggcggcgggcgaccaacgcggagcagcacgccggctgctgtggcaggtgacctgccactacagcgcctgtaactgccgcacttgcccgacatatggctgggcgtgctgcagcacttgctgctagctagctagctagctagctagtgtgagttcttccgcgcgcgcgcgcgcgcagcctttgcatacccctcttgcttagctcatgtccagtagtagccggttgctgccctcgtcgtcggcggcgtcatctctggcgtggttacgttctcatctggcgtggttacgttctcatcagcgacttctaatggcgctctcgatctttcctgcagtcctttttatttgtaataagaatccaattgatgtgtgtgcacgcgcaatcctagctaataaatagatcttctttgtgccttgctttgtttgatatatatataataaaagtcttcgttgcaaaaaaaaaaaaaaaaaaggcccctacctaaaaaaaaaaaaaaaaaggccccta

SEQ ID NO: 11677 - DNA, 2389 bp, Zea mays
agacaccggatgtgtgatgatttggggttgttgaaaaggcggcatgccgaactgagttccggcacctccatacatctgcaaatagattattcatcagtttttcagttaatcggacttgagaaacaacgaaataacaaaaaattgatacctgatgtagcatccaattttgcatctgttgcatctgttgctgcacttgttgcttatattgcgccatactctcctccatctgagtcatcttctcaagcagctctccttcacgtgcagatggtcgtcggggtcgattcgacccagctgagaaattggaccgtctagtgtaactccgacgggggacaacaccgtcaccaattgctaacctgtaagagtatcatatatatatatatatatgtagtaaatgacaagacatcactaaacagtaacaatgtgacaagcgcatatacctcccatgtggcacgcctccaccagccttataagccgcctccgtatcgaactcaccagtgagccaatccgcgtctggaccatttttctctctcacgttgtcaatgtagcgagcctgtgaaaaaatcatccaagtcacaacaaaggcatatcatgttcatcttagagtcgattttcatacttaccagtttctctgtcgcattactgtcattcagtatttccggatgattcggatcgggacccttgtgtccctcgacgaagacttgaagcaaagtaggctccactccatttcgagccgcctgcaacacatgattagaaagtctagacaagtctatgcaattaacaattgaccaggcaatttgacacataccatacgtgcggccttgccaacgtgtccatctgccccgaagaagtggacccctggcttgctcaaccgattcatacgatttctattagatatggccaagaactcctcagaagcccaatactcgcacatccacgcccaagcatccgaatggtggctcaaccaatccacctcactctctttgtactgctgagccgtcaggtgaatttcctttgccatattcgcgtcacaatagttcccctgacgcttttggtacaccgtgacggccctcaatcgtgctttatacatcataccctttacagctctatctgctgagccattgaatacctcacgcacatatgaatcatccaaggtataggggtcgcacacgcgaaattggccctgcaaatttgaagatcaccagagacttacaaatgcaaaatctgaattcaatttgaatatcacaagggacttacccaaaacaaatcccacactttgcttgtgtgtgtcccgtcgttcccgtacggcttgagatcccaatgagcccagtaatgagcagctatctcttgaccgccctctgtaaccatcgccgggtaggcgaatcgcaaacaaatccccaactctgtgaggattggtgtgcgatgccctgtcccgtcccaactaacctccttccacgccctggtgcctttcggttcaataaccctccgctgatcgaagggtttagaaggcttcaatgtgagggaccgacgatacctacaaatgaaagtttgttatttaacaatgcaaatcatttacttaaaacttcaacttgacaataaaacttcaactctataataagaatacctgatggcacgccgtggcgcagcctgtgtggcagcctcctctgtagaagcgtctgctcccgatgtctcctctccatcgtccagttctgcggcagcttcctcagcctccgcgtccacagccgcctccgctagtaggttccatagtaggtgccactaaatcagctgcacgcgaagtagtcccttctgtattggagggtccgctgctaccccgcatctgctctagggaggcaagcaactgctcttgcctgctcctgcttgttgtggtgccctgaaatgtaaacaattttagattgttagctggccccagtaactaaactaagaaaaaaacaagtacctcaaacatgttaggagcaccactggaacccctcgaccttcgtgatctgggtctcctaccagacgaatccatcctgaacatctgcaataattcacaaaatagtaagtatgtataaatttttcacaaagtaatgcatattaaataaacaaaaacaagagtgtgccattacatctatgaattatgtatcaaaaatcgtcggcatcagagtcctcttcggcgacacgtgtattaagttgttcaacccattgttgtgtttcaagaactgtttcttcaaacctttgacgttttgaatttgatgaaattggttcctccattaactctacggtaagagaagctaactcatttagtcctgccccttcggatacaatactatcattgtcgctatcgtctgcttgatcaccgacttcttggaagacaacatcatcatcatcatca

SEQ ID NO: 11678 - DNA, 4437 bp, Zea mays
  misc_feature (974)..(974): n is a, c, g, or t
acgtcatttaaacgtcctctaagtattttaaggcgttttatttgtgtttaggacgttctactcgtcgtgggatgttcattttctaggccaaaagatgaaaaaaccgtaagttcctaatgactaagccttctaggcggtccattctcagtcgccatctcctacgtgggagcagcgagcgcaggtcgccagccgccctcctctcaagcgtgtggatgcgcagccggcaaccgcctcatcttctccagcgccgccgccccgacaccctctcctccagcgtcgccgctgggcgctgcccacatcctccattaatcagcgccctttctctcctctcccctgccccctctctagcagccaacaacctctcctcttctctgcccctcctctctccaccatcctccagtgacaatgaaacacccaggttctaattcagacagtgatagactgacaactgctccatttggtgagtaatctggccatatgagatcaatgctctaggctctattttgattttgctcagtgacaataaatcattcttttaggtcttaatattaatgagttggataataattactgatcatgaatacaagttgtaacttgtgtggttgaacttatgttgaatttgatatatatctttttatgttatttgcttttgtgaactcaagtactcaacttatatataaagttattttatatttaaagttatatgtcaagtctaaaaatatatttcaacgtttaaatgtttaaaagttgttcataatttttttatattttaccgtttaataaccacattggtgcagtggcgggcccagaatgtttcatgggtatttgatgatttatagtaatttgttaataatgtattatacaaaatagcgttagagcactaatttttttaatttttaaatttttgaatacctaatctcaaatgtttaggcccgcttatgcattggtggcctccttccacctgcgcatgcgcngggaaaggtacgtcgatcgtgcatcaactccacgagtcgcaaaatgcaaagcaaacaccttaaatcctcgattaccctgatgaataaaaacgtcattacttacatagttagtacaccactacacgacgtgtcgactcgaggcctcgagggtcgaggattatgtcgtgcggtgcggtgcggtgcggtgcctaacactgcttacgtgtctcggtgtctggtttatttaagtcacgggccattgaggtggccctttcgcgccttgacccagcgtcattttctggaaagctcaaaaacctctccgctgcaaaccgccacacgtcgcacgccccgccccgctcctcttgaccgcctcgctcccacggtcccacccccgacgcgcggcttcctcaggcacccacctcgccgaccgacacatggaccccaccgccgcccccggctccggcggcacccccgccgactccgacgccacctccccgaccaacaccaccgtgacgctcccgccgctcaccctccgcgacgtgccgcgcctcgcctcctcgtccccggcggcggcggcggcggcggcggtcccgaaccccatctcgcgccacccctacttccacccccccgccaacttctacatctctccgggggacgtctccctccgccacgccttcttcgacctcgtctccgccgcgccctccccgctcgtcgcctaccgccgcgggggcccccggcgggacctcgccgtcgacccggccgcggcgcgcgccgcgctcgtcacctgcgggggcctctgcccggggctcaacaccgtgctgagggagctcgtcgtcgggctccaggagctctacggcgtccgccacgtcttcggcgtcgccgccggctaccgagggttctacggcgccgacgaggatcacgtcaggctgcaccccgccgccgtcgacgactggcacaagaagggtggcaccgtgctcaagaccacgcggggtggcttcgatctcggtaagatcgtcgacggcatcgtcgcgcgcgggtacacgcaggtgagatcatactttacacacttaaatccccaaattgaatctgggcagctcatgggtattgcagaagagaagtatgctatgctatttagttcgagatttcaaggttcagaatgagtttttgggagccgttcacgcacagcggctaattgtttcccttctttttttttatagttcgtacacgtgttttgagtgcttcagcaaatgcacgttcttcgttgtaaagcacagtataaagtataaactgaactgatcgcgtcctttttttattgaagatatatgcgataggcggggatggaaccatgagaggggctctggcgatctttgaagaatttaaacgccgtggtttgaacatatctatcactgggatcccgaaaaccgtggacaacgacatcggcatcatagacaggtcgtttggtttccagactgcggtggaggtcgctcagcaggcaattgacgccgctcatgtggaggctgttagcgccgtcaacggcgtaggcattgtcaaactgatgggaaggagtacaggccatatcgcccttcacgccaccctcagcagtcgggacgtcgactgctgcttgatcccagaggtggatttctacctggaaggcaagggtggcctgttcgagttcctgtacgaacggatcaagaagaaggggcatgctgtcgtcgtggtcgccgaaggagctggccaggaactgattccccggactgacgatcagaagcgggagcaggacgagtccggcaacaccgtcttcctcgacgtaggaccctggctgaagtccgagctgggcagatggtggaagagggaacatcccgacgagctgttcactgtgaagtacattgaccctacgtacatgatccgagcggtccctgcgaacgccagcgacaacttgtactgcactttgctggcgcattccgccatccacggggtcatggctgggtttactggcttcgtgcctggtccgataaacgggacgtacagttacataccgctggaagatgtcgctgtggcgaagaaccctgtcgatgtgaacgatcacaaatgggcatgggttcggtcggttacgaatcagcctgatttcctgaaatcccaagcatagtacctcaagtccaatggctgctcctcccttaattagactttcttactgatccagttgcctgcatccctggttattttctgttcaataagggttgtagcttttatgctctccagtttgtgcgcatgtggaacacttttgagaaactgttgtgcttgtacatatgctgatactatcgttctcatgaataaacgatgctttttactttgagtgaaaaaaaaaaaaaaaaaactgtattggattgctatagatgtcagccgacatcgattgataatgatccaatgctattcggatagatataaataaaatctaaatctcatagcaaatatatggcctattagctcagctggttagagcgtcgtgctgcaggttcgagacctgcatgggccaattttttggagtcattttctttcagtcgtatccttttttttttttacattttcaacttgcagctgtatactgcttcctgactcttgtagaacagaacctgtgggtgatcaaatgacaaacagactcacccctttttggaattcccatcttgcacctgcctgtatgctgcgtcccatcttttaatttccatcttttatccatcatttcttccaatgccaaattcaagtgtgacattttcatcctagttaccacagaccaaaacaagcggtcatcattctggtatcttcggagtaagtacggccagttgttagtaacgattgaaccattgtagattgttttacagggtggagtgaatcaaccactccaacaagcaattgccatggacaaaacatatctgcattagaagaacaaagacctctctttttttctccagaaaggcaatacgaggactcttataaaaaatcagttagctaaacttctgaaatttcaaaatgtttattgtaaacaaagatatacaaagatggaccaagttagaagatgaatgcacaaagtttttccacgcagctgccactaatagatacaaacacaactatactgctatcctcaccaatgaggatggagtctccatctctgggcataatgagaaatacgcctggggtttctgacactccttctatgctcttcaatattgaccctttagttaaacatgtggaaggccttgactcctcggtcatacccttctcttgtactgaacttgatagcattgttcggagtatgccgattgacaaagctcctggcccagacgacttcaatgggaaatttgtaaaatattgttggcatctgaccaaaggtgacttctacaatctcttcaaggacttcttcgacaatcagttgagtttggaaggtcttaacacctcctatgtcactctgattcctaaagttaacaattcg

SEQ ID NO: 11679 - DNA, 1106 bp, Zea mays
atacgtaaataaaaaaaaatccataacgcaatcgcaaggcgctgcctccaccgccgccacctgcacatccatcgtcgccgttcgcgtctccggatcccgcgaccggagtccggaccctcatcccgcggccgcatattctcccgtccgtgccctcgcgtgcgctctgcccctccggcgtccgccgccgccgtcgccctacccgaggtgccgtggtctccatctcccggagcttcgccggcgacgagaatcttccagcatctcggcgcgtgtagagccatgctgggcgcgcgtgtgcagctgaaggggtggcaacaggcagctgttgcatttggttctgcgtttggggccttgcttgaccctaggagggctgatcttatagctgctcttggagagactactgggaaaccgccgtttgagcgtgtgctgcaacgaatgaagaacagtgcagaaggcagggaagttctttcggagcgtcctcgcgtggtatcctcgcaggtttcccatgcctgggacatgcctcagaacacatttggcgcggcgtatgctcagttcatgggatcaaggaacttctcaccagacgatcgcccgcctgtccgtttcatggacaccgatgagctcgcctacgtcgcgacacgtgctcgcgaggtgcacgacttttggcacgtgctgtttggtcttccgacgaacctgattggggagaccgccctcaaggtgatagagtttgaacagatgttcctcccaatgtgcatgctgtcggtcgtcggtggctctgcgaggttcagtgacaaacaaagggcgctgtttttccagcactacttcccatgggcaacaaaagctggtctcaagtgtactgatctgatgtctgtatattacgagaagcactttcacgaagacctggaggaagtgagaaggaactggggaatccttccttgccccagtcccaaaaagagcagtgtataggccggcattttctgcgtgaactttctatctgtttcttctttggtttctgttagttgctcagttctttttggaataaaatcatgagctaatgttgatgaatactgatacgttaccgagttcgaagtatggttagcaagttgatgtgc

SEQ ID NO: 11680 - DNA, 2189 bp, Zea mays
cccgaaacccctatacgtaaataaaaaaaaatccataacgcaatcgcaaggcgctgcctccaccgccgccacctgcacatccatcgtcgccgttcgcgtctccggatcccgcgaccggagtccggaccctcatcccgcggccgcatattctcccgtccgtgccctcgcgtgcgctctgcccctccggcgtccgccgccgccgtcgccctacccgaggtgccgtggtctccatctcccggagcttcgccggcgacgagaatcttccagagccatgctgggcgcgcgtgtgcagctgaaggggtggcaacaggcagctgttgcatttggttctgcgtttggggccttgcttgaccctaggagggctgatcttatagctgctcttggagagactactgggaaaccagcgtttgagcgtgtgctgcaacgaatgaagaacagtgcagaaggcagggaagttctttcggagcgttaaacacatactgccccccgcccccccctctttgtgttctagctaccatagtttatggctgggaattcctttgttttcggcaatagcaggttttgtaaatcaagtgcagaattaccacattagtgaaatacagttgtttacttgtttttctcatttgacaacgaaattacacaaccgtcgccaacaggacgatactctgttactagaatggttgtgaatgctgtttcccccattttccatcgatgttttagcaagctgatgtaatcaaggcatatctgattaggttactatcttctgattaatcatgttgtaggcagttgctgtatgctacattaggtttccttaatagtatcatcggattaccaattccatgttcaactaagatatgccaaaaagaagaactcatgtcaacttgcagttatgttaccaatttcatgtgcagctaggatattgttgttgcctgaatttcttccactggccccatgtcactgacagacttattcctctaggaagttctctcggagcgtccccgcgtggtatcctcgcaggtttcccatgcctgggacctgcctcagaacacatttggcgcggcgtatgctcagttcatgggatcaaggaacttctcaccagacgatcgcccgcctgtccgtttcatggacaccgatgagctcgcctacgtcgcgacacgtgctcgcgaggtgcacgacttttggcacgtgctgtttggtcttccgacgaacctgattggggagaccgccctcaaggtgatagagtttgaacagatgttcctcccaatgtgcatgctgtcagtcgtcggtggctctgcgaggttcagcgacaaacaaagggcgctgtttttccagcactacttcccatgggcaacaaaagctggtctcaagtgtactgatctgatgtctgtatattacgagaagcactttcacgaagacctggaggaagtgagaaggaactggggaatccttccttgccccagtcccaaaaagagcagtgtataggccggcattttctgcgtgaactttctatctgtttcttctttggtttctgttagttgctcagttctttttggaataaaatcatgagctaatgttgatgaatactgatacgttaccgagttcgaagtatggttagcaagttgatgtgcgttgatgtgcagtgctctggaataccaacatgttactttgatatcctgctttagtctagtagcataacaatgcacttcagatagaattagaagtaaaggtggtaatggatcacgatccaaatagctcttcacaaaaagttaaagcccttaaataatattagttcaaaaatgaataagaatagggctcggccctaatccaattcaatccttaaaatttgtagtgtaaagtttatagtccattaccatccctaattagaaggccataagcccaactttaccctcatcttcacgggcggcattggaaacaaactgaaaaggccaagtagtacggtatgtggtgtcctcaaactttacataccgtgtcaccaccgaacttgacatactgagcggtgagcgcagcgtggcacgtttctgctacgtcatctttctgcaaaggacacattttgaacgatatatgaaatgtttcttcgcgggactgacggaagcaggccagtacaggtaagtattccggatcaaggaatgctaacaacatgggtcagtgaaaattctgatgggctaagc

SEQ ID NO: 11681 - DNA, 1120 bp, Zea mays
cccgaaacccctatacgtaaataaaaaaaatccataacgcaatcgcaaggcgctgcctccaccgccgccacctgcacatccatcgtcgccgttcgcgtctccggatcccgcgaccggagtccggaccctcatcccgcggccgcatattctcccgtccgtgccctcgcgtgcgctctgcccctccggcgtccgccgccgccgtcgccctatcccaggtgccgtggtctccatctcccggagcttcgccggcgacgagaatcctccagagccatgctgggcgcgcgtgtgcagctgaaggggtggcaacaggcagctgttgcatttggttctgcgtttggggccttgcttgaccctaggagggctgatcttatagctgctcttggagagactactgggaaaccagcgtttgagcgtgtgctgcaacgaatgaagaacagtgcagaaggcagggaagttctttcggagcgtccccgcgtggtatcctcgcaggtttcccatgcctgggacctgcctcagaacacatttggcgcggcgtatgctcagttcatgggatcaaggaacttctcaccagacgatcgcccgcctgtccgtttcatggacaccgatgagctcgcctacgtcgcgacacgtgctcgcgaggtgcacgacttttggcacgtgctgtttgggtcttccgacgaacctgattggggagaccgccctcaaggtgatagagtttgaacagatgttcctcccaatgtgcatgctgtcggtcgtcggtggctctgcgaggttcagtgacaaacaaagggcgctgtttttccagcactacttcccatgggcaacaaaagctggtctcaagtgtactgatctgatgtctgtatattacgagaagcactttcacgaagacctggaggaagtgagaaggaactggggaatccttccttgccccagtcccaaaaagagcagtgtataggccggcattttctgcgtgaactttctatctgtttcttctttggtttctgttagttgctcagttctttttggaataaaatcatgagctaatgttgatgaatactgatacgttaccgagttcgaagtatggttagcaaaaaaaaaaaaaaaaaaggcccctagggcc

SEQ ID NO: 11682 - DNA, 1352 bp, Zea mays
accaaccacaaccagcgtcagctcctccaggccggccgtacagtacataataagctaacagtccattccgtgcgcagccacaaaacaaagctagcttatttcccttcccttcacgcggcaagcggcggccggccttccgccgccatggccaccaccaccgctcccgtcctcctcgtcttcctcgttgccattgccacgtccgtcgccccctcaccattccccatcctgacgatggcggcggacgcggacaacggcaccacccacctgagcttcttcatgcacgacatcacgtcgggcgccagcccgaccgcggtgaaggtgatcaaggggcccggcgcggggtccacgccgacggcgccggcgctgggcatgacgttcggcgacaccatggtgatcgacgacccgctgacggaggaggcgtcgcccgcgtccgccgcgctgggccgcatgcagggcttctacatgctggcgtcccagaccggggcggcgcttatggtgtgcgccaacctgctgctcacgtcgggggcccacaacgggagcacgctcgccgtgctgggccgcgacgacaccggccaggacgtccgggagatccccgtcgtcggcggcaccgggacgttccggatggccacgggctacgtgctgtggaagacgccggatgggatcaacggcaccgacgccaccgtccagctggatgtctacgtcaccacggacggcaacggcaccacggacgccggcgacgccgacggcggaggcggatccccgtccgcagggtcagggtcgtcggggtcgtcgggaggctccaagtccacctccggtgccgagagtaggaggaggaggatgaccggcgggtgggtcgtcgccgtagtggttgcggtggttggatccttctgggtttggtgagcaacgacctgttgacgaaggatgggggtgggtgggtggtgtgtgagtggggtggtggtcccacatgctggtgggtgagagtgggtgcatgtgctctgctgcggcatgtcggttgccggcatcattcctatctatctgtattggacttgttctagagcttttgcttttcgcaaaaaaaaagacatgcgggtcattatgttaaagtcagaagagttttctttacaacgacgatctttatgaactgttaaagatatgagacagatatcgagcatcatcgtgcggccctttgaaccgattcggttttatatctaaatgattgtcattatcaatcatgaaagccattttcttaatacaacatttgatggagcagcatagagagcaggaaaatgatctacatttgatggagcatcctacgagtcaggtcaggcagagctgacgagcaactccgcagc

SEQ ID NO: 11683 - DNA, 964 bp, Zea mays
cgcgccatggcccaccaccgtcccgcctcttgtcttcctcgttgccttgcccgtccgtcgccccctacattccccatcctgacgatggcggcggacgcggacaacggaccacccacctgagcttcttcatgcacgacatcacgtcgggcgccagcccgaccgcggtgaaggtgatcaaggggcccggcgcggggtccaccccgacggcgccggcgctgggcatgacgttcggcgacaccatggtgatcgacgacccgctgacggaggaggcgtcgcccgcgtccgccgcgctgggccgcatgcagggcttctacatgctggcgtcccagaccggggcggcgcttatggtgtgcgccaacctgctgctcacgtcgggggcccacaacgggagcacgctcgccgtgctgggccgcgacgacaccggccaggacgtccgggagatccccgtcgtcggcggcaccgggacgttccggatggccacgggctacgtgctgtggaagacgccggaagggatcaacggcaccgacgccaccgtccagctggatgtctacgtcaccacggacggcaacggcaccacggacgccggcgacgccgacggcggaggcggatccccgtccgcagggtcagggtcgtcggggtcgtcgggaggctccaagtccacctccggtgccgagagtagtaggaggaggatgaccggcgggtgggtcgtcgccgtagtggttgcggtggttggaaccttctgggtttggtgagcaacctgttgacgaaggatgggggtgggtgggtgggtggtgtgtgagtggggtggtggtcccacatgctggtgggtgagagtgggtgtgcatgtgctctgctgcggcatgtcggttgccggcatcattcctatctatctgtatttgacttgttgtagagcttttgcttttccaaaaacaaaaaagaagacatgtgggtcattatgttggag

SEQ ID NO: 11684 - DNA, 1251 bp, Zea mays
ccctgatgctatgctagctagtcagcccggccctggtcttagcagtgggcggtgtcagtgtgcgccatcgccccccactcagactcagccactgctgcagtccgccggctagtacacgtacgacaggctgtaccgaggttcagttcggtagtgtagttgtaggttgcgatcgcgaggcggctgctggcggcggtcgccatagtagtcgtggccgccgcgctcgcgtgcggcgcgggcgcgcagctctcggcggggttctactcgtcgagctgccccgccgtgcacagcatcgtgcgccaggccatgtcgcaggccgtcacgaacaacacgcgcagcgccgccgccgtgctccgcgtcttcttccacgactgcttcgtcaatggctgcgacgcctcgctgctgctggacgacacgcccacgacgcccggcgagaagggcgccggccccaacgccggcggctccaccgtcggcttcgacctcatcgacaccatcaaggcgcaggtcgaggccgcctgccccgccaccgtctcctgcgccgacatcctggcgctcaccgcgcgcgacggcgtcaacctgctcggcggcccgagctgggccgtgccgctgggccggcgcgacgcgacgttccccaacagcacgggcgcggcgacggacctcccgggcccggactccgacctggccggcctggtggccgggttcgccgccaagggcctgagcccgcgcgacctcgcggcgctgtcgggcgcgcacacggtggggatggcgcgctgcgccagcttccgcacccgcgtctactgcgacgacaacgtgagcccggcgttcgccgcgcagcagcgccaggcctgcccgtcggccgacgccgacgacgcgctcgcgccgctcgactcgctcacccccgaccagttcgacaacggctactaccggagcctcatggccggcgccggcctgctgcactcggaccaggagctcttcagcaacggcgcactcgactcgctcgtgcgcctctacggcaccaacgccgacgccttctcgtcggacttcgccgcgtccatggtcaagctcggcaacatcggcccgctcacgggttccgcgggggaggtcaggctcaactgcaggacggtgaattcgaattcgtgacttcaggacggtgaatgccaccatttttaattctttttccctacaaggagttgtagaatttgcattccttcaacgatttcgaatttcgaatttgctgtgagtcagctgaagtgg

SEQ ID NO: 11685 - DNA, 1630 bp, Zea mays
tgtgcagtgtgctttttattcgcaagcaggttcgaccactggtcgcacgccgcgcacgcgggccctggaacggacgggtcgcgctacagattccgtccaccccggccggcccacgcgccgccgacgcaacgcacggctactatcattcgcacgtttaccgccactatggacgtacgtacctgcggcgttggcctgatgctaggctagctagtcaggccggccctggtcttagcagtgggcggtggcagtgcgcaatcgccccccactcagactcagccactgctgcagtccgccggctagtacacgctaacacgcacgagtcacgacaggctgcactgagggtcagttcagtagtgtacgtaggttctgatggcgaggcggctgctggcggcgctcgccatagtcgtcgtggccgccgcgctcgcgtgcggcgcggaagcgcagctctcggcggggttctactcgtcgagctgccccgccgtgcacagcatcgtgcgccaggccatgtcgcaggccgtcacgaacaacacgcgcagcgccgccgccgtgctccgcgtcttcttccacgactgcttcgtcaagggctgcgacgcctcgctgctgctggacgacacgcccacgactgcccggcgagaagggcgccggccccaacgccggcggctccaccgtcggcttcgacctcatcgacaccatcaaggcgcaggtcgaggccgcctgccccgccaccgtctcctgcgccgacatcctggcgctcaccgcgcgcgacggcgtcaacctggtctctgttcgttccgtgccttctctccccaatcgatgacgtagtgtagtattctctatctgctctgctctcctcctcctctggggcgtcaacctggacttgtggcagctcggcggcccgagctgggcagtgccgctgggccggcgcgacgcgacgttccccaacagcacgggcgcggcgacggacctcccgggcccggactccgacctggccggcctggtggccgggttcgccgccaagggcctgagcccgcgcgacctcgcggcgctgtcgggcgcgcacacggtggggatggcgcgctgcgccagcttccgcacccgcgtctactgcgacgacaacgtgagcccggcgttcgccgcgcagcagcgccaggcctgcccgtcgtcctcgggggccgacgccgacggcgcgctcgcgccgctcgactcgctcacccccgaccagttcgacaacggctactaccggagcctcatggccggcgccggcctgctgcactcggaccaggagctcttcagcaacggcgcactcgactcgctcgtgcgcctctacggcaccaacgccgacgccttctcgtcggacttcgccgcgtccatggtcaggctcggcaacatcggcccgctcacgggttccgcgggggaggtcaggctcaactgcaggacggtgaattcgaattcgtgacttcaggacggtgaatgccaccattttgaattgatactgctctttttcccccacaaggagttgtagattttgcattccttcaacgatttcgaatttcgaatatgctgtgagtcagctgaagtgatttcgccttttgtccattaactgaaaccaacccgttcagaccagacgggc

SEQ ID NO: 11686 - DNA, 1783 bp, Zea mays
cattgggtacctcgcggcggaataatcctcttgttcccaaaccagccctagcccctagaacatctcaaatctatctcgctctccctaggaaggtcctgcaaccccgccgccctctgctcccgcggccatggcaccaagattagtggtcacatagttcgtcttcctgcgacggctcaattcgcggaggcgcggcatggcgactccgtcgctgccgacgcagattgtggagttcaattacaaggcgatagaggacaagctcaagagactggctctcgaagtgagccaccatgagaacaacattaggttcctcaaatcccaactcaatactgttgaagaggcgtgcgtcgacctgggaattaaacttgggaattaccattcatccgtggccgctgttgtaaataatgatacttctgctcaagaggctgaacagcgcactattcgaagtatacttgatcagggcaagacagcagctgggattatatgccaactgaaagtccgtcatcatgagctagcatctaagatgccactgatgaaagatatacttggttttgtggctacattgggaaaagtaaataatgataacctcagcaggcttctcacagagtacttgggaatggataatatgcttgctcttgtttgcaagacttatgatggtgttaagggtcttgagaaatacgacaaggatggcatcattgataacaccagtggcattcatggacttggtcgctctgttggaaaatttctggatggaagatttactgtcttttgtcttgaaaacttgaggccattttccggtgatgttatcattgacgatccacaaagaaagcttattttacatagaccaaggttgcctggaggggagtcgcctcctggttttctggattttgcagtaaatatgatccacctggaccgagcacacttgaggttcctcacagccagtggccatggtcttagggaaactttgttttatactttgttttcccatttacaagtttataagactagaactgacattcaaagtgcccttcctctgataaaagatggtgctgtttctctagatggtggtctactgagacccaatggctcattctgccttggccatagcaagaatcttgaagtgaaatttcctgtaaccactgatgtttcaagtttacctgaaaatgtcgctgaaatggaggaacaagttaaacgtaagaattgggagaaggaaatggttcttgaagatatgaaaagggaggaagatctgctgaaacaagttaaggaattatacaggaagcagaagcaagagctcatggattatgtcactcaaccagcagtgacacagatgtcacgtgattcgccagcaactcattcacccgcgactcctgggagcaatccgtttggagccaagctctccaacaagtggcgataacattttggtggcgtacatccctattttgttggggcttattgcctgctcgggcatcagcacaaagtaactagcttttgccacaagcttggtgttagtttgtgagggtgataggccagtgaaattgttctgctgcttagcatagttggatgccaattgatgtatagggttagaatgctttttagcttttcctatgctaatcaaattgccaactgctaatcttgattcttggctgttgatagcacaaacaaattggaagcagcagctggttgtcgttttagttgcttcttcaacatgcacattcttattgcgatgtgccaatatgtatatgcctgctcaacgtgcttgactgatttttcaaaaaaaaaaagaaaa

SEQ ID NO: 11687 - DNA, 473 bp, Zea mays
gccaagctctccaacaagtggcggtaacattttggtggggagtaatccgtttggagccaagctttccaacaagtggcggtaacattttggtggcgtacatccctattttgttggggcttattgcctgctctggtatcagcacgaattaactagcttttgccacaagcttggtgttagtttgtgagggtgaataggccagtgaaattgttctgctgcttagcatagttggatgccaattgatctatagggttagaatgcattttagcttttcctttgctaatcaaattgccaactgctaatcttgatccttggctgttgatgcacttttctgctcgatgcatgcaaagagattatttcatttatagcacaaataaattggaagcagcagctggttgcttcttcaacatgcgcattcttattgcgatgtgccaatatgtatatatgcctgctcaatgtggttgactgatttttct

SEQ ID NO: 11688 - DNA, 3556 bp, Zea mays
gccggccgggctgggctcttcctcccctcgcccgccggcagtcttgctcacacagcacatagcacacacacgacacgctgcgagagggggaaagaacttagaagggcaggcaggagaagcgacacaggaaactgacgtcgccttcggcggcctgctacttaaataaatcccctcgcctcgcctccggctgcctcttccctttttccttccgcgcaaatcactcaggtgccagttgcgcggcggagatcgcgacgaattccggacggcagggaggtggtcgggggaactgggaagtgcatgtgagatccgatggcggcggctgcctgcgccggtgcggaagcaggacgcggatgcggagggaaggacgcgctgttcgtcgagctgtggaaggcctgcgcggggccgctgtcctgcgtgccgccgcttggggagaaggtctactacctcccgcagggccacatcgagcaggtggaggcatcgacgaaccagcttgccgagcagcagggcacgcccctctacaacctgccatggaagattccctgcaagctcatgaacatcgaactgaaggttgagccggatactgatgaggtgtacgcccagctcaccctgctccctgataagaagcaagatgagaatacatctacaacagtggaggaagaggaggtggtggtgcctcctgcgctaccagccacaaatgagggtcctcacatccattccttctgcaagacattgactgcctcagacacaagcacacatggtggtttctcagtgttgcgccggcatgcagatgagtgcctcccaccattggatatgagtcaacatcccccaaatcaagaattggtggccaaggacctgcatggggccgagtggcggttccgtcacatctttcgaggtcagccacggagacatctcctgcaaagtggttggagtgtttttgtgagcgccaagcgtcttgtcgcgggggatgccttcatatttctcagaggtgagaatggggagctccgtgttggagttcggcgtgcactgaggcaccaaaccactatcccatcttcagtcatatcaagccacaatatgcatcttggtcttcttgcaacagcatggcatgcagtgaacactgatagtatgttcactgtctactacaagccaaggactagtccagctgaatttgtggtttcgcgagataggtactatgaatcactgaaacgaaattattcaatagggatgagatttaagatgagatttgaaggtgaagaggcagcagagcaaagattcactggcacaatagttggaataggtgcttctgatccatctggttgggctgactcaaaatggcgttcccttaaggtgagatgggatgaaccttcttctatttctcgtcctgaaagagtttctccttggcaaatagaaccttctgttagcccatgtcatgtgaaccctcttccagttagattcaagaggtctcgatcaagcgttaatgctttgccatctgacgtgtctactgtaaccagagaagtcacttctaaagtcatggcagactcgcagcaaaatagtctcacaagagccttgcacaatcaaggaaggacacaattgacagttcgataccatgataacagtgatgtgaagactactcaggatcttaccgtgtggtcttcaggaactgagcaacagagaaacaatattgctgcccagacaaagctatgtctggagggttggacgccaactagaagtcctgaaggctacaatcagatattctcggcatttaaaccactgaaagatatacataacccacttggtccttttcctagtcaaatatctgggactcactcaaatagctgggacacagctgatgctcgttatccagtccaacaagctaattacagcatgttacctggcacatggtctttgaggcctcataacagtggttttaggatgaatcaacaaaattatctagtgatgcctgaaggtgcaaattttacggggaaatcagctttcacttcacttcaggaccatggcactgataaatgctccacaggctgctttggtcatattgagtcaagttcccacacagaccatgcatcctcaagtttgatcaggccccagcctttggtccttggaaatggtgttcagaaaagcaaaggcacttcatttaaattatttgggattccccttggcagcccagaaaaatctgaacctctggtatccccaccaagtgtcgcatatgacgggaaacttcaaacttctccatcagaaaaagggaatcagctagacgtagttgaagtggataattgttctcatccttctaagactgtgaagccacttgatggtcctcagtcagattctattacagagaataatcagccttctccagaagctacccttaatatccagaacaaagtgcaaagtagttccaccagaagctgcaagaaggttcatcatatgttgcacctttttccttgctagtagtcattccttgatacataaatgcttactaggcccaaaccttcaattgaatacttctcaaagtatgctccaaagaagtttatgtactcttgatcccttttggcaacttgttttatgtatctagaagcaccggtccaataaaacctgctagttgtgtaacctactaacctttcatgctaataaattacttgagtttttcttgccccttcaagtgtcgtatttggatctgtttggcatcatcgaaagagctatttatccttaagttcggctgtcaagaaagaaaaaaaaagctgtgggaatcctgcgatgagactttttaatctttaagcagtatgccttttggatatatagtctagcattatgcaaatggttattaaatacaatgtggatgacaaatgtcacgttgtcattagattggtgacatgggctttgagaaatgttagctttctaatgataacggtcaaatgttctatctaattgcatccatttttctccggttgctttttattttattttatttatttgaggggaaggataggcctgacacaatataccgagtaaaggccttgggttcgacgcagcttttctgcaaaaatgtagggatatggcgtgcctcggttattacttcatcggactccactcaagtgttcataagcaagatgtttgacttcgatggtgagctgaagagtccatgcaaaagttggttagttgtctacactgacaatgaaggcgatataatgctggttggtgatgacccctggaatgaattctgcgatatggtccacaagatcttcatctacacgagagaggaagtcgaaaggatgaacccaggtgccctgaactcaaggtctgaagatagtctatctgactcgctgggaagaggggtagcttccagagatccccgaggaggcgggtctacttcggctctcgattccgagaactgctagtttgttcagtcagtgaggcctttggaagtgaagcagacaaaaggcgtgaatcttgcggtgtagagtgtagttggtacattgtgtgtatgcctccgggtaagccctgcggtacccagtttgtgtcctggcgccagtttaccatttaagct

SEQ ID NO: 11689 - DNA, 1004 bp, Zea mays
atccttctaagactgtgaagccacttgatggtcctcagtcagattctattacagagaataatcagccttcccccccgcctcccccccgcgtccggtacaaagtgcaaagtagttccaccagaagctgcaagaaggttcataagcaaggtagtgccctcggcaggtcgattgatctaacaaagttcgcttgctatgatgagctgattgctgaactggatcagatgtttgacttcgatggtgagctgaagagtccatgcaaaagttggttagttgtctacactgacaatgaaggcgatataatgctggttggtgatgacccctggaatgaattctgcgatatggtccacaagatcttcatctacacgagagaggaagtcgaaaggatgaacccaggtgccctgaactcaaggtctgaagatagtctatctgactcgctgggaagaggggtagcttccagagatccccgaggaggcgggtctacttcggctctcgattccgagaactgctagtttgttcagtcagtgaggcctttggaagtgaagcagacaaaaggcgtgaatcttgcggtgtagagtgtagttggtacattgtgtgtatgcctccgggtaagccctgcggtacccagtttgtgtcctggcgccagtttaccatttaagctaagtttttgggtgtgccctgtgctggggtctgggctctagttattgtagcagagcaggcaatgcatgcaagaaactgatgatgcgcctgtttggccctctttcccttcccaagccatgtaaatagccttggctctgaagcgtagtattgtattgtcgacagccgtacttgagatagtactccaagaggcgcgcttgctcctgtcagttgggtgtgcgtatgtagatgtgcgtgtgaagccatgcaagcaagggtttgtggggttgatggcttttcatggtagcggatctgctttcatggtactgacgtgcaggtggcaggcttggtgttggctgctatgttttgct

SEQ ID NO: 11690 - DNA, 2952 bp, Zea mays
gcaaaaatcgcccgggtgccaggtgcgcggcgcagggaggtcgcgacggattccgggcaagtgcatgtgagatccgatggtggcggctgcagcggcggccggcggcggcgccgacgcgggatgcggaggcggaggcggaggcggagggaaggacgcgctgttcgtggagctgtggaaggcctgcgcggggccgctgtccagcgtgccgctactcggggagaaggtctactacttcccgcagggccacatcgagcaggtggaggcatcgacgaaccatcttgccgagcatcagggcacgcccctctacaacctgccatggaagataccctgcaagctcatgaacatggagctgaaggctgagccggatactgatgaggtgtacgcccaactcaccctgctccctgataagaagcaagatgagaatacatctgcaagagtggagaatgaggaggcagaggaggaggtggtgcctcatgtgccaccagccacaagtgaggggcttcgcatccattccttctgcaagacattgactgcctcagacacaagcacacatggtggtttctcagtgttgcgccggcatgcagatgagtgcctcccaccactggatatgagtcaacatcccccaaatcaagaattggtggccaaggacctgcatggggttgagtggcggttccgtcacatctttcgaggtcagccacggagacacctccttcagagtggttggagtgtttttgttagtgccaagcgtcttgttgcgggggatgcattcatatttctcagaggtgagaatggggagttacgtgttggagttcggcgtgcactgaggcaccaaaccactatcccatcttcagtcatatcaagccacagtatgcatcttggtgttcttgcaacagcatggcatgcagtgaacactgggagtatgttcactgtctactacaaaccaaggactagtccagctgaatttgtggtctcgcgagctaggtactgtgaatcactgaaacgaaattattcaatagggatgaggtttaggatgagatttgaaggtgaagaagcggcagagcaaagattcactggcacaatagttggaatatgtgtttctgatccatctggctgggctgactcaaaatggcgttcccttaaggtgagatgggatgaagcttcttctgttcctcgtcctgaaagagtttctccttggcaaatagaacctgctgttagcccatctcctgtgaaccctcttccagtcagattcaagaggtctcgttcaagtgttaatgcctcaccatctgatgtgtctactgtaaacagagaagttgcttctaaagtcatggtagagtcgcaacaaaataatctcccaagggccttgcacaatcaaggaaggacacaattgacaggtcgataccgtgatagcactgatgtgaagactgctcaggatcttaccatgtggtcttcaggaactgagcaacagagaaacaatattgctgcccagacaaaacgatgtctggagggttggacgcaatctagaactcccgaaggttacaatcaactgttctcggcatttcaaccactgaaggatgcacataatccacttcgtccttttcctaataaaatatctgggactcgctcaagtacctgggtcacagccgatgcccgttatccagctcaacaagccaatcacaacatgttacatggcacattgtcttttatgcctcatagcagtggttttaggatgattcaacagaataatctagtgatgcctgaagctgcaaattttactgggaaatcagctttcacttcagttcagggccatgtcactgatcagtgctccacaggttggtttggacctattgagtcaaattcccacacagaccatgcatcgtcaagtttgatcaggtcccagcctttggttattggaaatgatgttcagaaaaccaaaggcacttcattcaaactatttgggattcctcttggcagtccagaaaaatctgaacctctggtatccccaccaagtgtcgcatatgacgggaaacttcaaacttctccaacagacaacaatgagccttgttcagaagctacccagaatatccagaacaaagtgccaagtagttcaaccagaagctgcaagaaggtccataagcaaggcagcgcccttggcagatcgatcgatctaacaaagttcgcttgctacgatgagctgatcgccgaactggaccagatgtttgacttcgatggtgagctgaagagtccttgcaggaactggttggtcgtctacactgacaacgaaggcgacatgatgctggtcggcgacgacccctggaatgagttctgtgacatggtccacaagatcttcatctacacaagggaggaagtggagaggatgaacccaggcgccctaaactcgaggctcgaagactgcctgtctgagtcgctgggaagagggctggcttccaaagagccccggagcggcccctcgacttcggctgtcgattccgagaactgctaacttgtccagtcagtgagcccttttgaaagtggtgaagcagacaaaaggccacgtgtcagagtgaccggaagaacgagaaaggggtgtgtttcagtggtgtgtagtaggtaggtaattttgtgtgtatgcctccgggtaaaagccccgcggtacccagtttgtagatggtgcttctcctggtgctagtttcccgtcgtaagctggatttttttggggggtgtgtgccctgctctgtgtgctgacccgcctgggggtaagttgtagcagagcaggagaaagcaggcaagaaaccgctggtgcgcctgcttggccaatccttttccttgcggagcgctgtaaatagccttggatctgaagcgtagtaatgtattgtcatggtactcgaaaaaaaaaaaaaaaaaaaaaacgacaaaaaaaaaaaaaaaaaaactcgagggggggcccggtcccca

SEQ ID NO: 11691 - DNA, 1841 bp, Zea mays
agccactgcccaaataatactctttggttagccaaccgaaattctctagcctggcaacagccatgggagaagcacaagactactacaacacctccacggctctggccggcgccgccgccgcgggcctcgcgctgctcgcggtctgctcgtactacctgctcgtcgggcggcgccgcggcaaggcgccgaagcggtacgcgccggtggtggggacggtgttccaccagctgtaccacgtccggcggctgcacgactaccacacggacctgttccggcagcgcaagaccttccagctgctggtgccggccggccggcggcagatatacacgtgcgaccccgccgtggtcgagcacatcctcaggaccaacttcgccaactacggcaagggcagcttcaactacgagaacatgactgacctgctcggcgacggcatcttcgccgtggacggcgacaagtggaggcagcagcggaagatcgccagctacgacttctccacgagggcgctgcgcgacttcagcggcgcggtcttcaagaggaacgccgcgaggctcgccggcatcgtctccggcaacgcggcgtccgggcagcccatggagttccagggcctcgcgctcagggcgaccatggactccatcttcaccatcgccttcggcctggacctagacacgctgggcggctcggcggaagggagccgcttcgccgcggcgttcgacgacgccagcgagttcacgctgctccgctacgtgaacgcgttctggaaggcgcagaggttcctcggcgtcggctccgaggcggcgctcaagaagcgggtcaaggtcgtcgacgagttcgtgtacaagcgcatccgcgagagagcccaggagctctccgacagcaagctggcgaccgaggacactgtccctgattcgaggcaagacatgctgtccagattcatccacacggccacgaacgagtccgggacggtggactacaagtacctgagggacatcatactgaacatagtcatcgccggcaaggacacgacggcgggggcgctcgcctggttcctctacatggcgtgcaagcacccggagatccaggagaagatctgccaggaggccgcaaaggcgaccagcgccagcgagacggcgggcgtggacgagttcgcgcagagcctgaccgacgaggccctgaacaagatgcactacctgcacgccgcgctgaccgagacgctcaggctgtacccgtcggttcctctggataacaagcagtgcttcggagacgacgtcctgcctgacggttccagcgtcagcaagggagacatcgtgttctacgtcccctacgccatgggccggatggagtacctctggggcaaggacgccgaggtgttccggccggagcggtggctggatcaggacggagagttccagcaggagagcccgttcaaattcacagcgttccaggctggtccgaggatatgcctggggaaggagttcgcgtaccggcagatgaagatcttcgcggcggtgctcctccgattcttcgtgttccgcctgcgcgacggcgacaaagcgagcgtgaattaccggaccatgatcacgctccacatcgacgagggtctgcatctgacagcgacggcgagatgaggtcgcctggcctggccaccggtggacacgtagccgccggtgcctgtagctacgcgagcgacaggtccttgataccgtaccttgtgtacatatatatatgcaaagaaacgaaaacgagcagtggtagtggtagtaggctcccacattccgctttgtgtactgcgtcttcttggggaataatgacatgccatggcagttgcaggctagcttgcatgc

SEQ ID NO: 11692 - DNA, 962 bp, Zea mays
tggccctgctctgggtgtgctcgccactgtcgcagagtgctcagtggaacccgcggcacaaactaccccgcgattgggctcgaatggccggtcggcacctttcccaccacctgtcctcccccgcgtctgcttctctcctcggccccgaggcatggcgccctgcgcgtccccgtccgccctcgcgctctccgccagcacgcgggtcagcagcttcccactgacgctgcggctggaggcgcgtgtggcgcgcgcgcccggcagcgcccagctccgcccggcgaccgcgtgctcttggccgcgccccttgctgcccgagctcgcgccggcgttccctcgcgccggcgcccgcagcgccggcagaccgcagccgctgttccgaccacgcgcaatgatgacgacgtctcagatcgccagctgcgccttcaccgtgggcacggtcgccgtcctccccttctacacgctcatggtcgtcgcccccaacgccgacatcaccaaacgcacggtggagagcagcgccccctacgtcgccctaggcctcctctacgcctacctgctctacctgtcttggacccccgacacccttcgcgccatgttcgcgagcaagtactggctccccgagctgccgggcatcgtcaggatgttcgcgagcgagatgaccgtcgcctccgcgtggatccacctcctagcagtcgacctcttcgcggcgaggcaggtgtaccacgacggtgtcaagaacaacatcgagaccaggcattcggtctcgctgtgcctgctcttctgcccagtcgggatcctggctcatgtggtaaccaaggtattggcaggggcagctggtcgctcacattgatgattggaattgggttgttgtatctaggatttccgtttgtttagctggtggagtttatgagatctggatatgaataaagcttgttcaaggcaaaaaaaaaaaaaaaaaagcggcc

SEQ ID NO: 11693 - DNA, 3237 bp, Zea mays
  misc_feature (2307)..(2307): n is a, c, g, or t
  misc_feature (2818)..(2818): n is a, c, g, or t
  misc_feature (2820)..(2820): n is a, c, g, or t
gacaagaaacatttttatacacagacaataatctgacagctatgactggaaaaaaggaagatcttccgtccttttttaagaaaaagaggcgtaggcgtagaagtagaattcgagcctcaagcgctgcctgcctgcagcctgcttcagattttcagagcttgtcgacgtcgacgttcctgaagctcccgccaagcaacgacagcagaccaccgccgtgcaccctcccctcggggacagcgaccacccctccctctctgctcctcgccggtggctgcacggctgccgctgtcaaagatttcatagagtgggggaccagcacctggggagggatcaactcatgcctccctgtcgccgcctcaggcgagccgtcgcagtccgacaccgtgctcacgcccgacgacgagtactcgctatacatgttcgccgcgctggcggaccgaacgatgccgcggaagaggcctggcccaatcatgccaccgccgccgctgcggcgctgccgcgaggccaccagcgtgccgtgcgccgcgcagagcccgctccggccgcgcgcgaacttctcgcagacgcctccgaagttgcagcgcttcccgccgccgtgggccttgcagtactcggtgctcccctgtgcgctcttgccgcacccatccaccctgcaccgcttgccaccgccgtgcttcacgcaacagtccgtgcgcccgcgcgcgctcttgctgcacccaggcaccgcgcaccgcttcccgccgccgtgcgccacgcagaagtccgtgccgccgtggacgctcttggggcacacgccgccgccctcgtacacgcaccgcttcccgccgccgtgcgccttgcacagcggcgtgctgccttcggcccccttgccgcacccctcgaagacgcaccgcttcccgccgccgtgcgacttgcagtacagggtgctgccctgcgctcccctgcggcagtccgggaactggcaccgccgcccgccgccgtgggagatgcacagcccgaccctcccctcggcgctcctgatgcagccctcgaccgagcacctcttcccgccgccgtgcttgatgcaccgcccggacttgccccgcgcggctttagggcagtcaaggtagccgcaccgtcggccgccgccatgggcgatgcagtgatccgtcttcccttcggcgctcttggtgcagccgagctgcaggcaccggcgtcccccgccgtgggccttgcagtaggccgtgcggctctcggcgcccttgtagcacccgggcttctggcacctctgcccgccaccgtgagcgatgcacaggcccgacgcgcctcgcgcgcccttggagcaccctttgaacctgcacttcttgggatgccggcgttgagtctgctgtccaggattgcttgccaccgtcacaacatcagagctcgcgccaccaaaggaagcttccgtcatggatgccgaaggttcagggctgaaccgaaaaccgcggggatcagtgccaccattattactgttgtccgtgtcatctagcaaaccctgctcctcttcagctgtcgaatagtttggcagaggcgccaagagcagcaatggcatgtagccgccggagcttctcctggcagacgtggagccctcgtcagcagtggaaaaggagatgacggttccggcaggcacgggcacgcccaagtgtttagttgctccagcattatcacgcccccgatgaattccaaggctgagcgcccctggatcagcgaaggagaagctctggccaaacaacgttacaggtggtctcgacttgtctgctccggcaggctgctgaccacaatcacaagagttaacgtctggggccggcgtcggacccagcccgaggactagcctgcatccatcatcttgagcaggcgcatgaatcgacctctgaaaacctctgcggccatggccgctgctattgttcactgctgaacccagctggtctatgcctaatgttacctgactctgaccatggctacctgttgtgtagttcgtcaccgagaaaccaattgacactgcaggtccatccatggtattcatctaggctacgtacttgaaaaatacagtgaaggtggtttactgatctcttatacgtgcagagtcgagtagacgaagtgaaagaatatcagcagcagtgaagtaccatctgatccaccgctaacaaagccagatgtgtctgcccggtccattactgtcttgctccagtacaaaaactgtgatccaggagatggtgacttatgttcactgacagtttatcatcaataagaagcagaggtggtgccactgaattcttcagactgcantactgcaaaaaggagtagaaaaacagttcagattctgttctagaagaaaaaaaaacgcgtaggcaccgtttggtatgcgaaaatttcacgacagtatagttactatctcatgacatccttttcttgggataattaactaagaatggtttatattatgtactagtgttcacagtttgacgccatccaccacgcccatgtaattgaattcaacaacagaaccacgtaacgaagacctctatttactgcgcttcagaagaactgattcattatggtggcgtcagtaaacatacaaccaatcataattatgaacaaagttgaccgggatatttttttcttcttcaaatagatctacattttgttgcagaccagaaagaccatggacacactaataattgaaggtaaataaacaaagtaaaaacgacaagttgcctaactattctgcctgtgtctgataggtgccttttatttttccaataattaaccttttgccttgggtgttagagctagtttnangaacggagaagaaaaagatgccaagcacaaacatgagacttgagacaataaaatcatttaagaccaccatgattacatgattgggaccaagaatttgtgcaacacataggtatgttaaaatctcatgttcttcagagaatacatatacgttgacatctcggcagaacaagttgactttccaggctatcaatccttagataggttggttgtggcgctatgcaaacaattttgagaaaacgatatgggatggatgtcaagtaacttaatgcgtgattattcaagaatcactcagtgatgacgccggcccgtacagaccttacagaagtactgtacatagtttaggctggttcaggtcatacgtatgcctacgaacagctggggtcagagctcatacctttgagcaaattttctaagaca

SEQ ID NO: 11694 - DNA, 889 bp, Zea mays
  misc_feature (869)..(869): n is a, c, g, or t
ttgggtacctcgaggccggccgggtcacggcgcaagagctttgctgatgcattgcaggaaaatattagccgcaccgctgctacagccggtcacctttcacctcctaatcgccgcgctcgcccttgctggcgcaactccaatcaggtcatctgattcacccaagccacaactgcagcatagatcagaatccatgaatggcctgcgatctggatccacttcacccagtttggtcagggtgcaaagtcttggttcttcaatgtctcatacatttgcttcagcagtaggctcatctatctcaagaagcaccacccctgacccccagctgatacgtagaactccaagtccttgccttcctccagttggagttcggatggggagttctgataaaaaagttgaagctgcagctgttgcttcacttaatcatgataatgctgacattgcggcaactctgtctagcttaaacctatctggaaataagatgtcaattgtggaaaatcaagctcagaatcatgtttaccagaactttggtgaccagacagatgtgctctttaatgtaccaaaggaacacaggcaattttcaccacaaattttaagtcaaaataccgatgacggctcgtttaatgcccctgaatatgtagtttttccaaatggggggagcaacttcagttctgcttcttttgcatattgttgtgctcgtagcgtagaggcattgggttttagacgtcctttatttctgaaagaaagaaactggttggttcgttatcaattagctgcaatggtggaataattcaacagaagcaacaagtggaagaagcgtggcatttcttgtgtgcctgtaacatatgaggtgcagcttcggccaactcagnaaagtgtctatcatgaatga

SEQ ID NO: 11695 - DNA, 5066 bp, Zea mays
  misc_feature (304)..(304): n is a, c, g, or t
  misc_feature (2290)..(2290): n is a, c, g, or t
gatataaaaataaagtaaaattatttataagtaagggtcaagaaccttgttgtctccatattcatactcatctaaccaacaaaatatacatattttttatgtgaaacaaattatattcatgtaatatatagaaactctaatatatagaatctctagtaatgcagcatggcgctttgagattcggggaggtgcgggatctgacggatgggagcagctggggaggcgggctaccggtctcgagaaaggaagaaaaggccacacgtcgctttcagcctccgcctccgctcccttcctttcccattcntctcgtctcgctctcgcctgccgccttcccttcgcgtctcctcgctccggccgcagcagccgcctccgccctccatccgcaaaattacccaatccatcatccccgaaccctaaataaatcctcgatcggccgcgcgcgggaatcaacggatgggaccgcggccggcggctccgtagcggattggaggcgctcggttcgcgggggccgcggttcggctgccgggtggcgcccgcttctagaggtgagatttttgcaggtgtcgtttaggttcacgatcgactcctcggtaggggtagccgggtaggactgccgcgtttttattttcctctgttccctttacctgcctatctatatcttagttgcgatatggaattaatgtttggttgtttcgtccgcggattaggatgttttcccgtcaagttttgtcggttagtcccctgcaagttaggtttccagtggcttagtgtttggtttgtatattcagtccgatgtaacttgatgcgccagctctttatgcttcccttaaaggcgggacttatcatccgcggaaactcgggatcgaaacgatttcgtgtgttctgtaatcaagtttttctcatcataacaaagatgcgtccgatcattcttccaattgaattttcatgcataatttcagattacaactcgactctatgcaagttttttttttgggggggggggggacagtactgaacaccatttgcttactggtttagggaaaccaagaaggaaggaaggagattggaataaagacaggcactgcaacgatggctccatctcaagcggcggcagcggctggccccacctttgaggacctcgagcgcgacctgcaggcagttctcatggaccaaaaccacatgtccccagtggacgacctcggcatgtttcgcagcggcagcgctccccccaccgtcgagggatctcgcacggccattggcgcactcttctctggtccaccgcttcacgccaacagccttggcgccggcggcggcagcggtgggactgcttctggccttgacgtgctcactgatgaggagatacggtcacacccagcgtatctgtcgtactactattctaatgagcacctcaacccaaggcttccgccaccaatggtttccaaagaggactggcgtgcagcgcagtggttccaggctgtgtctggaggtattggggataggaggaggaggcctgcggaggtcgggagtggaaactccctgttctcggtgcagccaggggcaaacgaggttggtggagagaaggcgctgctgagtgatagaatggagaggagtggaaggaatgggctcgcacgacagcagtcttcagagtggcttgggagaggctccgatgggctcatcggcttgtcagatgccagtgcccttgggtctccgcgcaagagctttgctgatgcattgcaggtttgtagcatatttcactgttgattttgatttcattttgtcgctgcagttacattttcagtagaagcaaacattgtagttgaatgaaattatattacccatcttcagtataaccaaacatttggattaagtgaaattctcttctgaactctttgggatggaatgcttatatgaaattagcagattattcactttgcctgcaaatcatacttttagtaacataaaatccaccagaggtatcttcactgctgaacttgatggctggtatggtgatattttttttggtgcctgacattaccatatgaaacttcgtgcacagatattgataggctactgctataatttatccccaaaatatttgttactgcgtttttcattttgttttgttttttattctcatctgcaattgtttcaatggcaggaaaatattagccgtcctgctgttatagccggtcatctttcacgttctaatagccgtaatgttcttgagggcccaactccaatcaggtcatctgattcacgcaagccacaactgcagaataggtcagaatcnatgaatggcctgcgatctggatccacttcaccgagtctggtcagggtccaaagtcttggttcttcgatgtctcataccttcgcttctgctgttggttcatctatctcaagaagcaccacccctgacccccagctgatacggagaactcctagtccttgccttcctccagttggagttcggatggggagttctgataaaaaaagttgaagcttctgtttcttcacttaatcatgatggtgctgacattgtggcaactctgtctagcttaagcctatctggaaataagatgtcgaatgtggaaaatgaagttcagactcatgcttaccagaactttggtgatcaggctgatgtgtcgtttaatgtaccaaaggaacataggcaattttcaccacggaatttaactcaaaaaactgatgaagacttgcttaatgcccctgaatatgcagttttcccaaatggggggagtaacttcagtaatttgcatgctagtaaggtggcatctcatagcattagcaagttccctatgcaatcaccacacggttatgccaacaagaaaggatctttgatgagctcagctggatcagtttctcagtaccagcacttgaatggtgatagccatgacattgatgtatctggatggcatactcatacaggtggttttacttcatccatgctgaacaatcaactgaatcctgatggtgactatggcaatgttctttcgaatcatggtggatcgagttatcagggccaaccaacagagacgatgtacgcacaatgcttgcaggcaaaccctgattcaccccttggcgcagctgcaagcatgagccctttccaagggaggggttttactggttcaggacacttggatagtcctggataccaaaaagcttaccttgggtcattatttggccagcaaaagctacaatatgggatgccatacctgggcaattctggtgctcttaatcaaaatatctatggcaatgattctgcctttggcattggaatgacttatctaacaagcccgccatctactccatatatctcatctccccaaggccatgttgggcaaggaaaccgtctgactcgacttccagcagtggtgaggaacaccgctggaggatccatgggatcgtggaattcagagaatggtctgatggataatggttatgggtcctccttgctggaggaattcaaaagtaacaaaactagatcttttgagctgttagatattgtaggccatgtggtagagttcagttcggatcagtatgggagtcgctttatacagcagaaactagaaactgcttctactgaacagaagaatatgatttttcctgagatccttccccaggcacgtactttgatgactgatgtttttggaaactatgttatacagaagttctttgaatacggaactgaaacgcaaacgaagcaactggcaaccctgcttaagggttttgtgttacagctgagtcttcaaatgtatggctgccgggtgattcagaaggctttggaagttgttgaagtggaacaacaaacacaaatggctttggagcttgatggatctatcatgagatgtgttcgtgatcagaatggcaaccatgtcatccaaaaatgtatagaatgcatccctcaggagaggatacgatttatcatttctgcattttacggacatgtcgtggagctttctatgcatccttatggttgtcgtgttattcagaggatcttggagcattgtgacgatgaaagcactcaaaatgccatgatggaagagatcatgcagtccgtggttactttaacggaggaccagtatggtaattatgtaatccagcatgtcctgcaatatgggaaaccagaagagcgttctactataattgcacaactcgctggacagatagtgaagatgagccagcagaaatttgcatccaatgttgttgagaagtgtcttacttttggttctcctgagcaacggcagattctaatcaatgaaatgcttggcacaactgatgagaacgagccgttacaggcaatgatgaaagaccagttcgcaaactatgttgtgcagaaggttctggagacatgtgatgaccagaaccgtgaattgattctttcccgtatcaaggtccacttgaatgcactgaaaaggtacacctatgggaagcatattgtgacacgtgttgagaagcttattgccgcaggagaacggcgcattggcgcactaccctcctgctgagatggcaatggttaggtcacctgtacagcagaagatagcgaggcctagctttttaccattaccagtagtcgttaatattgagcaagtacaaccgcagaagttaaaaaagaaaggctcccaaatcctttgtaaataaaggagagcctctggaaataaataagaatgagaaaagatgagattttacttgtcctcgaggaaagacttgtatatttgtattgtttttcccccctcttgcaagcagcaggataaagaagttttaaatattttgtcgagaagcaaagcagttactagaaggataaaggttttaggatcatagatgatgggaaggactgctgtagattctccttttttccttgggtttcatcagtcagtgtataagtactaatgtccatgctgatgttaatctctgtaagactgccttcagtttactgaatcttttttttctcttctggtgcctgccaagtgccagcatctgagcagttcttcaaatattacttgtttccaaccactcaactttcggataatctgcagggggggcccggtacc

SEQ ID NO: 11696 - DNA, 1171 bp, Zea mays
ccggtccggaattcccgggtcgacccacgcgtccgagatcatgctttccgtggttactttaacagaggaccagtatggtaattatgtaattcatcatttctgctttttacggacatgtggtggagttttccatgcatccctatggttgccgtgttattcagagggtattggagcattgtgatgatgaaagcacacaaaatgccatgatggaagagatcatgcagtccgtggttactttaacagaggaccagtatggtaattatgtaatccagcatgtcctgcagcatgggaaaccagaagagcgttctacaataattacacaactcgctggacagatagtgaaaatgagccagcagaaatttgcttctaatgttgttgaaaagtgtcttacttttggtaatcctgagcaacgtcagattctgatcactgaaatgcttggcacaactgatgagaatgagccgttacaggcaatgatgaaagaccagttcgcaaactatgtggtgcagaaggttctggagatatgtgatgaccagaaccgtgaattgattctttcccgtatcaaggtccacttgaatgcactgaaaagatacacctatgggaagcatatcgtggcacgtgttgagaagcttattgctgcaggagaacggcgcattggtgccccatcctcttgctgagatggcaataaagctatatacaggtcgcagaataacacctgtacagacagacagggatagcgaggcctagctttttaccattaccagtagtcggtaatattgagcgacggagaggttaaaaaaggctcccaaatcctttgatgtaaataaaggatagccgctggaaataaataaaaagaatgagaaaagatgaagagattttgcttgtccttgagggaagagttgtatatttgtgtggtttattttcccctcttgaagcagatggataaatgttttaggatcatagatgatgggaagcaagggcagctgtagattatcctttctttttttccttgggtttcattagtcaatgtataatgtattaatgttcatggtgatgctaatctctgtaaagcctgccttgagtttactgacattttcctgaaatgaaattaaatgcatgtttcctggtaaaaaaaaaaaaaaaaaaaaaaaaaagtcgacgcggccccggggag

SEQ ID NO: 11697 - DNA, 2198 bp, Zea mays
  misc_feature (2)..(414): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccccaaaaaaatccccatcagaaactcttgccttctctataaaagccttccactctcaccatctgattggatgagatttgaattgtcacaagccaatgtttgattgcaattgtgatgtatttttcagaaaacgactgttgaattgtcatgagcaatgaagtggtggtgcgctgccttcagttgtgacgctgacagcccaaccagggtgaaatccttgattctttaaaaagaaaagagaaggggtatcagcaaggttcctaaatgtgaaatcgccattggatgccttcctcaagaaataaacgggcagacaggagtattccacaactgaaaacgcaaggcaagctagaattaagatgagaacaaactcactgacaagatcttactgtgattagaggggggaaaaactcagagacaatgagaggctgatctggccggaacgtataaaagcttaaacactgttggttctttgtccatggaagtttattaaaaagaagacagtgacagcgacctctgtgtctctacatataaaacaatgaggcagccacccactcttcccattagcaaagcgtacatccctccaacaaaccttgagttgagagaggagagaggagagaggagacagcaagcgacacaacacagaggtaaccggctcacgcctgtctcggtggccgtgggcaatcatggccactgtgggacagtccggggccctgaggagggtcaccgtgcactacgccaactcgcccacaggcagcacggtggcagaggtgagctttgacgaccttgacgacgagctgctcctgtttgtgctcgccgatcttcttcctggccaggaaggtttacaccagtcgatcttggaaggaacatacaacaaccaggagaaccacatgagaggtgcagcacccagtgcaccatatggttattcacggccagaggaataccgtgcagagagcagcactgctgcagcagcagcaactggttctaggaattcaggcatggatgaacagatcgcctcggacttcgagtacgccaagcagctgcagcaggagatggaggacctcagcgtcaaagacgaagacgacaacgatatcagctgcgtgccgtctccatctgactctgacgatgagcacgagcatcatgacgaagaggaagaggctgacaggcaggaggacggtgatggtgatgatggtccagacaacatgacttatgagcaaggacaggcacttgtagaatctgtggggactgagtacagaggtctatccgatgagctcatctcctacctgcagtcatggaagtacaagtcttcagggctcttctcccggaaaacaaaccatgaagactgcccgatctgcctgtccactttcagaaaccgggaaaccatgataacgttgccgtgcaggcatcactaccacgcagcttgtgtcaccagatggctcaaggtcaacaagacatgccctgtatgcaaatacgaactgtttggaccttcctaggatccgaccacgtcgacgatggagctgagaagataatgatgatgacgacgacaacgacagatggttgtgtcatctgctctctttttttagcgccaagaaaactggaaatgaaaaagggaaatcaatccgaaaggagaatagaaattaggaagtataggtagaatatctctcttgccagtgactatgtatttgttgtgcgatgaattaagcatacctcgtgctatttatgatgtattggatttttttatatataagaacttccccgtggaatcactagaaaaaaaaaaaaa

SEQ ID NO: 11698 - DNA, 1146 bp, Zea mays
atcttgcgcgccagggccagcgcgcgagcgacctcacttgatccgctcccttcgccgcgacgacgttcctacgcagctgcggtcgacgcgcgcacggcagctcgctcgctagctgatcacgacagctcgctcggctcgaccgaatggcgccgcggctgctggcgtgcttcgggcgcggcgtcgcggcggcgccggacgacgcgactggcgagggccagctggaggcgccccccgctggcccggtgctggtggagctgttcgggtcgcaggggtgcggggcgtcgcccgaggcggacgccgtggcggcgcggctggcgcaggactccgggtccggggacggcgccgtcgtggtgctggcgttccacgtcgactactgggactaccgcgggtggaaggaccccttcgcgtccagcgcctggaccgtgcgccagaaggcctacgtggaggcgctccgcctcgacacgctcttcacgccgcaggtcgtcctgcagggccgcgcgcactgcgtcggcaccgaccaggacgcgctcgcgctggccgtccgcgacgccccgcgctaccccgcgcccgccatcaaggtcacgttccagcggccgagccccgcaacactgcaggcgtcgttcacgggcaccctgcgcagccgcgtggagggcccaggcggcgcgagcgtgctggtggcgctgtacgagagcgggctggtgaccgactgcgggcgcggcgagaacaagggcaagtcgctgctcaacgaccacgtggtgcgccgtctcgagaaggtggccgccgtgcgggagggcgcctcgccgaagaagaccgtgtcgggcaccgtccagttcccgctctgggacggctttcgcgccaccaagtgcggcctcgtgctcttcgtccagaacgccgcgctgcaggtgctcgacgtccagcacttcgacctgcctgacaacgtctgagctcgtgacgcggtggggcgcgcgcgcgttccgcgttggctgcctccctgcggcgggcgtcacattctttgtatcactgtatgtagtacatcactggatggtatttagatggaaaacctgagtattctttatctccacgtatgttcttgttctgcattatggcaatggatcttctgttttgcacactaaaaaaaaaaaaaaa

SEQ ID NO: 11699 - DNA, 2087 bp, Zea mays
tctgtttgatgctgctgctggtttttctactcgtagtgcccgtgctggcactagcactggcgtgctggcgtgcctgttggcacggcacgacacggttaagcactggtagtgccgtgcctgggccgagggcccagcacgctggcactaataggcacggcacggatcttctaccgtgcctaaccgtgccgtgtcctttcgtgccgtgcctagccgtgctagtgccagtgccgtgccgtgcggcccggttggccatctataaagcaaagcatcatcatgcatcgtgaaagcaaaaggcgtgctcctcctcttttttttttttttttatactagtagcagtcatggagtatattgcatctcagatcgcactgaaccagtggaaactaaatgtagcaaaagtcagcagcaggaaaagatagatgaaaaaaaaacaaagagggctgcctggaggttaggcgtgggcgcgtaacacacacatggcagctagccggcgacgatccaagagcgggtgcgtggcgacaggctggtaccctgttgccgtcgcctccgccatgttacgttccaccacctctcctctccactccacccacccaacagctgcccccaccaatcacatcacacccagacacctcctacttatcttgcgcgccaagggccagcgcgcgagcgacctcacttgatccgctcccttcgccgcgacgacgttcctacgcagctgcggtcgacgcgcgcacggcagctcgctcgctagctgatcacgacagctcgctcggctcgaccgaatggcgccgcggctgctggcgtgcttcgggcgcggcgtcgcggcggcgccggacgacgcgactggcgagggccagctggaggcgccccccgctggcccggtgctggtggagctgttcgggtcgcaggggtgcggggcgtcgcccgaggcggacgccgtggcggcgcggctggcgcaggactccgggtccggggacggcgccgtcgtggtgctggcgttccacgtcgactactgggactaccgcgggtcgattaggaccttcgcggtaatggtctcgtgcgtgcgccagaaggcctacgtggaggcgctccgcctcgacacgctcttcacgccgcaggtcgtcctgcagggccgcgcgcactgcgtcggcaccgaccaggacgcgctcgcgctggccgtccgcgacgccccgcgctaccccgcgcccgccatcaaggtacgtacgtacgtatgctgcgtaaaattgcatacttcttgcacaaactgtttagctaactgctctgcaaatttaagaaccaagacaaaaaaaaaaaaccctggatattccaaatgctgttgctgtagagcgtctcatgatcgccactactatgcttacgctggatcggcaaccaacagcgattcagatctgccgtaaccggatcgcccgtagacgctgggggcctggggtgtcactgtcactgtagactgatgagcgtgattgcgtgaagccacgacctgaccggatcggatgcgcgcgcgcaggtcacgttccagcggccgagccccgcaacactgcaggcgtcgttcacgggcaccctgcgcagccgcgtggagggcccaggcggcgcgagcgtgctggtggcgctgtacgagagcgggctggtgaccgactgcgggcgcggcgagaacaagggcaagtcgctgctcaacgaccacgtggtgcgccgtctcgagaaggtggccgccgtgcgggagggcgcctcgccgaagaagaccgtgtcgggcaccgtccagttcccgctctgggacggctttcgcgccaccaagtgcggcctcgtgctcttcgtccagaacgccgcgctgcaggtgctcggcgtccagcacttcgacctgcctgacaacgtctgagctcgtgacgcggtggggcgcgcgcgcgttccgcgttggctgcctccctgcggcgggcgtcacattctttgtatcactgtatgtagtacatcactggatggtatttagatggaaaacctgagtattctttatctccacgtatgttcttgttctgcattatggcaatggatcttctgttttgcacaccaaaaaaaaaaaaaaa

SEQ ID NO: 11700 - DNA, 1666 bp, Zea mays
cagtcaccactaaccatgcagagacacagcccacttgcctcgccgcgccgcgcttctgccgaacccaagccaggcgcggaccggagaccccacccgcattctactactacaaaaggccgcgcgcccccgcgccgcgggccgccaccactcccagtcccagtctcccaccgtcccacgaaacacactcaactctgccccgaagcggagaaccgccagccagacatgaagagaaccagagcgcagcagcccaaggtcgaggagccgcaggacctcgccgccaacctaaagccgcagcgccgggacaaacagccgaggcagcccaagtcaggcgccaaagcgaagcccgcggcgggcccgcgcgtcgcggcggccacgaccctcgccgccgccgccgccgcagcagcagcagcagcaaatgccgcctcggccgcgtcgtcgcccgggccggaaacggctccgaccgtgccggacgtgtgcgtcggcggggacaaggacggggacgcggacgcggacgcgagcgccgtggactgggacctcgacgccgggctgagcgcggcggcgtggtggacgtggggcgtggacgaggagaagctgctcggctggttccccttcgtggaggaggacttccggtgcgccggcggcggcgccgccgaggtggccgccttcgaccacgacatttggagcatctggtgaacgaacctttgagagacagacaaccgagccggtggcgatgcttctttcgctggtcttgctctgccctgccccaggggttggaggtagtgtcttggtacagtgacgggggaatgcgggcggaggatgtgtaggcgaggtttgctagtcgactagataatgccgcgtgtctgcaatggcgcaattccaagcgcgctcttcgttgctccatcgatcgcgcagtgtctgcccggaagacgttctcgattcatacataagaacaacggcagcaatttcaatcaagcgcatcagcacccaaaaacttgtttagcgaagtactgtatgcaggatttgatagctatgtagaattgtgcaggcggtgtgtgctactacgggattgcgatttcaagttcactagagcttgggcatgtgggcaaaacgttgcgaggccgaaatgtcgtccatgtttcttcgccggttacttgggtgtataatgcaactgcccacacatattggaactgcgctccgcgactcaatcccgaacagtttggatattttagctgcttactcattcctagaaaggtcgtacatccccctccgtttcaaaatattattgttttttatatttatattcaaatagcggagcatgaatctaaacacatatataaaataaatatattagttatggtatgaatcaactaaaaagataaaaccatcattattttcggacagagtgatatttttttgtatacacgttcgtaagtatcattgaatcgacggtctaatatatatctacaacaagcatatttagctttctaaaaacaaatatatttagctataaatgttgataatactaatttcaagtttagtcagacacaatgtgtctttctggacaaaagattgggtcgcaggaggtacttaactctctgttccgcaaccgtttctataccaacacccagcagctgctacagcctacatgaccatcacggagcctaaa

SEQ ID NO: 11701 - DNA, 1520 bp, Zea mays
actgtagtatttcaaaaactgtggttttcaaaaactttgttcccaaacagggcctaagttgctcttagtgctgcaccggccggacggtgacatcgctttctttggttgcgtgcgcgtgggcgttgccgttgccgccttgggactatctattatatccgcctgctgctcggccggcaaagctgaccgccgaaacacagctagctcgctgtggcaggctggcagcatgttccgatctgccgtgcagcgtctcgtcagggccagcgggaagagtacggccgacccagccgccgccgcgtccgctttcttcctcagtcgcttctccgcggcggccgggccgccatcgccacagaggttctccttctccaatctccatctcaccgagctagctagctagcgctagccacctgctggaatccttcatcccgcatgccactgcacggtcatgtctgactcctctcgtccgtcgtcgctaggctggctggaaaggtagcgctgatcatcggcgcgcggacgcgtgggccacgtcgccgcggagctgagcctgccgggggggcccggcccggcggcggccgtccactacacccgctgcgacgtgaccgacgaggcgcaggtcgcggcggcggtggacctggccgtggagctgcacggccgcctcgacgtgatgctcagcaacgccggcatcagcggcagcctggcgccggcccccgtggcggcgctggacctggccgacttcgaccgcgtcatggccgtgaacgcccgcgccgcggtggcgggcgtcaagcacgcggcgcgcgtcatggtgccccgccgcgccggcagcatcgtgtgcacggccagcgtggccggcgtgctgggcggcgtcgcgctgccgccctacagcgtgtccaaggccgccgtgctgggcctggtgcgcgccgtggccgggcagctcgcgcggtcgggcgtccgcgtcaacgccatctcgcccacctacatccccacgccgctcgtcatgggcgccatggccgagtggttccccggcgccaccgccgaggagcgcaggcggatcgtggagaaggacatgaacgagatggacggccccgtgctccaggtggaggacgtggccagcgccgccctgtacctggcgtccgatgagtccaagtgtgtcaatggccacaacctcgtcgtcgacggcggcttcacggtggggaaggcgcccaatatgccgccgcctggaaactactgagcagctaccacttgccaatctaaaggcacggtggatgactttctattgagcatttctttttcttttgcgattggaaaacttaggtaatatagttaaaagaactcgatcacgcgttttctttccatgtgcaagaacatggctagcttaatggtacacagtctgtgttgttggctctatagatctatgaaaagcttccagcatgactgtccacttggtgatgcgtcttgtagcgttaaggttgtgtagaatatcatcgagcagctagtcgcatcttacgtgcaagaaataccggtag

SEQ ID NO: 11702 - DNA, 1109 bp, Zea mays
cagctagctcgctgtggcaggctggcagcatgttccgatctgccgtggcagcgtctcgtcagggccagcgggaagagtacggccgacccagccgccgccgcgtccgctttcttcctcagtcgcttctccgcggcggccgggccgccatcgccacagaggctggctggaaaggtagcgctgatcatcggcagggcaactggggcgccacgtcgccgcggagctgagcctgctgggggggcccggcccggcggcggccgtccactacacccgctgcgacgtgaccgacgaggcgcaggtcgcggcggcggtggacctggccgtggagctgcacggccgcctcgacgtgatgctcagcaacgccggcatcagcggcagcctggcgccggcccccgtggcggcgctggacctggccgacttcgaccgcgtcatggccgtgaacgcccgcgccgcggtggcgggcgtcaagcacgcggcgcgcgtcatggtgccccgccgcgccggcagcatcgtgtgcacggccagcgtggccggcgtgctgggcggcgtcgcgctgccgccctacagcgtgtccaaggccgccgtgctgggcctggtgcgcgccgtggccgggcagctcgcgcggtcgggcgtccgcgtcaacgccatctcgcccacctacatccccacgccgctcgtcatgggcgccatggccgagtggttccccggcgccaccgccgaggagcgcaggcggatcgtggagaaggacatgaacgagatggacggccccgtgctccaggtggaggacgtggccagcgccgccctgtacctggcgtccgatgagtccaagtgtgtcaatggccacaacctcgtcgtcgacggcggcttcacggtggggaaggcgcccaatatgccgccgcctggaaactactgagcagctaccacttgccaatctaaaggcacggtggatgactttctattgagcatttctttttcttttgcgattggaaaacttaggtaatatagttaaaagaactcgatcacgcgttttctttccatgtgcaagaacatggctagcttaatggtacacagtctgtgttgttggctctatagatctatgaaaagcttccagc

SEQ ID NO: 11703 - DNA, 944 bp, Zea mays
ggccgagaaaaaaaaaaaaaaaaaaaaaaaaagggactatctattatatccgcctgctgctcggccggcaaagctgaccgccgaaacacagctagctcgctgtggcagcatgttccgatctgccgtgcagcgtctcgtcagggccagcgggaagagtacggccgacccagccgccgccgcgtccgctttcttcctcagtcgcttctccgcggcggccgggccgccaccgccaccgccacagaggctggctggaaaggtggcgctgatcaccggcggcgcgagcggcatcggcagggcaacggcggcggaattcgtccggcacggcgccaaggtcatcctcgcggacgtccaggacgacctgggacgccacgtcgccgcggagctgagcctgccgggggggcccggcccggcggccgtccactacacccgctgcgacgtgaccgacgaggcgcaggtcgcggcggcggtggacctggccgtggagctgcacggccgcctcgacgtgatgctcagcaacgccggcatcagcggcagcctggcgccggcccccgtggcggcgctggacctggccgacttcgaccgcgtcatggccgtgaacgcccgcgccgcggtggcgggcgtcaagcacgcggcgcgcgtcatggtgccccgccgcgccggcagcatcgtgtgcacggccagcgtggccggcgtgctgggcggcgtcgcgccgccgccctacagcgtgtccaaggccgccgtgctgggcctggtgcgcgccgtggccgggcagctcgcgcggccgggcgtccgcgtcaacgccatctcgcccacctacatccccacgccgctcgtcatgggcgccatggcagagtggttccccggaaaaaaaaaaaggagcgcaggcggatcgtggagaaggacatgaacgagatggacggccccgtgctccagggggatcctct

SEQ ID NO: 11704 - DNA, 1116 bp, Zea mays
gattatagtagctgggtttggtttgtggctggctggctggctggataccacaccggtaatagcggccgagagagcaaccacgtccacggccattgggccctccgccccccgcccggccgggagctctcctttcctttttgctccgatccgatccgatcaatgaccaagtcgaagggtggttcggtggacgcgcgcacgctggtggcgcacgtcctggcagcgggcgccgtcgtgctggtgctcctgtggtgcatccacttccgcggcggcctcgccctccgctcccaggacaagccgctcatcttcaacgtccaccccgtgctcatggtcctcggccccatcgtcctcggcggagaagccatcctcagctaccgctctctcccgctcgcccgcgacgccaggaagaaggtgcacctggcgctgcacgccgcgggcctcgccgcgggcgtcctcggcgtctacgccgtcttcaagttccacgtcgagagcggcatcccaaacctctactcgctgcactcctgggtcggcatcgccgccatcaccctctacggcctccagtggaccgccgggttcctcgcctacttcttcccgggcgcctcccccgccaccaggcgcagaacgctgccgtggcacgccgtcttcggcctcctcgtcttcgtgctcgccgtcggcaccgcgcagctgggcttcctcgagaagctcaccttcatgcagggcccgccactgcgcctgcccaagtacggcgcagaggcgctgctcgtcaacttcacctccgtcaccgtgctcctcctcggcgtcgccgtcgtgcttgccatcgtcgatattgacgggacccggtacaacaccatcatctgactcagcgtcaagctgctgcatgctactacgatcagggatcgatgttgcctgtggtgtgtaggtgtgtggtgtacagtacagtacagatttatatgtttgtccggtgtttctgtgtgactaaactaaatatcataaaaaaatatatatattacaagttctttgcatggcatgcatgggtttagatctctgaggaggcatatgtatattttgtcctaaataatttcaagttcaagggaggaatgaccaaaaaaaaaaaaaaaa

SEQ ID NO: 11705 - DNA, 1506 bp, Zea mays
agagtgttcctccggttagtagctgaccggccggcgacgtacgcactgcgctagcaatggcgcctccacggcggccgagcatggggcggcagaaaatcgagatccggcgcatagagagcgacgaggcacggcaggtgtgcttctccaagcggcgcgcggggctgttcaagaaggccagcgagctctccatcctatgcggcgccgacgtggccgccgtcgtcttctcccccgccggcaaggccttctcgttcggccacccctcggtggagtccgtcgtcgaccgcttcctcgcctcgtccaccccctcgcctgccggtgccggtgccggtgccggccactcctccgccggcggcggcgaggaccgcgcggtctccgagctgaaccgccagcacggcgacctgcgcgcgcagctggacgcggagaaggcgaggcaggagcgcgcggacgaggccatccggaaggagcgcgaggccgggagccccgccatggcgtggatcgacgcggacctgggcgccatgggccacgacgacctggtcgcgttctgggccgcgctggccggcgtgcaggccgctgtggccgccagcgccgatcagctgctgcgtgacgcgctgctcgtcgggcgcaggggccgacagcagcagcagccagcggcccagcttggcggtggtggtgtggccttcgacgtcggcgcgtttggcatcggcgtgcaggtgccgccgcctccaggattcgctggcgtcgacctgcaggggttcgggggacaggctgctgccatcctcggcgccggcggcccctcgtgaggtggtggaatggaatgcatgtgcgcgcagttcgcttgagttgttgcattcgcatggaggacgcgtcgtgcctatgttaggtttggttgataacatcgcaaatttgcaaaacagtgttttaaattaaaatttgatgtgtgcttcctgcttctctcctatcctactgctgctcgtgatcgtgatgcattcattgttcgttctcacctggcttcggagcatcattctcgctcattgacactgacgttatctgacaaacaactccatagtagtgctgactgctagtcctaacaaaaagtagttctggaatctagatggacgaagtctctaattccaacaggtaggtagctctccaatcgtcaccctctcagctattgtttttcaaaatccatcaattacttctgtgttcgtgtcagatgtttgattgtcacctacgagcattaaataatctaattacaaacctaattgtacagataaaagctactcattatgtacttagcaaatgtttactatagcatttattaaaactaattaatatataattagcaaatgtttactatagcatcacatggatgaatcatggattaattaggattaataaggtagtattgtgtctccattatgtacttagttttataattagattgtatctaatactttttaactagtaccaaacatccgatttagcggcgcagtctgcaggcatgca

SEQ ID NO: 11706 - DNA, 1532 bp, Zea mays
attaggcccatctgtcagttgacgtgcgcctttccgattacggaaagcgttggagctttctctgccaccagacgcgcaggggcaccccgggcctacctgccagcgtcggtcagagacccgcctccgtctctgaatcggccgctgccgctgccgctaccgccgccggcggcgacgaccatgccccgcgccgctacgggtgcgatcactgcggcgttcctgcgcgcgcaggccccgcacatggcgccgctggcatcgcgcatcgcgcgcgcgttccccggcctcgccaccgccgccgcgacgcgcttcgctccctcctcgtccgcgtcctcgccgcggcttggcctcgtcccgcgcctccgatccgcgcgctccttctccggcgcccgtgcgtctcccgttagcggcgcggtttctggctcctcgacgtcggaggagggccagcagctgcagtcggagctcatcttcctgggcacgggcaccagcgagggcatcccgcgcgtcagctgcctcacgcaccccaccaagatttgccccgtttgcaccaaggcggctgagccagggaacccgaacaggaggcgcaacacctctatccttctgcgccacgccaccccgtctggcaccacaaacatcgttgttgatgccggcaagttcttctatcactcggcactccagtggttccccacgtttggtttgaggacaatcgatggtgtcattattacccattctcatgctgatgccattggagggcttgattgtcttcgtgattggacgaacaatgttcagtcatcgatcccaatttatgtggcagaacgtgattatgaggtgatgaagatgacccactattatctcgtcgacacaagtgtagttatacctggagccgcagtttcagcattgcaatttaacattataaaagaggaaccatttatggttcacaatcttgaggtgattcctttacctgtttggcacggtcagggttaccgctctcttggttttcgttttggtgatgtatgctatataagtgatgtcagtgatatacccgaagaaacatacaagcttctggaaaactgtgaacttcttataatggatgctctaagacctgatcgttcttcatcaacacacttcggactaccaagggctcttgaggaagttaggaaaatcaaaccaacgaaaacactgtttactggaatgatgcatttgatggaccatgagaaagtaaacagtgatcttgccaggctgattggaacagacggtcttgacatccagcttagctatgacggtctcaggatacctgtaaggctttagaatttttattattttttgggaaaaatatttatgtattgggtgctgctaattgatgatttcagagtctctttagttcgaactgagtaaaatgatgaccagatgtaatctgatgagctctcgatgcagtgcgattttacttttcattctttccccctcagagaggaaacttatgtagcagagttataccaaatactttatgacgtaataaagtcagattatttgattttgtg

SEQ ID NO: 11707 - DNA, 910 bp, Zea mays
gggggaacgggcagatttagctcctgaaattcccgccccgccggcgtgccggcaggatgatgaagagaacgaagaagaagggggcctgagcaagtctggcaaggaactaaaaaagttgcttgggcgcgctgctggactaaatgagtcagatgcggatgaggatgaagaagacgaagatcaagaagatgattcatcgccagtgcttgctccaaaacagaaggatcaagttaaagatgaacctgtggatagcagcccatctaaaccagcaccatcaggacatgctcgaggcacacctccggcatccaaatccaagcaaaagagaaaatcaggtgttgatgatgcaaaaacttctagtggtgcagcttcaaagaaagcaaaggtggaattggatgcgaaagcatcaggcctcaaagaggaggcatcatctttggcaaaacctgcatcaaagacctctgctgcatcaaaaagtgggacaagcgtatcacctgtcacagaggatgaaatcaggagtgttcttcttgcagtggctccagtcaccacacaagatctggtatccagattcaagtctaggcttcgaggtgcagaggacaagaatgcatttgctgaaattctgaagaaaatttcgaagatacagaagacgaacggccacaactacgttgtcctcagagatgacaagaagtaaataaccgaacaaaggcgctgacatcgcaaccgttggctgtactgagataatatgtttatgtaacatgctgccttgaagataaacaagtctgtaacactagaattgtcttctaacccttgtgtacttgaattttattttactattccagattttatttatgcggctttgcactacacacctgttataaatggaaatccattgggagttcaaaaaaaaaaaaaaaaaaaa

SEQ ID NO: 11708 - DNA, 1332 bp, Zea mays
atttgttctaacagttcggattaccactttcatccctagttctgaaggcacacccgaaggagttatcgtgcgttcgtgggaaaggcatgttgtaagcacgagacatatgggccccgtgttagccgtgtacccactgtattagtgatgatggtgagtggtgacgggcatagaagcaccaatctgcggccgcgtggccgcccgggaaagccctcctcggggctcgggctcgtacccgtcgtggaagaggtcgacccagtcccagttcagattccgcaaaacaggcagtcaggctcaggcaccaacaccaaccatggcctccgctgcgacacctgcgcctttgctccccgtgaccagcacggctgccggcggcggctccgcgccgtcctccgccacgggcctctccgacgcggcgctcgccacgccggccttccgcctcttcgtgagccggctggccgagacggcgcggcgctcgctcgcggaccggcgcccatggacggagctgctggaccgatcggctttctcccgccccgactccctctccgaggccacctcgcgcctgcgccgcaacctcggctacttccgcgtcaactacgccgccgtcgtcgccttctccctcgcggcctcgctcctggcgcaccctttctccctcctcgtcctcctcagcatcctcggcgcctggtgcttcctctacgtcttccgcgcccccgaccagctcgtcgtgctcttcggccgcaccttcaccgaccgcgagacgctgcttggccttaccgtcgcttctgtgctcgccttcttcctcacctccgtggcttcgctcatcatctccgggctgcttgtcgggggcgccattgtcgcagcgcacggcgcctgccgcattccagaggacctcttccttgatgatccgagcgctgcgtccagtggaaacaccaccagcaggctgatctccttccttgcgtcgcccggatctggggtttgatgcatcaaggaccggtaggaaattcttgtgctcggcgaattcagttgaagtcaaatagagatctgatccagaagctgtataaaccagctccttgctcatgtggtacctcacctgcgagtagcattgtataagtggatccgatttttctgttctactttgtgtggaattacgcaaggatctgcaattgctgtacttctcttgcacttcaccagatctggtgacaatgaccattaagcattgtcaaatgccaacatgtatcggtgtgatctttacattcatcattcatgtgtacaactctacatcatgacaaattttatggatctctggttatttttgcctcactaaaaaaaaaaaaaaaa

SEQ ID NO: 11709 - DNA, 1874 bp, Zea mays
  misc_feature (2)..(3): n is a, c, g, or t
  misc_feature (1789)..(1789): n is a, c, g, or t
cnncggccgggaaaaagaaaagaaaagaaaaactcaaaagcgcacggcgggccggcggcacgccgcacggctacggcagaaaagttagcaacaacaaaccagcggagggcgaaatcgaattccccaatccccgccttcctcggttccctcaccgcgaaccctaaccctagtccaccccgctcccatggacgaggatgctggcggcgcctcgccgccgccggtgccactggctcacgtgccccctcttcagcaacccaccaccgccgccccctcgcatcgggacatggcggcgtcccccaccagctcgcgctccgtgacggagacggtgaacggctcccaccgcttcgtgatccagggctactcgctcgccaagggcatgggcgtggggaagcacatcgccagcgagaccttctccgtgggcggataccagtgggcggtctacttctaccccgacgggaagaaccccgaggacaactccgtctacgtctccgtcttcatcgccctcgcttccgatggcaccgacgtgcgtgccctcttcgagctcacgctccttgatcagagcggcaagggcaagcacaaggtccactcccactttgaccgctccatggagtccgggccgtacaccctcaagtaccgcggatccatgtggggttacaaacgattctttcggcgaactgcccttgaattatcagactatctcaaagatgattgtctgaaaataaattgcactgtgggagttgtagtgtcaactatcgattactccataccgcactctatccatgttccagactcagacatcggctatgattttggttcactgttggacagtcaggagggtgctgatgtcattcttaatgtgggaggagagaggtttcatgcccataagttagtgttggctgcacggtctcatgtattcggatctcaattttttgatgatgaatctgatggagagaagagtgaggttaatgagactgatgaactaaaagagttttctattgatgatatggagccaaatgttttcaaggcaatgcttcacttcatctatagagatacccttgttgatgatgatgagttgggcgcgtcaagctctgatggttctatctttgatactccggcagctaagttgttggctgcagccgataagtatcacttagcaagactaaagtcgctatgtgaatcttacctgtgcaagggcatatcagtggcctcagttgcgagtacgttagcattggctgataggcaccatgccatggagcttaaagctgtttgcctaaaatttgctgctgaaaatctttcagctgtaatgcggagtgagggtttcatttacctcaaggacaactgcccatctctccagtcagagatactgaaaactgttgcagggtgtgaggaccagtgcagcagtgttgggaagagccagagcgtttgtgggcagctctcggacggtggcgattccagttgccgcagggttaggcaaagaacctgaggtcaacccagaactgacatggttagccagctcttgctctgtaaatgacgatggcaatcatctgtatgtgaagaaaaaacaatttgaaggagctgtaactagctgtatctcatcatgctccttacatcttacctgccgtcttgtttgtaactagttgactgtttggtcatgagcagttactgaatcgatgtgtagacagccctgcaaaaaaaaaaaaaaaaacgataaacatggtggccttgtgtcttggcaactggtgtttgcagcaggcgggccagcagctgtctgctactaatatggatccgntgattttgttgtattcttctttcgactggaaggtatcataagtcaattaggaggtgattcttatatgtattccgtatgctgcaaa

SEQ ID NO: 11710 - DNA, 2214 bp, Zea mays
ggcctggttcggtgcatgacactaaagtgctacaagatactttgatcacgtacggggatcggttcccgcatcctccagaaggtattggtatattttacaagacttagcatttgtacttaatgacgttatgtatgtccttaacctttgtgacattttgcagagaaatgttatcttgtagattcagggtaccctaacaggaagggatatcttgcaccttataagggtcagaaataccatatttcggaatgacaacatgcgcggcaaccagttggtgccaaagaagttttcaactatgcccactcatcactgaggaatgtgatagagcgtttatttggggtgctgaagatgaagtggagaatccttctaaatctgccatcattttcacttagtaaacaatcaaagataattattgcatgcatggcgttgcataacttcattcgagatagtgctatacacgattgcgactttgaccagtttgtacctagcacgacgtatgttcaggatgtaggtatatgtgagagtagtactagcacatcagatgagttagacatgagtgcatttagagatgaaattgctaatgcattagtgtcgtagttatttatgtgaaccaatgcatagtaatggtgcagtggacatatctgtctaattgtagtcaagcgttgtttattgtgtctttccctgtttcatttttttcactctatacttacaatctcagaatctccgtatccaaacaactagattctaaccatcagtttcttcccacagcagccgaaccaaacacttaaaccacatccaactttttaccacagccaggttttcagaaaagctactcataaaaagctaaaccaaacaaacacatagccataggatggatatctttgacctacatagacatagtcataggtatgcagggacagaggaaaatttgtaccaactagtaaatatgagtagagtgacacgacatgttatttttcgtcgtggtatggaaacgctactaaactaaggttatcagactttctattcttattttcactatgatttataacgcaaaataattaataaccataacaatttatatatagccgtttttggtccacaaaacaaccggtagacccttccaagctggcattgtcccgtcccctgtcgacttcctctccatttcatttccgttccaggtctcctgtttccatcctcttccacggttccacttccacccccatctcctcgtcctcggcaagcccagcaaccccaatccccaatcccgtccgcttctttccccgtccccgaccttgccgaggaacctcccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgaacgggtcccaccgcttcatgatccagggctactcgctcgccaagggcatgggcgtcgggaagcacatcgccagcgacaccttcaccgtcggcggctaccagtgggcgatctacttctacccagacgggaagaaccccgaggacaactccggctacgtctcggtcttcatcgcgctcgcgtccgacggcaccgacgtgcgcgcgctcttcgagctcacgcttctagaccagagtggcaagggcaagcacaaggtgcactcgcactttgaccgctccctagagtccggaccgtacaccctcaagtaccgcggacgacagcaacggtgttcgagctgttttgtccccttctctcttgccgccttaaagcagcttgcattgagtaatgagctctgtttaggtttagaacgagtgtctagtggctagattggttacagggtatctgccgaattagtttgatttgaaagtagttggtggatgttgggtgttattttagtgattattctacatgatagtccatgtttttgtttcggtgcctgattttagttgatttggattggatgtgtttgtattgctccagcctattaagtggcctgtgagttttacaacgaacgctgtctaacaaaattggcgatctatagtacctagatgtgattcagttgtgctacagctgtgatcacacagatgcctgcaatgatgtatttattacagtttcattcggttgcttccctgtttg

SEQ ID NO: 11711 - DNA, 1627 bp, Zea mays
ttccgttccaggtctcctgtttccatcctcttccacggttccacttccacccccatctcctcgccctcggcaagcccagcaaccccaatccccaatcccgtccgcttctttccccgtccccgaccttgccgaggaacctcccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgaacgggtcccaccgcttcgtgatccagggctactcgctcgccaagggcatgggcgtcgggaagcacatcgccagcgacaccttcaccgtcggcggctaccagtgggcgatctacttttacccagacgggaagaaccccgaggacaactccggctacgtctcggtcttcatcgcgctcgcgtccgacggcaccgacgtgcgcgcgctcttcgagctcacgcttctagaccagagtggcaagggcaagcacaaggtgcactcgcactttgaccgctccctagagtccggaccgtacaccctcaagtaccgcggatccatgtggggctataaaaggttctttcggcgtaatgctcttgagcaatcagattttcttaaagatgattgcttgaagataaactgtactgtgggtgttgtagtatcaactatggattattccaggccacattcaatagaggttccagagtctgacataggctatcattttggaactcttttggacactctggaaggtgtagatgtcatttttagtgtagcaggagagaagtttcatgcccataagttggtattggctgcccgatcttccttttttagatctgaatttttcgaccatgaatctgatgaagagaagaacgaaactggtacaggggatgaaatcaaggagatcgttattgatgatatggatcctgtagtgttcaaggcggtgcttcactttatgtacagggacaatcttgttaatgatgatgagttgatggcatcaagctctgactgctctatatttgatagtttagctgggaagttaatggctgctgcagacaaatatgagttgccaaggctaagattgttgtgtgaatcttacttgtgcaagcatgtttctgtaaactccgtggcaactactctagcattggctgatcgataccatgctatcgagcttaaatctgtttgcctaaaatttgctgctgaaaacctttcggctgtgatccggaccgaggggttcgactatctcaaagacaactgcccatccctgcagtcagagatactgcggacagttgccggatgtgaggaacaatgtagcagcggcgtgaaaagccagagcgtatgggcgcagctctctgacggcggcgacaccagcggtcgcagggtgaggccaagggtctgagacgcgatcctgcaagcactaacctttgtaatcaaactgtggtagtgtaaaatggatacagctatttgaattttaatctgggacgacgatttaaatcacatgattgacgtgtttgtggtgctcgcagtcattatttggttctgaattctgagtct

SEQ ID NO: 11712 - DNA, 5550 bp, Zea mays
gctggcggcgcctcgccgccgccggtgccactggctcacgtgccccctcttcagcaacccaccaccgccgccccctcgcatcgggacatggcggcgtcccccaccagctcgcgctccgtgacggagacggtgaacggctcccaccgcttcgtgatccagggctactcgctcgccaagggcatgggcgtggggaagcacatcgccagcgagaccttctccgtgggcggataccagtgggcggtctacttctaccccgacgggaagaaccccgaggacaactccgtctacgtctccgtcttcatcgccctcgcttccgatggcaccgacgtgcgtgccctcttcgagctcacgctccttgatcagagcggcaagggcaagcacaaggtccactcccactttgaccgctccatggagtccgggccgtacaccctcaagtaccgcggatccatgtggtaaacactcaatccatcctgttccatatccggttgttaggttcgttataagatgggactgctgttgagacgatctataatccacaattgcttactctgcagtagaatttagcctaatattattcaattactacttactagtgcgcgagtgctcctgtcgtgccaatttagttcacatatgtatatattgcagtagaattatagccattcaacattcaattcgggttcattttgttgtgttaacatgggtttagtgctgtatgactggaattgctgatattttttttactaattgttgttctttagttttagtagtacattgcttgttggatcagtttcgatttgaatgattgcgaggtgctgaattggcttgtgtgtgcataagtgcaatgatcttgtttgacttcatactgttgtttgtggctgtgaaactgtggatctgactcctaggagagtttagtgtgcttgagggtctatttgttggttttcatcttggtgttgttttagtcatacgaattccccattaattgatgtgtgtggctatgtcttgtactcttggttatttatccattttcatttgtgtggttatgaattttcagttgcaatttgctctcatccaataattcttttgcacgcttcattggtaactatacttatgcgctgacaagttccagttctccgttgttgaaagtagattatccttatttgtgtttgaatatggggggatgctggtatgcatgtgatagaaatatggcattacatacatttgttttttgaggtgcctggatttggtatttttttgtttttttgttcaatctattttgttgctttcgtttatgtttgttgctagcgcaaacctgttattagaataagtaattctatgttaatttgtacaattcgagtttttgtattttttgttagacaatcatctcattacccggcccgctgaatgattttattcaatgtaaacagcagttattttaatttgcccattattttggatgcaaattgtttgtggaaccagtcatcacagtcatgagactctttgatgcatttgttatataatagagagatggatgaagctttcttaatgtttctttacatgtggaacctgtattgtgggaatcattgctcttgcaataactggcctctgataattgaattttacgtctatccttctttgtttcaggggttacaaacgattctttcggcgaactgcccttgaattatcagactatctcaaagatgattgtctgaaaataaattgcactgtgggagttgtagtgtcaactatcgattactccataccgcactctatccatgttccagactcagacatcggctatgattttggttcactgttggacagtccggagggtgctgatgtcattcttaatgtgggaggagagaggtttcatgcccataagttagtgttggctgcacggtctcatgtattcggatctcaattttttgatgatgaatctgatggagagaagagtgaggttaatgagactgatgaactaaaagagttttctattgatgatatggagccaaatgttttcaaggtctgtttctgttcttgtattgctttatccttccaataaacctgtgactagcaagtatttggtgaatatttgttgcaggcaatgcttcacttcatctatagagatacccttgttgatgatgatgagttgggcgcgtcaagctctgatggttctatctttgatactccggcagctaagttgttggctgcagccgataagtatcacttagcaagactaaagtcgctatgtgaatcttacctgtgcaagggcatatcagtggcctcagttgcgagtacgttagcattggctgataggcaccatgccatggagcttaaagctgtttgcctaaaatttgctgctgaaaatctttcaggtactaaaatttgtcataccagacattgcttatgattatttcatgcaagtggcctcattatttgctacgtaaactcttgtcagttgaaaaatattcaaagtgggctgtcatcaaaaggaaaaaaaacacaatgaaaaatagtaaaagaactttataacctgtaaatttctagtgtctgagactctgagtgtatggccgtgcactgtgcgttctttcttttggtcactattcttgcacagaaaattctcttgaacttgtgggataaactttttggtacttctcatggaaatatgcattagactattacagatgcttccatgtttgttttaagtacagtttgcttgagccatctacattgttacagcttccgaagcattcatataatcagctctatatgtcacctgattgccatattagtgcaatagtttttaacaatgtagactgtgttgacatttttgactgaatgaaacagattttaagctatcaacaattcagtagttagcgtgtagatgccattatgtgttagcatcttctgatagcaatacatgcgtcatgagtattatacttattctgcacgtagtacattagcagcctaaattgtgaatagaagcttgggattggttacttgcattactaccagcctgtgttgagcataatgcagtataggctaagccagcataaacatacgcaatggcatggtgtttggttgcctgcattgcattgtattgtatgtgaataagagtaaagtatgtcatctccatcttcttcctcccccactcttgtctgccttttcggcactgcttggaccgctggagatggaggacgaggagagccagagcttgtggatgaggtggaggtggacaaggttgaggatgacgttaagcgtggcaatgcttgcccaccctaaggtgtgcacaatgcagagagacaaaggactggttttgatgagagcgtgatggaggataatgaggggagcgacagagatatctgtgcactgaaggtggttgcggtagcgatggcagtggaggcggtggctgtgtctgctagcgcaggcaggaggggactgtttggtttacggcctgccaggcaagtttagagacaaacatttatcaacaaacaggcccaaagtgcagagagggcagtgtcagaggagagcagggagaagggcgtcggattgtgtggtgggtgatgtccattggtggtggtggcggtgcggtggtggcagtgtggtcacggtgtcgtaggagagcagggagaagggcgctgggtcatggtggtaggcgacatccgttggcgtcgccaggccgggggtgtggttgactggttgtgacagtaagtgggccatttttgcatactactccacaatgtggccatgaacctttcttttgcttccctaagcctgtataacttctagtgcggccaaccaaacactgctggcctgcatcatcaaagcctagatatgctctaatacaggcaagagcttagacttgtagtgagagagacggctcctacacattaattatgtaatttctttgcaatattaaccttgtttaagctctaagacctggtaataatgtttattttggtggtacaaatagaaaatttataaacataaaaaattataaaaatgttaaatagctgagttatattgtatagggagagttggatagggtgaatggttggagacgccctgtacgcagggggagtcttttaggtggatgtagtaaaatataatagaaaatacagataggtggagaaatatgggggaatggttggaatggaccttacctgaattagactgtactgcaacatattatttattatcgacttcagatgtgagatggactaatatgtcttgctagattatattccttccattacaaattataaataagatgttttggcttttctgatatatagtttttgctatgcacttagatgtactccatgcctagatacataataaaagcaatgtatctagaaaagtcaaaacatcttataatttggataaaaaagaataataaaagagagtaatagttatgatgtgttttataacaaggtctgggttggtggacaagtatatttttattccttgtgtcagagctgatattctgttattgccaaccttttccgtttcagcatggggtagttccagggcttgtccctggatacaagaaaattatgcctcgagtccacgataccatcgtttgaccttttggttgctttatttgctcaattaagtttgtacagcttctggtgcgattaagtttataaagcttcataacccattccagatacccttatgtgtctgcaggcatgcaatgcggagtgagggtttcatttacctcaaggacaactgcccatctctccagtcagagatactgaaaactgttgcagggtgtgaggaccagtgcagcagtgttgggaagagccagagcgtttgtgggcagctctcggacggtggcgattccagttgccgcagggttaggcaaagaacctgaggtcaacccagaactgacatggttagccagctcttgctctgtaaatgacgatggcaatcatctgtatgtgaagaaaaaacaatttgaaggagctgtaactagctgtatctcatcatgctccttacatcttacctgccgtcttgtttgtaactagttgactgtttggtcatgagcagttactgaatcgatgtgtagacagccctgcaaatgctcacgagtcaacgataaacatggtggccttgtgtcttggcaactggtgtttgcagcaggcgggccagcagctgtctgctactaatatggatccgttgattttgttgtattcttctttcgactggaaggtatcataagtcaattaggaggtgattcttatatgtattcgttatgctgcaaaagtgaaggtgacaatatttttggtttattggcaagtacatggaatttacatttttgttgagatggttcgtagatggagtaattttgctgtaaagatatagtggtgacaagttttttttgtttgtttggattttttacatttctgttcgcaagtatcgtcatctgtcaatgttgagaggtgatgatatataggattgtcctttggtggcctccacgacagggttgtttttttccttgtattgtgggccgttttttcttttattaatataatgatatgttcaaggaatctt

SEQ ID NO: 11713 - DNA, 1691 bp, Zea mays
ggggtaccctccgaggctggccggaagtctcctgtttcagctctcttcccttcactccatcggctcgtctgctcgaggccgcatcgggtgtagcgtggccccccctcgtcgccaccccaatcctcattccccaatcccgtccgcttctctccccgtcccttacctcgcccaggaggggagcctcccgcttacaaaccctagcctctactcctctgagcttccaccgctccgctccccatggaggacgaggacaccggccccggcgatgggggcgaggcctctcctccgcaccacgtcgcggcgtcgagcgaccgggcgcgcgacatggtggcgtccccgaccagctcgcgctctgtgacgcagacggtgaacgggtcccaccacttcgtgatccagggctactcgctcgctaagggcatgggcgtggggaagcacatcgccagcgagacattcaccgtgggcggttaccagtgggcgatctacttctaccccgacgggaagaaccccgaggacaactccacctacgtctccgtcttcatcgcgctcgcgtccgacggcaccgacgtgcgcgcgctcttcgagctcacgctcctcgaccagagcggaaagggcaagcataaggtgcactcgcacttcgaccgctccctagagtccgggccgtacaccctcaagtaccgcggatccatgtggggctacaaaaggttctttcggcgtactgctcttgagcaatcagattttcttaaagatgattgcttgaagataaactgtactgtgggtgttgtagtatcaactatggattattctaggccacattcaatagaggttccagagtctgacataggctttcattttggaacgcttttggacactcaggaaggtgtagatgttatttttagtgtagcaggagagaagtttcatgcccataagttggtattggctgcccgatctcccttttttagatctgaatttttcgatcatgaattgggtgaagagaagaatggaactgatacgggggatgaaatcaaagagatcgttattgatgacatggatcctgtagtgttcaaggctgtgcttcattttatctacagggacaatcttgttaatgatgacgagttgtctgcatcaagctctgactgctctatctttgatagtttgtccgggaagttaatggctgcagcagacaaatatgagttgccaaggttaagattgttgtgtgaatcttacttgtgcaagcatatttctgtaaattccgtggcaactactctagcattggctgatcggcaccatgctatggagcttaaatccgtttgcctcaaatttgctgccgaaaacctgtcagctgtgatccggactgagggtttcgactatctcaaagacaactgcccatctctgcagtcagagatactgcggacagttgccgggtgtgaggagccatgtagcagcggcttgaaaagccagagcgtgtgggcgcagctctctgacggcggcgacaccagcgggcgcagggtgaggccaagggtctgagacgcaaaccccgcaagcactgacctttgtaatcaaaagctgtcgtggtgtaaatgggacggcttttcttaattttcacttgagacaacgattgaaataacatgattgacgtgtttgtggtgctcgcagacaaaaaaaaaaaaaaaaaacggcacgagccccacatt

SEQ ID NO: 11714 - DNA, 1575 bp, Zea mays
gcacgagaccattacctagaacatcctaatcgaaaagaatgaacgaaaaaaaaagatgaacagggagggagagaggaaaaagatgaacatgacaggacctcgtcgctaaaaccctagcgcagcggcgcgggagcggatgcaccttgccctgatcatctcccgcattcgcctcttgccgaccgccatgcccagcacccgctccgcctccgcctccaggctgctggtccgcgctgacaacagcccagttgcacgagaaatcaaacgtgaatccagtgtttcttttgacactccgaagcccgaagcaactgtctctgttaagcggagaagggtgaatcgagaacttgaagtaaatgggcagcatcataagaagcaggtccctgacattgaggattttatatatgaaaaggccaaaacattgacatcgtcaagtaaggcaacaacatctttggtcaaggtggagaaaaaggtcggagtttcttcagttataaaagttggagctccagataactgggaggcagttcttggaggcattaaaagcatgaggttatctggtgaagcccccgtagatacgaagggctgtgaaaaagctggttctctccttccacccaaggaaagaagatttgcagttctgatatcaactatgatgtcaagccagacaaaagatgaagttacacatgctgctgtggaacgcctctctgaaaacggtttacttgatccggatgctatagtgaggactgatgagaccacgcttgcgaatcttatcaaacctgtcggattctatcagcgaaaggcgcagttcataaaagaagcttctaaaatttgccttgagcgctttggaggggatattccggattctctgaatgaactgcttgctctgaggggagttggccctaaaatggctcatttggtgatgagcattgcttggaagaatactcaaggaatctgtgttgacactcatgtgcatcgcatttctaaccgacttgggtgggtttttcgggaagggacaagacagaaaactacgacaccagaacagacaagaatttctctagagaaatggctacccaaggatgagtgggaacctataaatccattactggttggatttgggcaaactatctgtactccactgaggcccaaatgcgataagtgtggcatcaacaacctttgcccttctgcttttaaggaatcatcaagcccaattccaaagcaaaagaaaacaaggtctccatagaactctgactgtgacttgtctggcaccgacgtgagatgatattttgggttgtccgtcggtggtaaatattatggggtttccttttggtcagttattgttggatcaccttggtgccgtaccattggcatttggcaagtcatgtatatcattttgtataccggtaaattgttcaagacggtatgaagacacgcttatctaccagttactgtaaaaagtactggtaacaagcgaaattttcatgtgccaaatgacacatgattcgtgacaaaaaaaaaaaaaaaagaaaattctgttgcgtgcaccaaagtctatcaccggttcctataagacctaacaagagatat

SEQ ID NO: 11715 - DNA, 5263 bp, Zea mays
  misc_feature (5218)..(5218): n is a, c, g, or t
  misc_feature (5234)..(5234): n is a, c, g, or t
tcttaaagtgattcataaggtcttgttaggttattcatattcaatgtagattagatgggattagaaaaaataataaaagattttaacttgtttaggatttaaacatatctaattacaactaatctatatagattgagagcaaaactaacaaggcattataaggatgtgactagtgtggctccagcgcgtcgttgtctctggcagtagcagtcgattctctgtagcgcactgtggacggaagaggcggagcggtgcaggcaggtgccggagtaatacctcctccaaggggcaaacacacatgacacacaccacgctcgtgtgatgcgaaacggcgaatgacaggtgggaagccagcccatgccgccatgcctgcctggtcggtaaacggagtgatcaaacatctggagagagatcggtcgatttcaggtggtaacgatgcaaccagtccgccccagcaagacacatctagactctagaggagaggagaggagagacggtacgtagatggaaagcctgggaacgcgggaagagctctagatgtgtcgtcgacgcacgttgcgttgggccccgctgggtttggctacgcaaaataaggctgcgcaaagtaggcacattcttggagaccctacactcctacaggctgtgctgtgtctgtgtgcacaacctcagctcgcaatcgcaaggggaacgacagctactgagagtacgtacgtactgactgccggacttggcgtattagcgctatacaaggaaacgggtgatgctatttgcctaaccaagaccaagatagtaatattccgcggcgcttttgcgaccgacgatgatgacatgttcgatcttttgcctcctgggacacgtgaagaaccaaaaggcaaaaaagtgcgcgctaatataatcacaagtgcatgcccatcgatccgccggccccctcgaccgagctattgtttttttttttgactgctagctcgctttgtgtccactgacatttgcatttgcaagtgacgcaaacagacaaccgctccaaggtcagtgtagcagtaataataaagaagagataagagagactcgctgctggttgcaggttgcagcagcccagtcgccacgtccgacatgcatgcatgtggctcagccaaaccccggcagaagcagaaggcacagcatcatccacttgcgctcccacacccggtccggtgggaggtaaactaatcgccgccacgtcggacggcttaatcctactgcgagtagagcgtaggcccgccgctcgtagcggctgaggctgagctgttacctggctgtgctttttttcggcctgcctggcccatgccggcgaaccgatcaggcctctgcatgggggccacggacgcgccacgtcggccgtggggaagccacatgtggcgcttcctcgttccaaaggccgtgttgccctctgccggctgccgcctccttgactccttgtgctcgcgacccctcgacctcgcttctcctcgcggcgggtggtcctggccgggtccatcagacttcagacggtcttcttgcccgtgaccccgccccctccattaattgaaaattttcgatatcgggcatagcaaacttggttcccgtgtcagtataacttttttttaccccctaacaaaaagactaccgcttcattcgaaaagaaaaggaagtttctgtacagcgataaaaagtgcattccagcgacacaactacgcaggtgctgaaacgttcctaggcaaacacgttcgtttgtgatccaccgtgccggtcgtttttaacagcggggtggtaacaaggaagtgacgagcaacccgaacccgacgaggaggtggcaactggcggaggtcgtttctgataatcgcattcccccctgcctgcgggactaggctgcaagtctggaaacgtgggacggccacatctcccgttgtccgggccgcccaggcctgagccggcttttccctccctcccccctggccccctctctctagatccgcgctcgtccgcctgcagggctgcggcaattggcctggctacccagacaagagcacgcaacgcaagcaactgcgacgtctcccgcccccgccgcgccccggaccttttccgcagatattttttttatccccccacgcccccggctcgttcccttccattccaccacctctcgccagacaacgagatgtgcgaggcaccgcggctcggcaaccgcgccggcgccggcgacccggccgccgccgacgtcgacgtcgtcacgacgggcgggcgccggaggatccccgcgcattcctctgtcctggtaagcgtccgatccctttttccccccctccttggcgcattgctccgttcggccgtcccgtccgggtcgtctagcagtcgtctgacgggagctgtgtccgtctctgtttccgcgcgcgctaggcctcggcgtcgccggtgctcggcagcatcctggagcgtcgcctgcggaaggacagggagagcggcaagcccgggcggtccgtcgtccggatccgcggcgtcaccgacgacgccgccgcggccttcgtccgcctcctctacgccggcaggtaacgcccgtgggcaccgtgcgtgcctgtctgtctccctttcaattccccggtcgcgcgcgctcagccatggcggcctccttgttgctagtcttgttttcgcacatgttagttcctcgcgaggctgcggccgcctggtccccggcctggggctggacaagccagtgcggcacacgattattagcaaggactaatcctgcgttattctaaacgcacgaggaggggaaacatggcgcgcgtgtgtgctccacccacacgttaactgcccggaagatcaacctttattcttagacatcatccagaagcgtttttatattgaaaaaaagtattctagtacttttttattctttatttatctcgagtccatctgtacgtttccttctttaacagtatatacacacagtataaacctgaaattcgaggtgtccaacgttctaggaatggcaagaagcaagtccatgaccacgcgctagcttcaacaatcgattttaaaactttgagtaggtaccaaatccaaccaaaccgatcgagctcccccgtagtaggaaaaccttgcacccaaattaagcattccccggacactatatctactataaactacggatcgaaatgcatttgaacagcggttccggacactatctagcgcttgtcggctcaacgagccaatcccgtgatattttttttttgccgcaccatccaatcaccgagccgggtcaggtcgcaaatcaaatggggctctcgttggtttgggttggccaactggctgcctcaccatcatctgtcagactgtcacgtcccgggttggcgcggcggcaggtcgcagccacgtcgcccgccgaacccctcttacaaccagagccacacacacaccccgcgccggtctgccaagtgcccaaacccccgtagcggacgccaaaaaatctcgtggctttcccagcggcgaataggacggcgacggagggcaaaaaaaaaagataaagctaaagcgaggttaaaaaaagcgttacaacctttttaggttaggattattagtattatttccccgcccgctaggctgcctggttggtgtgggtgtggcactgtgggttgtgtgggtggcacctgcccggttggacctgcacgaccccgcgctctcagccgacgtgcgcgtcatcgcgtagcgcacgactgggccgggccgagccgtcgctgtcgcggggacggccggcgccgggacgcaacgcaccggcggaccactctcgcccacggctgctatcattcattgtggtgttgcttaccgtggattggaaaattcttcggccgacgtggctacatgcggattccgagaaaacgaccgcccgagcgatcgcagcctcgcgccctgggcaaatgttctttcttgtggaacccgtcgaaggttcttctaccacactagtacactactacctgactaccaggtcgaagtgctatacaactagtacggcatacgattcgtccaccacactagcgcatgttcttgtggctcacaggaacttgtcaggttctaactaaacagtgtctgcaacgctgtccgtgcttaacaatttgttagattttggatgatgacgaacgatcatgtgcttaacacgacagcaaaaacccgtctgggcaggtgcggcgaggatgaggatgacgacatggaggagcacgcggtgcaggtgctggtgctggcgcacgcgtaccaggtgccgtggctgaagcgggcgtgcgagggcgccatcggcgcgcgcctcaccgcggactcggtggtggacgtgctgcagctggccggcctctgcgacgcgccgcgcctgcacctgcgctgcgccaggctgctggccaaggagttcgcggccgtggagcgcaccgaggcctggcgcttcctgcaggagaacgacccctggcaggagctccacgtcctgcagcgcctgcacgaggccgacatgcggcggcgcaagtggcggcggaagcgcgcggagcagcgcgtgtacatggagctgagcgaggccatggactgcctggaccacatctgcacggagggatgcacggaggtcggcccggcggggcgggcgccggcgccggcgccgtgcgcgcgctacgccacgtgccggggcctgcagctgctcatccgccacttctcccagtgccaccgcaagagctgcgcgcggtgccagcgcatgtggcagctgctccgcctccactccgcgctctgcgaccgtaccgaccgctgcaacaccccgctctgcatgaggtttaagcagcaggagcaggataaggcggctgccaagggcggcgatgatggcgacaaatgggggcttctggtgaagaaggtgaagactgccagggtcttctcttctctggccaacaggaagcagatgagcaccaccaccacccagtgctgaggagcagcctgggatgcttaggggtcaaagttagattagtgagagagaatgaagcgagcagtttttttttgggtctgttttgagatgtcagatctcttttgagatatgtacatgtacatgcctactttgtcaccctacgttggtatagctcttttatcgaggtgggagttggtcagccggaagtctatgtaaaaagtgcgcatgtatcattatataataatagggaaatatgagaagtaaaaaaaaaaaaaaaactgncccccctgtttgtaanctatgccaattaagtctaaactgcccgaa

SEQ ID NO: 11716 - DNA, 1442 bp, Zea mays
gaattggcctggctacccagacaagagcacgcaacgcaagcaactgcgacgtctcccgcccccgccgcgccccggaccttttccgcagatattttttttatccccccacgcccccggctcgttcccttccattccaccacctctcgccagacaacgagatgtgcgaggcaccgcggctcggcaaccgcgccggcgccggcgacccggccgccgccgacgtcgacgtcgtcacgacgggcgggcgccggaggatccccgcgcattcctctgtcctggcctcggcgtcgccggtgctcggcagcatcctggagcgtcgcctgcggaaggacagggagagcggcaagcccgggcggtccgtcgtccggatccgcggcgtcaccgacgacgccgccgcggccttcgtccgcctcctctacgccggcaggtgcggcgaggatgaggatgacgacatggaggagcacgcggtgcaggtgctggtgctggcgcacgcgtaccaggtgccgtggctgaagcgggcgtgcgagggcgccatcggcgcgcgcctcaccgcggactcggtggtggacgtgctgcagctggccggcctctgcgacgcgccgcgcctgcacctgcgctgcgccaggctgctggccaaggagttcgcggccgtggagcgcaccgaggcctggcgcttcctgcaggagaacgacccctggcaggagctccacgtcctgcagcgcctgcacgaggccgacatgcggcgccccctgtggcggcggaagcgcgcggagcagcgcgtgtacatggagctgagcgaggccatggactgcctggaccacatctgcacggagggatgcacggaggtcggcccggcggggcgggcgccggcgccggcgccgtgcgcgcgctacgccacgtgccggggcctgcagctgctcatccgccacttctcccagtgccaccgcaagagctgcgcgcggtgccagcgcatgtggcagctgctccgcctccactccgcgctctgcgaccgtaccgaccgctgcaacaccccgctctgcatgaggtttaagcagcaggagcaggataaggcggctgccaagggcggcgatgatggcgacaaatgggggcttctggtgaagaaggtgaagactgccagggtcttctcttctctggccaacaggaagcagatgagcaccaccaccacccagtgctgaggagcagcctgggatgcttaggggtcaaagttagattagtgagagagaatgaagcgagcagtttttttttgggtctgttttgagatgtcagatctcttttgagatatgtacatgtacatgcctactttgtcaccctacgttggtatagctcttttatcgaggtgggagttggtcagccggaagtctatgtaaaaagtgcgcatgtatcattatataataatagggaaatatgagaagtattttagtctt

SEQ ID NO: 11717 - DNA, 1345 bp, Zea mays
cattatccacattctttccagctagctcctgagattacttgcaaaacattcttgttgtttgctctagctagctgctgcaccatatatagaactatcgatctgagccattatattgttggcatttgtgctcgatcgacgtcgtcgtcgtcgtcccatggcgactaataagccttttgcagttaataagctgctgccagttgtggccctcctgctcctcctcgcagcatgtagctcaccggtggtggtggctcagctggtcgccggctactacagcaaaacatgcccggacgtcgaggagatcgtccgcgacgagatggagaagatcatctcggctgcacccagccttgctggcccgctcctcaggctgcatttccacgactgcttcgtcaggggctgtgacgcctctgtgctgctcaactctacggagggcaacctggcggagagggacgcgaagccgaacaagagcctccggggattcggttccgtggagagggtgaaggccaggctggaggccgcctgccccggcaccgtttcctgcgcggacgtcctcaccctcatggcccgcgacgccgtcgtgcttgccaaggggccattctggccagtcgcgctggggaggagagacggccgtgcgtccagcgccacggaggcggccgaccatctgcctccagcttacggagacgtgcccctgctcaccaggatcttctcttccaagggcctcgccgtcaaggacctcgccgtcctctccggcgcccacacgctaggcacggcgcactgcccctcctacgccgaccgcttctacaacttcagcagcgcctacgactcggacccgtccctcgacaccgcgtacgccgaccggctcaggtcgcgctgcaagagcgtccaccacgacgacaaggcactgctgtccgagatggatcccggcagctacaagaccttcgacaccagctactaccgccacgtcgccaagcgccgggggctcttccagtccgacgccgcgctcctcgccgacgccaccactagggagtacgtcccccgtattgccaccggcaagtttgacgacgtgttcttcaaggacttcgccgagtccatgaccaagatggccaacgtccccgtgctcaccggtgccgagggggagatcaggaagaaatgctacatcgtcaactaaagtatatatgtattatcagctagtagctaaatcattgttgttttaatgagtttaaccccgccccctagatgatagggcgtgtgtctgcttgttattaatcaatgtaatgtatgtactcctattttgctgtaaattcattcttatcaatatgatcgtggcaatggtggcaaataaactcat

SEQ ID NO: 11718 - DNA, 1865 bp, Zea mays
cagtacccagtccagacccggctccagctggcgggtataaataagtgaactccatcagcaggaaaaggaacgcaggaagctgcttcctcgttcgattttaaaatggctccccctccatcactggcagcctgtacggctgaccgaaaatgcgcaatcggttctgatatgaacagcaaatcgtattcaaatgttcaactattaattaaacaatgcgcaagacgctcacattgacatttagcacaggcgtggcatgccaccaccctataaaatgcgtgtcatctatcgcccaggcagacaccagtcgcgatctagaccccgggaagcacacacatcactgatcgagaacttactacatagtacaccaagaaagcaagcgacgacgacgtctgggaacgacgaagccgaagccggagagctatactatacctgtcatccaaccagccagccagccaagccatcatatcatggtgaagacggcggcgagcagcagcagcgacgacgccgccgccgccaagaggaggacgtacaagggcgtgcggatgcggagctggggctcgtgggtgtcggaggtgcgagcgcccggccagaagacgcggatatggctcggctcccacgccaccgccgaggccgcggcgcgcgcgcacgacgccgcgctgctctgcctccggggctcggcggccgacctcaacttcccgctccgcctcccgttcgacctgccccccgcggccaccatgtcgcccaaagccatccagcgcgtggccgccgccgccgccagcgcctcctcctcctcctcctgcggcggtggcggcggcttgcgcgcgccgccgcccttcgcgccacgcgccgagaacaacggcaccagtgcctgcagcgacggcgacggcgacgccaccccggcgtcgagcaccaccagctcgcccaccagccacgccgacgacgtctcctccccggactccaccgtcagcagcgccggcgacgtcgactactacacctcgctcgcggacatcgacgccttcttccagtcgcccaagtgcgtggtggactacgccctcatggacccctgcagcgccttcttcgcgccggactcgacggcggccgacgacgacggcggctgctgctgggcctcgcaggaggacggcggcggcattgcgctctggagcttctccgctacactggactgctgaagtgtgggcgtcaggggaagcggaagcgattcgagtcagtcactgactatagtcgccgatcgatcaagtgacagaattccatatatatatatacacgtgataattattcaattcccggagaaagcaacattcgtaataagctaatttaattaagcatcgtaggaggagctctcgtacgtggagctacatgttttaaggtggcttccatggagttaacctctttactgttgcttgattatgagtacaaaaaaatcaactttattgccattataattgcagaaagaaactattctattccctttttgttaggacaaaaaaaaaacataatagaagccccatataccactaacgagttcatgcgcctgaacgttgttgatctcgaacgacccttcgtcttgtatgaactccatcacctccctgtcagaaatatagtggtatggtatgtaaaatgaatctaacatttctctgctgctcacaccctgctaatcagaaatatatcgtgtgttatttttttttctgccaataatacaatgggtgtaggtgtacttcactcaatcgcattgcagctaccggcaggctggagtgccagagatttggtccatgcttgatgtacttcactcaatcggattacaaaactaactaattcacttttttttctaaatctggacataataatattgt

SEQ ID NO: 11719 - DNA, 565 bp, Zea mays
cccgaccgggatacaaacctcgtcccttcggtgtggaaagaaccctcgcctgtcgttggcggcgcgcgaggcagctgcagcgagcttcgagacggaggcgctccggcagctgcagcgggcttcgagacaggcgctccggcagctatggcgacgtagacggggccgctccgggcaggtacggtacaaaggcgactacgacacggtctggcggtggcttcttcacctgctgaccagcgtctcgtggatcccttcggtggctacttctcgccgatcgttggtaagatgatggctagatgtggctggagttgctagagagatgagaaggtctagacgagttggacaacgatctttaatgtatagatgatgaaatgccaaattgtaaccggttttggtgcatgccaaactgtaaccggttctgcacgttctgatgcatgtcaaattgtgtatggctagtggttctggtgcatgttaaactgtacacgttctgtttatattctaaacgttctggtgcatcttaaactctacaagttactgttaaaataaaattattctgttgacctcttgt

SEQ ID NO: 11720 - DNA, 1923 bp, Zea mays
aggccggacactacagaccccgcccccaacctcggtcttttccagtcccagccgccaccgtgcgtctgtgcaagtggccttcggcggtgcgcagagcagagctggtgccgtggcccgtggtggtggcccgtggtgcgcgcttccctgcagcctcgaggtctgcacgccgccggcctccctcgtagcaccacgcgccgccggcctccctcgctcactaccggacttcgcacacgccggcgcggcggcggccgaccatcctcggaggtgcagttacgcgcgccgtaggaaggtttttcttccatcatttgtgcgttcgttcaactgagccgccatgcgccagccacggtccgggccggggaagaggcggggccgcggtccgcgcatccccgcggcgacgcttcagaagcagaaaacggcgttggcgaacgtcgaccagatcaccggcgccaagattccgaagagcttcgtattctcccgcggtaaactcccctccacgctccgccatcttcagcaggacctccgcaaggtcatgctcccctacactgctctcaatctcaaggagaagaaacgaaataacctcaaggattttgtcaatgttgccggcccgatgggtgtgacacatttcttaatcctctcaaaccctcaaagcctgccacatttgcgctttgccaaatcaccgcagggcccaacattcacatttcagatagaggagtactcacttgcggcggacattgcaaactctcagaagcgcccaaggtgcccaccagggatattcaaaaactcaccactggttgtacttggtgggttgacaggtctcggcaaccctttcaggagtttggtcgaatacttccaacatatgttcccttccgttgacccaaccactgtcaagctggcaacatgccaaaggattctgttgttaaaacatgataaagagaaggatgttattgaattccggcattactccatcaagctccagcctgttggggtcagtcgcaggattagaaagctcatgcaaaacaatcaagtgcctgatctaggagaatttgaagatgttagtgagtttgtgaaaaaagctgggtatggatcagaaagtgaagcagacgatgaagcagcaatggtaagcttgccaagtgacattgacaaattaaaccgggcatccagaaaaagcgctgtcagactccaggagattggaccaaggatgactatgcgcctagttaaagttgaagctgggctatgttcaggagatgtcttatacccatggcctgtggaaaaggaagtggtgggaaagaaaggaacagaaactggggaagtagaagggcaagaagacgattctgaggccacagatgagtccgaggatgagatggtgtaggatttcagatgttttggacaggcagacgcaggtgttttgacagtcctggatgtttcatgctgaaaccaacgggccctgtgcccaataacgtggtgcattcatgccaattttgtcactgaaggtgcattgcattcgttgtaacgaagtgtaacattgttttgccgatggttacctcttttgtgttatgacaaatttggaggatagtttttggttcgcagtctaagatttctcattcttgtcggggtttcacaaggatgcacatgatgccctacacaactacaaaggctttgtttggttacgctggtactgatagtgggttggcatgatgatcttcatgttttgagggtttgtttatggctgctatttgtaatttttttctggtggaccctgtattctgtgttctctaaagtaggcagaggggtgctttagggactgtttaggttgctgcattcaccaaaaccggccctgctccactaagataagctcctgaagtgtcatttgaggtgccctacaaggaccttcattttttagaacaaaaaaaaaaaaaaaaaaaa

SEQ ID NO: 11721 - DNA, 989 bp, Zea mays
aatcccactcatccggttcgcacacggcacactacagaccccgcccccaacctcggtctttcccagtcccagccgccaccgtgcgtctgtgcaagtggccttcggcggtgcgcagagcagagctggtgacgtggcccgtggtgcgcgtttccctgcagcctcgaggtctgcacgccgccggcctccctctcagcgccacgcgccgccggcctccgttgctcactaccggacttcgcacacgcccggcggcggccgaccatcctcggaggtgcagttacgcgcgccgtaggaaggtttttcttccatcatttgtgtgttcgttcaactgagccgccatgcgccagccacggtccgggccggggaagaggcggggccgcggtccgcgcatccctgcggcgacgcttcagaagcagaaaacggcgttggcgaacgtcgaccagatcaccggcgccaagattccgaagagcttcgtattctcccgcggtaaactcccctccacgcttcgccatcttcagcaggacctccgcaaggtcatgctcccctacactgctctcaatctcaaggagaagaaacgaaataacctcaaggattttgtcaatgttgccggcccgatgggtgtgacacatttcttaatcctctcaaaccctcaaagcctgccacatttgcgctttgccaaatcaccgcagggcccaacattcacatttcagatagaggagtactcacttgcggcggacattgcaaactctcagaagcgcccaaggtgcccaccagggatattcaaaaactcaccactggttgtacttggtgggttgacaggtctcggcaacccttttcaggagtttgggtcgaatacttccaacatatggttcccttccgttgacccaaccactgtcaagctggcaacatgccaaaggattctgttgttaaaacatgataaagagaaggataatattgaattcctgtttaaacacaatagaatgggaacgtga

SEQ ID NO: 11722 - DNA, 4613 bp, Zea mays
ccagcactctcccagatatattgacatgctgaggaagaacgatggcatttacgtgccgcgaagttgcccgaggggttcccgctaggcactgggcagataggccggattaggcaaggcaataacagctgcaagcgcgagtacgcaaaaccgccataaacacgagaccaaaaggtggcacggtggtcctgagatttgccttttacacaaagcaacacacacacacacaattactcaccccacaccacacacacgcacacgtaatcaccaatgaaatagatagatgtactacgcgcgcctatcgccatgtccctcctagctgtggcgtggcatgtgtctcgacgactcgccgccgatctccccgtcctacggttgggctgggggcgcatgcatggctggcgtacggcgagcagcaccggaaacgacccatcacacagtacgcgctgcgcactgtgctgccactggctcactgtgtgggaataactacgcgcgtactggcagtacttggtgcgctcgccaggcgtcgatcgcagccggcgcgacatggcggtggtaggcggtagctgatctacggaagcgcccggacggccggtgtccccgccggcacggaggaggcccctttttttccccctgcctgccacgggggcaaagcatgtgatcccttcccttccgtcgttcccccgatcggacgcgaaagaatcagctgggtacaataaacacgccgatcccgatcccgtacccgcggccgcggccacggcacgctcccgggtcccgagccctcgaccggacccgacccgacccgaccgccgcatttaccctcggcaactgcgccgtaccacggtgcccgcgtaccaaaccggcgcgcgcgtatgccacacaccattcatgggtcctgggtcctgagtctcctgacccgcgcagcgaggcggccgctgcattgcatcgcggcgcggctccacccgcacgcgcacccgcagtcgtgcgggcatggacctggactctggctgtaataaccacaagtggccctggcgtccgcctaacccagcctgtaaagatctctcgtcgcctcgctcgcgcagacgcaggcaccaccagccacgcacgcgcacccacccgcagacggatcgggcacggccagagccaatgagccagaaccagagccaggcaaccagcccacacccgctgctccccaccggcccaccccactccactccgctccactaaccaacgcccagggtttttaataatcccgccacaacccaaccactccgaccgcttttcccccgcgcgtttcaaaatcagcgaggccgcgagggcagcggtaacaccgtgggattaatcatcaatcaaccaggcaggtactcgtaagctgatgggggtaaagcagggggattagtgaggacctcgtttgaagccgggtataaaagccgcgaggctagcaaaggcgacctcgcgaggaaaaactaccggggccgccaccgccacagccccgccccgccccgcccccgcctcccgagctgagcgagcgactcagcaagcgcgcaacggaaccagccgccgcggcgcgccatggcgccgttccagatgcgtttcgggctccagatctctcccgcgcgctccgacgacgacgaggaggaggacgacgacgacgacaacgaggaggagtatgacgagatggcgagcgaggggacggcctcgccgccgatgatgctccggccagggaggggagggggagggctggtgagcgccgtcgtgggcgcgctgcggaggtcgctggtgatgtgcagcgctggcgccgtggatatcgacgacgacgacgacgaggaggagggcgggatcgagatcgggcggcccacggacgtgcaccacgtctcgcacgtcaccttcgaccgctttggtggcttcctcggcctccccgcggacctcgaacccgaagtgccgcggcgcacgccgagtgccaggtgagctcgccagtcgccgctgccgctgccgtgcgggtgattacgcttcgattttcgcttcagctgtaactttgtgtgccttagtttttcccgactgcttccgtgacggaactgtagctttctgatgaagtgcccgttgtccacaaagacgctacgcgaaaaaatgggcgtgttcctaaattcagttctacaagtttaggcgcacactgttttcagcggacgctcctaagcaagctgacgaaagtgagctgtatttttgtttttctctgtgtttagcaatgatacagttctgtaacaaggtggttagctgagggttccgaattaattagtagtaactggacaagttgatctcgtggagagagagagacgagaggcagtacttttaaagtactacgagttgttgctttctgtatcaggaagtacagatgggaatttagttatcttggattgtttactttctgcacctggcatagaagagattctgaatatctattctgagggcatatagttctgaagataaatgcgtgcttatcaaaaaaattatataggatattcttacatggctaatggtatattcagcccaaatgaattttgtcgccaaacttgatttgcccatgtgcttgagcttgaaacaacaaggctgtttgaggtggttggcaacatgggctacagaatcttctaacctatcttttattttggggtatgttcatttgtacttggatcaaatatggtctctgttgtttttgtctttttccatttaccaaatgggttcgcacggtacttttaggttgttggaataagatcaggatcttcttacctatatagacagtttccttcttgtgtttgcttttacattctatctctttgctagtagtggttgctgatgcagtctttagctgttatggtggtctgaaagtatatgccataaggccttaaacatgatgcgtaagtgtaagtctaagttcactatttgtgctagtttctaactttttccaggtcaaattctacatgcagtgtaagcgtatttggggtttcacctacctctctgcaatgttcatatgatccaagaggaaacagtgtgcccacaatattgctaatgatgcagaggaagttatatgatcgcggaggacttaaggtatacccggccgagctctcatagttagaattagaattttagtattcaatcctgtgctgacacttatacatgctcacttttgtcttaggttgaagggatctttaggattaatgctagaaaatagccaggaagtctatgtgagggaccaattaaacagtggagtggttccaaatgaagttgacttgcactgccttgccgggttgataaaggtattttgaactctccaatttaccatttgtcttccatgtgatttctttatttgacttccagttgagaaacaattgaaaatgacagcaaaagatgcagagttgcagataacacctcaagtgttttgaaatatcaaacagttagttgttggaataattaacatgtagttatttgaaggaagtatttttgaagtgggttgttaggtacccacgtgcacatattttttttggggtactccgttccatgatctccgtggtgcctttttgtaggcatggtttcgggagcttccttcaggtgtattggatgcactgacaccagaacaagtgatgcactgcaacacggaaggggggtgcgctctccttgcttctatgctaccaccagtggaagcagcattacttgactgggcaattaatctgatggccgatgttgtagagcaagaaaactacaacaagatgaacgcccggaacatcgcgatggtttttgcgcccaatatgactcaggttaactgacacgcgtcttactatgtcttcagattatacaaggttcatattatacctacacatacgctaatcctggtgcatttctcttccagatggccgatccgttaactgccctgatacatgcggttcaggtgatgaatttcctcaagaccttaatcttgaagactctcaaggaacgaaacaaaaaggatgcggcacttcaggcgttgcaaccatgctccagctctccaaatgaccaagacgaacatcaggtgtccgagcatttggagaaaccttcagttctgccaaatcaaaaaggcttcggtttccacatgaatgatagtgccactcctgttcaagtccttggagctgagaaaactctccatcatcactcacaaatccgttctcacgagccaaaaaagtttggaaccgatatggaccacaagaaaagacagagtgatgcctcctctctcctcggcagcgattcgagcaaccgattcaacagttctgggagagaattcggtagcagaaatggcgcgtccgacagatttagttttaggaaaggggtggagaggctttgcaggcatcccgtgtttcagttgaataggtccatgaagaagtctgcagatgccgtggtcttcgatgccccccgagaagcaagacaggcttgggtgtgatacaataacgacattgtatgtattatgtagttctgtttccacctgtgtttcagctgataaaaaaaaacaaaaaagccgcgcgcgcgcgatcggctagcctgttaggtgttacaaaatcgaggttatttggagtgtacattatcgcagtttacttttc

SEQ ID NO: 11723 - DNA, 1289 bp, Zea mays
  misc_feature (4)..(4): n is a, c, g, or t
cggncgcgtgggattgctaatgatgcaggaggaagttatatgatcgcggaggacttaaggttgaagggatctttaggattaatgcagaaaatagccaggaagtctatgtgagggaccaattaaacagtggagtggttccaaatgaagttgacttgcactgccttgccgggttgataaaggcatggtttcgggagcttccttcaggtgtattggatgcactgacaccagaacaagtaatgcactgcaacacggaaggggggtgcgctctccttgcttctatgctaccaccagtggaagcagcattacttgactgggccattaatctgatggccgatgttgtagagcaagaaaactacaacaagatgaacgcccggaacatcgcgatggtttttgcgcccaatatgactcagatggccgatccgttaactgccctgatacatgcggttcaggtgatgaatttcctcaagaccttaatcttgaagactctaaaggaacgaaacaaaaaggatgcggcacttcaggcgttgcaaccatgctccagctctccgaatgaccaagacgaacatcaggtgtccgagcatttggagaaaccttcagttctgccaagtcaaaaaggcttcggtttccccatgaatgatagtgccactcctgttcaagtccttggagctgagaaaactctccatcatcactcacaaatccgttctcacgagccaaaaaggtttggaaccgatatggaccacaagaaaagacagagtgatgcctcctctctcctcggcagcgattcgagcaaccgattcaacagttctgggagagaattcggtagcagaaatggcgcgtccgacagatttagttttaggaaaggggtggagaggctttgcaggcatcccgtgtttcagttgaataggtccatgaagaagtctgcagatgccgtggtcttcgatgccccccgagaagcaagacaggcttgggtgtgatacaataacgacattgtatgtattatgtagttctgtttccacctgtgtttcagctgataagccgttcccactagtctgtgtgagtagaatcggttagcctcttaggtgttacaaaatccaggttatttggagtgtacattatcgcagtttactcttctccgacgaaagtgtcaggagaagtacacactgtacactagcacgtgtcttgtgcggaacgaacgaaagcgagagtgaactcaggctccatggctgcgcgctgcatacctcaagcgttagtgaccccttgatattataaccttgctgatattttgtaac

SEQ ID NO: 11724 - DNA, 968 bp, Zea mays
ccccccggccggccggggcctcccttgcgccacagcaccacttgctcctgcctcctgctgcttcttcccgagttcccgtgccgccgcgagcgctcccaaccaagcaacgagacaacaacaacaaccctgcaccgccgcagcacttgcgccgtccggtcctgtcctcccgcggtctcgacgccgtcccctaccgtcctaccttatcgcgcaccgctccatggccgccaagtgggcccagaagaccgtcgttatcccggcgcatcggcggggctgccacctcatcacccccaagattctgagggagatcgagggcgacctggccgggttcaagtgcggtctcgcgcatttcttccttcagcacacaagcgcatcgctgaccatcaacgagaactatgactctgatgtgcaggctgacactgagacttttcttaacagaattgttccagagggccacaatgctccttggaaacacactatggaaggacctgatgacatgccagcacatattaaatcttctatgtttggttgttccctaacgattcctataactgatggacgtctcaatacgggcacttggcagggcatatggctgtgcgaacatcgagaccatgccagccctcgcaaaattgtgattactctcaacggtgtttaacttgaagatcttatatgctgccaggaaatagggccaatgcattttggacctgaatgtgtttcagttaccatgtactatgttgagttgtaatgtatgctataaattccaataaattcatcgttactatttcgtatgtgattattggcttagccccttaggtgaccgttgaacttatcttttgaacactacgctttgcagtatttcatagaaattggtgaatgtacaaacaggaaaattgtcatatgctttctataataagagggcagttataaaataagtcttaacaaaaaaaaaaaaaaaaaagccacctagggcc

SEQ ID NO: 11725 - DNA, 3068 bp, Zea mays
aattcggcacgagggagagagagagaggagacccctccccctccccctgcccctcctcgtcctcggaccttcccccctcgtcgacacctaccctcaccgcatccgcggtcgcaatggcgctagcctcccaaggcatcaccctgcgttccccgccagcggggtccgggggccacagcgggaggcggtcctcttccgtgcccgccgccgcggccccgcgcggctgggggcagccccacgcggggcaagccttatccatctcgcccgccaggtacgaaccagccgctcgtccaccatggcgaggctccctcgctgccgccatacgtgccgctgcctcggccggtgcgcaccacggcagcgacccggtccctgccgagcccagaatcgagctccccgcgatatttaccgtcttctccgaggccgctaagaccggcgctgccttcttcatcgcctcgtcgagcgcggccttcctcctcggctcgtttggggggttcggaggcggcgctgggggtctcttcggcggcggtggtgggagggggtggatggggcgcggggggtgctcgtgccgggggcggagggggtggagacttctggtcctggctgttctccgccggtgcggcgaacgcggacgacaagtcatcgggggattgggacgcgcacgggctccccgtcaacatgacggtgccgctcacgaagctgagcgggctgaagaggtacaagctgtctgagctcaagttctttgaccgggcagctgccggcggtggcgcctacacggggccagaggattccttcttcgaaatggtcacactgcagcctggtggcgtgtacaccaagtcgcagctgttgaaggagcttgaaacactcgtttcctgtggcatgttcgagcgggttgatctggaggtgaagcccaagccagataacacaattgggctcacagtctcctttgtggagagtgtgtggagtgctgcaaagcagttcaagtgcatcaatgtggggcttatgtcacagtcagggcaggttgacttcgaccaggacatgacagagagggagaaaatggattacctccgcaagcaggaacgcgattaccagcagcgtgtaaggggtgccaagccctgcatcttgccagaaaatgtacgtggagaggtgctgggaatgatgaagaagcaggagaaggtgagcgccaggatgctgcagaagatcagggaccatgtccagaaatggtaccacaacgagggtttcgtatgcgcacaggttgttaactttggaaaccttaacaccaatgaggttgtctgtgaggtggttgagggtgacatcaccaaggtggagtaccagttccaggataagcttggaaatattgttgagggaaatacccagcttcagatcatagaccgtgagctgccccaacagcttcgacctggccacatctttaacattggagcagggaaacaggctctgaagaatataaattcacttgctttgttttcaaatatagaagttaatccacgtcctgatgagacaaaggaagggggcatagtagttgaaattaagcttaaggaactggaacccaagtcagctgaagtaagcacagaatggagtattgtacctgggcgtgaaggccggccaactttggcatccatacaacctggaggaactgtgtcatttgagcaccggaacatctatggtctaaatagatctattgttggttctgtcacttccagcaacctgctgaaccctcaggatgatctttcattcaagcttgagtatgttcatccttatttggatggtgtggatgatcgtagtaaaaaccgtacatttaaaactagctgcttcaacaccaggaagttgagtcctgtctttgttgctggtcccaacatggatgaggctccacctgtttggatcgatagagttggatttaaagccaacataactgagagcttcacacggcaaagcaaattcacatatggcctcgtggttgaagagattacaacacgtgatgaaactaatactatctgtacccatggttcacgagcaatgcctagcggcggtttgagcatggacggacctcccacaacactcagtggtactggagttgaccggatggcattccttcaggctaatataacccgtgacaatactgagtttgtgaatggtgcaattgttggagacagatacattttccagctagaccaaggtcttggcatcgggagcaaaaacccattcttcaaccgtcatcaactgactctgaccaagttcatcaatttaaataagcaagagaaaggtgctggcaagccactaccagctgttttggttcttcatagtcattatgctggttgtgtgggtgatttgccaagctatgatgcatttgcacttggagggccttactctgttaggggctttagtaatggtgaactgggcgcttctaggaatattcttgagcttgctactgagttgcgtgtccctataagaaacacccacgtgtatgcatttgctgaacatgggactgaccttggaagttccaaggacgtgaaaggaaaccctacggagtttttcaggcgcgtaggtcatggatcttcatatggcgttggcgtcaagcttgggttggtaaggggagagtacatcgtagatcacaatgctggtactgggaccgtttttttcagatttggtgagagattttgagtatgctgcctcccgttaccgtggaaggcaggcttctgaggtactttgtttagcgatgtttgtggtctgataggactcaaacggcattggagctctgctgaaataatgaagctattttctgaggaagagtgatagctagtgtgagattaaattttcttcatgtaggatgtaagatctgttctttcagagctgggagctcataaatagatgaatgttcagaaacgttgtcccaatttttaccgtcagttgtgtttgtgcttctgacaaattgtccatttcgttttgcccggaaccttttgtcaattgcttatctacagttttgtttcattttcagaatatgtaaaaaaaaaaaaaaaaaaaaaaaaaaaaaaactcgaggggagggcccgggtacc
